United States Patent 9,328,346 (POLYCOMB-ASSOCIATED NON-CODING RNAS) - sequence listing, part 118

SEQ ID NO: 191092 - RNA, 31947 nt, Homo sapiens
uacuuuaaauugggaauuuaauauuuuucaaucaccaaaaauucauuugcaugaaucauuugugguauaccagaauaagaaaauacacaugauacagaguuauggaaccaauagauagucaugauauaguugauagaaacaucaagacaaagcaauuauguacagauagagacaaggguugaggaaagaguaaaggugcauagaaaucugugcuguuaaauaaaguagcuauagaaaacaguauaacugaucacuaguaauagauaacuaacggccaaaaauaauaucaacuuuaaauuagauaaauuuuauuauuuuuaaaguaaucauuuuauuuaaucuauugaaaacugauaaacuauuagauuaugaauuuuugguaaaacguuagaagacaagguuagagaaauaaccuaucauaugguuguauaguguaauuuacauauuuuagcauaaauauaacauuauuuuaaaguauaucuaggguuauuuuuaauguuuuauacuuuuauauucucuauaaaauaaccuauaguuaagaaaacauaccauucucugaaagcaaaauaaaacaaagcuuucuuuaaucugaaacuaaagaugagcuuuccauuucuugucaggaucuguguugcuaacuguaaaaagaaaaucagagaguaaaaauuuaacaauagauaaguaaaugcacugaauuuuaaguuaccuuguggcuagaaaaagcauucauucuuaaaauaauuuuguugcucaauauaaaguuggguauuuuugguacauguaaaaacauugcuaaggcuucuacaucaaauucaagcuuagaauucuggauuuuaaggauuacauuucuauaaagauuauuaguuugacaaacuaacacuagaaaauaauuacauaauuacugcuuugacaucucuaaguuuacuaccuuuaccacuguuuaaaaccuuuggcuguucccaaaucuaccacaugugaaauucuucgugguuuuugggucugggagaagaaaaguuaucuuccugcuacaugucuuugauugccauucugguggguaaggauuggaauuccaacugagauucuaauuccccugggagcuuuugguuccagcuugugguccacuggcccugugcuacugaccuuccuagcgccugucucuccaacuuaaagugauauucaugggagaacucugauggguauuauuuuuccucaaaggaaacuaaggcaucuguaaaaauauuuuaaaugcugguaauagaagaaaauuuggaagcauacucacauauuuuuccuucuuuuucuaguuuuuucaaaugaaguaagagauuauguuuagccauuucauguaaauucucaggaguauucuaaaagaaaaaugaaggugaaaaaaauuccuuuuuuuuuaaaaaaaagaacacaguuaauuuuuugaaagcuuugaagaaaagcaaaauguagcaaaaguuuaucuuaaacacauuuuuuuuuuuuuuugagacagagucucacucugucgccaggcuggaaugcaguggugcaucucggcucacugcaaccuccgccucccagguucaagcaauucuccugccucagccucccgaguagcugggacuacaggcgagcaccaccacgcccagcuaauuuuuguacuuuuaguagagacgggguuucaccauguuggucagaauggucucgaucucuugaccuugugauccaccugccucggccucccaaagugcugggauuacagacgugagccacugcgccuggccuaucuuaaacacauuuuuaacuuguuugacauuuuuaacaauuucacuuuguauacaucuuguuuuauauucuauauauacuccuauagauagaauagguuguaagcuccauaaagacaguagcaguaucuuuuuuuuugagacagaguuucacucuugucaccuaggcuggagugcaauggcgcgaucucggcucacugcaaccuccaccucccagguucaaacuauucucgugccucagccucccgaguagcuaggauuacaggcgugugccaccaugccucgcuaauuuuuguauuuuuaguagagaugggguuucaccauguuggccagacuggucucgaacuccugaccucgggugauccgcccgccucggccucccaaagugcugggauuacaggcgugagccaccaugcccggccuggcagcaguaucuguuuuguucauuacugaauauucaguguuuagcauaauaauacauagcagaaacacauuaauauuuuaugaaugaauaaauguaaaauuauucuuagaaaguuuucaugaugcuacagacaguuggcccuguaauuuauuuauuagguuacaggguaauaucuuuguauauuuuaauuuaaauuuaauuuuuuuaaaaaaguuuuugggccgggcgcagugacucaugccuguaaucccagcacuuugggaggcugaggcggguggaucaccugaggucgggaguucgagaccagucugaccaacauugagaaacaccaucucuacuaaaaauacaaaauuagcuggguaugguggcacaugccuguaaucccagcuacucgggaggcugaggcaggagaaucgcgugaacccaggaggcagagguuguggugagccaagauggcgccacugcacuccagccugggcaacaagagcaaaacuccaucucaaaaaaaaaaguuuuugagauacagucuugcacugucaccuaggcuggugugcaacggugcgauguaggcucacugcagccuugacuucccaggcucaugugauccucccaucucaaccacccgagcagcugggaucacaggcauguuccaugacaccuggcucauuuaaaaaauuucuuguagagaugaggucucacuauguugcccaagcuugucucggacuccugggcugaagcaaaccucccacuuagccucccaaaauacugggauuacaggggugagccaccacgccuggccacaaaagcuuacauuuuuaaccucuaagcuaugcugccuacacagcagacaucuaauaaacauuugcugaaaaacugaauuauacugacugcuauauagugcugucaauacagugauauucucagaggccagugagguguaaggcucuuucccuacauacuauuuuacucauguucuuugauuuuuuuuuucuuuuucuccauuguuuggcauugcuacuacuucucacugcuuugcuacuacuucucacuguuaacauuccaauauuugugucuagcaggucaccccuccucucuuggugcaggcugggacacaagauaaucaagauggcuagaauaaugcaaaaauuauuacaaaauguaaucaucaggcuguugguaguuucuccuacauaguuaggcaguuucuccuacauaguuaaguauauaaaguucaaugauggcucgaaauggcuaucuuuguucucuaaggccaguuuuuguuuaauuuuagcacuguagaaaguuuaggcugcuggucucaaaucuagaaaaguggcguaacuucugaucugggauauaaguuuaucauuucuauagucuacuaaauagauaauucuaauaaauuuguggcuacauacaaauaagaaaacugaaaauuaccuuguaaauaauuuuuacaagcuccauuacuguaaaugauuucucaaaguucucacgaaauaauguaagaauuugcugcucucgaauauuucugugagaaauguauuguugaauuuuagcuucagcauuaugaauuacugggccauguccugaauuaaaauaauuauaagaguuacuucagucagauaaaaaaauacuaaguacaacagaagcuaacucacucuauuuaaaaauaauucauaugauauauugaaaaagcauacuaaaugucaaauaugaacuauuuggaaagcuauacaggugaaagagauuuaaaaauuauauacaauaccccccaauuagaaaauuauagcaaauacaaucuauagaaaauauuguguacauuaaaaauauggaauagaaauuuaacaauaaaacacagcaauaaaaauagcaacuacaauaauaacaauagguaauguuuauggagugcucacuaugugcuaggcacugcccuaaaugcuuaacauacauuauucuuacaagaaucccaugaaguagguacaauuauuacacauuucuuaugguagaaacugagacauacggaggguaaauaauccguccacaguuacauagcuaagaagggguggaguuaggauucugacaggaucucuuaaccacucugugcucuugaccauuaggcuaagcuuauaaaauacugcaaaaggacaauguaaaaagcaguuucauguacaugaccaagcucuauuaaaaauucacaagacccacaguaaaacuuuaagaauccuauguauaggcuucuguaugucagaaauuuugacaacccagauuaaguuauacuauaauuuacuuccccuuuaagacaguacacauuaauauuauauauuauauaagucugcaagaaugauguucuuaaauauuugagaacaaaauauccagaagcaggcuaaccuauuacgggaucugguuagacacagaccuaucauuuauuugcuguguggcuaauaaaugaggaaguaucugaaucucucuaagcuguuucuucugcuguguggugaggaaaccacuaccuacuuuacauggguuuuggugaggaugacaacuguaaaggccccugcacaaaaccugauggcuagaagacuuuaauauaugguagcuauggcuacagagcauaauuuacauauaaacaacugcugugcuaguaagccaguucacuggauucacuaaagcacucuagaaucuuuacuagguagccucucauuagcuuagcuugaaugugaauucacucaacgucugcccucuucgcuuuaaaaauagcugucuuuagcaaaaacaaagcaaaacaaacaaacaaacccccccaaagcuaucagcccgcaauccuuuaaugucaucauauaaaucuaaaugcccagcucuaccguauguuuucuauucccccagcaguaggaacucaucgcagaguguaaauguguugaagauacuggauggacggaucuuucaauggcuugguuaaucgcaaguuagaagaacuuaggaaguuaagugaccuagucccuuuuuccuuuugggccuuuuuauuggguccugugucuuucuuagcuuuuuuuuuuuuuuuuugagaaggagucucacucuguugcgugaucucugcucacuacaaccucugccucccagguucaagugauuuuccugccucagccucuugagaagcugggauuacaggugcccaccaagacgcuuggcuaauuuuuguauuuuuaguagggaugggguuuugccauauuggccaggcuggucuugaaguccugaccucaggugaucugccugccuuggccucccaaagagcugggauuacaggcgugagccacugcgccuggccauuucuuagcucuucagaugaaggagagauugauauuguagaacagucuagugagaucugagacacuaacauguuucuuuuucuggagaauggaaauaaagauaccauuuuauaguugauauagaagcuauugguauuucaauauuguaaauuaaaaaaacuaaagcucagaggucaaacauuacccaaaguuacacagcuaaaaugugguccaaauaaaaaucaaguuaacaaaaauaacagugguuuauggaaugaaaacauuuucccauuucaauguaaguuuaugucuuuuuaacaguucuauuaauaacuguauguugaaaaauaacccucauaucuuuaucaaaaguuauuaauauggcucuuggccuucucuuuaaguuuaacugcacagcuagacaggacuuagggguguauuuuccuuuuuuuuuuuuuuuuuuuuuuuuuuuuuuuuugagacagaguuucgcucuguugcccaggcuggaguacaauggcggaucuuggcucacuacaaccuccaccucucagguucaagcaacucuccugccucagccucccgcguagcugggauuauagguaccugccaccacgccuggguaauuuuuguauuauuaguagagacaggguuucaccauguuggccaggcugaucucgaacuccugaccucaggugaucugcccaccuaggccucucaaagagggguauauuuuaaagaaguaguugauauguuuuuuuuuucccccagacagagucuugcuucugucacccaggcuggcaugcaguggugcaaucucugcugacugcaacuuccaccucccagguucaagcgauucuccugucucagccucccaaguagcugggauuacaagugugcgccaccacacucagcuaauuuuuuuauuuuuaguagagaugggguuucaccauguuggccaggcuggucuugaacuccugaccucaugaucugcccaccuuggcaucccaaagugcugggauuacaggugugagccacugagccuggccuuauauguuaucucuucaaggccaaauacauacagagacaagccaaaaugaaccuuccucaucauuugacacaaaugguuugcuagguuugaaaaacuacccacuuuggcaugccuguauacccagcgcuuugggagguugaggugggaggacugcuugaggucaggaguuugagaacagccuggaaaacauagcaagaccuugucucuauuuaaaaacauaaaaauauaaaaaaauuuaaaaauuacccaccuggauauauaauaucagcuuugauuuucaauaacucuuuuaaagaguucauauaaucauagaggucuucaaauaccguuguuccuuccccuaggaugcaaucuccagaaaagauagcauuuuccucuucuaagaguagagccaugugaucaucaguguggccagggguauauagaacucugguugaaagaagaaauaaggaauaauaacaauuaugaacucgagcuuagaagaaauuuugagaaguaaauuauucuguauccuuaucuuuagacacaaauaaacagaugaguuaaaaagcugcuuuuucuuuucuugaacccacugaaaauuaucauuagaaaauucucuccuuuaacuaaaccaagauucucacucugaaguaaaauuuaauacuuuucccacccuuuuucuuuucuuuuuuugagacagggucucacucuguugcccaggcugcagugcagaggcaggaucacaggucacugcaggcucaaucuucugggcccaagugacccucccaccucagccuccugaguagcuggaaccacaggugugggccaccaagccuggcuaauuuauuuuuauuuuuauuuuuuguagagacaggaucucacaauauugaccaggcuggucuugaacucuuagacucaagcaauccuaccaccucggccucccaaagugcugggauuacaggcauuagccaccucaucuggccuccuaccauuuuucuuacuuuauaaauaauaagcacugauuauaacaaauuuggaaaauagaaaaguaaaguguuuaaaagaaaugaacaucaacaaucauuucuauuccucagagggagagcuuuuauuauuacagaauauauacuuuuugauuuucuaugcauauuuauauauuuuaaaaacaaaacugauauuguuuuaauaccugauuuuugaaaucuuaacuuacuauauuguauuuuccuacaucauuauauguuuacaucauuuuauauauauauauacacacacacacacauauacacauauauacauauauguuuauuuauuuuugagauauaucaaggucuuguuauguuuuccaagcuguucucacccaggcugaagcgugguggcauguuccuggcucacugcagccucaaccuccugggcucaagcaauucuccaacuucagccucccgacuaguugggagcacagguaugugccaccacgcuuggcuaauuuauuuuuauuuuuuuguaaagacaaggucucuuuauguugccuaggcuggcaucaguauauacuuuucaaagacaaguauuuaagugcuuagcauagcagauggcacaaaauugcaugcuuaauaaaugguaaauuuauuuuaguaguuauuaucuaaaagcuuaaaagaaacuuucuuaacaugcagaagguggucagaaaaagacucuuuuuuuuuuuuaaauuauacuuuaaguuuuaggguacaugugcacaacgugcagguuaguuacguauguauacaugcgccauguuggugugcugcacccaguaacucgucauuuaacauuagguauaucuccaaaugcuaucccucccccuccccccaccccacaauaggccccggugugugauguuccccuuccuguguccauguguucucacuguucaauucccaccuaugagugagaacaugugguguuugguguuuuguccuugcgauaguuugcugagaaugaugguuuccagcuucauccaugucccuacaaaggacaugaacucaucauuuuuuauggcugcauaguauuccaugguguauaugugccacauuuucuuaauccagucuaucauuguuggacguuuggguugguuccacgucuuugcuauugugaauagugccgugauaaacauacaugugcaugugucuuuauagcagcaugauuuauaauccuuugaguauauacccaguaaugggacugcugggucaaaugguauuucuaguucuagaucccugaggaaucgccacacugacuuccacaaugguugaacuaguuuacagucccagcaacaguguaaaaguguuccuauuucuccacauccucuccagcaccuguuguuuccugacuuuuuaaugaucgccauucuaacuggugugagaugguaucucauugugguuaagagcuucugcacagcaaaagaaacuaccaucagagugaacaggcaaccuacagaaugggagaaaauuuuugcaaucuacucaucugacaaagggcuaauauccagaaucuacaaugaacuccaacaaauuuacaagaaaaaaacaaccccaucaaaagugggcaaaggauaugaacagacacucucaaaagaagacauuuaugcagccaaaagacacaagaaaaaaugcucaucaucacuggccaucagagaaacgcaaaucagaaaaagacucuuuaaucuauuuuuuucucucuaguuaaacauuuuaagacagagccguuuuuuauaaauucuacccuauauaagaaacuuaacaugcauuuauuuccuuuuuccuuuccuccaauuuucaguuuuuguugacaaaacugauuauaauacuuuuaaaguaugacagguauuuuauuucaaaaauucuuauuuacauuuauauuguuuuguaacuaugccaacaauaaaccagauaaacaaaaagcugaguucaaauaaucuguucugcaaagcaccccgacuucucagcaauauacagacuuaauucucuguacuggucacuguugccucuauauucuucuucuacuuugaauuauguguuauucuguaggcuucacauuguuuuguuugcuauucuaccucacaagguuaugaguuccagaagggcaggacucucaucucauuuucauuuuuauacgcucaguacuuggcacuuaguaguaguuaauuuuaguaauagauugcuuuccauguaccaggcagugucuucagggauuuacacaaauuacauuuaauccuuacacuacuuuggguugggcauuauuagccucuccauuuuacauuuuacauaaauaaaucacagcaaauagcaauacaugucugaaggaauaugguuuaaauuauauuuuauuuaguuuaagaggauaauuaccugcuauucuagucaguauugaguuuuuaugugcuuggaauauauauaucucuaucuaucuauauauauaauuuuuuuuuuuuuugagacagggucucgcucugucgcccaggcuggagugcaguggugcaaucuuggcucacugcaaccucugccucccagguucaagcaauucuccugccucagccuccugaguagcugggacuacaggugcccgccaccacaccuggcuaauuuuuguauuuuuaguagagaugggguuucaccauguuggccaggguggucucaaacuccugaccucaagugaucugccugcccuggccucacaaagugcugggauuacaggcaggagccgcuguacccagccauguuugggauauacuuaauaaaucuucccaauaauggaauauuuugugggaauaagguaaaugugaugacauauagaugagugauaagugacuuaccagacaggagaaaauggaagccuaaauaagcagcagggaaagcugagaaccaaucagauuugcacugcagaauuccucaaagucuaaggauuuaggaaaucuggaaguggagggugaaguggaaggaagguggcugaaauaagaagucuguugaaagucuuuuuagcaaacauucagauccucaagagucucuucccacuuugaguugagaagugccccaaucucacuaagggaaacgcuggagguuuaaucuuugaagaggguaaaacagaggcauagaugcaggaagugacaauauacuaaaaaaaaguaagauuacaagaauauauguagauuccuaugccuucuuuccacacucagcuucuauaauucuggcagccaggccuuuacgcuacaugaagauuagaagagucuuuuucuaaguuauuuuaccaucucaggaagaaagacucuacgauaccaauguuggaaaguucccaacugaagagcucauccagauuauccuacagugaggccuaaagccuacggaagacucccccccacauucucagagcucccaaacagcucuguaguuuccaucagaacacaauuaguaaacaucagaagauaaacaggauuacuaggcaucuaaggaaaguuauguugaagacagcgcauaaaaacgaacaagcaaacaaaggggguuaugaagaaaauuuccaaaacaaccaaaccccacagaauauaauauccucagcaaaaaaagaagaaauugcaacuaugaaacaagauuagguuaguauaaaagcaacauuuugggaacaaaaaguuucugaaaauuacaaaucugagaacagaaauaaaaacauguaguaagauuaggcgauaaaguuaauaaaaaucucccagaaaguauaguaaaaaggcaaaaagaugaaaaaugagagagaaaaaaauaaaguuagaguaguacaggaguucuaacaaaauaauaggaauuuuaguaaaugaaacagcacaaaagagaugagagaaaauaagcaccucaagaaaaauuuuuggaacugaaggacauguuucaagacugaaaaagccuaucauggauugacaaagacucgcuuugacuaaaacuauagucaacuccucugaguuuuuuccgaugaugggacucagaacacacuacugccaaaauauggcaccuuugcaugcugagguaggauccuuugaugaggcagugauuccuuugaugaaggaaucacugugaaauuucaggauacaguggaaaagaagggaaaaagcaaaagccagggaccaaagaaguucagcaaucagaagggcuuuagauuucucuauugcaauauugaaaccagaaggaaaugaaaccuugcagacaauacugagaaggaaaaauacuuucaacuuagaaucuauacucauaaauaccuuaaauaaaguuagaugaaaaaaggauacuuucagauaucuaaggucucaaaaauucaccauuucucagaaagcuacuggagauggguuccccuaaaacagaggggguuuuaagaaacuuauggggcacuggagaaaggagauccaacacuggagagaggcaaagggaagccccaggugagagugcagggaauucugagaugacaccagcaucaggcccggaggaaaacaagccgacaggagcaaguuauuagcuggaaggcuuaaaggguagguucuuucagaagauuaaauugagagaauccaugaugcauuuaaacacccuaagggaagauuuauauacucagaguuaaauuagugauaaauacacagaaaacuauccaaaauaacaaagcaaaaacaaugacuaacugcaggaaagcaggaaaaguaaggauaguuuacuacacgguucagcuguaaauagugucuacagucauaacaacaucaccgaaugcugaucuaaccagcauuaugacauugagagguuagaggacaggaauggugcucaaaagugggagaagaggaaaacccaauucuaauuuuuucuuaguggaaaguuaauaucucaaauugaaaaauaagauguaggaaagaaucaaauaguccgcuaagauuuguaacuguuacugccccacuguuuaauuucuuucucccuagacgcaaccacuuucaccuguuagcuaaucauuugugucauuugucuguuuguuccuguacaacaaaacuguaccauuaaagguaauuaugugugucucucuuccuugagaccuugaugagccuagccauaauauguaaauguuuucaaguuuggauuuuagauucuagaagccacaguaauaaguaaaccuuuugaaaaauguuuuuaaaaauuuuauuauuauuuuuaagagaugagggcuuacccugucaccuagucuggagugcacuggagugaucauggcucacugcagccuugaacuccuggcaucaagggauccucccaccuucaucucccaaagagcugggauuacagguaugagccaccaugcccagccuaaguaaaccugucuuuuuacaagaugaucugauuauaguuuaauuuagaauacaaaacucguuuaggccaaccuuauauuaaaaaauaaucuauaaaaaguaguauacagaaaaagcauaaaguuauuuguguuaagcuuaacucacaggaccacauuauuaauaagcaacagugaagcucuaguaaaaagaugugugacugucacuagaaacuaaagguucaguauuuucacaggauaauucuaccaaacauuuaaaggucagauaauuucacuacuauguacuuaaacucuccuggagcacagaaaaaggccaggugcgguagcucaugccuguaaucccagcacuuugggaggccgaggccugaggucaggaguucgagaucagccuggccaacauggcgaaacccugucucuacuaaaaauacaaaaauuagcugggcgugguggcggaugccuguaaucucagcuacucaggagucuaaggcaagagaauugcuggaacccaggaggcggagguugcaguugcagugagccaacauugcgccacugcacuccaaccugggcgacagagugagacuccaucucaaaaaaaaaaaaaaaaaaaaaaagaaaaaaaaagaaacagauaaagccccaaacugacaaagguacaaaaagaaaaauacuacccaauuuuauuacuauucuaaaaauaauaaccaaaauauuaacaaagagaauccaaaagcacauugaaagaucaugaccaaauaagauuuauuaaaaaaugcaagaaugcuccaauauuauaagaucccugaaaaucauaguaaagauauggaggaaacuaguaaguucaucucccuagacagugaaaagacauuugauaaaauucaacucuuaaaguauuuaagagaacugaaaugacuauaacuuagggaaguuucuccuuuaccauaaauauaaaaaccaaccaaauccuuaauauuaaauauugaaacuguaaagacuuuaaaaagucuaauaauauaauagauauaagguauaagacaugagauacuaauggaagcaauuauuuuugaaaggccaaugucugacauuaagaacuauuaugcuuuuauaguuuccaaguauauauuucauauauugcaaacaauuacuauauuauaguugauccaauggcaagguauuaaagagcuguuagaaaucaucucuuuugucugguuaaacuugcugcaagcuguuaauagaaguauucaauguuauaugaaaauaauuccaagggguguauuuccagccaacuauauaaacaugugucuuuguguggcgaugugucauaucuuguggacaaucuuaugaauacauagaaugcauuaacaaacagaaccccaaucuuucuuuuuuuaaucuacaaaaacucacuuguagaaccacucuucaucugaaaacuguuuugcuugcaaugccuccuucauuaucagcccucccugacccccuaccacaccagaacucaguaacuguuuucugugauauaaacacagaaaacaauuuguuuuucugugauauaaacacagaaaacaaguagcaggguuucuuaaauuggggaaucaguaaucucaauucuccagucaccuggguggcugcuguaauuugcauaaaacuguuaaaauucacuucacacaggcaggaggagaaaaggaaaugacaucagaggugcuuugcuaaagaucacaggaacugcagcuguggccuuccuauuucgcagguagaaaauuuaucuaguucuguuacuucugugauagaguggacuuuguaaggaugacucucuuagagaauucaagacagugaucaaaaacugucagauugacuuuucuucaagaaauuuaacuuagcuugcuaguuuacauccagaaucaaauucuuacugaaaaaccuuucuaguuuucuacuuuuuacugcaaggguucuugguggauauuaucucugucccuacugcauuuuauguuauuuuuuucaaaguuggcaaguaggcaagaucaacuggccaaugaauacaugaggacugaggcagauuuuaaccuucuauuuaugcaacuuucacugaacaaaacucuuaagugcuguuauuuauauagaguugaacucugucaaaugucuuuucacuagcuagcuuaacaaagguuuugcuuaaaauauuacauguuaauauugaaaacaguugggcuuuucugacuucauaaaaguggaaauugaaaaccacauucaucaggaaauuaaauguuuuauccaggcuuuagcuuaaugagaauuuauauuuugagaaaagauuauuuacuacuagucauuuuuaaaaugugucuguuuuugauucuuuuugucaguuuuccccuuaaaucuuuacacagauucccaucagaguacaguaaaacaaaaauuaaauagaauucauauauuugaaauccuuggcaucaauucacuccaggaauccaagacaguacucaacugaaggggaagcaagcacaagggagauuucugggacacugauacuguuccguuucuucaucugaaugcugcuuaugggccuuguucaauuugugaaaauucaugacuuuguacauuuaugguaugugaucuuuccuguuuauauauuauacuuugauaagaaguuuuaaaaaaaugaccuguuccaccuggauggcaguuaacauccaacagcugcauaucuuuaaucugguaaauuagguauagcucuaaugauuacccaugauucuaugugauaaaccaguacugugauucccaaaucuucgagacagaagauucaauaaaccaucucuaccccuuucauuaacuuggucuagggcuggugugcuauggaggaaauuucaguauugugaagaauacuuuuugagcaaguaguaauauaacauuuguuuuccuuuggugucaugggcgaauuauauaacaugcuauuauauuuucuugcucuuucuuacuauuuucuugcagagucuugcucugucaccaggcuggaguguaguggcacuaucccaguucacugcaaccucugcccucacaggcucaaacaauccucucaccucagccucccaaguagcugggaccauaggcacacaccaccaugccuggcuauuuuuuuuguauuuuugguagagaugggguuucaccauguuacccaggcuagucucaaaccgccugccuuggccucccaaaguacugggauuacaggugugagccaccgcaccuggcuauauuuucaacaaaagcauuauaaggaaacugccuagaaacuacauuuugaaaaucacagcacaguagaaaaaagggggcaccaauuuaaaagaggacauggacaucuacuacuucauuuucucuuacucaucuguuugucuauuugccucuuuaaagauauuaacuauauguaagauaaauauucagugccuucugugugcuagaggugaggaugugaggaugaaucugguaucugccuauaucagagaauggcuaucuaguuacuaaacccauuuccucuauuuugcugggcauacaguuaauuucccagacacccuacagugaggggugacuuaugacugaauugacagccaaugcaacagaagacuugguccaugaaaaccucccaugcaauaucccuuccaugcucuuuucuaccugcuggauugaucgagcugagcaugcaaccuugaaaaaaaaagccuucaggaggguagagucacaagauggaaggagcauacaucauuacuugcagagggccacuggcuaacugggaaccuuuuugggacuguaugggaccaagaaauaaauuuauuuccuauuugagccguuaaacauuucugaguuguuuugcuauggcaacuggcauuaacuaauauugugaacuuaaggagcugacugcuuuuuaaggagacacuuaccccccuccacaaaaccacaauacaacuuaguaagugcuauuauagaauaaaauuuauacaaaagcuggagaagagcaguuaauuuugcccagaaagcguucuugauauaaguaacaugugaacugggcuuugaagaauaaauagauaagaauuuaccagggagacaaguaguggaaaggggugauauaaacaaaaacauaaacaggcauaauaugcccaggaauauuuguauauggcuaaguguuuuugugaggggagugggaacuaagaccagaaaaguggccuggggucagacugugguaugguaaagagaauaaacauuaucuuguaugcagcgagagucauuaaagauuucaaguagcacaaugaaggaugguaggcuaaaggggagagcuggagacaguaagauaaaggaggaaguacugguaguggaugugaagaagggauagcacugacaaauaugugugugugugucuguguguauuuaccuauuuuuuuuuuagagauggguuucuacuuuguggcccaggcuggaguacaguggcuauuuacaggcuccaucccaguacugaucagcaugggaguucugaccugcucuguuuccgaucugggccaguucaccucuccuuaggcaaccuggugguccccagcuccuaaggucugagcggucaccauacugacgcugaauuuaacauggacaugcaauuggcauaguacacuacagccaagaacuccuggacuuaagugauccuccugccucagccucuuguguggcugggacuacaggcaugugccacugugcucagcugacaaauauauuuuuuccauaaguuauugggguacaggugguaucugguuacauaaguccuuuaguggugaucugugagauuuuggugcacucgucgcccgagcaauauacacuguacccuauuuguagucuuuuaucccucaucucccucccacccuuccccccaaguccccaaaguccauuguauuguucuuaugccuuugcauccucauagcuuagguuccacauaucagugagaacaaacaauguuugguuuuccauuccugaguuacuucauuuagaauaauagucuccaaucucaaccaggucacuacaaaugccguuaauuaauuccuauuuuuuuuuuuuuuuugagagggaguuucacucuuguugcccaggcuggagugcaguggcacaauuucggcucacugcaaccucugccucccagauucaagcaauucuccuaccucagccucccaaguagcugggauuacaggcaugcaccaccaugcccggcuaauuuuuguauuuuuuuaguagagacaggguuucaucauguuggccaggcuggucucaaacuccugaccucaggugauccaccugccuuggccucccaaagugcugggauuacaggugugagccaccaugccuggccccguaauucauuccuuuuuauggcugaguaguauuccaucauauauauauaccacaguuucuuuauccacucguugauggaugggcauuugaguugguuccaugauuuugcaauugcaaacugugcugcuaugaacauguguaugcaaauaucuuuuuuguauaaugacuucuuuuccucuggguagacacccaguagcuggauugcuggaucaaaugguaguucuacuuuuaguucuuuaaggaaucuccacacuguuuuccauagugguuguacuaauuuacauucccaccagcaguguagaaaguguccccuguucaccgcauccacaccaacauuuacuguuuuuugauuuuuugauuauggccauucuugcaggaguaaggugguauugcauugcgguuuugauuuguauuucccugaucauuagugauguugaguauuuuuucauguuuguuggccauuugcauaucuucuuuugagaacuguguccuuagccuacuuuuugaugggcuuguuuuuuucuuacagauuuguguucauuguagauucuggauauuaguccuuugucagauguauagauuaugaagauuuucucccacucuguggguuuucuguuuacucugcuguuuguuccuuuugccaugcaaaagcucuuuaguuuaauuaagucccaacuguuuaucuuuguuuuuaauacauuugcuuucggguucuuggucaugaaaucuugccuaagccaaagucuagacggguuuugccaauguuaucuucuguaauuuuuauaguuucaggucuuagguuuaaguccuuaauccaucuugaguugauuuuuguauaaggugagagaugaggauccaguuucauucucuguauguggcuagccaauuaucccgccaccauuuauugaaaaggauguccuuuccccacuuuaugguuuuguuugcuuugucaaagaucaguuagcuguaaguauuuagguuuauuucuggguucucuguucuguuccauugguguaugugacuauuuuauauugguaccaugcuguuuuggugacuauggccuuacaguauaguuuaaaaucagguagugugaugccuccagauuuguucuuuuugcuuagucuugcuuuggcuaugugggcucuuuuugguuccauaugaauuuuagaauuguuuuuucuaauucugugaagaaugauggugguauuuugauggggauuguguugaauuuguagauugcuuuugccaguauggucauuuucacaauacugauccuacccagagaugaacuugggauguguuuccauuuguuugugucagcugacaaauauuuuugauguaaaaacuaaccugauuaguguggugggcaaggggagggggaugguaaaggugaagagcagugcaagguaauccugaagccucugucuuagaagaaugaguaaagucuuacauacugagaaaaguggauguucugagaucagaaaacaggugcagauugugggggagagaggaguucaguuuuacaauaacugaguuugaaauaccauuuugaaacccucagauaggucaugagguaugaucggucaggccuaaaacuuauuuaauuuagguaugggucaucuuugggaagugagaauaugggaaagcccugaauugaauugauagguagaucccuaagccuccuugggagacaacacuuauuuuuuaaaguguaaauuuuauuuuuuaaaacaaugguaaucauaugauucaaauaaacaauuuaauaaagagugaagucuuucuuuucucauuucucaagcaacucauuuucuccucccagaguaagcaauguuuauuggauuucuuuuguauccuuccugauguacucuuuacacauaccagcacauaugcacagaucuucuauuuuuuuuuuuuuuuuuuuuugagacaggguuucacucgguugcacaggcuggaaugcagugguacaaucuugacucacugcagccucugcuucccagguucaagcaaucaucucaucucagccuccugaauagcaggauuauaggcaugugccaccaugcucagcuaauuaaauuuuuuuuugguauugcccaggcuggucuugaacuccugggcucaaacgaucuucccaucucagccucccaaaaugcugggauccuuccauccuuuucuauaacacacauacacagacucuucaccuucccuggcuaagggacauuuacuuaccuuagaguggcucccucagucuuaaucacaucuccaucuuucagauaaacauauuguugcucuccauuuccuauaauuucuucucucugaggauuccgugggaguuuuuuaaugcaauagguagugucuagucauaaaacauauaaaauauauuaauucacacuuuauaauuaagccuuuuaagagaucaacuuucauagagcuaacacuugugaaugacugcauaaaauauuaacauuaagagacaacagaaaaugggaugaauuacagcagguuaucucugggauguaaauauuucauaucuuucaaccaaacagcucuucauucuuucaugccccucuaggucuacaugaaagccucuauuuuuugagucaguccuaguuuauacaaaaaauuuaaaaguagcuagcuucggcauccugacaaguguugaagaggcacuaauacagaaccuggaaacucuucucuauccaggugccuaacauguagcaaaggugucaugacaguaauuaauaacaaaaggauaaacauuaauuaauaacgaaagcaugagguccuugcuacaaguacugaaaugaagccccaaaccaguggcuaagauauuaaaccuuuaaaauaagcuaaaucuauaccacccuucacugacacaaagaaaauaaauuaauuaaccaauuaacaauugagugccaauuaacuaaccaguauacuagguauacugaauacaaccacugugauaucaaaguucuuaaaagcuguccugauugggaaacuaaaacuuacaaacaugaaacaaagaacuauacuugguaccauuuaaugaauauuaaauggacaauucggcuaauaaaggcagcaggaguucagagagaguuaggaaaggauuuauaaauaugauagaacuugaggugugacuuacagaaugagcaggauggguaaagguacagagaaggacuugcagguaaggggaacagcauuagaaaaggcauuaaguccaggcgugguggcucacaccuguaaucccagcacuuugggaggccaaggugggaggaucacgaggucaggaguucgagaccagucuggccaacauagugaaaccccaucucuacuaaacauacaaaaaaauuagccaggugugguggugugcaccuaacgucccagauacucgggaggcugaggcaggagaaucgaaugagcccaggaggcggagguugcagugagccaagaucacgccauugcauuccaggccgagcgacagugcgagacucugucucaaaaaaauaaagcauuaaaaugagaaugagcaugacauaugugugacaacauaaugcuaccaacuuucuacugcaaaauacuggcuaggaagaguggagauaaaguuggauagguaagauaagcucagaucagaaagggucucaaauugccuuuuacaaaauaggagaauuuaaacuuuaccacguguaaucacugcacacucuuuaguaagauaaugaaauaguguuaacugaugaucaauauggcggcuguggguagggagaccaaaaggagaucagagagcccaggaggggaaugacuacaauuucccagcuagaagguaaugaauaguaggguuaagacgguagcacuggaaauaugaagggagaaagagauauuucaaagaaaaauggacaaggcacagaaauuugcuaguuugaggauaaaggagacagaaacacugaaauaaaaagaaacaacaacaaauaccaccuccccuuccaaccccaaacucuauuauuuuguaucuaagaggccgaaggaaaacaaugauaugcuuuucugggaauugacauuauauaacaagauugagauauugagguuuuuuuguuuguuuuguuuauaagcuguauaauuuuaucuuucaguaaagaaauggaggcauuacauuucugcuuaugagaccuuuaguagacaauuaaaaaaucacaauuauaucaaaauuacaaaauaaaugucauacuauaacuuuguaucugucuucaaaauuaugugcaaauauaaaugaaaacacauauccuauuugagugguuguuggaggcuggggaugggggaaaucacugcaaagcagcaugaggggaccucuuuuuggaauggaggaaguguuccauaucuugacuggaauggucacauagguauugauguuuguuaaaacucacuaaacuguucacuuaaaaugggcacauuuuauguauguaaauuaaagcucaauaaaauugauuuaugaaggaaaaaagugggccauaaacauuuuaauuuuucaaacugaaaaaucugaagaguuggcugaggugacaaagcuaauuaagaaaucacagaguaguuucuuuuuuuuuuucuuuuuuuuucccgcaaacaggguuucacuuuguagcucaggcuggucuugaacugcugggcucaaacuaucguccugccucagucuccugaguggaugggauuauaagcacacaccaccgucccuggcauaaaauaguuuuuuaauucacaagauuuaauagguagauuaaaagaagagguaagacaaaauuaaaagagguaagacaagagaaggaaaagucagacugacagauuauaaguuccuaugguacacaguccccuuagauuggaagaaaggagcuaagaggguaaggaagcuugguugccaguuuuuuauaacuggcagccuggugauauugggugugguagcugagaugucccaauuguagucacaaggccuaaaaaagcagaucuuuacaaauguuuaaaaauacuagcucaauguaaauaagcaugaauguucuugaccuccuuacugugcccugaaugugccaaccacacucucauuccaccaucuuugcuccugcaaugcuguuugccugcaggccuuccugccaggagcuugcuccuucucucuguccacucuggauauaacagcccuugcccuucuccacuuuacgcucucuucccuuucucuucuuguaccuuuauuuuccugcauagcacccaugauuaucugaucuauuuuuuucccuuuuuuuuucauucuggugcccaggcuggagugcaguggcacaauauuggcuuacugcagccucagcuucccuggcucaagccaucugcccaccuuagccucccgaguagcugggacugcaggugcacgccaccauacccgggaaauuuuuguacuuuuuuuguagagacagggucuugcuauguugcccaagcuggucuugaacuccugagcucaagcaauccacacaccuugaccucccaaagugcugggauuacaggcaugagccacugcacccagccugaucuauuauuuauuuaccaguaccuucccuacuggaaugaaagcuccaugagaacagagucuguuuuguucacugcuauaccccuugugccaagaacacugucugacauauaacaguaacuggaauauuuaaugaaugaaugaaugaaucuagguauaugauggugggaugaggaaauaaagagauagaaaaugucaguacuguauagguuucagggacaaugaauuaucaauacaaugauauauugccugaauuucagcauaucuuaguaacugccuuaaaguuacagaaggacugagauaaucuguuagaaugugaacaauaagagcaccuaccucacaguauccacauaaauuguuuagugcagugccuggcacagaguaaaugcucaacaguuguuaguuaugauuaagucugaauaguaacucacacacuaaaguaaaauugaggauuugaaacagaaaucaggauuuccguuccuccuuuguuaaaacuaggcacaguauucaacagucuaaucaauuucuaaaaguaccauuuaaaacugagguauuuaguaaaugguuuauagacuacuuagcucuguaacugaaauaaauuauucuccaaacacggcuuuccucaaugagcuuaaugaauguuuucuguuuaccauuauugaugcuuuuacaaauaucuccuaugccuccagaaugaucucggugccagugagucacuacaauuuccuggauugcuguguuaaauucaguuagagccugcuuuaaacagcugauguauucuggaauugcugguucuccagugucaaugaggauucuccugaaaauuaaauggaagauaaucacacaauuggaacacugcguugacauuagcauuauuuugcacacagauaauuuacauuaaagaaacugcaaaaauuauuuuacuuuuaacaugcacaaaaaccagcuacaucacuucagcuuaacuacaguaaucucacccuaagaaaguuuucugagaaaaauuagagcuaaauauaagucugaacaaggaauaauagcagucaucuugaacauuuacauagcaauuaaaauaaacauggcaccauuccaaggacuuuacauauuuuaccaauuacauuccucguaacaacuguuuaaaguagauauuuuaucauuauauuuagaaguaacuugcccagguuacucuacagauaaauggcagaaacagcuuucaaacccagguauucugaugccagaauaugugcuuuuaucuaucugccuuugagaucucauaucucaguauauuucaaaaguuuuauagauaugaaagauuuugauucaauggcaccccuaaagaaacuagucuuuggcacuagauauacaacuuaucacugaaguuuuauauuagcacccugacacaugaaaaugaaggcuuuagugaagcaugggaaaaacaucugagcuauuuucuuucuuuacuuagacaaccccauuagcuguauuuuuugcuugugguucugaaucuuccuuauauuuuguuugcccuuccucacgauuuuaugagguggccuuucucugugaaguuuugcugaacuaaagacaugggggugacauguuccucaagauccaauucuuuuuuuuuugagacagggucuugcucugucacccaggcuggagugcaguguugcgaucucagcucauugcagccuugaccuccugggcacaagcgauucucccacaucuacuuccugaguagcugggacuacagguaugugccaccaugcccggcucauuuuuguauuuuuuguagagaugguguuucgucauauugcccaggcuggucucuuaacuccuggggucaagcaauccucccaccucagccucccaaagugcugggauuacaggcguugagccaccaugcccagcucaagauccaauucacaaacuucuucacucauacuguuucacaguaacaccucaauaauucaggcuggcugacagauuagccuugaugaaaagucugaguuauucauuaauugaucaauaacuguuuauggauuaccuaauaugugcuacaaauuuguuucuugcaguaagcaggacacaacaacccugcuuacauucaacuguuggugagaaggggaacugcauaugacuggaaauaaacaauaaaaguaacauaccauagaaagcauuuugcaaagcauuaaaauuaaacagugaguaacuggaugguuauuuuuuauugguuuguuucccuaacccuacucccugagacccagagccaacaaaaacaaacuggccucucauaagggaggaggguaauggccucauagcccauuggcuucuaucugcacccuauguucuguagcacaguagauguccuucagaaacacaguguugaacuguccuauccggagacaggagaccagaugguuacacuggaccaagagggcauuuauuauaggguucuguugguaguggaaauguaaggaagagauggcuuuaagaacauuuagaagguacaaucaaccaaccaccaggauauuuguuaaacaacgagauguggaaggagggaaacaguuggcgacucugagguuucuaggugggaggauuggugugccauuaaucaagaagguaaacccuggagggagcaaauuugagaugaguuugacucgggucagagugaguucugaugcuauuccuagccaucuuaucuugcuuuuuuuccauagcaauuauuaccauguaauauauuauguauuuacauauuuauuuuuuuauugccuauuuccacaaccaacaccaccguacaaauuugagucccuucagggcagaaagcuugucuguuugguucaaggaauuuauggauuuauuucuauauccauaauacauuguacugcacuuagcauugugcauauuuaguuaugcuaaauuaaaauacacaagacuauaauacuaugauaccuccaauaauacucucuagcccacccauccuagauuuuggcugccuccaugcauuugcaguuauuuaccacaaauucucacugccccuaacguagagucacugggacuauuuuugugggucuucugguccucacaaaaagaauacuuccaugcuucagguaaggcucaaauuuuuucaauccaucaaggccccaccacuuuuaaaauuauuucuuaauccuugccuucccguccucccaagaaacucuguuuugaaauaucuccuaaucuaaaaaugaauauaaauuucuguaauuuaaugaccagaucacaucacacugaucaaaagucaugacaaaauuaacaggguugauacaugaauuugauaaaaucuaguagcaaagaaaacagaucuuuuagaaugccugugcugguuguuugcaggugaaagugugagugaccauacgacugugguaguggagaacauguuucuggggcuccaguuuuaggucucuuaaugguccugucuugguuuaacaaaauuggaauugauaaaagaagggcucucaaaagaaagaaaacagaaaaaaguucuggaauuaauacaaucuauucagaacaaaggaggggugucuagauacuauaaaaccuaaaacaugaguuugcaccaagcuuugagggaaaaaaaaagucacacugauaacauaugacauugacauagcaauuuaaaccauuuggggcuuucauauuuacuauuucuuuugauccucauaucaacucuagggagguauuauuacuuuauuaauuauuuauuuuauagaaaacuuaucuucagaaaggcuaagugauuugcuccaggucauauaaccagcaagaggcagugcuaggaagcacuagauguucagauacaagguccagugacuucuccauucaaaacacugccucucuagcagaaggggauugcuuagguuaagugcuuagaaucauuauguggcaaaaauaaaacuucagcuauacauuugaaaaaacuguuaucaguuuugaaauugaaaaaaauguuaucaguuucucccuuagcaaacaguuacucuaucagugaugucuguaaauaguuauaauagaugauuggauaguaucaucucuacaugggcuaguugacuuuguucuucuuggccacagauaauaauaucccuaucucaggaggucauuuugcaaaugcaaauuaugcuaaugaagggcucaagggaagaguauggaugaaucuguauaggucuaugaacgauuuauucacuagagcaaagugccuggcacauaguaggcacacaauaacuguuugcuacaugaauggagaaaaaaauuuuuaauugauggaaaauuaguagaaucaaauuccuuguuauagguauuucaugucaauauuaagauagcuauuaacuggucucuauuugcugucacucuuauaaaaucauuagauauuuucugaacaccuacuaugagcacaguguuaucuagauguuaugaggaaagcagaagugauaaacauaauggcuaacaugguauguuuuccacgugcuagaacuuguuaagugcuuuucauauacguuuuuucacuuaaauuucacugagcccuuauaaaauccaaugagguagguacuacacaaccuucauuggguuguaucaggaaucugaagcuuagaacugucuuguccaaagucauauggcuaguaaauggcaccaggauucuaaucgagguaaccagaguccagaguuuuaauucuauuccacuugacuaccuuuuucuauuaucagccacacugucugcccacaaaguauguacaauuuugauaggaaagguuaaaauugcaguuuuuaaagguucuugagcagaggaggaaaguaaaaacacuggacaauuuggcugucauuuguugauucaaaugcuuauugaguaccuauguacuaagcaucacaguuaggucuagcaguguuuuagugaaauucauuuggcuuccaugggcugaucagaugaggaaggaagaccagcuaaaacuguaguuauccagcaguucuggagucauaauagugaaaauuaagagaaaauguacagaaugcucauucauucagcaacuguuuacuguucuaccugaacuguguacaaggcucugugcuaggugcuggggauauagccaugaauaugcuuucacugaacugauguuauagugggguaugaagguguggaaagacacuaagcuucuugcacaaaaaaaucauuucauuaucauugagauaaggaccaugaaaaguauggagugucccuaauacagucugaugggucagggaagacuuccaugaggaaaugguauuuaaacugugcucuaaaggaugaaugagauuagcuggguaaagaagggaggaaugaguggaagaaagaggaaagcaugcgugaaggcccugagacagggaaucacaaaccucaucugagacacuagaaggccagcauggcuggagugggagagguuugagaggagccugauaagacugauggaggccagaauacacaaggccuuccaguuuuaauuccuaaaauaccacucaggcuacaaagggaagauuggauugaagagagacagagguagucguacagaagccaauuaggaggcuauuacaguagccuaagcaagaguugugcuggcuuggacugagugacagcaggggacaugaacagaucuucauaauggcuuggauaugcaguaggaagcaaauaaaugucaggaaggguauuuaggcauuuccuuugauggcuuuguuuaucaagauaugaacaacugaaggaggaccuggcaguuuucuggaaagguuaugaguucaguauggaaaacacugaguuccaggcagcagugagucaugcaaauagauuuaaaaguuggcuacuugagucugaagaucaaguuuggaauuugaacuugagcuauauauuugguaguuaauaauaaacagauaauaaaggcaaagccaaauaaguagaugagaucaccuagguagagaauacaguagaagaacaugagagaugaggauuauauacugaauaacuaaaauaauuaaagauuugauaaagaagaugacucuaucaaggugaaagagaaagagcagcucaagagguaauaggaaaccugaagaaugugguguuggcaaauuaaggagggagucgucaauggugucaaagcacugaaguucaaggaagaugagaacagaaaaauaccauugggguuagugauacaaaagccgcuugugaucuuagaacuguuuugugaagcggaacagguggauaccaaucucagaacaucugacaaggggccaauuaauauuaacuucuagccaccuuuuacuuuacaccuuuuacuuuauacaguagcauuaucuacacuuauuucuagcucaacuauacggacucucuaguucaacuauauggagaaauaauuuacauagugcaaguaauuccacuggccauuccacuccauuaauuuaugugagcaacaguguuaaguaauuuaagacgagagacuauaaaucugcuuuucccucaguuagucuuuaagucucucuuagcacuagcacuuugcuauguugagugugauuauaguguuuaaagauacaguauguauuuuucauacaauauagccccucaacacaagccaauuucuucaccugguuuucaaacagaaucagccaucuguuucaacgcuggaaaaaaggcagguugugcugaacuuacugagacaauacacugaucuccaacaugguguucuucuaagagacuuuccaggguaauucugauaauaugcaucuuuugucugagguauugacuaguucaagaugacacacuguagagagaccgccuauggauuuacuugguugagggacuuccagccaagacagacuguacccuagagaucuggcauuuuuccugcuuaauucucuauccuccuagauucugguggcagccuaaaccuuugguaacuaccugacccugccuuauuuacucugaacuuaaucuuuuaccugcccacuuugcaggucugcugcuucuaaaauucuuauuuacuggaaaaacgccaaacaguagacacuuccaaggaaaacucaauuaacuguacuuacuaaaucguuuuuaguaaucaauuauauuuuaaaaauaauuuaugucuugacugcacaauuaaauucuaugcucaagagaaacuacauuaucuggguucauccaguaaagacuacaaaaguugcuaaaugccuaagacuuacuaugcaguaaaccaaaucucccauuccugcauaauuccacuaaaacagaaugcagcuaaacaagagcaaaaguaucuucuuagaaauacagguguguuacugugucugcaaauuaaacucaaacaaggucacacacaauuguaacaaaaaacuuccccaaauuacuuaugucagcuccucuuaugagcccacaggcugcagagaaccaauuuggaagccaggagaauccugcccucugcugcugaguugaggaaaucgccucaacauaauuaaucgcuuuugagaagggaaguuacacucugggcaaaacaccagugaaagucaagugagcaaaguaaacgcuuucuuggacucuugacauccgaauuuucucaacaguuuaaacacgcacacccuggcauucaaacaucaagaacaguaaaucggguuucaaaacagaaguuuuuuuuuuuuuuuuuuuuuuuuuuuccauuucucccuaaauuagagagcuaucaccugggguggucguauuuuagcuagcuucgagauccgagugucugcgugcagucccgacggggcugcuaggcgcggggcugcccagcuagggacaggacgcggcgcucuccacugcccgcgcagccgcgaucagucaaagcccgggcuccggggccggcugcgaacguuggggagguuggagagggacguuuaccuggggccgguccccacuagguagguguuggugccuuggagggucaugggacccggguuacagcccaacacacgcacgacucgauuggacagccgcucgacgcgcugcaguacagcagccauucccgccucagccgcccgccggcgugucgccuaucuggauacuccagcgcggaagaagccaacaggccggggauagcgaguagcguccacgu

SEQ ID NO: 191093 - RNA, 38891 nt, Homo sapiens
gcaguacccaagcgagccauuuaacauggcggaggauguuuccucagcggccccgagcccgcggggcugugcggaugguagggaugccgacccuacugaggagcagauggcagaaacagagagaaacgacgaggagcaguucgaaugccaggaacugcucgagugccaggugcaggugggggcccccgaggaggaggaggaggaggaggaggacgcgggccugguggccgaggccgaggccguggcugccggcuggaugcucgauuuccucugccucucucuuugccgagcuuuccgcgacggccgcuccgaggacuuccgcaggacccgcaacagcgcagagggugagugcagaccgcguccgggccgggacuacgcggggggcggaugcgggcuccguggugcgcggcagagggcugguucccuacgucgccgagggaggggcugcugcggccgauuagcugggaguccgaggcuccgggcugaacuuuguucgaaucccgguucgcccguugucagcaccugaguuuuucucagauugauuuccucuucgauaaaaugaaaauaagacccuguuuagguuugaugcaagcauuaaaugaguuaaaauguauacaguuccacucaacccaguaccuuugucucuuuuggcgcuuucuacucagguauuccuguaguaauauucagcagucccuguggccuccaguaacccccgaggcaucaguguuuuauguuaauuugugagcuauuaaaucucauuuggccugcuggcucuacagcaguuacuuuuauucuguguagucucagaauaaaaguaaauguuggccacaugccugcaagucccagcuacuugggagccugaggugggaggaucgcuugaacccaagaggcagagguugcagugagucgagaucgugccacuacaguccugccuggguaacagagugauacccuguaugaauaaauaaaugaaugaaugaaacuguucaugaaaucugcugcaccccgcccccgucccaagauggggucucacugucacccaggcuggagaguguaguggcgccaucacagcucacugcaggcucgaccuccucaggcucagguauccucccgcuucagcuucuggaguagcugggucugcaggcgugcaccaccacccgcagcuguaagauuacagguaugagccaccgcgccuggccuaguguagcuuuuugaaaaacaacagaaagauguucugguacuucauucauaguuggcgcuaaaauuacugugcaaguauauauuuauaauacuauaauuaugcuauuuaauagaauucuuagacauuuugacacauuucaucuucaccauaauccugugaguuaggcaaauaaucuuaguuuuaagguacugauagguuaaaagggaguguuucagccccauccuuuaucuuccaguucaaggaucuuuccucuguauugcgguuaacacuggagccagggauaauuaacauuaaguagaaaauuaaauccuggaaugaagcuaguuccucagaauucucuuagaguucucuuagaguuggagacaucaguaugaacuguuuagcucauguagguauagaugacuuagaaauauuugcauaugcauguguagacauagguuacuauacaaauauguauuuccuuacucugucagauaaaagggcacagaagcaaccuaacucuaguaacaaugaguacaccuagcaccccgaucuuguuuacaacuaaguuuaguuuaaagaccucacuuggcuuuauugugauucuggauucagguaauacuuuauuccauaaaauaagugcucaaugaauugagcaguuggggguuggcuuuauagacaguaaggacuuaaggaagcugaaacagaacaaaaagaagauugguuauuucacaguuacuuguaaggcugggacagggagacagaacaauagauacaugggaugcagaauggauguuguguuaucaggcaugaaagcaacaguaauuuccuuguauguacgucucccucagagcucuugagugguuaggcgcauuaucaaugagcaaugguauuuugaaaggaaucuuuuuuccaagcaguagaucucaauaaugggcuuaaaauauucaguaaaccaugguguaaacagaggcacugucaucuuguuccauuucuagagcacaggcaaaguugauauaucauuugaagggccuuaagauuuucagaaugagaaaugggcaauggguuuaacuuaaagucaccagcagcauuagucccuaaggagagucagccuguccuuugaaauauuaaaguuaggcauugacuucucucuggcuaugaaaguucucuaugacaucuucuucuaauaugaggcuguuucaucuacaaugaaaaucuguuguuggcuggauacaguggcucacaccuguaaucccagcccuuuggaaggccaaggcaguuggaucacuugaggucaggaguuugagacaccagccuggccaacauggcgaaaccccaucucuacuaaaaauacaaaaauuagcugggcauuguggcacacaucuguaaucccagcuacucaggaggcugaggcacgagaaucaaucacuugagccugggagguggaggcugcagugagcugaggucacaccacugcccuucaaccugggugacacggcgagacucugucucacaaaaaaacaaaaucaguuguuuaguguaaccaccuucauuugugauuguagcuagaucuucucaauaacuuguagcuuuuacuucagcacuugcugcuucaccuugcacuucuaugucacagagauggcuucuuuucuuaaaccucaugaaccaacaaccucugcuagcuuccaacuuuucuuuugcaauuuucuuaccucugucagccuucuuagacuugcucuggauuaggcuguggcuuaaaggaauguuguggcugguuugauuuuuuuuuuucuauccaagucaaacuuucuccauaugagcaauaggcucuuuuacuuucuuaucauuuauguguucaguggauuagaacuuuuaauuuccuuugagaacuuuuccuuuguauuaacaacuuggcuguuagacacaagaggccuauguuucagccuaucauggcauuugacauccuuuccucacuaagcuuaaucauuucuagcuuuugauuuaaagugaaugacuugcaacucuuccuuucacugaaacacuuggagggcauguagaguuacucauuggccuaauuucaaucuuguuguguuucaggagauaaggaggccugaagagagggaguaaggggaagggcuggucaguggagcaguuagaacacacacaauauuuauggaauaaguuugugucuuaugggcaugauuugugguacuccagaaccuuuacaauaguaacaucagagauuauugaucacagaccaccauacagauauaauaauaaugaaaaaguuugaaauauugcaagaauuaucaaaaugugacagguacagguacuguuagaaaaaugagccagacgcgguggcucaugccuguaaucccagcacuuugggaggcugaggcgggcagaucacgaggucaggagaucgagaccauccuggcuaacauggugaaaccccgucucuacuaaaaaaauacaaaaaaaauuagccagccuugguggugggcgccuguagucccagcuaugcgggaggcugaggcagaagaauggcaugaaccugggaggcggagcuugcagugaguggagaugcaccauugcacuccagccugggcgacagagcgugacucugucucaaaaaaaaaaaaaggugccguuagacuuggcucaagcugggcugcgguaaacuuucaauuuguaaaaaacaugcaaucugcaaagcacaauaaaaugagguaugucugcaccuauccuucgugguacucauuaaaauuuuaauuaguuacuuacauaacuuuuuguuuaauugugucuucucagauuaaaaccuucaugggggcagagacuggcuaucugaagucaucaccuccuaacacaggcuggcaguagauguucaguaaauauugaauggcuuguguuuaaauucuauauaaauuuugugcucucuuaaaauccuguuaaauucuauuaugacuguguaugguccagauaaucucugguguagcauaagauuauguuagaauugagggaggaaauuggguaaaaauauauucgucuuauaugcuuaauugcuacagaauugcuuuucaguuugcuaguuauuuaaguuuuuuauauauacaccaaccaagcccuggguuagguauaaugguaguaguggcaccuucaggucuuagguuagacauuauuuccucagagaagccuucccugacaccuccucugugcagaagauacuuaaacacacagauuucuuguuauaugcuuccaaagcauucuguacuugucuuuuuaaaguuuucacaacauuuuuacuucaguaguucaaucgcuugucucauugcuacaugguaaaaagcucacugugguccaggaguauggcuuacuugguauuguauguaaucacugccugacucaacaucugggugggcauucaaguuuggggagguuaauauuaauagguuuuaaacuuuguaagcuaaacagacucacuuaacugaaaccuagauagaaauaauauaaaauauuuucuauuauaugaaauguuucuagguauaaguuuccaaccaaugauuuuacacauuuuacaauuuguaucuaaaucuuuuuuguuaauguagacugcuacuugugaaagaauuuucaacaauuuuuauucuacaugugaaaguuauauuuuguaagaaaugucuucauugcuauucuuuuuuuuuguucugaauuuuaaucagaucuuaaauguacaacucuaaauuuaugauaauuuuuacaauauguuuguagccuauuacucaacaaaccacacaguggcacuacuggaucaaguuugauuuuaauaaaauuuacuuuuuuucuuuuuuagcuauuauucauggacuauccagucuaacagcuugccaguugagaacgauauacauaugucaguuuuugacaagaauugcagcaggaaaaacccuugguaaauauguuuuuuuauuuuauauuggaaauauuucaaucuguuucuaauguaagacaaugggaagaaacagacguuuuugggggaaguuugccuacaagugucuggugcauaggggugugggggggugguguguguguguguguacacauacagucauaucuaaagcaaguaaaagaaauguagucccugucaucuuagaacauugguucucaaacuuuagccugcuccagaauuacuuaaagggcuuauuaaaaaaaaaaaaacauagugcugagucucccuaacucucaugaguuucagauucaguaggauggguauggggcucugaaauauacauuucuaauaaauucccaggugauucugaugcuacucuuggggaaguguguuucauugacucuauuugcuaacuuuguggugacuccaaucauacacacucuguuuuuacuggcaacuauuauauuugaaaccuuuuauuugaacuugaugccagcgcuuacguaagaaguacaguuuauagcuguaaucucucucccuugucucuguaguuccauuuuagauuguaaugggcaaggcugauucaguuuaucaguaauggcugguauuuacaacauggucauuuuaaaaggcuauuugauggaaauaauuuuguauuuagauugguuuuuauaauuuacaaaauacuuuuccaacaauccugaguagugggcaguacuuacauaaaacugcuugcuuauugaaguguugucuuacauaaaaucccaguguauuagcaccacugucaaggccuucacuaaaguaucucuggcugauguagucugcuuuguuuggggggugaggguaggucuggaguuggugccaggaccauaaauggauagaacuagauagaggcagaauaguugugaaagagacagagccauagguaggccugggccaguugcuggagaaguagcaggcuggagcagaauuccagaccaugcagacuauaaguugacacuguuguuaacaggguuguuuucuacauuaagguggaaaaguauucuaaagugccuggcagugcuuuacacauagcaguuguucagcacaucuuaguugcuuccuggauaaccuuuucuccaaaaaaggcaggggggaauccagauuuuaugugugaucucaugguuuaaucuuggaauuuaccaggauacucuuuuggauauauccuagauauaauaggccagggucagcugucaagaaucaauguauuucaccauaaugcacuaaacugaggcagcauuuaaaauuuuauguauuggauuuuuggcuauacauaacccuuuugcuuuuuuuuuuuuuuuuuuaauuuugcucuauaguggcacugccuaauagagauaugugagccacaugucuaauuuaaaauuuucuaauagcuauguuaagaaaaguaggccaggcauagugacucacaccuguaaucccaguacuuugggaggccuagacaggaggaucgcuugagccuaagaauuugacaccagccuaggcaacauagcgagacccugucucuacaaaaaauuuaaaaaauuggcugggcguggugauucacgccuguaaucccagcacuuugggaggccgaggugagcggaucacgaggccaggcaauaaagaccauccuugcuaacguggugaaaccccgucucuacuaaaaauacaaaaaaaaauaaaaauaaaaaguuaaccacgugugguccucuggagacugagguaggaucguuugagcccaggagguugaggcugugguuagcugugauugugccacuucacuucagccugagugacagaaugaaauccugucaugaaauuuagaaauucccauuccagcagguguagcuaaaaaauaauaaugauaauuaaaauagguggaauuaauuuugauaaucuuauuuaacucaauauuucucaaacacuaugucaacaaguagucaguguaaaaaauguuaguaaggccaggcacauggcucacaccuguaaucccagcucugggaggcugagguggguggaucacuugagcccacgaguuuaaggcugcagugagcuaugaucacaccacugcaccccaaccugggcagcacagcaaggcccccaucucuuaaaaaaaaucaaaugagauauuuuaccuuuuuuuggaguaagucuuugaaaucucauguguacuuuauacuuaaggugcaucucaauucaaacuagccauauuuuagcugugcaguaaucauguauggcuaguagcugugcaguaaucauguauggcuaguagcuaccauauuggguuuagucuccuaccccacauagguuugacaagauuggacauguuuggggugauguggcuguagacccccacguagcucugaaauacagcagauaucuuaaaggggaaaugcuugucauccuccucuuauggaacuuuaagcuuuuuuuuuuuuuuuuagccagggugucucucuggcccaggcuggaaugcaguggugccaucauaguuuauugcagacucaaacucuugagcucaagugauccuccugccucagccuccugaguagcuaggacuacaggugcaccaucaggcccaguuaauuuuuuaauuuuuuguagagacgaggucucauguuguccaggcuggucuugaacuccuugccuuaagugauccucccgccuaggccucccaaaacucugggagacuuaaugugccuuuccacugcagccuauugcauugccguggaacucagcacauguccuguggagaaaagccaaucauguuugcaguuucucuaguuuccagucgacgugccagccccaaggaaaccaccagaagcuguucuuauuugucuuucuccaguaaagucucucuggcuggagugcacuggauccucagccuuauccaaaaucagcaaaucggcagcucaccucagaagggauucucucuggaauuuuaguucaucucauuuucauugcuuccauggcuaucccaugucuuuagcaaugugauuuuggaguuuaucuaacuguuuucuagcuguagugugaguguuuuguuugcugcaguauacuacaucccaccuggaagugaaugucuauacuguaaauuuuuugaagcuaagaucuaacauacauuuuucucuaugucacauuuauaagaaggaaggcagauaagugagaaggguuaaguaaugucagucaagaaauacuuauuugaaaauguguguugaaauuagcucuugaaagaaagcaagcagaugaaaaaugaggaagaaaaauuaggcagucuaccuuugcauuuucauuucacuacuuuugaggcacaguaagugauauuuaagugucuuggugucugcuuguacuacuugcuuggugugugaccucucuagcucucagaucuuacuguauaaaacaagugccacagugccugacacucaguguuaguuacuagcaugaauaucuuuuguacaccucuuucuuaccuuaugcugcuccauuuuccugaaguguucuccuucccauccuuguagucuacacuuaguuaucaucuguuuauccuuaaugccccaauuuggaugacuucuguuucaugagggauucacuucugcuauuccuacuuagaguuaauaccauguuccucaaauacacuagacucugcuugagaauuuaaucucugggagauggguauaggcaucaauauuuuuuuucuuuuuuuuuuuuuugagacagagucucacucugucaccaggcuggaguacagugacgccaucuuggcucacugcaaccuccgccucccggguucaagcgauucuucugccucagccucaugaguagcugggacuacaggcgugcgccaccaugccugacuaauuuuucuauuauuaguagagacaggguuucaccauguuggccaggauggucucaauuucuugauuggcggaucucgugauccgccugccuuggccucccaaagugcugggauuacaggcgugagccaccgcgccuggccaugcaucaauauuuuucaaaagcucuucagauguuucugagguauagcaaacauugagaaccauuggcauaaugcacaauuccauuaaaguaccaguuauauugguuugucugcaugucuucuuccauagcuaggaugugaguuccacaaggucaggaacuuuuuuuuucauguuuguaucuuaaguaccugacacagaaccuggaauauaaagagacuuaguaugugaaugaauauauuuuuauaucuaaaauguuggaaaaacaauuuggagaggacaacaggaaauaaaguaaaaauauuugaaacuacgaauauuuaaacugcaugcucacucugguuuuucaaggaaaaaaggaugugcuauuuaaaauucucuuuauucggucgggcuugguggcucacgccuguaaucccagcacuuugggaggcugaggcggguggaucaccugaggucaggaguucgagaccagccuggccaacauggcaaaaccccgucucuacuaaaaguacaaaaauuagccuggcgugguggugggcaccuguaaucccagcuacuugggagacugaaacagcagaaucgcuugaacccagggggcggagguugcaguaagccgagaucgcgucacuucacuccagccuggucaaaagagcaaagcacugccucaaaaaauaaauaaguaaaaauaaaaauaaaaaauucucuuuauuaugcuuauuuguugcauacuugcuauggaacuacaacugugcuaggaauuacagggauuuagaaaaauacacuuaaguggcuucugccccccaaaauuugaaauaugcauuauagaguaagaaguuuuuugucuucaagacacuguaaaagcuaauaggguuguugagguaaguauaaaguacugcaaggcauuaaaaaaugaauaaugauacaagaguuucuuuuuaauuaaugcagugcucaugaauuuuugugucauccuucucgaggggccaugcuaaucucugcauucuuccaauuuuuauauauuugcugccaaagcaagcacauacaggagauuuagagaaaggacauuuccuagucucuuagcugcugggguaaggacagcauucaagaaagaggugcuguuugcacuaugccuguaagaauugcuagauuuugucagaaagaaaguauaaaaaugguagucuauccacauccucagaugugguguggggguggggggaagguagucuagauaaaaugaaaacauuagcauuauuuugaaaauaaacuauaguuuaccuggauaauagacucuugauuuccauauacaacuucauaaacuugguccucacccaggcuuccuaugauaguaaauguuagcaccauuuauccaauuauuaaaacccaagaguccuccauuuuuuccucaugcucuacaugcaguccauuagcagguucuauucuacauucaaaauaaguuccaaaacagacaacuacuugccuuuuccaucaucuuucuaagaguaugcauccaacuugcccaccgaccuuccuccugcccuuuguauuuguuuuuucaagacaaggucacgcuggaaggcuguggugucaucaucgcucacugagccucagacuccuggcucaagcaguccucccaccucagccucccaaguagcugagacuacaggcacacgcccccaccuggcucuuccugcccuuugaacaucaaacuccuccucaggaccuuugcacuugccauucccucuggaauguuuuucuuccagaucuuugugugacuguuccuucugcuucacauuacgcuguucucagcuccacugucacuucuucagagaggucuuuaaccugucugaaagagcuucccucuccccuaccauucuucauuuccagaaccuuuuuucuuucuucuagcccuuacuacucugaaacuauauuguuuacuacucugaaacuguauuguuuacuacucugaaacuguauuuauuucucauuagcaugugcguaucauaagagcaggauuuugucuuacugagccauuccaaguuuuuaggcgagugccuauauauacugagugaucaauaaauauuuauugaaugaauuguagacuguagaugcuagacauguaagacauuaucaugaaggcucuugaauguccgaauggguuguugcuguguaauuugcuaauuaguuaucagcuguugugagucuuuguucugaauaacuugaucacaacucuuuuaggaaagcuuaauaauaguacaacuauuaucucauuauauauucacauaaauucugugagauaguauuuauucucaccauuuuauaggugagaaaacuggccugucuugagguuuguuauaaugcauuagacuuaggaaccacuuaagaauucuguugcuaugacauguuauguaaaauaguuuacuuucguucuuaaaauucauguuuuuguaaagaaaaucuucaaauguuuguaaucucaucaaccuuuuucuauuugaaauugaucuuaaugagcaaauuaacuuagaaaauaaaaucacuucuaaacugguauaaacaagaagaguaccuagcacauaguauacacucaguaaauauuuaaaggaaugcauuauuaaaaacugacaaaguucuacuuagcuuucugaguuacuuauuuuuguucuguuuuuaaaagaugcacaguuugaaaaugaugaacgaauuacacccuuggaaucagcccugaugauuugggguucaauugaaaaggaacaugacaaacuucaugaagaaauacagaauuuaauuaaaauucagguaugaauaaauuacuuuuaugcuuauuauauuucuagaaaauaacauuuaaaagaaauuaagaggaaccuaguagaaguugagcaguaguaaaauuuaauguauuguuucucuucagaaauuugaccuuugguuuauagucuuaacaugagcacugggggcuggaacuuaaugugccauacuuaagcauauguugccucuauguuguggaaaauuuaaaaaccagggguuugugcacucucaauugaugcuuaaagauuauguaaaaaguagauacuauuuuuaauuaaugguaaauuuuagauuuuuguaaucaagaauauauaaaauuuuaaccaaguagggagaauuuuaguagacaguaaguagcccaaaacgucauucaaagauacaauagcuagcagucaaagcaaauacuagguacuuucuuaguuaaauaaacuuuuucucuuuugagaauuuuaaaaauuucuuuucagguuggauaaaagaaaauccaagucauuccccaccuucccaagaauuaguguggugauugucaaguagaauuaggaccugaggaaaagaaaauaggcagaaaaacgacugcuuccuuuaugaauucaacccagagcaaagagauuugucauguuauugcaaucuuuuaggcugcuagagaaagcaagucuuucuuaauacacuacuguaaaaucaaaugggugacaaaguuuauagcaaacauuuaauauauuccuuacuauuugccaggcacuguucuaaacucuuucacauaaaacucuuacauccucauaacaauccuaugaaauagguacuauuguuuccaccauuuuacauauaagguaacugggacaccaagagguuaaguagcuuaccaaguuuacauagcuacccaaaugguaagugguccugucuuacuuaccacguuaccaaaaaugccaaugcaugaaaaaaaugaucauuaaaaaacaucuagcuucuuagguguguauuagauauuuuccagggaucugacuagcaaauuuuauguauccuaaucaucacaaacaucaucuaccuccucucauuucccuuuuacucaaaauuaauauuuagguggguccuaaaugugugugguauggcuucuaauuuauuuauuaauacauacuuuucauuuggucuaaauuagagauagaaugcugggcauuuaugaauaaaugugcaugggaccagugcaaauuuuucaugucauuucaagcgacacuuauuuugucuuugaaaaauaauuuuauaucuuuuaucaaauuaaaauuauuaagcuacauaaaaauguucucaacagaggauuucagacuuaccugaguuaucuuaauaauuaaauaacuauuggguauuuauaaacgcagucuaagguugguauuuuucaucuuuuaggcuauagcuguuuguauggaaaauggcaacuuuaaagaagcagaagaagucuuugaaagaauauuuggugauccaaauucucauaugguaauuauuuaaauuaaaaccauagaauuuuagaaguguuuauguagagugaggaaaacugaaagaaaauuggaggagaaaagaaaugcuuuaucuuuuaaacaguauagaauaauaccgugcaacagaaaaacuacgcaagucacauaugugauuuaaaauuuucuaauaagcuggacgcaguagcuuacaccuauaauuccagcacuuugggaggcugaggugggaggaucucuugagcucaggcauucgagaccagccugggcaacauggagagauccucaucucuccaaaaagaaggaauaauaaauaaugaaaaauaaauacaauuuuccaguagucauauuaaaaaaguaaaaagaggcccggugcaauagcucaugccuauaauaccaguacuuuaggaggcugaagcaggaggaucauuugaggucaguaguucaagagcagccugggcaacacagcgagacccuguucucuacaaaaaaauuaaaaauuagccaggugugguggcgcaauacuguaguccugaggugggaagauugcuugagccuaggaagucaaggcugcagugagcuauaacgcugccacugcgcuccagccuaagcaacagagagagacgcugucucuaaaaauaaauaaauaauaaaauaguauaguauuugcauauaacauauguacauccuccuguauaguuuaaaucaucucuagauuauguauaauaacuuacacaauguaaauaguuguacuguuuaggaacaaaaagauacaaaaaaucuguauguguucaguacagguguaauuuuuucccccauacauuuuguggaacaaauauaugcauuucuuuuggguuuauaugaagaguagaacugauuagucauaagauguguacauacucaguuuuaguagauauugccaaacuguucuccaaaguaguuaugucaguuccuccaguagugugaaagaauucuaguugcuccacacaccuuguaucuggguuuucauuuuagccauucaggcaaauauguagugcuauccuguuggauuuuaauuuguuucccugaugaauaaucagauugagcaccuucccuugauaauguuaguagauagaguuggagagugacuaccuuaauccaguaaggaaccugggccuaguagagaguagguugggcaguuuuggcaaggcuuugucuaucucuaauuuaacccuguaccugggguauaacccuccagaaauuucagccaauagccugauaugucuguuggguuuucuacccuuaauauuuucuccauagcacuaugagacuacugaaaauucuacucugcuuauaccucccagaagaggaaaacuuaauggccaggaaauauuaagagguuaagauaaguacuugaccucacuaguauuaauguugccucauuagggcaauauuaaguacuauauugaaauaccacuuuccaugccucagacuggcaucaauuaaaaugucuuagaauaucaacaguugucucaacaaauugagaaaugauuguacugccugccauaacuuccuuucaagacuguaaauugguacuucuuugggagaucauuuuagcaaaauauuuuaagcaugcauuccagcaauuccacuucuagacaauaccuuagaauagcugguuucacuuuuaacugcauauuuuaaaagccaugaaguuuaaaggcaacaaaaaaccaaggccuuccugagacaguugcucugggauugagccuaagaauuuuuuuaaaguucuacuuuuuuuauugugcagccagcauugaaaaagcuacuguccaagaaaaacacauacaaugcacagaagauaauguagaaaaauguugaagagcgauacaauaauugcaaguagccuaaaucccucaauaggcaugaagaauggaugaauaagugauguuuuugaucaguguaguacuuuacaauggcaaaaauaacuacuucuaggaauaucaaaucagcauggauaaauguuguaaacauagaguugagugaaauauagcaaguuucaaaagaauacgcaucguacaacacuauuuguagaguuaaaaccaugcuaagcaaugcuacauauuuguggauacauacauauguagugcaaguaaaggaauuccugggaauggugaauucuaaauucaggguaaugguuacaguuaggagaggaaagggaauacaaucagauuaugguaguaaacagggauuuuaaccauauugauuauguuuuauuucugaaacuggguaauggauacucugguuuauaauacauaucuuuuugaaucugucuaaaauguaaaauauuuuuuaaaaugaggagaggccagaagaagucagaaaaagguacauuggcaugccauuuaaaacuuaauuuuaaaaauaucugugucucuugaguuuguaaagugauuucuuuucaauuaaauaauaugugacaaaaaucguuguaucuguaacuuugugugauuuauguuaauauauuucuucuguuuucuuuagccuuucaaaagcaaauugcuuaugauaaucucucagaaagauacauuucauuccuuuuuucaacacuucagcuacaaccacaugauggagaaaauuaagaguuaugugaauuaugugcuaagugaaaaaucaucaaccuuucuaaugaagguauacauauuauucaagagugacuaauaauagacuuaaaggaaacguuauaauaaaggagaauacuugaaauagaaauccuuuaaaauuaaucagaauuuuucauugugguuuuguagaaaggugugguaaaauguuacauuuuguggaccuaauuaaaagauuuaugagugauauguacuuuuguaacuuuucaaaauuaguuuggggaaauuuucaaaagaaaaaguugaagggaaaacuuagaaugaauuaaaaauaagaaauaggcaaaagcaaauauuuuaauuuaaguaaauuuuaaagacuuuuuaaacauauuuuuggggaaaaauagaauuguauuaaagaagggccuuuuaaaauuuuucuaggccaggcgcgguggcucaugccuguaaugcuagcacuuugggaggccaaguuucaggaguucgagacuagccugggcgacauggugaaaccccuuaucuacaaaaaaauacaaaaaaauuagcugggccgggcgcgguggcucacgccuguaaucccagcacuuugggaggccaaggcaggugaaucacacggucaggcggaucacacggucagguggcuaacauggugaaaccccgucucuccuaagaaaauacaaaaaaauuagcugggugugguggcaggugccuguagucccagcuacucaggaggcugaagcaggagaauggcaugaaccugggaggcagagcuugcagugagcugagauugcgccacugcacuccagccugggcgacagugagacucugucucaaaaaaaaaaaaaaaaaaaaaaaaaagcugggcaugguggcauacaccuguagucccagcuacuuuggggaguugaggcuguagugagcugagguugagccacugcacuccagccugggugacaaaaugagacccugucucaaaaaaaagacauuucuggucaggcgcaguggcucaugccuguaaucccagcacuuugggaggccgaaauggguagaucgcuugaucccaggaguuugagaccagccugggcaacauggcaaaaccccaucucuaccgaaaaaauagaaaaauuuagccagacauaguggcacacgccuguagucccagcuacuuguggcggcugaggcagaaggauugcuugaacccaggagguugaggcuguagugagcugagauugaaccacugcacuccagccugggugacaaagugagacuugucucaaaaaaaaacacauuucuagucaggcgcgguaacucacgccuguaaucccagcacuuugggaagccaaaauggguggaucgcuugagcccaggaguuugagaccagccugggcaacauggcaaaaccccgucucuacaaaaaaauuacaaaaauuuagccaggcauaguggcgcaugccuguagucccagcuaccuaggaggcugaugugggaaaucaccugagcccaggagguugaggcugcagugagcugugauugugccacugcacuccagccugggugacagagugagacccugucucaaaacaaacaacaauaaaauuuuucuaauaacauuuuauuuucugucuuggccuccaaauuuuuaaguugacaguguuauaguggagcaucuugauugauuugagauaguuuuuauuugaaaauaucuagaauuuuuauuuuuuuuuuuuuucaugcagccuuuucucuuaaaauugccuagagagcauuuugucuaucaaauauauuuacaaggaaagaccaccuucguaacgcugauaaaccaagcagauagcuaauguagcugcuggcagugucauaauuauuggugaaaauaacaacacagugcccuucauuggccugugaacagauacauuagcuaugacuaucaaagaauuacaaggcuuaauuuaaugcuauuuguuuaaaauggcuuaaugcauuucuuccuauccuucuaccuccacgcacguuuuuuaaggcagcggcaaaaguaguagaaagcaaaaggacaagaacaauaacuucucaagauaaaccuagugguaaugauguugaaauggaaacugaagcuaauuuggauacaagaaaaagguuuguaauuuaaucaauuuguauauuuuuuguuuuaugaauguucugucuuuauguaaaauugauaugucuuuuuauuaaaaauaauuauugaguagcauguuaucuugcugaugauuaacauuuagguauuugaaguacuguagaguuauuucaugacuugugcaaauuauauaugcuaagcaaaaguagagaauaagaaaauauuacaguuuaaauaauguggauaguuuaccauucuugggguaugcuuaggaacaagggugagguuggacuccugugccccuuaguuguguuuagauucuacauguucucauuaugugauucauguuucacuguacuaagagucuaguauuuuaagauauuauucauauaucuucucuaagcauaagcucacugcuucaucuggugcucaacugaagaaauagugauuugcuuuaauacuggaggaaaacaaguugugucaguccuauauauugagagauaguuguuaagucuccaaaauuauuuuuucuuuagggauuuucaggggugauuguugucuuuuguuuuagaagcuuaaguaucuuccccuauugagaaagauauaacucuuaacauuauaaagaucuucuuuucuguugaacccauggucuguuuucucuguucuucuacccuuaaaccaaggccagauaaucaaaucucuguggucucuggauggguauauuuggaaauggauguaauauuacuuucuucuugggaccaugaccuaaguguugcagggaccccaucuuaacuacuuauuuagagguggagauugggguucaaguuggaucuacacugcauuugucacaucuuaggacugagguucugucaucuuauaguggccccuccuauuguuccugccugucaaagcaugacuuguuccucagggguucaucucuccaaaggcuguacuaaagucuuauuucacauugauguacuuuuuucuaaacuccaauuuaagaaguagagauuccauuuuuauuggcccaauuacuuccuuuuguuucaaaaaucaaaguugaaugauacuaauacccaguacauucuuguggccaagccauccugcucaugauaauauugcuaauaccaugguucuuacagauaaucaugagcacacuuccuauggacucuccuuauauagugcuacccacuuauuucagaugcucuccuagacacaaacacagugcaauccauguguaccaaacagaacucuucauguucucauuugccucucuacacccugccucucuuuaaccucacacauccagcugcucuccaaguauuaggaaccgcaccucagaaaugcuucuccaaucuauuuuuaucuauauagcuuuguaccauucaaauccauccuugacauaacuucuagaguuagcuuccacaaaaauaaaucucuuuagaucacucccagcuuaaaaaccuuuuggcuccuauuuccuacuagaugagucagaauuuauuggcauggcuuauaaagccuuacguagacccauuuuuuuuuuuuuuuuuuuuuuuuacauacagucuuaucccuaagcaugaacuccucccuguccacauacaugguacuuucuagcagcacagaagcuuuguuccuucuauuugaauuccuaucauuuuauucucuccaaggcaagcucuuccuugccauucagucuaucucagagaucaccuauaugaagucuugcccagcucuguaaucagaguuguuacuucugugcuuucauagcauacaucucuauaaaaggacuuaucuucguugguaacuuauuuguuuaccugauucuuucaauagauugagaauuauuugaagguucuuacuuagcuuugaagcaucuuaauuagcuugguauccuuguugccucauucauuaccaggcauacauuagaacuugcuguacacuaguuacagggaacaaaacuaaaaccagaaacaggguaaagaucaagaaucgagcaaauaccaaaaccaucguggaagcagaaccagggcaaauaaagcaucaaaccaccagugucaugacaguuaccaguaaggauucaaguaaagcaaguauagaaucagaagugugauugugaggucagacaaauccuagaaaaauggaaaccuccauguuaugaagacuagaugaaauaaauauuuugcucugauaaagcuuauacaguuguuccuugguguuugaaggggauuaguccuaggacauccauccuucaugaauaccaaaauccauggaugcucaagugucuuacaaaaaugguguaauagccaggaacaguggcucacaccuguaaucccagcacuuugaaaggcugaggcaggaggaucacuugagcccaggaguuugagaccagccuaggcaacauggcagaaccuugucuuuacaaaaauuaaccagucuugguggugcaugccuguagugccaacuacuuaagaggcuuaggugagaggauuguuugagcccggcaggucugcaguaagcuguguuugugccacugcacuccggugacccucggcgagacccugucaaaaaaaaaaaggggguguaauauuuguauacaaccuacacacauccucccauauacuuuaaaucaucucuagauuacuuaaaauaucuaacacaguguugaaauaguugagauggacagcuucauggagguaguagucuugaacaggggcuuuuguaggaugguuaagauuuuuacagauggauagaagaggaaauaucauuuuaggagagaggaauauuacuagugaaagcauggagguguaaauagucaugcuguguguauguggaaaccauuuuaacuauaacaaacgggaacuuaaucgauucccaaaaguucaauuggagacugguggggagaaccagaaauuaaaauugaacccaucaaauuguauacuuuaaacaugugccaugcuuuuuauguaucaauuauaccuuaauaaagcaguuuuuaaaacuugaauucauggaaauaaagugccguagaagaguuuuugaaagaguguuauaaaugcuugacuacaccauuaauuaugcuuauguuuggagaaacuugguuuaauaccucuuauaagcaugucuggacaagaauuagccauguuguaauggacuguauaugucccgauguuaccaagguuucuuuccaaaguuauuuuuuuauaaauugaaauaugccuugacuauguggaaaguacuauccuuaugaaaaguuucuuuuguuuacauucuuacaaauuuuuucuucuuuuaaaguguuagugacaaacagucugcgguaacugaauccucagaggguacaguauccuuauugaggugaaguaaauugacguuuuucuucuuugucuuucaaaucuuugauugaagcaauucaugcagaccuaauaaaaacuaccacauaaaugguacaauugaaagaauaucucaggguccuaguuagcccaacagauagucacgacucugagacaucuugaaauuccaaacuguagagaccugcucugagacuggguuguuucacauuguuucuacaaagccauuauuggaauacacauauagggaguucuugagcuuaaaacagauguuuaguaaacacuucucugucacagaaacaaagauaugauacuggggcaggaaggggauggcaauuacauuucuaaugaaugccccaugccaauuuuaugaaaguuacuugaaaaacuuuauuugaucuaauagaaucgcugugacagacaauacaaccugucccgagggcagaaagucugcaugaaugauuucuaacauagagcaguugggaucacaaguggaaccauggggaggagguggcugacuucauguggaggaggugauuggacaugaggaacugagaggccaagaugguauaugaauugucugugagaacacugaaauaauucauaauagcagcacuuagguguagagaaagaucugugaaugaugaagaagugcuuggaaggaugguaaauggcugugaagaaugauugaaggugauacaucucaguggcaugaauccucaaggcugaaguuucuauggaagcaggaucuugaaaguggcauucauuaggaaaugaaaacugcugucucuggaguccuauaguuuauggaggguggaagauuaagccaaucucuacuugagaaggcuaccaaggagagaaacauuguccccaggggaaagcuagauuuuagacaaggcaaagagcggagaggaaugggugaagagauugagaaugacauucuagaaaggacaauagaaagucuuaggaaggagggacagaggggaagagagaaaggauggcuggucaccuagaguaucuauagggauaaaaguauagcuaaaauaaccuacauuuuagguggagauaauacagcugccuaagcuuaggugaacugcuuuuugaaucuuaguuugcuccuucauaaaauuggauuaauauaauaccaauuuggcagaguuuucaaaaaaaaugaugccacauccuguguuuccaaacagccuuaccuuucaaaacucuuuuuggaagcuguaaagauaaucaagugauaccugccauuauguaaaggaauuuuggaauccgucuuuggggaaauaaaagccauaagagagaaugaaagcuaauacuuuguaguuuaaggauuuuuuuccuugauguaucuaauuggaaggccgaaagagucuugucuuuucuuuuuuuugccugcuucuucugagacaucaaaaaacaucuugauuucugcggaguagaugagauggagaaagaugagacaggcaacagaaaucuuaagaggccacagguuaagaugggguacuaagcagggagagcaccaaaggaaguaggccaaaguauuaauagaagauccuagaacagauuaaggcaaaucauuuaccuguuuuccauugccuuacuaucuuucuggagccaauuacaaacuuuccuguuuuauuuuaggucucacaagaaucuuuucuuaucuaaguugcaacauggaacccagcaacaagaccuuaauaagaaagaaagaagaguaggaacuccucaaagugaguacuguuauaacaguuuuagaaggggagaauugauguguccucaaacaauccagccauugacuuuaccacuauagcaaaaaaacacacacuucagaaaacugaagcacaaagucuugacuucauagaguuaauugagauaguguuuaauuuagaaaguuagcuauuuugacugucuagcuuaggguucuuuugcuauggugguacacugcuuuucuaccuucacuguguucagcaacuucaaguauagucauaugccacaucaugacauuucagucaaagacagacugcauugcauauaggauggugguccuguaauaauguaauggagcacauauggaaacuugauaauguggcacuugauauuggcauugcauaucaaguaggggaaaugauugauaauuagcaaugguacugggaaccguggguuuucuauaugaauauauauauauauauguauguuuguguaaguguacucuuaauaauguucacauaaggacaaaaucacccaacgccccauuucucagaacauaucccccuuguaaagcaauccgugacuguaguuacuuuucagaaacauuaaguacaguugauucuuguuauucacaguaguuacguuuaauaaagucugagagcguugacuuagcaaauuacaaguuucuuuuugguauguagucauuuaacaaauguuuauugaccccacaguaauauuuuagguacugaacugauacugagauuuuuuuuuuuuauacuuuaaguuuuaggguacauguucacaacgugcagguuuguuacauauguauacaugugccauguuggugugcugcacccauuaacucgucauuuagcauuagguauaucuccuaaugcuaucccuccccccuccccccugagauuuuuaauauggaucuaaaccuaaauacuuauugauaaaaauaauagacauaaugaaauuagguuuauuucuccaugcucauaagguaccaucuuggugccaggcaaaugauaggccugcaguaaauauuauagaauaaauuuguucauaccugauggcugaugacauggcaaccauuagcaaauauuuguaaauagaguucuaaaauauuuacauucauagauaucauucccauuuuuaaagaugagaaaacggaaacucaguaaaguuaugugcuuaauguugguggaguuccaagauugguuuucuauaccuauugcugcaagacggcugggaaucauuuuaaaugagaauaaugugagcauuuuccuaggguuuuaauuucauaguaugaaauucaaagaaaaggaaauguaggccaggcgcaguggcucacgccuauaguccuagcacuuugggacgcugaggcagguggauugccugaagagcucaggaguuugagaccagccuuggcaacauggcgaaaccccguuucuacuaaaaauagaaaaaauuagccaggcaugguggugccugccuguaaugccagcuacucaggaggcugaggcacgagaauccagcuugaaccuaggagguggagguugcacuccagccugugugacagagcgagacugucucaaaaaagagaaaacaugguuuaucagcaaacucgaagacuauaaacucuuugcaaacuggcuugacagugacuguggcuauugagucuauaaggucuuugaguuuuagcacauuuuauuaggugucaguaauaaguacguuuucuuaaaaaaauucaguguacuucagugguacccagguacccccucuuuauaguuugaggcuaauaauuuuguuugugcuaaaccuuuuuuucucuucuuuuucuguuuuuggagacagagucuuacuuuguugcccaggcuggaaugcagugcaguggugagaucuuggcucacuguagcaucuaccuucccaggcucaguugauccucccaccucagccuuccaaguagcugggaccacaggcacaugccgccacacccugcuauuuuuuuguuuguuuguuuguuuguuuguuuugagauggggucuugcacugucacccuggcuggagugugguggaucaaucucggcucacugcaaccuccauuuccagguuucaagcaauucuccugccucagccuccugaguagcugggauuacaggagugugccaccacacccggcagauuuuuguauuuuuaguagagacgggguuucgccauguuggccaggcuggucuggaacuccuaaccucaggcaauccgcccaccucggccuccccaaagugcugggauuacaggcgugagccaccacacccggccuuuuuguguuuuuuguagaggugggguuuggcauguugccccugcaggucucuaacucccaaacucaagcaaucugcuugcuguaauugugcugagauuacaggcaugagccacugcucccagcccuaaccuuuuuuucaaaaacuaauuuuuguguuguaaaauugacauaugcuuagggaaaaaaaaucaaguuaauucagaaaacuugaaagaaaaagccaaaucauccagauuucaucagugcagaaaaacucaccagcauugagugaaauuauuaauauuugaguugaaagcuuuuuauagguaaaugcauucaauccucaaaacaaccuuaugagauuagugcuuuuuuuuuuuaucaucuccauuauacagaugaggaagcugagacuuaaaaagguaaauaaaaugccuuugguuacacaguguaugaauagaacaggagccaaaauuugaaaucagacagucugacuccagagcccaggcuuuuaauugcuuagauggacuaccucaguagaagaauguauagauugaaagcaaaucaaauuuuagaaaaaugucaucaaguuacauauguuacuuuaaaauauauuuacauuuaauuuuuaauauguaaaacugaaggauucaguacuucagauaaaggugguuucacaagaaaucuaucaguaaccuuuaugaucuguguaaaauaaagaauaugaaaugcuuuaagaggucauucaacuuuaguuaaucaacuuuagucuguugauugaccuuagcaaaaauuucuuccaccaauccccaaauuuucuugguuauauuuuauauaaucaauaguuguagcauuguuuucccauguuggauuuucaguucaaaauacuuuuucauuuuuguagagacuuuuuuacugaccuaugagggaaguuguuuaauuuccaaauaucuuucuguuacugauuuuuaguuuaauucuauuucagucugugaauaugcuucguagauuuuuuuuuuuuuaagauuuguuuuauggcccacaguaugguuuauuuugguccauuuggaugugcacagagaagaacgugaauucuggcauuguugaaugaaguguuuuaaaaugucaauuaggucaaguuuuuaauaaugcuguucagguauucuauauauguacucauuuccugucuauuguuguaucaauuagaaaagugauaaaucucccaaauauaauuaugaauuugucuuuacauuuaugugauuauuugcuuuuugcuauuuuaguccccuagcaccuguuuaaacauuucuccuaaugcuaaaaucucuccaucagagcuagugugguuuccauuuuccugacuggaacacacccaguauauaugucaaaaucccauauaugucaacaucccauguuuguaguaggguaaucuuauuguuuuucaagaguaucuugacuauucugguguuuugguguuccauauugucagggaaaaaaccuagccauagggcuuuauaagcaguaaaccugcugcuacuuuauagauacaaaagguagacaacaagacuuagugacuuaaugaguuagaguaagacagauuauuauagcaaacaacauggcauugauguaguuguucagauuucccuaccccaaguccgguggacuaugcaacaggccuaaauggaugcugcgaaggcaguaaguuauauuucagcugaggaaaacucagagccaagggcccagugcuuuuugaguaagcaacaaaacauuguaacaaauagcaaacaagccaguacccucucccaggagagagcaguuggccuggucaucauguugugguuuccuugaccugcuuaauugccuaucugacuggcuauagaaaaugcacuauuucaggagaugaauaaggcuuuucuacauucaacaggaauugcaggggugcucagagccaauaguggacuaccugucuuaacacauaauuuuagaauaauuuuguuaaacuauacgaagaacccuguugagauuuuuaugugaaauugcauuguuaacaauagaugauuuugcagagaacugacaccauuacauuaaguuuccugugcaugaacaaaauacauuucucuaacauguuuuuauauauacagucaucccuugguuuucacaggguauugguuccaggacccauccccccgcccccacagcagggauaccagaauucucaaaugcucaagucccuuacauaaaauggcauagucuuugcauauagaccugugcacccgccuaccacaugcuuuaacucauccccaaauuacuuacaguaacuaaaacaauguaaaugauaaauaacuaaauuguaguaaauaauuguuagacuauauuuuuuauuuguaucacuuuuauuauuguaguuauauauaaauauauauaauauauauuuauauauaauauauuauauauauaugaccuaugagggaaguuguuuaauuuccaaauaucuuucuguuacugauuuuuaguuuaauucuauuucagucugugaauaugcuucauagauuuuuuuuuaaagauuuguuuaauggcccacaguaugguuuauauguaauauaauauauaauauauauaauauauaauguacauaauauauaauuauaauauauauaauaauuauacuacauauaauauauaucauauauuauauaaaaccccauauauacuauauaauuaauaauuuauauauuauaauauauaauaauuuauauuauaauauauaauauaauaauauauauuauauaauauaauuuauauauaauuauaauauaauaauuuauauauaauuauaaagcuuuacuauguauauaaaacauguuaugagaagcuuuaucuaucuuaucuaccuaucuacuuaccuaccuaccuaccuaacuguuggcccucuauauucacagauuccacaucuguggauucaaccaaccuuggaauaaaauauuuggggggaaaauacauauaaauuuuuauauauaauauauaauauauauuauauauguuauauuaacauauaaaauauauuaaauauauuuauauauaauaaauuuauauauuuggaauaaaauauauaaaccuuggaaccuuggaauaaaauauucgggggggaaaauauauauauuuuuuauauauaauauauauaacauaucauaaauuuauuauauauauuauauauuauauauaacauauauaauauauauuauauguauaauaauauuauauuauauauaauauauauuauauaguauaauauuauauuauauauaauauauauuauauaguaugaaauauauauuauauauaauauuauauaguauaauauauauauuauauauaauauauaguauaauaauauauauauuauauauaauauauaguauaauaauauauauaauauauaauauauaaauaugauauauaauauauauaaauaugauauauaauauauauaaauaugauauaauauauaauauauauaaauauuauauauauauaaaacauauauauauuuuuccccccgaauauuuuauuccaagguugguugaauccacagauguggaaccugcgaauauagaaggccagcaguagguagguagguagguaaguagauagguagauagauagauaaagcuucucauaacauguuuuauauacauaguaaagcuuuauaauuuacuacauacaaauguaucacuuuugauaaaguuaucuaagaggccaugaccugauggcucauaccuguaauuccagcacuuugggaggccaaggcaggaggauuacuugagcccaggaauuaagagaccagccugugcaauauagugaaaccaugucuuuacaaaaaaauuuuaaaaaauuagucgggcauggcggccggugccucuaguaccagcuacucaggaggcugaggugagggaggauaaggcagaaguaucacuugagcccaggaguuugagcugugaucauaccacugcacuucagccuaggcaaaagagagagacccuaucucuuaaaaaaaaaaaguuaccucuaagaauguuagauuuuuuuguggcuauuguaaauaguaucuuuauauuguuuuaauuaaauuauuuuaacuguuuguugcuaaugaauagaaauccuauugcuaaugaaugaaauccuuuuuguguauugaucuuacugaucuuuuaauucuauuuguagauucucuuagguuuucugccuaaacaauuaucauuuuucaguaauuacaguucuguuucuuuucaguuacauauauuugucuuaccaaacugacuaugaauaagaaagaaggagugaggaaaggauuaugcuucuuaguacuccuaaaacauuaucguaagaaaauuucaacgauccuaugcaauaaauauuuuuccuuuuuuuuuaaacagauaauggaaagacagguucagggaugugaaaugauuuauuuaaagacauauaaaagaaucaagacucaaaacacucccccucugauuucaaaggcugaucuuugcacuauaccauacugcuuccagauuugaaggaaaaaguuaaacauguacuuuuucuuagaauagcuuagaaaaggaauuucauuauaaucauuaaaaauauaauugcucuuuuuucuuuaauguaaaucaauauuuaugacauuauuuuucuacuuuuagguacaaaaaagaaaaaagaaagcagaagagccacugaaagcagaauaccuguuucaaagagucagccgguaacuccugaaaaacaucgagcuagaaaaagacagguauuugguuuuuuaaaauucgaauaacgcuuauggacauuaaaguuauaacuugaauaauugugauuauuucuguucaaccuccccaaaauuuugaguguaaaauauuugcccuuugccaucuuuuauuuugccgucuuagauaggugacuaaucagccuauucaaaaugaaauacuucacccauauuuaaaaagucuuaaguuggguguugguacugacaucuguuuggaauuauugugauacuaucauaaaaucuguuuauuagauguaaggugggacuuaacuccacauuauaagcuuugauguuuaaauuuuccuaacagggauccaguguaaaaagaguuuucuuuacuuaaaaacaaagaaaagauaccauuugaucacaaaauuuuauuaaggugggucaauuuagggcuugauucauuugcuuccccuuucagugacuauagucuugugccaucuguccagugucugaaaccauuauuuuauguauuuuuugauugucuaguuguucacagcagauggauaaaucuggucuuuguuuuugugguguguguguguguguguguguguguguguguguguguguguguguuucccccuuuuuuuuguagagauggugucucacaauguugcccaggcuggucuugaauuacuuggcucgagugauccucccaccuugggcuccaaaagugcugggacuguaggcaugagcuacugcacccagucaggcccuuguuuucuuuuguggcuggaaccguuuucuuacucgaaggugccuuuuuuuuuuuuuuuuugacaagcuaauugcaaauaguucauacugaggugcugcagauagugucaaguugcacgcuacucggaauaucuucugugacucaaaguuauguuacccuucauuucucccccagugaacauagcaagcaacuucuacuuuucauuugcuuccuacacauauuacuugccuuugugauucccuuuuuuagccuugccaucucuggccuuuaguagguugaggggagcuccugcuguugcugaccagagauuuaggggguguaccucaggguauuuucauuagaaaaacagauggcacacacuuccugagaucuguagacagaguugcuuuuucauacaccuaaguugcacugauuauuuauacccuuucuaccuacauuaugguucagguuguaaauuucucuuaacuuuuuucagaguuugggauuuuauuucuuguugcuuuugggugaauucccaaaggagaagagggaaaugcuaaccuuaugcuaccauaugugaccacagucaugcauauguuuugugcuggauuuuuuuugcaguuugaauaugauguacauguauauaguuuguuauuuauccugcuugguauuuucugagcuuccugaaucuguaguuuggugucugucuuuaguuuuggaaaaugcucagccauuauuacuucaaaucuuucuuuuguuccuuuccuucuucuucugguguucccauuaugauuccaaauguuacaccuuuuaagauugucccacuguucuuaguuauuccuuuaucuuuuucauucuuuuuucuguuuacuuuucaguuugagaacuuucuauuaauauaucuucaaauguacugauucuuucuucagcuguguuuaaucugcuuaugagcccaucagaggcauuguucauuucuguuaccauguugauuucuggcauuucccuuugguucuuucuuagaguuuucaucucuccauuuacauuuacccaucuguucuugcauguuguccacuuuuuccauuaaauccuuugacauauugaucauaaucauuuuaaauuccaagucugacaauuucaaaaucugugccauaucuugagugugguccuggugcuugcuuugucucuucagacuguguuuuuugcuuuuuagcauguuuauaauauuuugcugauagcuagacaugauauaucagguaaaaggaaaugagauaaaugauccuuuaaugugagguuuuauguuuaucugucuaggaguuaccguuuguagcuguaggugucaaaggcuaaaauuuccuuuaguguccuguuuuugucucucuuguugucucuggguuucccuagagacugcuuuuuaauaagaaucugagggaccucuuucaacuauaacgcccaggauccugacuaauguagugguaagguaaggggaggugaagcguucuggaguccugugcauaguucuccuucuuuuaguaagccuguguccuaggcugugaccuucauaagugcuucucagcccaccaccccuugggugagacaugaaggcuagagagggguggaguugaguauuuccacagguaaguuagguucugguaaaaccucaguugguuagguucuggcaaaauuaguuucucuugaggaaaggauuuuguuaagaagaccagaacgcuuuccucauuuauuuugaaauggggaguauuucuaauuggggaguauuucaaaauggcuacuuuuucccuccgccugucagaagcaggaaggaauuuuuguguaaucuuuacccugagaccugggggggcuccuggagauaaaacucacaaaaguuugugagucccucugaaacugggcccuuggaguuuuuaacucugaagcuuauccacacggauccuccaucaguuccucagucacaguuaauugcuccuaccaguauuggcuccagcugugagcuucugcuccuggccuuucuguccccaguaauucuugugauuuucucaaucugccucucucucucuuuaguuuucaggacagcaguuugcccugugacauuuguucuuugauguaucuaagaagaguuacugaguuucaguuuguucaacagcuuuuuucuucuggggacuguagugaugauuuccaagcucuucacauguuagauuggaaaccagaagucucugucuuauacauauaacugaucuuucccuauaguucuuccagcagccauuccaaaugagguguuauuuacagauauauaugaggaaaacaguuguuucucuucuauucaaaacgaaauauaggauaucgaccacauaaucagugauaauaucuaucaccauuuccuaugccaaaaaagaauucuguggauaucacaagggccugguuuuauuuuuuagcuuuccguuguuggccuuuuguuaaaauacuuguuuuagaagauaagugacagacuuaauuuuauuuuguauugagguuuuuaaaaaaaaaaacuuacggcaauagcccaugucuacuuggacaguuuucuuuugcugcauuggucuguuaaagauauuucuuccuuccucaucagaauuaaagagcccuccuuuuauaaacuuauuccauuaaagaagaaaaguaaaugccuuucaaacuguuuuccauaaacaguauguaaugagaaauacuguagcaguauuuucuuuuacuauucguaguaucauuuuaaggcauuaaaaagcauuauuuguucuuuagaauggauauacagugcagaucugaguuauguaaucucuagccuugggaaagaaaaagauugguguguuuuaauuuguuaugugcucuuuguaucuuuucaggcuauuggcauggcugggguuguuaagauuuuguauuugauuuuuugagaaaauaaaagacaaaugacaauaaaacaaaggaaauggguuguauggguuuaauguccagaaauacaucaucuuaaacucuucccuuaauuauuacuaucaguggaaucugguacaaucaguuaaauguauaaaaugaggaaauggaaaguuuuaagcacaauaguagacuuuaugaaauuguacugcccuuauguuuucuuucugaucugacacaggucaguugugucacucauuaaacucuagcuauagaaaguagaaguugguaccaaugacuacuaggccacuugaaccucuaaacuuaaaaauuacagcuuuccuuacuugccagacgauagcuuauucuguaugauguuuucaaaacucuuucagucacagguaaaauuaagcaaagacugaaaacauucagaucaagcaaaacaaucaaggcauaaucaaccaugaaauaacacuauaucaagcuaaaguuacucuuuuucaauagaagaaaaaaauaaaauacuuaaugcuaaacacuguuaguuuucaguuaaucuauacugacaacauuacuacuuuccucuagguuaggggugagcaaaauuuuucuauaaagagcaagauuuauaauauauuuauuacuaauguauuuuauguauauuucacauacauaguuucuguuacauauuuuaaauauauuuuuuaaaugacuuaaauuuuaauaugguucuuagcuccggggcuguagaaaaccagccuugggcuggguuuuggcaguggcuugcuguccccugcuauagaugauacaugggaaaauacugcuuaaacauacugcacccaggaccccaaauaggauucagaaaacauuggucauuucuugaaagaaaggggcuuuuguauuguaucaaacgucaucugugcaccuuauuaaaaauacuacagcucagauaagaacaagaaaacaaugcuguauauguguaugaaauuugucuaaaccacaaacuacuuuuuaaagcugaauaacguauauggcaaguuuuugaaagaacagaaaugcuuaacuuggagaccauggaguugauaggcucuuuaaagagaguuuauguggcccccaaauuuguauaugaaauuuuagauacuauacuuuucuguggaguacgucuguaagauuuauaugaccccaaagauuaauaacccacuguugaagugcuuuuaaucagucaccccacacaugaaaaauuuauuaaugcaucucuugguuuuugucaguuaaugacaagcaguguagugagguuuuguaggagugaaggccgagucaggcaguaauagauggucauaggaggcugucagccuuugucuagcgauugaauagccauguacuuguaagcagcacaguugccgauaggugugcugcagacaaacaaaagcaaaagcacguacagaagagaccagguucguaucuuggauuuaagucacaaagcagaggaauagcaagaacaggggaucagguuuaagguagcucaaacaaacuucugcauggguuugguuacggucacugccaacuuuuugguacugagucauacacgagaugguucucaugucauguuuguauucuucaggccaccuugaauucuuucuaauauugcauuagacaauugaacuggauuuuuuuuucuucgauuauaguaaaguacacaugauauaaaauuuaccauuugccauuuuaacuauuuuuaaguguacaguuugguagcauuaaauauauucauauugugcuaccaucacuaccaucuaucaauagcacucuuccucuuacaaaacugaaaccguacuccuuaaacaguaaguccauuuccauccucccagcccccuugccaccaucauucuacuuucuguuuaugaguuggacuauucuaggcaccucauaucagaaguagcauaguauuuuucuuuuucugucuaaccuaauguccucaagguuuauccauguucuagaaugcgucagaacuuccuuuuuaaggcugaauuauauaaguauaauauauaauauaauuuuguuuauccauuuaucaguugauggacaguuggguugcauccacauuuuaacuauugugaauaaugcugcuaugaacauggauguacaaauaccucuucaggucccugcucucgacucuuuuagauauguacccagaaguggaauugcuggaucauaugguaguccuuuuaaaaaauuuuuuggguaacugucauacuguuuuccauaguggugcuauaauuuuacauucccaccacuagugcacacagguuccaauuuauccauauccucaccaacacuuauuuuguguuuuuuugauagcagccaucugaaugaguguggguugaugaaccggguuuuuaaagaaaaucugaagugcuggagaauuucuuguagucuagacacaguaaauaaccacgcagauggucaaauugcucuuucagcaugccaacagaaggaauaauuaguuaguugccuguagcaaaugccaaguaucaguaauuuuucuguguauaguauuaaauuugauuuuuaaaaauguuuaggaauuuucucccagcauaaaauuaaauguuuuuaauuaguuuauguuaguuguauuuuugaaagucuauuuuagacaagauuugaguuuuauauggguguguaauacuuccccuaccauaggcagaacagguuuuucacugaguucauuagugaacuacuaaacauucacaaagccuauuuggagauuuggaggauaauaaauacaacuauuaacaauuguagaagagcauuuuaagagacagugugggcuuaaagucagacaaauucaguugacauguagcacugccacuuucuagcuaucugaucuugggcagcugagcuuacauaaaaugaacaguaauaauaaugaccccuaaaaauguuacgauaaauguaaaaucuuuuaaaaaucuaagaaauguuuagagaagucuuccgucuuuaagaaacuaagcauuauuuugauuuuuuaaaacuggcauuuauaguagguauuuucuuuuugaauaauuguuucuguaaauaacuguuuuacuuuuuaucaaaaggcauggcuuugggaagaagacaagaauuugagaucuggcgugaggaaauauggagagggaaacuggucuaaaauacuguugcauuauaaauucaacaaccggacaagugucauguuaaaagacagauggaggaccaugaagaaacuaaaacugauuuccucagacagcgaagacugauuguguuuguaaaagcuugaugaaaggacaguuaaguauuuugaucacugcauuuuguuugaaacuugugucauugauguaauuuaaaacuuuuguuuaaagcauuacaguauuuuucugugaccaucaauuaaugaggguuugugcuaccagaguuaaagcauaugcuaucauuguauucuuuaagaaccuuauuuugauaaaauguaaauuuguugaacccugccacauuuaguauccccacccccaaauccuguuccaaugaaaaaauuaaaaccugauacgaaaaaaaaaaaauuccaguuaaccuauuuugugucuguaggcugaccucaacccuguaacguaacccauuaaaaugaauuucuuuuuuuuuaagacagaguuucucucuguugcccaggcuggagugcaguggcgcaauuucagcucacugcaaccucugccucccagguucaagugauucuccugccucagccuccugaguagcugggauuacaggcacacaccaccacgcccagcuaauuuuuguauuuuuaguagaggcgggguuucaccaugcuggucaggauguucuccaacuccugacuucaugauccacccaccucggccucccaaagugcugagauuacagacgugagccacugcguccugccuaaaaugaauuuucuagaugauugaauaacaguaguccuuugauagaagauaaugacuugguuuauggccuuaauauacuacuuaauuacuuaagauguuuauuaauagaaugauaaauguacagaguaaccuauaagcaugacauacuuuugcuuucaguaguuucauguaaagaaaaaaacuugaaaauaguaauaccugaguacccaugggaauaauagacacuggggagguaggguggggagcgggagcaagagcugaaaaacuuaccuacuggggacugugcucacuaccugggugacaggaucauacguaccccaaaccucaacaucacacaguauacucagcuaacaaaccugcccauguguuuccugaaucuaaaauaaaaaucgaaauaauuuuuuuaaaaaagaaaaagacaauaguauuacccaugggacaaaauuuguacuauuagcaagaaucauuuugugucucauuuagaaacaauuugacuuuuguuccaguguuuaaacuuugacaaaaaugguuuugaauagaucuuuauaaccugaugccauaaauacaagauucucugauaccuucauuuaauauaucaauauugggccuaaaacaguauucuguaaagcuuaaauugguauuaacuaugaucaucuugaugucuaugauagauaauaaacaaggucauacauaccuuacuaaacaauuuugguuuuucaccaacauuuuauucuuuaaaagauuuagacuaacagaauuauuuagcauuucgagucaugugcuuuauuuagcaagugaguaaaaauauuggaauauugaaguauuugcauaaaaaaucaaauggugguguuuuguaaucucuauuguauuuccuauuaagguuucauauauuacuuucccauuguuccugaauuuguuauccuauauauaaacagaaacauggaugaguaccauauac

SEQ ID NO: 191094 - RNA, 28730 nt, Homo sapiens
uuagagggcaggaaccaguuuuauuaacaucaauuuugugcacaucuagaaaagauagcuaacugaaauuuuuaugccagaugauaaccaaacacuuuaaauuauugcuguugcgguuuaugcuuaauuguaacauucucgaauaaaaaccaaagcaaaacuccaaaaagaauacugugauuauaguuaccuuauuccuuuuucuauucuuuuuuuccuucacuuguuuuucacuuuucucuucaaaaauggccauuaucccuugcuucuuuucccuucuuuccugguggcuguauuuauuuuuguucgaauuauuuuccaugagcacuuuugaaaaucagucuauuaagggauuuuagaguucguaaaucuuuuuagagugccuggggauagggcccuaagacuaagguacuuauuaaaaaagagugccaagaggucuuauauacuuugauuuuuaaauuugaaaauaaaaacuuuugguuuuucauucaucacuuggacuacauguuucaguucugaacuauuucccuugggcuuugcuaaaauuaauaacaagcuuuucaaaacuguuauuuaacaguuaacuccucuagcccauaaaauuuucucaagaauagaaauaacaaaaauuuaacuucaauaagaaagcaauuacuggucauccaccaaaaauuaaaugcauaaggugaaaaauuuauuuuauacaccucaauuauguuaaauguuauaacacauaucggaacuauaaaagcaccauugcuuuauugcuauuaguaguuguuguaccuauaccuaucaguucugaaggauuuuuuuguuuuauuuuuggugaaauuuuaucauucucugacugguccagaaaauuuggguuauuuucuagucaaacaaauauagagcuuuuauaaaugugaacaaaaaguuuauuuacuaguauaaaaauuuuaaguaacaggccaggcgcaguggcucacgcccauaaucccagcaccuugggaggccgagguggguggaucacgaggucaggagaucgagaccacccuggcuaacacagugaaacccugucucuacuaaaaaaaaaaaacaaaaaauuagccaggcgugaugacggcgccuguagucccagcuacuugggaggcugaggcagaagaauggcgugaacccgggaggcggagcuugcagugagccgagauggggccacugcacuccagccugggcaacagagugagacucugucucaaagaaaaaaaaacuuuuaaguaacauuggaaauuacccagacauagcuucaaaaaucuagcuuaauaaauguuagaaacaguaugaaaauguuaauacugacuuaaaguugcuagccuugaugagacucacauauuuuauuauuaauuucugaagaauuuaauuuuccacaaaaacaacuuugacaauuaaaugaaaauacaguaaaaaauauugcuacucucgguguuauuaauuauuggggaaaucuccauccuuauugcuguugugaaucugucauuacaugauaaggaccaagaaauacguauuuuaguaaaucauuuguuagugaauauuauucaauugaaaccaaagaaaucucauguaguuuacaucucaagacucaauucucuaaacuaaauaucuugaauuuaaaauuuacuucacaaaugaaaggggcuuagcuuuuccagcacaguguuuggcaaagucaggcuuuucauggaguucugguugaggaguccaaauuuggcucuguggcugacugcagaaugacuugucaucccagguccuuaaacaugccauuuugccucuaggucauugauuuuccaaucauaaaauaaggagacuaacauuuccuugugugugugugagaucguagcaccuguaaugacgucuaugccuuccauaaccgacacaccauccaccccaaacauuagaaaaugcaugcgguaggaaaaaaauagugagcuuacaucaacuaaacuugaagcuggacucugaaagauuauuuuauucagcuucaggcuuuaagccuuggaaauaaucuuagaugcaaauggugguagaauuuucagaaugaaagcaauuguuucauucacuggugucaacauuucuuuucaugaaaauuauaacauuuaaaagaacucccauugaccuacaaugagcauuugauccuuucacuucuuaagcaaaaaaaaaauuucuucuucaaaaaauguuuuuaguauaacuugguuuuucauuacagaaugcuuacuaaaauuuuaaauaauuugcccuguggaaaaauuauuugugauaauuugcuugaaauuauuucagaauuuauggaauauuaaauauauggaaauauauguguagagugugcauaccuguauacauguuuuaaagugagaaacuuuuaaaagauuauaaaauagacugcaagguucaaaacauagauccccuuaaaugacacuuccgucaccaauaaucggacugaguuacaguaauuuuacuuuagcaaacagacauguauucugugucucacgggccaccugcugaaugagaggacuccaguugaaaggucaagaacauaaaaccacaagagcuuuuugagugggucuucaacuuaguuaaaauaaaaauaaaggaccuguguuccuugagaacuggccccuaaauuuucuuucucuacuucagaguguggcaaugauguguuuggggacuuuggccaaaauugaagguuuaggaaacauugaacaugacuugagaauauuuagaauguuuacaaaugcauuuggaaauauuuauaucaccaucuauauaaaaauaaaacugugaacagcuggacaagaacacuggucuacucgccgaacuuuuuuccaaguuccuugacaccgaggauuaccaauugcuugccaauggagagucugauuucugaaacgauauuucgaaaguguuaguuacacuaaaagcauaccgaagaaaggucuaauuuacagaauuaaaacucggaguuaaaaaaaacugaucacagccugagcaauauagugaaaccccgucucuacuauauauauauauauauaguuuuuuuuuuuuucuaauuagccagacaugguggcacacgccuauggucuugggaggcuggguccacaggugcaugccaccacgucuggcuaauuuuuauaaagaaaaauuauuuguagggauggaguuuaacuguguugccaagcugaucucaaacuccugggugcaagggauccuccugccucggccuccuggcucacgcugggauuagaaacaugacccacugcacccgguuccccaauuuuuuuuuuaaugaucacaaacagaguuucccuuguuuaguuucugucaaagcaaguuuuaauucauugcuacuuuaggacacccucauguugacagaguaacuugggguuacuguauuugcuuuucccguucuaucugagcacaagugcugcauaaaggaaaauggcugacuguucuauguguauuuaaacugggaggucugaacuaaaugaucucuuuuacugcuuuccaacucugauuucauaaugaaaaaacaaugagagagcugaaaagaacaaagccagauuauuaaaauuauuauuuuuaaagucacugcuaccucagccaggguuuaaauacuauauggguacaaauuaaauuauaaauucauuuaaaaccaaaacauggaugagguauucagaaaaauauuauguaaauauuuucuauuugauauaaauuccuuacccacuuuauuguucuuauggugugcucaauggaggccaugaggcacuagugacuaauaaacauaaauucuaguuauuaaauaugaaaacauucuacaggaauaauaauugacuggaaaggcccauauuuuaccuuuuaaucuguauuucuaccaguuacaccugacauacugaaaaccauaaucuaugugugaccuaaauuagucuuugcccaauaguugcccagcacgaaguugacucuucuuuuaguuuuguauaguguuaucaaauuuaaacacuaaauaagugcagaacugggauacaggugcaugacuguaaaauguuuuuggagucaauuauuucagagaaaucuacagauuuauauaagauuauuauaccgcagaggugaccccaccacugucucagucaggguuuuaugaagaagccccauugagcaacaguucugaaacuucaucguggguaugaauuaccugggcagggguccccaaacuaggaccccguagaggccaaagccggccuaccccuucuuugugucuggacugugaguuaagaauaauuuuuauguuuuaaaguguuaaaaucaaaacaauaaugauauuuugugacacaugaaaauuauacgaaauucaaauuuuaggguccauaaauaaaguuuuguuagaacaaauccaagguuugcauagugucugugacuguuuuccugcuacaaagucagaguugagggguugucacagagaccacacagccugcaaagucaaaaauaucuacucucuggcccuuuacagaaaagguuuucuggauccugaccuaagacauuuuuaaaaauccaccuccaaagagugauucaguuagucggaaaugagguucaggaaucugcacauuuuacaucuccaucucacgagauucugauucuagugaucuucagaacaccacuuuggagugaucagguuuuuggugaucauuugggaaugugaucuaaacuccaauauccuuuuuuuuuuucuucuggagacagagucuggcucuaucacccaugccagagugcaguggugcaaucuuggaucacugcaaccuccgccuccuggacucaagugauccuccccaguagcugagacuacaggcaugcgccaccaugccaggcuaauuuuuuauuuuuuguagacaugggguuuuaccauguuguccaggcuggucccaacuccugagcucaagcagucuacccaccucggccucccaaagugcugggauuacaggcaugagccaccacucccagcccccaauguccaaauggacccauauuaacugcugguguauagggccuguggguuccauagugggaacuggagcccuggccccaggcagugccagaggaugguccuccucaccuacuguuuugacuucccagucaucccuugauauguuacauacuggucagcugucuggacauggagaggacagauuucucagaaugagugacaagaaaaguacuucaguuaauuuccauucuuacccaucggaguccaggccaucuccagaacaacgaaggcucacagaguucauagcuggaggcugacaauccacacacaccguguaucccucucggagauacugcauccaucuagucaagggccaguuuuccagagcacagugaggagucaaggacucugucuuaaacuccauacaguaucuacagcaaaagaaguaacaaugacacuugcuguaaugagcaguggccuaaagcuguagaaagucuuagaaagccugucaccuccaagggcauuuggccgacuggagcagguagugaguacaucuucacaaguuacgugucaaucaccuuuaagguuucucauucccugaagcauggugaaauauuacugauaaucacaaagaaccuuugugcccuuuuucaguccaucauugagcucucugggcaauauaaaugugcagaaguuuggauauccuguauccugucuaaucagaucacuaaauugugcacagaaguccagguuuuuguagaaacccaguccuugauaauuuugcugaucuaaaggaauucuauaaauugaacaagcacuugcuugagccugagaacccuaaaaaugugagcccaggagggcuagcccuuaacaccuaggucagcaccucugcuguucugcuccacgaaaguacccgggaucuuccccacccucuccacccaccucacuuguauggucuggaguaaugaugaugaguuuugacuugaagucaauuaucacaguuacauugggcaucgcaggugaaagcagaagugggaggcugagacacacuuuucugacagaaguuagugucaccuuaaacugagcugcggaaaacucuaacauuauaugugacuggacacugaaagcccaggggaacauccagacaugaggaauauuuuagaaauuuguacuucagugcaguuuuccaauucuucagggaaacaagacauaguaaaaucuccgaguauuguaacagaaacuuguggcauuuucaguuccaugggcuaauuucuuacccauacaauuaugaguugcaauauguuauaaaugggaaguguuuggagaaucugcuuuaaagaucuuuaagaaugauagguacagcuaauuaguaacuaaagguaacaaguaucuuuaguuauugagguaagaaauccuacaauguggcuucaaucaauuucagagagcuaagcccagacagcucuuuuuaaaaaaguauuuauuuuucauagagaugggguucucacuauguugcccuggcuggucucaaaccccugggcucaagcaauccuccugcuccagccucccaaggcacugagguuacagguaugagcaaccaggcccagccucaggcaucucuucaauguuauuuucucauuaaaugcucauaccaaccucaugugguagguuauuaacagucucauuuuuuaggaagaaaaaacugagguggaacaaguuguucaaggucuuaugcuagugagggcaguguggggaccugagcgugcagcugucugguaucccuuaucugacagcagaagaauggauuucagcugagcgugaaggugacuuccagccuguaccaauagguuuccauaagaaaccucugaguugaagugugugucacuuucaaauucaccaaacagagguggugcugaagucuaacgucccauaaagacuguaagagaagcauccuuaguaugauugauaaaauaagcucacaaaauaaucucauuuguauauaguuuguuucuuguugaagauuggaccuaagagguagauauaucuuuauagcuccacaaaaaccaggaggggacaaguauuuucccaacucugaugaagaguccauauuuuagccaaagucaaagagcaaguagaaagaagaagaaaacauaaaccaaguugacccucuugcauugacuugacuauacaauugaaaaacaugauuaaaaaaaaaaaaaaacacgaaauuacccagcauccucuguguguguagaccaguguggagacguagcuugucguguucucuccuuguugaaugcagagguaguuauaaaggcaggaacuggaaaagggagauuucuguugaauucagggagccaaaguacucagaccaucguuucccaauuuugguuuuguaccugucuaagggucuccauuccuaaacucacagggcuacggcacaccaucaaggugugaaaugaggccaaguuacaaauucaauaaagaugugugugcacacagaucgguagggagggggccugcaggccuuugacaagcacauuugucugcaguaauaaaacugugugagaggaaggagaggggccaggaggaaaaaccagaaggaaaggaagaugggggucagaaggggaacaagggaaaaagugagauaauagagagcaugaagagaagaggagguuucaaaaaugaaaggaagagaaauagagaaagaaagggagaaauaagauaauaaaagaauagaaaggaaacaaagaaggauagagagaagacaaaagagaguaaaagcggauggaaggagagaaaacagacaaacagagaaaaaaaugagaaaggaaaaaagcagcuggcguguuggcucaugccuguaaucccagcagugugggaggccaugguggguggaucaucugaggucaggaguucaaaaucagccuggccaacauggcaaaacccugucucuacuaaaaauacaaaaauuagccgggcgugguggcaagugccuguaaucccagcuacucaggaggcugaggcaggagaaucacuugaacccgggaggcggagguuucagugagccgacaucgcgccccugcacuccagccugagcaaaagagugaaacuccgucucaaaaagaaaaaggcagaagaagcagaggaggaaagaaggugagucuuccccaagccucagguaaccacagcaggaaaaguucauggaagcucugcccaccacauaguaucaauguggcugcccagugccagccugcacagcauuguccccacaccagcucagggaaagaaagucuucagugguccccuucuuuucccucuuccuccccacaacccucccccaacucugaugcucugggucagagaaaaaaaaauggcaccaagaauccuuccuccugucucugcucacuuuaauucuauuguguuugugugucuccucucuaccucaucacuaagucuagggaggcauuuguugcuauaauaacaccuauaggugucagucuccuggacugacucuguugucaucuugaggaaggcaggguuuugccuuguccaucacuauagcuucacacauuuacacacucaauaaauauuugugcaaggaauaaaugggccagugagugaaugaaugaggucaugggcuugcagccaagacacacaggcccuacuucccugcagucuuccguuccuauacugagccuugcagccaagauggcucagcaguccucuaccucuguuucagaaacugcgcgauuccaggaaggguagauacaagcugauaucaacuuaugagacgccaaagucaucaucaacaugaacucaacaaugugaggauacugguugcaaaauagaugcuugaagccuacauguugauuuuaccugucucuuuacuaucccaagaugacaaaccuuaacucuuuuugagcuuuucuuaaugaggaguuauuuuuguauuacuagggaauuuaagacaaaaggccaggcacaguggcucaugccuguaaucccagcacuuuggaagcccaaggcaggcagcucacuugaggccaggagaucaagaccagccuggccaacauggugaaacccugucucuacuaaaaauuuuacaaaaaugagccagauuuuguggcauucggccauagacccaucuguucgggaggcugggaaaaucacuugaacccaggaggugggggcugcagugagccgagaucacaccacugcacugcagccugggcaacagaguaagaccaucucaaaaaaaaaaaacaaaaacaaaaacaaaaaaaaacagacaagagcagcugccuaauaccggguagccacuuguuccuguguggcucuuuuuugcugcacugacauguuuaauuguuuucuaaaugugacuguagcguuugcauuucuaagaucuacagacagaauuagaaagaacaagagagugcauguauaucaggaucccucucuguuucucugagaccuaauuaucagaaacacaaacaucuaaaggauuuaauucucccauacauuuucauuucuguucuucagacacacauauguguuucuucacuaagugaagaaucaauuuacugcuaaauccaugcagcauuacacaaguccaccuguaauuuuuuggggauucuuuagcucagauauuuauguaaucaaauuuguacugcauauaucauuacaaaaguucaaaggcaagguacuuaauguauagcucagaaaaagaggcuaugaaguggaaggaaaacauaaauauaugauucuaguuucugauacaaaauucuuggaaaagguucuauaauaauaaaaauacgcacuucuaaguuuccagggacaacucuaagucacuuuucagguauuaauuuauuuaauucucacaagccucuugagauagauccuauuauuuccccauuucacagacaagaaaauuauggcacagagagguuaagaaauguguuuaaggcucacaucuaaauauagcacagccaggcaacgucuccgaaaucaaacuccucagggcggcacuccacugccucuguaauaauauagaugacaaaguuccaguacuguuugcagcaucuuucccaugaauuauuuaaauuuggcuuuauuuucccuuucugucacgaaucauuaugcucuaugugaagucagauuuaagaaaggaaaagagaaacuuuuagccccuuguaucuggagucaccucaguccaugagagagguaaggaggccagggagggcacacagugggugcagggucacccucuggguaccauggccccugguauguguauagccugcucauuuacaaaguaauuucacaucauguguuaccuucaacaaaaacuuuguaaaaggguguuauaccaauuucauucaucagaaaacugaggcucaccgagguuaaaugaagggaaaauaaguaguaagugacuaagcaaggacccagcacagaagcuaucuucugagggcuuggggguuugcauuuuuguuuuccauuuucuguuugugguagagauggggucucacucuguuuuccaggcuggucuucuggggcccaagcaauccuucugccuuggcuucccaaagugcuaggauuacaggcaucugccaccaagcuuggcccaucuguuuuucaggacuuucuaucaagcucaguuucaugcucuugggauuagggugcauccuaagagcaagccagguacccagggcuguccccaggccuugggcuuggugguggcacauucuauugccaaggucccucucacaugagccagacugccuggaggucccagaaccagcaucacuuuuuaauacaccccccccaaauucacuuuucauuacuuaaguaaugaaauaacuuagaaauuauuuuugccucccgccacacuucugcuaaugugcggaagcacguaacccagcaucccugggacaaaggcccccaauaaaucuaaguuccccuuccuggcaacaguauucaagugcaauauauucuuuguucacaggcgauuugccaauguuucuggcguucuaucagccucccauuguuugguuuuacaacaacuuccacuucuaaaagcagggcauugcauauacuuacuuugaacaugaaaguaaauuaaauuugcuuugagaauuucauaacgcccucugacacaauggggugucacaaaagcaggccugggaucacuggucuauaguacagaagagaguaaaaugaaaaauugacaaauaauaucuaccuagaggcauaugguuuauaauaaugcacauugaucuccuuuuaggaggaaaacacauauauauaaacaauugucaaugaugugcaacacauucaguaauguggcuuuuuaaauuuguuuuuauaauaaaaauauaauuaugguaugcauuaaaugaaacaggaaaaaggaaauagcuacucagucauuaauaagagagcuucagggaucauguuuccuucacuagcuucacgggcauuuauauuucuacuuaguuacaagaaucuguaauuacaauuuuagcuguaaugaugacaguuaauagcaaaacacuauugaggugggaaaaucccauaagacuuagagccgggagauccagguuuuaguuccaguaguccuucacacgugcugucaccucucagaacuccaguguccucagguguaaaccaaggauaaugacucuguccuaccucucuguggaggcagaauuguggcccccaaagaauguccauguccugauccccagaaucugugaauauguuauauuacaugggaacaaagaauuaagguuacagguggaauuaagguugcugcucagcugaccuuaaaauaggaagcauagccuggguuuuccagguggacccaauguaaucacaggauccuaagaaagagcuggucagaacuuggccagcagggcgaaaccccaucucuacuaaaaauacaaaaauuagccggguguguuggugcgcgccuguaaucccagcuacucgggaggcuguggcaggagaaucgcuugaaccugggaggcagagguugcagugagccaugaucacaccacugcacuccagccugggcaacagggcaagacuccaucuuauaugaaaagaaaaaaaaaaagauguggcaacggaagaaaggcaccgagaaaugcauuguugcuagcuaugaggauggaggacggcggcagugaggaaaggaugugggcagccucuggaagguggaaaaggcaaggaagaagagucuccccuagagccuccagaaaggccuguagcccagcugacaccuucauuuuugccuggggaaacccaugucagauucugaucuucagaaauguaagaucauaaaucugugggguuuuuuguuuuguuuuuuugagacagaguuucgcucuuguugcccagacuggagugcaauggcacaaucuuggcucacugcaaccuccaccucccagguucaagcaauucuccugccucagccucccaaguagguaagauuacagguauaugccaccacacccagcuaauauuuuauuuuuaguagagaugggguuucaccauguuggucagucuggucucgaacuccugaccucaggugauccacucaccucgaccucccaaagugcugggauuacaggcaugagccagcacacccggccuaaucuguguuguuuuaagccacuaaauuugggguaaucuguagcagcagccguagaaaaugaauacacuccuucacgggguugcuaugaaggcugaaccaaugaugccuguaagaucucucugcuaugcaaacaugagggauucgugugccgcgccucaaaggcgccugaucugcgaacaggaagucuaguggggguggaaggcaguaacagggacacaggugaccaugaagcaggaugagagccuccagguugagugugggcuucuucuccaugcucccacgccaaccuauguuuccuucuaucccagagcucaccaccgugaguucuauuuagcugugauauguuuguuaaucaaguuuggaucucuaaaaccuagcacagugcuggcacacacaggaggugcucagugaguguuaaguuaaugaaacacauaagugaaugcuuagugcguggagccaaacagggccuggggcccauggagaauccacgaaauuggauguuuacgugauugccucucaugucccucuuguuuuccucuaguaagccaucauuuuucaaagaucauuccacagcacaugaaugauuuuagugggacgcuccauagaaaaggggaucauaugaucaaauuaagugggaagacacugcaaauccucucucucucuuauggaaugaaaaugcagauccacauaauaaaggcucugaaaaguucuuugguagagaaaacugucugauuuaccccauauuuuccuacuaaucccuuuucuugcacaacuauucuaauaaaagaggauacucugggaacuucugccuucaggaaagugcugauuaggugacccagcuaugacagaggggccucugucacgcuugggcuacagcaguggcucucaaacuccagugagcauccgaagccccuggaagccuugcuagaaugcagagugcugggcccacaugcagggauuaugaucccaugggucuggguggggcugaggaaccagauccugaugcugcugauccaggaccacccguuaggaaucaucagacaggguugcuggagggguccugucuuccccaacuagcuugugacaggaguaaucaucaccaagacaucuccagcaggaggggaaugcuggggaccaaagucaggacugcaaaugccagccgcccuaccucgaguagagauuucuccucucuucccaagcugacaucuuuuauuuuaugauaguagggaaggaggcuguucaguacagauauguuaagacacagucucuaacaacuuccugcauuguccugguguagagacccagggcugagaaggugagugcgauggccuggugccccacugaagagcccgaugugcugaaggaacccucuagcagucaggcauggcacaggaguaggugggcugcuuuuccagauagguuggcgcuagcuuuuaagauccaccaaaaacauccauaauguccuacagugucuuccuccccgagcaguuuguguacugucucugcaaagugacugagcguaauuuuguucuauggcugugucugugagcaaccacgucugaagcacugaaugaccucccugugaccuuaauaugaccaccguaucaaugggggaacaacacucuggccccuccauuugccacuccacuaccacagugaucuucuccccggcaaagaacaccccaauggcucuuaagauaaagcccagaaucccaaauaggguguucucugugcgccccacaugccgaccuuccuuugccaaucgcaugcaggccuugugcucccccauguuacauaaaagagccaaagaugcuuauuccucacccuaggcugagacccuuuagcucacaaacaugcuggcacaaaacucaaauuuuuuauacaugcaacuguuuuuaaauagacaaacaggcagauuuuuagccauuagggccugccugccugcacaccugugaaacuauacccagcaucuguuggccacugauaggccuuguguuaucagaccccaagaugcugcugcccuucugaggucucugaccaaaagacuccccacugugcugcuggaugaccucaccuugacauuuaaggccccuuuccaaucucccucucccccaggaguugcugugcccuccuccccagcccaccauaagccucugaacagucucaugcugugaggacguccucucucaugcagcccuguccaagcacagcccaguaaacuucgcugugcuacugccucucauggauauagcuuuucccuugaucagcucccaaaucccucaaacccucuacaccuggccaucagguuuaaccacacuagucugccugccugggcagcucuacagaccucagccccacauaccucagccccacauaccucagccccacacaccucagccccacauaccucagcuccaucuccaggaaagccccuccuccuccuucucccccaagaccgaggggaaucaccugauuacacccgcugagagcucccugcaccucucacucguuugcuaccagcugcaccaauuacugcagcuguaaauccauuaauucccuggauuaucugauaauugcaccccucucacuaggcugugaucuaccugacagcaggcuccacaucaacuuuucuccacaucaaccaucgugaccccagcgccagcccagcaccuggcaucaaguagacucucaauaaauauuugugugugaaaaaaaagaagaaacaaaauggcuugacaaggauuguguugacaugaaauuuccacguuccuaugagaaacauaugguuuuugcuauccugagaagucaguguuuugcccuauuggauucaaugcagaucaacacaucagcuuuuucauuuauuucucugugagccuuguauggucucuggcucauuaaugagccgauuccuggccccuccauuggccacuccaaaaccagagugaucuuuucaaauuacauuagccccaauccagucuugagaggaggggcagguaaaacgaaucauuaaaaaauaauaauaaaaggccgggcgcaguggcucaugccuguaaucccagcacuuugggaggcugaggcggguggaucacaaggucaggagaucgagaccauccuggcuagcacagugaaaccccgucucuacuaaaaaauacaaaaaauuagccgggcgugguggcaggcgccuguagucccagcuacucgggaggcugaggcagaagaauggcgugaacccaggaggcagagcuugcagugagccgagaucaugccacugcccuccagccugggugacagagcgagacucugucucaaaaauaauaauaauaauaaaagaaucacuuuaucauuguuuagaauucugugauuuuuccacgauuuuuccacaugcgugagugugcauaaugaaacaggaauugcaguggaaggugaaauagcguuauacuuccuggacucuuacugugcugugugaaaugucauccuccuaucuaaaguccuuuaucaccagcuugauugaguucacucaaaaccacaagcaugcgguuuauuucauuacugaguccgugcacaaugagaaugggccaucggauuauaaaacacaccaagggaagugagggaaagggaggcgucugcacagcuggccauaauuccuuuauuaagcauuuccugagcuuccuaucuacuuugggcagccuggcccauaccacucccuguggugcauggaaccuucccugcacagcauauggccuuuuguaggaugaaguggucaaaaagucaucacagauaacaaaggcagcaaccaugaaaacaucaguaccauaggugugcccgcaguccuggcccugcgggguggaguacuccaggcagccagcucucucuuccaggggugggcagggcgccccgccguucugaggcuccugcugcaccgagcgccuccgcacacggguuguaggcuugcacuggucugcacaaccacuccaggggcuccauucccccacgaagcacgggcgagcugaaaaacagcacaauaggacgcucaccugaguaaaucccgccaggcuggcaggcuguucccgccaacacaaacagcugaguuuagcuccauguaaacuuugccuggccccaggcccuguaucaggagacgcacacaaagccucagcaggucccagaugacacugauuccaccugcccaccccgauggugaauugauaaccugguaccccuuagaaguagcuggauacccugggauccuaaaugugggucugauccagggaaacacacccaaggagaugagacggaugcuuucaggggaauuucucauacucccugggcugagaucagauauuugcuuuuguuuuuccuugauauuaauuuuaucugccccugcccauaacauuuuuauuauaacaagacauucucaucauagacaacauaaacaacaaaaaaaaaaguauaaaaaagaaaauguacuucacccaccaacaaucccaucaccuacucaggucaauucuucucagcaaaugugucuucauaagaaacagggcuuagggccaugcacagggaccccuauacucuaagcuucuccuguuuacucuauuuucuuucuccauggcuuguagacucaugaacuaugagggcugaaguuuagagaugagccaccagggcccagagagauaaagaguauucacggucacccaugaaaaggcagugucaggccaagaaucugggccuggagucuuguuugugcuguuggucuaugcuuuuccacaugauuuggucgguguggggcucagcugguuucucagcaaacagccgugcacugggcugcucccuggaguccagcaauacauacugggauuccccugauggacaacuaaagccauucuccuuccuugauugugaaguccacuuaacaaaucugaagauguaauuuaaaaaugcaauuuccucaccaugaccauaaaaucaauauggcgucacguuuaacuuucucauugaaaguuuuaauguaucucagacuguaaucaacuuuuaaauugaauuauuucaggauuuaaaauuaaauauaaggaaagaaccagaagacagaagacaugcccaugaccuagaugccaaacauuuuuuuccccuugaagugugauccgcuuuccuaucauccucacacuuucuaauucauaauguuucccacaagaauuagcacucugucuucuuugaaagcuugacuugaacuucugcauucacgguuuuuggaggacaugugauuugccagugcauagcuaccccugacauaaaaagggucccaugcaacauaaacaugucaguaauuuuaaaauuuccauacuaguuuaaaacaugcuuucauucaucaaugaaauacccacagguaucacaugucaacuaccuaaagaagccagaauaagccacguuacaguucauucccaauaucugccauguauacaucuuuuggaaaaacacuaacaggucacuuccugcuuuuguuggcucuuguuagcccuucccuuuuuauuuucuugauuucauaauuucauuggcccaucaaaccaaaaagcauuuaaagagaucuccuaggcugcgagcugauugagaaggacuccuucuauccuucauuauuucaaugccucuuuucuuccaccuucagccuugagucuagcuaguccuguugugagguguugggcuugaacaacacuuaauauugcauaaaaagaaugcacuuguuucaaagauuaacauuuggacaucacuauaaaauacaauuuugccauagcauuaacucagaacuuaguaauauggccuugaauuagacuugguccuuaugguaaaagaugacacuggggaggguuuucugacugaacuuagccucccaggauuccaucgucauaugugucucuugucuaguauuuguuucuuguauucgguuuggucucacaguugaaguccucaaaauuacagaaucaaucauugcaucaaguugcuccuauucguuaaaguuuguccuuagcaaaacacuauauccuguuuuuccaauccaugauuuuaaaagcuccauaaagagaaucagaaaguuguaggguccagaacaaugacaucucaauagcuucauuaugagacaaaauaaaaaacacucacucagaauuauaggaauaaagagguguuucacaaaauauuuugcgucggaagauuaaauaaauuaagaaguauuuauuccuauacugcaccaaagauucuauuguugguuagcuugugaacuuuugauuauuuggauugcaagccaucauagaucacaagagaucuuggucauggagguuaagggaaguacggaaaccucugacagauuuauuucaagucauuuauuacagcugccugacacagauuuccuuuuggacgaugccaauaguauucauguccccuuucccacuagcuuaucuaacucacaucuauucacagcauaucaaaauauucuuuuuacaaucugaccuucucaaucuucacuugaguuucaccagcuguuaauggagccgauagacuguggcaccuaggagcggcaugguggccuuugacuccaaguuugucacagcuucucaguugcuucagaguuaggauuugaugacaucauccaccccuuuuaggagaagaaagccuagauuuaaugggugccaggaagcucaguaagcuugcuguuuucuuuucuucuuuguuuaaacucaagcuaauauucagguugggucuccccagaagcagccugugagacauggauuuaaaugcaaguaauuuauuugugaggugaucucaagcaccauacaggaguggagaacagagucagagagggagacagaagagagcacagacagaaaauaaaaaaagcuaaaagcucugcugaaggucuggggggcaccccuggcuuucagcucauuggagagugagacaauggauguagauucagagugcaagaaauuaucaaguccuugcccauuuaccaacuggucccccuuucucaagaccuuuccaguuaucagagauuccuaccacagccaaaggagaauaaguuauauaucucaguaaugaaucacacacaagagugcagcacauuuucacaguccuaauggagauagccagucacguccaaguacaauuacuuuaaaagauguaucacuaauuuuuuaaaaguauaaaugacuuaaacucccucauuuccuuuggauuucaucugacaucugaacucccugcugugaccuacaagguucuguuccugugugaccuggcaucugccugaccuuccacuuccaccugcacuuccccgcccaccucugcuccaaguucagccacaugggccucuuuaccccuugaacacaccaagcucuuucccacccugggaccguuguacacauuuuuacucugcugggaauauucucccuacacugggcauggcugggucccacucacccuuuaacucccagacuaacuacuuccucuucagggagucuuuuucuggccagcuuuuucuagucuucgccuagccccacuacacagacacacacacacacacacacacacacacacacacacacacacacacacacuuauuuccucucagagcuugguguuccucaccuuguagcauugccauaauucauaauuacuuauucauuuguuguguuuauuauugaugccccugaggaucaugauaguuuucuauuucauuccuggugcuuggcacaugguaggugcuuaauaauauucauugaaugaaugaaugaaauggcauugggcauguuuccccuccucccuagauaauguucuacauugaaacagacucugaucugcucauaucauuaguuagaagccaaaaugcugaaggaggcuccagcaaaggaaggaagugggguggaaggagacgagugaaucagaagcccccacagccaaacccaugggaauucuuagccuggcccagagugugggcucuccuggcagcaauggccccaaggguguccaucagaaggagcauuguuuucugugccuuaagaucagguagguccaagcuucuccuggcagcuacaaguccuuuagauccauucugaucuauuuauaucuccugccaggaccacauuuugaaaguaacaagcuucuuuacuuuuauuaucuguggcacaaaauggcauuuccuuucauuugauccaaauuucccucacucaagaauuucagaauauggugaaaaaaaaaaaaauccaugcuuaccuuuucuaugccacucauggucugacauggucugugccacucaugguuuggggaggucuccuuuccucccagccagacucuccaaggucaugucuucugcuuuuggacccaucuuucuaggcacuucucaucucggaguuaccacuggacuuucuccaggucuguucgcagcucgaggaguugugccagccagagcaagacacccuauucucagccuuuagguaccaaagggucauuuaaaaauauauauauuuuuucaaaugcuuuucuaggugaugucaaauacaugcacacagagacaacaaaaugagccgacagccagagccauucauuuuauaaagagaguuuggacuauuuuuccuucgaggugaggccuuguucuuguuuucauguagcagugucuccuugguuaaucacagagacucaagcacucuccuuuguaaucuagcccugccuauuggcuuuuugccaucuaaaaguuuaaggccacccacaaacaagugcuuucucccucacaucguuaaguucaaauaguccuaaucauuccuaaggaaauguucuuacaccguacccacagcaguacccauuuaugcauagcuauuguuucuucacauucuguggaagaaaaauaaaacagcccuauuaucccccaacacccacacaugcacaccucauagugacacaaauuuaaauauauaucaucucccuuuucuuuuuuuuuuuggagacggagucuugcucugucacccacgcuggagugcaauggcgugaucucgacucacugcaaccuccgccuccugaguucaagagauucucaugcuucagccucccgaguagcugggauuauaggagcgcaccucccugccuggcuaauuuuuuguauuuuuaguagagaugggguuuugccauguuggucaggcuggucucgaacuccugacuucaggugauccuuccaccuuggccucccgaagugcugggauuacaggcaugagccaccgugcccggccaucaucuuccuuucuuuuucuccauguguauuccucuuuccguagaaccuugucaaagcuucucugaaagccaaaugagacuacauuccccaagugccuauuacucccucagaaagcucaaauaaaaugaucaagacuuuucucccucucuugcagaaaccacguuaucuggcccccaaagggguuuuuuuuccuuuugagacauuuacuggcuaguuccugaaguacuagcaagaugacaugggcugugucauuugauaaauagaauuuuauauacuauguaacccaggagaaaaaaagauaugaauaaaaaagauaauaguacuuuuucuuucuggguaacagguuuccaggugaguugccuucuuguuuugugcauuucuguauuuuccaaauuuucugcaacaaacauauauuuuguaguuaaggaaagaaaaucuuuuauagaggaaauguggcucuacccuggauggcggugccgucugaagccauggauaacaucaccugguggggaugggugggacgacugcucacauucuuuugacaaacauuauuaaguagcaucaugauagccauuggaguuuaugcagacaggcaagacacacucugcccucgaggagcccugaguagauggagggagaagccuugcucacucuguugguguuuauguggggccuaccccgcaaagcacacugcuucucauaagaccucauuucucugaggcagaaaaacaucauguuuugacguauggccucuggauccggaugaccuggguucaaaucucgcuacaccaguuauuaguggugugacuuuggacaaguuacccaaccugucugugccuugcuuaccucguauguaaaacgagaccaaaaugaggacuaacaucagcggguugagggauccaaguaaguuaauaacugugaagugcuugggagagcgccugguauggaggaaaugugaaguguuaacaacuugacccuccuucacugcucacccagggccgcagccaaauucugcuaagucaaguccauuugaauacuggcuccagucaggccccgcucguuuuuuuucuucaaagccaaaggcgaugucucucagacuguucugguuccuguaaagccucaacucucuaaaucaucguagacucuggcaucuuuccuuugggugaguuuggagcccauauuuucaagcauggugccucuuucccuccagauaugaugucaucagacuuuggcuaguuuguuuccuagacucuccauaaaucuaggagaagacaccagcccauauaggcuauucaauguuuguccugcuucacuuggguuaauuauuacccucuccuuaagcugccaaucaaugaucuaaugcaacuacuguucuaugaucuuagaaaaugcaaauucuaggaacccagcuggagaaucagagauugggauguuauccaccucauaagcaaguuuuccaagaaguucuuccagggcagggaaacuuggaucuguuccccuacucuacuuuuccccaucccugguaaggcacagccaguggagaauuuuccaucccuuucuuagaggaggugggaagggagcugugaugcucccuugguguugaaacucaugccauugucauaaggagauuuccugagaucauuccagaacagaugucuuugacaguuuaguaauuguauagauucaauaacauuuuaguuuuuaccugagaaagucuuuuuacuuagaaaaagaaaugccaguauuucaucucuuagccacauaauaacaauaauaauaaugcauuuaucaagaugaaaaaaucagaaggaauagaaguaaagcaugcuuaguuacacugacucaguuacauuuuccauucacauugaauguaauaucagucaaaaaaggcuuuaggcagcaacaauagguaaaauaauggguaagaaggaaaagagggccaggcacccuggcucacaccuacaaucccagcauguugggaggccaaggcaggcagauugcuugagccuaggaauuggagaccagcuugggcaacauggggaaacuucgucuccacaaaaaauagccaggcuuggcagcacacgucugcagucccagcuacuccgggagcugaggugggaagauggacuugaaccugugaagcagaaguguggagguugcaaugagcugagaucacgccacugcacuccagccuaggcaacagaaucagaucccaucucaaaaagaaaaaaaaagagagaagaagagagucuaagaggcagaaugguucuaugaguauagaguaacuggggguucuaagaugcugaaaccugauuuaucuaggaauaaguaauagccauaaauuggcaaauauauguggcaauuggcagucugaaaucaggcacuucagaucucagcucugcucauugguguuagcuugaguaauggaaacccuuggaaagccuuagcuguucugucuguaaaaaugcuaguauaggucaccagguucuuuucccaaaugcuugaggcaguugagucucaguacucaggacuuccuggaucuuagaaagggaauacagucuauguaccuuauuuggggugucccccucuacucagcagggucuggagcagauccuugcaaaauauauuaauauuuuugaggcaaaauauaaacaaagaugaucaauauccuucuaucagugcaagucaggugagacuuuugccaccaaaugaguuaugaaaaagcuuucaaauguuagcacuuuuuagauugggauugucauauggguuuguggaccugaccugccuuucuuaacaauuguuaggauggcugggcaugguaagcucacaccuguaauccuaacacuuugggaggccaaggcagguggaucacuugaggucaggagauugaaaccagccuggccaacauggugaaaacuuguuucuacuuaaauuacaaaaaaauuagccgggcaugguggcaggugccuguaaucccagcuacucaggaagcugaggcaggagaaucgcuugaaccugguaggcggggguugcaaugagccaagaucacgccaguguacuccagccugggugauagagugaaugagacuccgucucaaaaaaaaaaaaaaaauuguugggaggauuaaaugagacaaaguauuaaguaucuggcacauggugugaguugaauaaaauguauuuaugauuuaauauuaacgaauacaaauuauagcaauauguugucagaaaauuaugauguaaauauuuaaucaaaugaaauauucuccgcugucgaccagugcuaagagccaaccaacaguacauuugcuaccuaaaugucuaccacaugccaggugcagugcucugggcuugccaggcauagccuccuucugucaacuccacagucccacacagugguuucaucuccccugccccuacuuuuuuuugagacagggucuuacucuguggcccaggcugaagugcaguggcauggucacaaccacaacucacuguagucucuaccuccugggcucaggugauccucccaccucagccuucuggguagcuaggacuacaagggcaccaccacacccagcuaauuuuugucuuuuuaguagaaauaggguuucgccauguuggccaggcuggucucaaacuccugagcucaggcaauccaucugccuuggccucccacugugcugggauuauaggcaugagucacugcugccuggcaguaucauuccgcuuuaaugagguacuuuaggccccacgagggugacuucuccaaagucacaaagccaaacagcaccaggguaaaggcugaacccaggauucugacuuuagaggcaaaauugaggcauucggguuacuucugggauuaaaaaaaaucacaaauaaaaaacaaauauuugagacuuagaaucugugagagggaaggcugcauuccaggaguugccccgaaccagcuuccagcugccaggucagcucugagcccgggaggcaggcggugaccgcccugcccaggagccacagucggcaugguuguggcauggguccagggcugagcaggcugggccucucggcuccgggccuucugcucucacccucggaggggcaggcucagucccaccaaguggccaccuuccaauugucuuuguuuuccuccucccuucgcaagaaacuucaggcacagggaauuucucaacacggagcuuuucagucccccaccugcuuccuucuaggccugcaagguccucuguugacucugccacaggguauugagggcuucagaauaugcuccuuuuaaaauucaaucugacaccaucuccuuuucccccacucacagcucuucucuggggcacacacuuacagugauuucugagagcuucacaagacagcaggccaugucaccgcuuccauacuuacccacuaaauccccacuccaaaaccauaggcucuuugucucacuauucuaccgccuagacugaaaauaagcaauuucuuuuugaccaaauaaagacaggguuuuccaauuccugggagcgcugucaggucucacuagaaagcaaguucuucucaagacauucuccuugucucuccucaucccucuuacgggccugaaucucuccagaucuggcugccuccagcaucuguccuguucaccauuuuggccucagggccuagcacagggccuggcacaagcaggugaugcccacaguaacuacuggacugugacauugggcuucccuccuacagccugccucucucuccuccagcaggccucuuccucauucuccaggcccaggcucgcccauuacuuccucaggugagucuuccuugaauuccuugggucuuuuaagugcuuccuuccaggucagcuccuggaucaacuauuucagugcuaagugugucgaacaggagcuugcacagguugcccagcuagaguagaaaguccuagagagcagagacugcaucuuugucacuucucuaucccugcgcuuaccacagaucaggggacauuagcugggucacaggaauuccauaauuaccuuuaaaauguaugcaagccccucaugagagagaggcuuugcuugaguuaugcagggaaaugaggccgacaguuuaggaugcugugaggaggggcuggaguuaccuggcucaagggcacugcauuuccuaaauagcugacucuuccaucuuacuuuaguaguaaaauacucugaacuuagagccagaaagggaaagaagcuuaucaaaaagcuuuaucaaaaauaauaucaauauucacagguaaaucauuagcuuucaaccagggucaaaaaaucuuaaugcuuucaacuguguucuuucagcaucgggccuggccacggguugaagcccucuucaaacagcacagaggcaggagggugcuccccgccacuggguauccgguugcccagggaauggcauagccccagaaaaugcugaggcucccacaugucgggauccuucagcucgaacccuaauaucuguguggcuuuggggaugaugugauuaacaggagcagggcgacuuccacuuccauggcuggcuucucucagguacaccuuguuccucaaggcuguacucaucauuuguuccuuuaucuuuuaauucaauuaaaccagcuuuuauugagcccuuacggggacaaggaacugugagauacugugggaaauuuaaaguugaaaaagacugacccuaaaggaaaaccagcaagauuacaacauaauagggaccucgagauaaaauccuugucaugcuguacagagaaaauuaaauuccaagaacauacuguacaccuccuaggagaaagaggcuguucuacauuuugggguccagagaugaggacaucuucagauuuuuaagaccuugcucuccagaagaaaguauuaauaccuucccagagcacgcccuuggcacaaagugggaagauuacacaauccugcccucaucaccccucaccagccccaaagauccccgaggguugacagaaugaaggugguggagccuggcccaggggcaugccccuuaucugucagugccaucucugccggccagagguggcccuauccagcuggaguuucugagucggagauuucgucucucggcucccuuccaucccgcuggagaacagcgggauccagcccuuccauccgggcucuggucugucuuggggguggggggacacuucgaugucuagcaggggacugggagacccuaggaugaacggagccgggcguaccuggauggcggugguggggauggguggggauaaagggucuggaggacaccuggcucagggacugagguccuuggcacagcgcccugcccugugcccguugguugcaggcuaacggccggcgccccacucucggccugaccacccaccugggcacgcccugucguagucgaagcagcaguccccggugaagcgacaggcuuggucgcagaaacacgucccguagacccuguccagccuccagccgcgggcgaagcaggcggggucccggccgggacagcagcgcccggccucggcgcagccggccugggccccgggccacagccgcgacagcgcgcacagcgccauccacaggguccucauggccagggcuccggcggcgccugcgacgcgacagacccccggggcaagcgcucugauccucggcuggccgcggcccgggagcugcccgagcggccggcgaggcacagccgggcccugcccugcgcccggcccccgcccuccgcgccgccccuccccagcccuggcggcgcgcccgucgaggcccgggcggguggcggggcugccc

SEQ ID NO: 191095 - RNA, 27150 nt, Homo sapiens
cagacggaagugagcgacacacucugcguccucgccucaccagguacggaucucccgcgcgucgccgaaagcggcucugacccagcggaaguaauucuuucgacugccccggaacccaccggagcaggcagcugggggugggggggcggcccugggauaggggcuguggcaguacgcggggacccggcugcgguggcugcgggacugacgagugagucucgggcuggggcggaaacggagcuccggguaaggguggagggcgagggaggccgagacgggacgagcucgcaaucccacuucccaccccuucccuucuaggcggggaaggaacggaagcuguuaaccuccuugggccuccccagccccuaguuugggggaggggagaagagggcggcgggaccuuuccuggcgccgcucgguggguuuggaaagagguggaaggaggggcagcagccagcgagacugggccuucuccgggcugagcgcgggaggguggaguuaggagcaugguagcccugucgcuuuuccuuucugcuuguuccucguguccgcucagauuaguucuuuucuugaagucagucccuagcccagggagaggucucucgcuucuucuagcugcaguacccgagaaguuuaccuucuggguaacuuguugggugauucuaugcucgacuucaugaguuggggguaucgugcaucuacuggccguccagucuugucugaaaggagguaucuagugugaaauacugugcccauugaguuucucuuaaggaacugagaucuguuaaguaacauauaacuguggaguuugugccauuuagcgugagcauuucuacuccacauugcuuuuaguguagaaaaccgaaauucuuuuuuaaggggccgggggagacagacuugcucuuguugcccaggcuagagugcagugguucguuuucagcuugcugcaaccucugccucccagguucaagugauucuccugccucagccucccacguagcugggaccaaggcgcaugccaccacgccugacuaaucuauuauuaguagagacgggguuucgacauguuggccaggcuggucuggaacuccugaccucaagugauccgcccccgucggccucccaaagugcugggguuacaggcgugagccaccgcgccuggccuugaaauucuuuagugucuuaaaaccucacuuucucacuuuuuaacugccauauuugcuuuuuuucuuuuucuuuuuuuuuuuuuuuuuuugagacggagucucgcucuguccugaggcuggagugcagugacuugaucucggcucacugcaaccuccgcauccaggguucaagccauucuccugccucagccucuggagcagcugggauuacaggcgcgcaccaccacugccggcuaauuuuguuuuuuuuuuguuuuguuuuguuuuuuaguagagaugggguuucaccauguuggucaggcuggacuccugaccucaggugauccgcccgccuccaccucccaaagagcuacgauuacaggcgugagccaccgcgcuuggcuccauauuugcuuuuugauccccgaaaguuguuuccuuuucuauucaguuaccuaaaaugacauaugucugaucucauuuacauuauaaucauguugaaacguagcaguuuacauguggauuuauucauucuggagauacaauggcaaggaaacagcugugguacguacuauaauggauauuuauuguuucuugccaaugaugauuuggggucccuguuuaauauuaagugaccguuccucuuuuucuuaaauaugaaauuugauaacuaccauucaaaaaauacacguguaugcauugccagaugguaauucuguaauauaauaggcacuaguuuacagccagaaguuauagucaguccuauacaucaaguucuaaagugauauuuaauuguuuaaaucuucuaaaauguuuaucuugguuuuuuugguagauuuuuuagcacuggaaaauaaucagggaaaucuuugcuauuaugcucauauuuauuuuugagucagagucucacucuguucugcacucccaggcuggagugcaguagcacuaucacggcucacucuagccucaaccuccugggcucaaaccauccaccugccucagccucccuaguagcugggacuauaggugcccaccacgacaccuagcuaauuuuuuguuuugggggcucaaguaggcuuccugccuuggccucccaaagugcuggaauaacaggcaugaaccaccaaaucuggccagcuauggucauauuuauguguuaaugcauuucagcuaaacugcuguccuaaauucuuuauuguuguuauuaaguaagagcagaaaaagcccauccaguaaugccugaauuucaagccucagcgauuaggaaaauaauaguacauucacucaagaaauauuuauugagcaucuacuaagugccaggcacuauucuaggccugcugucaagaaacuugaggaaagaaaggauauguguaaguaagcaaguauaguuucaggaagugauaaaugugaaaaaaauauagcaagguuaaggguuagagugacugggauggggugucuaauuuugguaggaucaucagggaaggaagaccucucugaggaguugauguuuuaccuggagaccuaaaugaugaggauuuaaaagcuuuucggacaacagcaauuacaaaugcaaagaccuugagguaagagugaacuugaccgauuucgaggaauaccaaaaaggccagugugacuggagcauagugaaggaagaguggugggagacaagaucagagugguaaguagggaaguaaaucaaauguccaguugagacaugguagcuugaacuagaaguguggaguugaaagugaguaguagucugauuuggaauguaauuugaagcuggagccaaauggguuuugcuuucuucccaggaacaaaacgaacaaaaaaaaauguuuuuugaauaacgaaucacuuuuccaagaaucuggguaaacagcagugcauguacugaaauggggaagacaaaggaagggaguaucaguuucugagauugauaaaucagaaguucuauaugggacuuacugaguucgauaacuaguagacaccugagaauaugugcaguagaaaaguuggauauucacgacuggcacucgggagaaaaacuagggagaugaucugggagucauauuuuauagaugauaaccucuggucuggaggacaucaaauagggaauguuaaauggagaagaaggcagaugacugggagcacuccaguuagaagaggagcauacaguaauggaagcagaaaagccaggagugugugacaucuggaguacuaaggaagaaauguuucaagauggagggaguaggcaauuguauaaaacacugcuaaaugaggauuaaaaauugaccaugugaccaagugaaguaguugaaauuugauaagaaccccuaaaauggacuggugggccaaaggcugaucagaauagguuaagaaguggaugggaauaauggccauagcagagucuuuaguuaggugacggaauaucaaucauugcuuaaguggaaagguugaccuuuaguaggaaggacaguuuuuauucaauauuugaaauagcaggguggacaaaauauauaaacacaggaaugcugaagauggagagacaaggcaacugaagugauugguuucaguuuauuuuuagccuaucuuucgaaagguucuguuaauauguagaaucuaugauuaauacacauuauauguugggaauaucugcuuauaauuuuaaaacugaaacaagggaguuuggagauauuauuugagagaauaauuaggucguuugcaggggugaggcagacagacucagaacaugcagcgcucugcagcccuuaaguucuguguugugggagggcgacucuggguaauaaacaugggaagcugaguuauaggugguugucugggaaggaugaauuucagauggauuuagucaugaaauagagccagaauggacuuuuggacauaauugaguccaauugucucauuuggaagaugaagaaacagaaguccuaucacuuaauuuauccgagucucaagauagaaaugucaaacagaguagaaauucagauguggagauggauucgggucuauauaagguagccauugauuuucauucaacugggcuaguucuuaauuuaugauaagagaugaaagcuguggaccuucucaugccucuuacugugaacugcacauaggcacaaaauugugcuuacagauugaaggguuugggauucuacugcuuaucugugaaccucgaggaaugggggacugcagauuaagaaccugcuagaacagagucaacaaguuagaaccacaggccacaucuggcccacuaccugcuuuuauacuacccgcaagcuaagaaugguuuuuaaauguuuuaauaguuggacagaaauucaaaguaaauguguauuuuauaacaugaaaauuauaggccggaugcaguggcucacgccuguaaucccagcacuuugggaggccaaggugagcggauuaccagaggucaggaguuugagaccagccugaccaaauggugaaacccugucuccacuaaaaauacaaauaauuagcuaggcguggugaugcaugccuguaaucccagcuacucgggaggcugaggcaggagaaucacuugaaccugggagguggagguugcagugagccaagguugcaccacugcacuccagccuggguaacaagagcgaaacucugucucaaaaaaaaaaaaaaaagaaaagaaaauuauauaaaauguacccuuuuuugcccauaaauaaaguuuuguuggaucauagccacacucaaucguuuacaucuugucuguggcugcuuuugcacuccaguggcagaguuggaguaguuguaacagagaccuuacagccugcuaagcaaaaaauacuuauuuuuuggcccuuuagugugucaacccccacacuaaaaauguaaauuccaggauacggguggaggagagguuguuggauuuauuuuguccacagauuccucccaagcauguagagcagugccuggcacaugguaggcccuugauacauauagaaaugaaccucugguucaaaaauagaauaauggccaguguuuuaaugugugcuaggcaguauucugagugcuuuuauauguaaagccauuuauucuucagaacagcucugugagguagaugcuguauuauccucauuuuaccguugaagaaaccaggcaaggaaagauuagguuaguucucccgcagugacauagcuaggaguugacugauuuuaagcacuacauuauauggagggcugaaaucaagucuucagaaaugauagcagcaaaaggauagauaggagugaugaaacaggauaauguagcaaaggaggaauacauucuuauguaguguuguuuacuauuauauuaggcauucaagacccaugucuugggcuaugugugguggcucacaccuauaaucgcagcacuuugggaggucaaggcaggagguuuacuugagcucagaaguuggagaccagcuugggcaacacagggagaccuccacuuaaaaaaaaaaaaaaaagaaauuuuagccgggcuugguagcaggcuacucaggaagaaggugggagaauccuuugagcucugaagguugaggcugcacugagccaggauugcacaacuguacuucaacuugggugacagagcaagaacuugucucaaaaaaaaaaaaaaagacccauggcuuggucaguaucucaguauguguuccuuaugugucacuguuccccucuuugauaaaguccaacuucccaaacucucaccucuuuuccuaucuuccuacacucucuucuugacucacucaucuggccagacuguucuccuugccauucucccuccauaaaaagcuguuccuucaaauaucugugacucauucccuugcuuucuucagaucucuguuaauguuaguucuucaccaugccguauguauuauuuuguuuugguuuucuguccccaccauucuucccauuagguuggaauguuuguuauguucaucucuguccccagugccuaggugagcaucuagcauccuaacccuugguaaauauuuauugaaugaaugaaucuguaaacugauuuccaacaacacugaguuacauugugugccccaagcugucugacugaggucauacuguucacuuugccuggaucucccuccuuuccaguuuugccugguaaaaauaccucuacccaucgagacccagaucaaaagcuacuuuccuuuuauaacuguucacuuaacagaucuucuguuguagauuuguagucucauauuuccuuucuuugggacgaccaacucuuauuccuccucuguuagcauuugcauagcuagaaaauuuggguuaauuuuauuaccgaugucacuuucaaaagcuuaauuaggcagaaaaccauccuagagugaugauaucuuuggaguuaagguaaaauaaacuucagaaaugcuaucuuuuuuuaaaauucuagcuuuaaccuacauacagugaaaugcuaauuguaccauuuaguuuugacaaauauauagcaagacauuuuuaucacuccagaauguuccucucuaaucaccugcugagcugucaccauugguuuguuuugccuguucuauaauuuuauauaaaucggauaauacaauguauacuuuuuuguuuggcuuguccacuuaguguaguauuuuuauauucuuccauguuguaucaguagaucaucccuuuuugugaauaguacugcucuguaugaauguaccacagcuuauuuauccauucuccuauuaugauggacuccccaucagcaguguaugagaauucauuugcuccacauccucuccagccuuuaauguucacagucuuuuuaauuuuagcuauacucguggcuguauaguaguauuucguugcaguuuugaguuucacugauaaguaauaauguugagcacuuuuuaauguguucauucaauucuucugcccaacuuuaauuggauuuuuuuuuuauugacauacaggaauuuuuuaauuuacucuagaugcaaauccauugucagauacgcguugugaauauuuuuuuccaguucguggcuugacuucauuuuuuucauuuuucuuuuugguuuuugagaguuuuuuuuuuuuuuuuugguuuguuuuugagacagugucuuacucuugcucaggcuggaaugcaguggaaccaucauggccugcugcagccuuacccuccucgggcucaggugauucucccaucucagccucccaaauaccuugggcuacagguaugcaccaccaugcccagcuaauuuuucuauuuuuuauagaaacgggguuucaccaccauguuguccaggcuggucucaaacuccuggguucaaacagucagcuugccuuggccucccaaagugcugagauuauacgugugagccacggugcccagcuaugguauuugaugaacagaaguuuuguuuuggagaaaugcaguucaucaaguuuuucauuuacaauuugugcuuuuugcaucuuuucugagauuuuuguuuuguuuuuugagacagagucuugcuguguggcccaggcuggagugcccggcuggucucaaauuccugaccucaagugaucucccucccaaaguguugcgauugcaggugugagccacugcaccuggcugcugagaaaucuuugccuacagugaggguaugaaaauaauuuguuuucuucuaguagccuuauuuugcauuuuaaguugaauucugugaaccaucugaaauugauuuuuguguaugguuuaacagugagcuucuuauccauauggauauuguuccagcuuccuuuguugaagagacuguccuuucucaccauacgcuuugaccuuugacucacuuuuccauauaaggauucaggaaaucugugcuuaucuuuuuuuuuuuuuuuuuuggccauuuauaaguugauaugaaacaacuguagcccaccaaaauauaaacuacagagaaccaucauucacuauccagggaccacuuaacauacugugauuaccuguugcaauccacacuacuauauguaauacuuuuuuuuuuuuuuuuuuuugagacggaauuucacucuuaucgcccaggcuggagugcaguggcgcagucuuggcucacugcaaccuccgccuccuggguucaagccauucuccugccucagccucccgaguagcugggauuacaggcacccacuacuacacccagcuaauuauuguauuuuucguggagacgggguuucaccauguuggucaggcuagucucgaacuccugaccucaggugauccacccccuucggccucccaaagugcugggauuauaggcgugagccaucacacccagccccaucaagcauuuuuauaccugucuaagcuaguuguauucuuuuuucugcuauuuuuccagaguucauggauuuuuauggauauuuuacauuuggcucuuuaaucuguaguguauuuuugugagugaucuguucuaaccuuauuuuauccaaguaaauagccaauguaaaaagacaaaaagauaugaagaacagauuuugcagcagugucuguuaucuacuuagguaauucaaguaagucaacugaaaaacuauuaaaacuuauaugaguucugcaaaaaaaaugacgggaugcaaaaucaacuuaggacauuuuaaagcuuuuaacaacacgagcaauagccuuucagaaaauaucauaguaaaacagaccccauucauaauggaaacuuaaaaguaccuaaaaguagaccuaacaagaaacaugugagaacaaaauggagacuuacccaacuauuccuguacagaauauagucuagaauuucauguagcaauauagaauaugauaaagguaauauuucaaaucaaaggauaagcuauucaaauaucuuauaaauauucacugauacuagauucaacacuuaauuucaguguaggcccuaggcucaccuagauuuuuuaaguauuuguuauuaaacacaaacauacacaaaaaaacuuuaagagauuaauauuuauauguaacaccuuaaaagcauaaugacgucucaggccauuguucaugcucuuucuucugccuagaacuauucucaauccagcgguuccccuacgaguggcuuuuaccugcccaauucauauuuccagaauucagcucugugauggaauacauguucaagcugaaauuuuugucuccucaaacuuauauuucuuuagauaacuuauggauuggguccaaacugaaucauauuuuaaauauuucuaacuucuaccuaagaauuaggaauuuuaacucuuaauguugauuuucccuuucaaaggugggagaaagggugggucuccucuucucuccuuaaucucuguuguauaaaaugauggaauugauuuacuacauuaacucuguagagaaacuguugcuacccaaagggcuccuaagaugugacuuugcauuguugcuuagcuacugcuaguuagauaaacauccuaaauguuuuauucuagggauuuuccagauaaaagaguuggcccuugaaauucuuguacuucaagcuuucucgcauuuguuuuguuuuuuuuuuuguuuuguuuuuuaaaagaguauuuacaaagcaguauaaugaaaagaaaauaauaauggcucucaugaauuuuuaaauugcguaguaucauaaaaugacaguacuauuuuuaaauuuuagagaacuauuugaggauuuacaucaguagcuguugggaauuguggcaauuaaguuuaacuggagccagaauuuuuuacugugguaguaggcaauaauggaaggaguggaaugugggcugugaagucagaccuaccuagguuuaaauccuaacgcugccacuuaagcuguagaagccuucaacaaguagcagacucuuccaguguuucucaucucuaaaaucagaauaauucccuuguggaagaguuguuuuuaaauaagauaggccaggcacaguggcucacaccuguacucccagcacuuugggaggcugaguuggguggaucacuugaggucaggagcucaagaccagccuggccaacauggugaaaccccgucucuacugaaaauacaaaaauuagcuggacauggucccaugcaccuguagucccagcuacucgggaggcugaggcacaagaaucguuugaaccuggaaggcagagguugcagugagccaagaucacgccacugcacuccagccugggccaaagagugagacucugucucaaaaaauaaauaaacaagauaauguauguaaggcauuuaguacaguguuuaccgcuucuuaggccugcaaaaggcucaucagauuuaauuguuagugcugccuauuuucucugcuuuaucucaaauuagaaaugguacuuugggaggcugaggcaaguggaucaccugaggucaggaguucgagaccagccuggccaacauggcgaaaccuggucucuacuaaaauacaaaaauuagccaggcacggugacagacgccuguaaucccagcuacuggggaggcugaggcgggcaaaucauuugaaccugggaggcagagguugcugugagcugagaucgugcuucugcacuccagccugggcaauagagcaagacugccucucaaaaaaaaaaaaagagagagugaugguacuuugaauaucugucuccaugccuagcaaguguucuagacuaagauuugauuucugcuccugcucugucgcuaccugaaacaaauuauuuauccucucuacauggaugacauuauuuaaaccugaggcauuagagagguuacuugcaaguuccuuuucugcguugaaguguuaugguucauuuucuugacccuucucuuaaggccagaacuaaaauuugucaggaauuucuuagagcaugauaguuaggaaaugcuuuuuuccuguuaaugacguaaaaaagaguaucaguauaaaugagauccccugaauaaaugcuguaguauguuacuaaaauacaguuacugagaaagugaaaccauuuccuuuagcaaucaucuuguuauuuugucaaauuuauaauuucucaaaaacuuguacauuuuuaaccacuuuauuguuaaauuucaaaacuuagccuguauauggaagagauggaagcauaaaaauauguauguguacuuaucuaaguaaagagcaagacuucucuuuuuucuuauuuauuuauuuauuuauuuuagagauaggaucucacuguguuguccaggcuggucucagucuccuggguucaggcaguacuccugccucagccauccaaagugcugggauuacaggugugagccacugcacccagcccugucuuuuuuauucucauggaaguuacuucauguccuugguuauaucaugccauucauucaagcaaauauuugcuuauugucuaccacuguguacuaaauacaagauccagaacuugcuguguccucacuguuuuaagucaguaugcaucauccuuccagcauguguaccauagcaagguguacagagcauugcuaaccucaaaagcucacuugagcuuugguguccagggauuuucuugggguuucauucuguagacaugauugaugagucauaagcaacaaggcugagcugagucuucagcaccccuccaacuggaggucauguugauaucaaaaaaggcaccucaaagcuuuuuguccugaguccuuuuguuaguuuaaacuauccaaaggcccauuaugaguuaccugguuaacauaaacuaccaggacccaugaagaauagcaaggacuuguaucacuagggaaauuccaaggauuuagaggccaccucucaaaacgaggaucaaaaaccagccaaauucuuuauuauacaacaggacccauaguuuuguuuggauuuucaacggaggccuuuauccagaaaaagaauaaaggaccucugccuuaaaacaccucaguauggcaguuuuuucucgauaauuauguuccguguauguauuuuaauggaaugaacauuuuuacacgucuguuacuuuuaacaugucacauuuuacaaccucuucaacaaccccacccccaaucaauuuauaaugauuauauguuauguuucuauuuuaaguaaucuuucucugauucagaagugccaacugaucaagcucacaaagcauuuugguauucuucaauugauuuuauaaaaguacaguguuuuuguuguaggaauggugagcucguaauguaaccaggagggagaguucuuaaacuuuuaacaccaaggacauuaaauaacagugaaugaaaacuugucucuugcaacauuaaucuuaauaugauauuguuauauuuucaggaaacuacuaaaguuccuggggaagcaaaguagaauuucauaagaacaaaauggguaagcuaaagauaauuaauuuuguguuuuaacuaguagaaacuggacuuuguuucaaagaucuuuaaaauucagugaacacaaguaaaauuucaguagacugaaauuaguuguccacaucaacagcuuauguuuacuacacagucaugcccuacauaaugauuuuucggucaguguuggaccacaugugugacaugguuucauaaagauuauaauagagcugaaaaauuccuguggccuacggugacaucuugaugaucuuguccuuguauaggccuaggcuaaugugugauuguaucuuaguuuuuaacaaaaaaauuuaaaaagaacaaaaauuacaauuuuuuaaaauagaaaaaagcauauagaauaaggauauaaagaaaaauagugcugggugcaguggcucacgcuuauaguccagcugccugggaggcugagaccagagaguugcuugaaugagcccaggaguucgaggcagaaauaagcuaugauugcacgacugcgcuccagccugggcaacagguaaauuuacuguagccuaaguguacaguacuuaugaagucuguaguaguauaguaaugcauuaggccuucacauucacucaccacucacuuaccaacucacacagagcaauuuccaguccugcagacuccauucaucgugagugcccuauacagguauaccuuuuuaacucuuuuaugcuauauuucuacuguaccuuuucuauguuuagauacacaaauacuuacccucauguuacaguugcuuauaguauucauacaguaacauaccguacagguuuguagccuaggagcaguagguuacaccauauagccuagguguaaauacacucuagauuuaguaaguacacucuuaggauguuugcaucaugauaagauugccuaaugaugcauuucuugucuuggaagguaucuccaucguuaagcaaugcaugacuauauauucccgacaggcagaucaguaauaauaucgugcuaaccccaauuugugauuuuuagugaguaauuuuaccuuaagaaauuugaaacucuccugacaaacauacaauguuuucuguugccaaaaauauuagaagcauaaauugaaauaauaaccauuuuuauuuuucuuuuuugagguuggcaaaaacugcuaaaaaucuauaugcuugaauagucuguaauuuagaagcuacuuacaucuuuauggcuccucccgcuuuuuaugaaaaauuagacaaaaaaagauacuaacauagcuuucaccagauuguuaauguuuuaccaaauuugcuuucguguguguguauguguguguguucauauuguagaguuggcaaaacuccauucuagucuucuuaggguccuggcugggucugagaauuaaaucaauguaacauagaugaacauuuauuacauaacauaagaugaugacauaacauagaugaauauuuauuacaaguuuuacauggaacagaagccauuuuuuaaaaaacaaagaccaaagccaggcaugguggugcacgccuauuucccagcuacuuuggaggcugaggccaaaggaucucgaacccaggaguugcagguuacugugagccaugauugcgccacugcacuccagccuggguaacagagcaaggcccugucucuuaaaaaaaaaaaaaaaaaaaccauaaauaaauaaguaguccgggugcagcggcucaugccuguaaucccagcacuuugggaggccaaggcagguggaucacuugaggucaggaguucgagacauccugaccaacauggugaaaccccaucucuacuaaauacaaaaauuagccagccgugguggugggcgccuguaaucccagcugcucgggaggcugaggcaggagaaccucuugaaccugggagguggaaguugcagugagccgagauugugccacuguacuccacaacaaaagugagacuccaucucaaaaaauaaaaauaaauaaacaaauaguuggguggguggauggauggauggauaaaaauuuuaaaugaucauaaugcauuaacuugucucuuuagucuccuuuaaauaguuuucuacuucaaagacuauuccucaauuuuaauuugucugguuguuuucuugugauuugauucaaauuaaacauuuuuggcagugggagcacaugagugauuuugauacuaauuuuaauuuuagagauuucugaauuaauuguuuaacaaauggauauuuguggcugaacaguacuucagcuucauccuuucuagggcuuccugaguuuuuagaauaaaccuuaagcuauuuuauuucacauguuaauaauuauaaaaauuaaaauucuguuacaguacaaaauuguaaaaauuaaggagauuuuuacuugcauauguaacuuuuacucuauauauaucuggcuacugugacugaagccaguacagcagcaauggcaguagcagaguaacaucugugcacucugucuccucaugucagcuuuggguuuuuuuaaagaccaauauuuuguccauauuaauuacuuuuaaugcaugcauuuaaaccgaguauuguuuaaaugcauacuuuuuuuuuuuuuuugagacagggucuuucucuguuucccaggcuggagugcaguggcgcagucucggcucacugcaagcuccgccuccuguguucaugccauucuccugccucagccuccugaguagcugggacuacaggcacccgccaccacgcccagcuaauuuuuuuuguauuuuuaguagagacgggguuucaccguguuagccaggauggucucgaucuccacuguguuagccaggauggucucgaucuccugacgucgugauccacccgccuuggccucccaaagugcugggaugugagccaccgcccccagccuaaauacauacuugaucauuauuuuuaaccaucaagugugaaaugcugaguaaaagaagucuuaacuuuuagaacuuaggacuugucaaaggaagucgagcucucauggcauauaaacacugauuuauaaaucugcuaugcaucuuauuucuaaaaaugaguauuucaggugauagaauuaaagucauacuauuuaaauauuugucuuagucuucaaauuugaaugggcugcuuugguuacaaaacaacuguuaacaccuccuugaaaaaacuagugaauuuucacugaaguagcauucuuaaaucuacaguuuauucugauaauggaagauguugauagagaaguauaaaacaaggaguuaaaaacuguuaaugucuuggugacuauuauaauaccuuccagaaauguuucugguaugaguucuucaaauauuaaccuuguuaauaaaucuguuuauuuuuuauuuuuauuuauuuuuuuugagauggagcuuugcucugucauccaggcuggacuacaguggcgugaucucggcucacugcagccuccaccuccgagguucaagugauucuccugccucagccucccgaguagcugagauuacaugugugcgccaccacacacagcuaauuuuuguauuuuuaguagagacgggcuuguuugaccaggcuggucuugaacuccugaccucaggugauuggccugccaaagugcugggauuacaggcgugagccacugcgcccagccaaaccuguuuaguuuuaguacacugugugacucaaaaauuguuucacuacuuacuuuacuuuagauggagaggagaaaaccuaugguggcugugaaggaccugaugccauguaugucaaauugauaucaucugauggccaugaauuuauuguaaaaagagaacaugcauuaacaucaggcacgauaaaagccauguugaguggcccagguaagcacaguucugucuuuuucuucauauauucacuuuuaauguuugauggauguuuuuaaguugaauuaaugauucagcauuuaaagagaaaauaagucuucuaacauuguuguaugauuauguuuuuguucuuuuguuugagagagacagagucucauucuguugcccaggcuggagugcaauggugcggucucagcucacugcaaucuccgccugcuggguucaggcaauucuccugccucagaguagcuggaauuacagguguguaccaccaccccuggcuaauuuuuuuuuuuuuuuuugagacagagucuugcucuguugcccaggcuggagugcaauggcacaaucuuggcucacugcaaccuccaccucccggguucaagcgauucuccugccucagccuccugaguaucugggauuacaagugccugccaccacgccuggcuaauuuuuguauuuuuaguagagacgggguuucccuauguuggccaggcuggucucgaacuccugaccucaagugauccacccaccucagccucccaaagugcugggauuacaagagugagccaccacgcccagguuuaacuuuuguauuuuuaguagagaugggguuucaccauguuggccaggcuggucuugaacuccugaccucaggugauccgccugccucagcuucgcaaagugcggggauuacaggcaugagccuuuugcaugccuggccuuuugcaugauuauguugcauuggggaaaaaaaauugauuucugccauguucuguuuucaguuauuuauccuauaaguuucaacaagacugaauugguuuuccuacauuagguuccauagucagccuuuuuuuuuuuuuuuuuuuuuuccgagauggagucucacucugucacccaggcuggagugcaauggugccaucucggcucacugcaaccuccgccuuccagguucaagagauucuucugccucagccucccgaguagcugggauuacaggcaccuaccaccacgccuggcuaauuuuuuguauuuuuaguagagacgggguuuucaccauauuggucggacuggucuugaucuccugaccucaggcagugcacccgccucagccucccaaagugcagggauuauaggugugagccacugcgcccggcccauagucagccuuuuaaccacagacuggugauuuguguuccuagcuagauaaaacaaguugcuaccuuccaaaucucuauucuuuuuuuuuuuuuuuugagacggagucuugcucugccgcccaggcuggagugcaguggcacgaucucggcucacugcaaccuucgccucccggguucaagugauucucaugccucagccucccaagucugggacuacaggugcccaccacacgccaggcuaauuuuuuguacuuuuaguagagacgggguuucaccguguuagccaggauggucucgaucugaccuugugauccgccugccucagccucccaaagugcugggauuacaggcgugagccaccacacccagcgcaaaucucuauucuuaaaauuuuuuucuugaaguaaaauucacauaauguaaaagcagcuguuuuaaaguguacaauuuaguggcguuuacugcauucacaguauuuugcagccaucaucucuaucuaguuccaaaacauuuuauuacuccaaaagcaagcuccauacucauuagcugucacuaucccuucccauucucuacccucagugucugacuaccaccagucugcuuucuaauuuaccuauucuggccauuuuguauaaauugaaucauacaguauauggccuuuuguaucuggcuuuuguuauuuuucauguuuucaagguucauuuauguggugcauguacagcacuucauucuuuuuuauggcugaauaauauuucauucagccagaugugaauacaccacaauuuguuuauucaucaguugauaaauauuuggguuguugacacauuuuggcuaccaugaauaguucugugaacacuuguguacaaauaauuguuugaauaccugcuuugaguucuuuugggugucuucuuagaagugcaguugcuugaucauaugacaauucucuuuaacuuuuggaggagccacagaacuguuucacgguggcugaauuguuuuacauuucuaccaacgguguccuaggguuccaguuuguauacaucuuggccaauauuuguuauuguuuuuuguuuuuugguuuuuuuuuuuugagacagaguuucacucucguugcccaggcugcagugcaauggugcagucuugguucaccacaaccuccaccucccagguucaagcgauucuccugcagcugugauuacaggcaugcgcccccacgcccagcuaauuuuguauuuuaguggagacgggguuucuccauguuggucaggcuggucucgaauucccggccucaggugacccgcccgccucagccucccaaagugcugggauuacaagcgugagccacugugccuggccacucuuuuuuuuaucacugcuaucuuaaugggugugaaaugguuaucugguggguuuuaggugguuuguuuggugauggugguuguuuuuugagauagucucacucuguuacgcaggcuagagugcaguggcacagucuccacucaccgcaaccuccaccucccagguucaaacgauucucaugccucagccuccugaguaccugggguuauaggugcacaccaccaugccaaacuaauuuuuuguauuuuugguagaaaugggaucucacuguguuggccaggcuggucuugaacuccuggcuucaagugaucagcccaccucggccucgcaaagugcugggauuacagacgugagccagcacacccagccuaucuggugguuuugauuugcauuuccuuaaugacuaaugauguugaacauuauuuaauacacuuccuagacauuuuuguaucuccuuuggagaaaugucuauucaagucuuuugcccauuuuugaauugggugguuuguauuuuuguuguugaauugugagaguuccuuauuaauucucaguaguagacccuuaucagauacaugauuugcuaauauuuucucccauuccauagauuuuuuuuuuuuuucgagacaccuguugcccaggcuggagugcaguggcgcaaccuuggcuuauugcaagcuccaccucccaguuucaugccauucuccugccucagccucccgaguagcugggaccacaggcgcccgccaccacacccagcuaauuuuuuuguauuuuuaguagagacgggguuucacuguguuagccgggaaggucuugaucuccugaccucaugauccgcccaucucagccucccaaagugcugggauuacaggcaugagccaccgcaccuggccagucuuuuuuuuuuuuuuaauggugucauuugaagcacacuuuuauuuuuauuuauuuauuuuuuaaauuaauuaauauauuuauuuauuuugagacagcgucuugcugugucacccaggcuggagugcaguggcucaaucucggcucacugcacccuccaccucacugcacccucaaccgauucuccugucucagccuccugaauagcugggauuacaggugcccaccaccacaccuggcuaguuuuuguguuuuuaguggagauggaguuucaccguguuggccaggcuggucucgaaauccuagccucaagugauccacugaccuuggccuccuaaaguuuuaauuuugaagugugauuuauuuuuccuuugguuuuugugucauauauaagaaucuguugucaaaucuaacccuguguuuucccuuguguuuucuuauaggcguuuuauggguuuggcucuuaaauuuaggucuuuggucuuaaguuaauuuuuguuuaugcugugaaguaagagaucagcuucauucuuuugcauguggcuaucccacuaccauuuauugaagagaccguuuccccauagcacccuuguugaaaaucaguugacuguagauuuguguauuucugggcucucaauucuauuccauugaucuauaugucuguccuuaugccaguaccacacuguuuugauuacuguagcuuuguaguaaguuucaaaaucagaaaguaugaggccuccaacuuuguuuuucuguuucaagauuguuugggcuauuugggaucccuugcagcucuuucugguuuugucuguuguuuuguuguuguuguuguuguuguuguuguuguugugggguuuuuuguuuguuuguuuuugagauagggucuugcuuguugcccaggcuggaguguaguggcacaagccuuccuaggcucaagcaauccucccaccucaaccuccugaguagcuggaaccacaggcaugcaccuuuuuuuaaauuguauuuucuguagcgauguugcccagguuggucuugaacuccuggccucaagcaguccucccaacuuggccucccaaagugcugggguuacaggugugagccacuguguguggccacaauucuucuauguuuuuacuauggagauuuuaaaaccuacucagaaguaaagagaacuguguaauacaccuccaugugcccaucauccagcuucaauaguuauuaacauuuugccagucuuucgcucuaucucacaggcuggagugcaguggcacaaccucagcucacugcaaccucugccucuaggguucaagcgauucuccucccucagcuuccugaguagcugguauuacaggcaugccgccaccacgcccagcuaauuuuaguauuuuuaguagagaugggguuucacuguguuggucaggcuguucuugaacuccugaccucaagcaauccaccugccucggccucccaaaguguugggauuacaggcaugagccaccaugcccagcccauuuugccaaucuuaaguugugucauuaucccuacuuuuuuggaguauuucaagcacaugccugauguugugccauuucacuuggaaaaucugcaauaguuccccugcaccuuuucuuuuauuuccaggcaggccauuaauuuuacagagaagcaaggucauuuguaugcuguccauauuucauauugaauuacauuugagcuuuauucuguaaacucauaguuaaaauuccagagacuugauuagacucugauacauuuuucuaagcaaaggauauuuguagguagcacucuuguauuccuguucuaucaugucuuuuagcagugucaagcuugaucaguggguuccagguugucaggcugauucauccauuaaaaauuccccacuaugauuuagcauucauugugauuauuguugagauuuacuuugagauuacaaaacagugacuuuccaauucuguaaaauuuuuugcauuuauuagcuaaaauuuuccuauaagauauuauuugguuacauugaaauacagucuauaugggaaagaugauaaagacuugauuuuuuuccuuuuaaauauaauuuuucagaguaaugaauugguucuucagcaucaucuaauaguaaagaguguuuuguuuuuguuuuugagugaaugucaucaugaauucaugacuauauuucauguuuuucagucuguugcagucauucuuacuggugcucagauuguuccauuugcuucauuuuuaugucagaaagagccacauuguguuagcuucuguguccuuuugacauggcuccguuagucuugaauaguuauacuacuuucuguaauaagauuucuuaggcaugucaugaacauuguuccccgaucccgaaaacagcuguuucuccaaaaaucccuguuuuuaguagaaaaugguauuuaggggccccaaucugggugcugaagauacucauuccuccuugguugaauuguaccccccacuccucauauacacacacaacauggcucugaugaaucugaugaauugcuuuugggcuuuuccacaggacaaugcaaggaaguacuuuaaggggaaaaaaaaucacaaaugccaacagaauuuuaauuaaaauuaauuuuauuuuauaacagcaggcuagaaacaaagagcuuuugcuuuuuauaaauuugaucuuuaguuuaaacacaagauuuuuaucuuggaaagaucagaaaacauucagccucaaacuacuguuugcaugaaaaggagugaaguacugauagcaugcuacaguccguaugcaccucgacagcaugcuaaguaaaagaacucagacacaaaaugucacauuuguaugauuccauuuuuaugaaauauccagaguagguaaauccauagagacggaaagcagauugguguuugccagaggcuggggggauggggaagaugaggaguaacugcuuaauggauuaucggguuuuaauuugggaugaugaaaauguuuuggaacuaaauagaagggauaguugcacaacauuguaaauauacuaaaugccacugaauuguacacuuuaaaaugguugauuuuauguuauauaaaucucaccuuuuagaaaaaucacugauguuugucuaguaucaaagucuuaauaagugccuauaggcaauauuuucaggcauguauuuaagaaaaggaguucuaguuauuggcaaaccaaaauuuaccucauuguugugaauuauuugcugagucccgcaguacuccuuucucccugcuacaguauacccccaaccaacagauauauaaaaggcauuuuguauauauuuuaguauuuuaaaauacuauauucucaaaguauauuuguagaugugaaaugccuuuuauauucagcauacagugcuaguacuagacugcuaagaaaauauuuuaucucuauguguaaaggcuaaaugauacaaccuuuguguagcuacagaaauuuugaagaaugacugaaaaacuguuuaugaaaugcuguuaaacaaaggaaaaugucuugugaagagaucucguuaacaugaucauauuuuuaaaaaaacuaaaggaggaaacaauggaauuccuuuccugaaauguuucuuuugcuugcuugcuugcuugcuugcuugcuugcuugcuugcuugcuugugagugacagggucucugucuugcccaggcuggaguacaguggcgccaucauggcgcacugcagccuugaacucccgggcucaagcaguccucccaccugagccuccccaguagcugagacuacaaguaggucucccaaagugcugugauuacaggcaugagccaccaugcucagcccauuucuuuuaaguaguauuuuucuuauuauuuuagguaaacaguuaaauaguuuaaauagguuuuuuguuuguuuuguuuuaucuuuuaagacggagucuugcucugucacccagguuggagugcagugguaugauaucagcucacugcaacuuccaccuccuggauucaggugauuuuauauauucacuaauucucagaaaagccaaaucagaaaaccuguuauuugcccugacuuuauuuuuacauggcaauucaguacaacacagggauccuaaugauccauaaagacuugauugccuggauugaucuuuuuuaaaaaugauuuuacuuuuucauccugcucgccaaucauaccaccaagauuguuaggaaaagcuacuuaaguuuccaacccacagggagagaauuagaauuuuaaaauucagucuugaugaaucucaaguacuaucuuuuuuuuuuuuuugagacggaguuucguucuugucgcccaggcuggagugcaauggcacaaucuuggcucacugcaaccucugccuccuggguucaagaaauucuccugccucagccucccgaguaccugggauuacuggcacucaccaccacggccagcuaauuuuguauuuuuaguacagaugggguuucacuauguuagucaggcugcucucgaacucuugaccucaaaugaucgcccaccucagccucccaaagugcugggauuacaggcaugagccaccccgcccggcccucaaguacuauuuuaguaaagguuuuuuuuaauguuggccaggugcaaguggccaagccuguaaucuuagcacuuugggauucugaggcagggggaucacuugaguccaguaguucaagaccagccugggcaacauggcaaaacucugucucuacaaaaaauacaagaauuauccagacaugguggcgcucaccuguggucccagcuacucgaggaggcugaggugggaggaucacuugagcccaggaggcagggguuacagugagccacaaccaugccacugcacuccagccugggcaacagaucaagacucuaugucaaaaaaaagaaaaaaacuuagguuaauacuaaaaaaaucagaauuccauaauucauuuggugcuaauugagguuauuuuaaugaugauuaguuugcuagggcugccauaacaaaguaccaccccuagauggcuugaacaacagaacuuuauuuucucacaauucuggaguguagagguugaaaguagaguuggucucuucugaggcucucuuuuugucuuguacauggccaucuucuuccugucuucacacaguuuucccucuaugcccaucucuguccggaucucuuacgagaauaccaaucauggccgggcgcgguggcucaugccuguaaucccagcacuuugggaggcugagguggguggaucaugaggucaggaguuugagaccagccugaccaacauggugaaaccccgucucuacuaaaaauacaaaaauuagccggucguggugcugcacaccuguaaucccagcuacucaggaggcugaggcaggaaaaucgcuugaaccugggagguggagguugcagugagcugagaucccgccauugcacuucagccugggugacagagcgcgacucugucucaaacaaacaaacaaaaagacaccaaucauauuggauugccacccuaaugaccucuuuuaauuaccucuuuaaagaacuuaucucuaaauacagccacauucugugguacaagggguuaagacuucaacauaugaauuuggaggacacaauucagccaauaacauacauaauucuuuuguuuuacaggucaguuugcugagaacgaaaccaaugaggucaauuuuagagagauaccuucacaugugcuaucgaaaguaugcauguauuuuacguacaagguucgcuacacuaacagcuccaccgagauuccugaauucccaauugcaccugaaauugcacuggaacugcugauggcugcgaacuucuuagauuguuaaauaaaauaaauuauaauaaacuguuaacucuuuucaguauuuaauaccuguaguucaguuaguaacuuuuucauauauagcauguugccuguaugcaguugaacuauauaaaguucauugcaaagcagauuaucuuguuuuuuugcauagcaaucaaaguugaaauuuguuugcuacaucaacaaauuaaggacauuuucacaaacugagaaauaaacaaauaugccaauucguaggugguuuugccuuauccuuugaaugugacuuaaaaucagcaaugaugauauaguaaauacugaaauuuagguguaaaucaauacguucuacagggaaauaaugaggcuaaguauuuuuauguuuuuagugguuuuuuagaaaccuaaucuuauagccgccauuagcauuacuagaguuaugcaaauaauugcauuauaaacauguuuauaacuuagccaaaacauugauuuuuauaacucuccaaguaugaguugaaauuucuuaugucuuuugauaaacugcaguauucuuuaaguguacuuuguccuuuuguuuauugcuacaauuuaagaacuuuauuuaaaaacaauuuuggaagguuacuagguacagcuuuugcagaagaaacugaacuguagccagauggucagcaaguaaacuacaugacuuagaguucuugugcauuauacauuuuggguaauucaaaguacuguauuugcauugacuauaaagcgucguuugcaauauuuauucuuccuucauagucccuuguugugauuauacuuccaguuguuuaaauguauuuuaaaagacucacuauuaacuuuauucagaucuuaaaagcuacaccuuuuugaacuauuccagucuuucuccauccaauuagaauguuauggaauaacaugugaagagauacagugaaaaucauauuauaaugcauugaagauauccuacaugaauuaucuucuauuaaaauaugucccaauaaauauacccauaaucagugggucuucuacugaaaucaagcucauucagcuuuucuauuaagcagccaaaaaauuuuuugaaaaaauaugacagcaucauuccuuaugcauggggaaagaagcacuggagauggguuuaguauugucuuuaucucagagguggaacaaaguugucauuauagggucuauaaacuuaagucuccagcuuauuugagacuggcuuaauauggcugagcccgguggcucaugccuguaaucccagcacuuucagaggacgaggcggguagaucacuugaggccaggaguuugagaccagccuggccaccauggcaaaaccccaucucuaccaaaaaugcaaaaauuagcuaggccaugguggcacacgccuguaaucccagcuacuugugaggcugaggcaugagaaucgcuugaaccugggagguggagguggcagugagccgagaucgcaccacugcacuccagccugggugacagagcgagacugucuc

SEQ ID NO: 191096 - RNA, 1908 nt, Homo sapiens
uugcaucauagguagcuuauuuuauuggauugcuuugccaauaacacuucuaacacucaggagacuucccucagacacaugccuagaaggccugagaggggcaggucuggccacaaauucaaacuuucuucaguguuuuucaugucuuucucaccaaaagcgaagccaagacuucuccucucauccccucuucccaggggagaucagucuccgguguacgguggcaggcuaacggaggugaccaggucaucauuggucaggggcuggcuucggacacgcucuagcaucuucagaccugcaaaagaauugccuggagcugaagaaccagagucccauuacuggggcccuuaguaggcccagacuccaccaggaagguuccagagaggaugucaccccagcccaggucuuccaagguaacccauuuacuccucccugcuacccucuccucccugagcaaucgcaugccacaaaaaugagcccuucccuucccaauggacucugggaagcaccuggauuccccagccacacaagggauucuucacgaauccaagaugccacacaacacagccagaacuccaccaucaagcccuccaccuccacaguucggccaaggauaccuaccucgagcgugacacuuggaguccuggcuccccacgcaauggaacaugagcagcagccacugcuuugccauuggugguccgacuacagucacacgugucuggccuguagcugugaaacaccucuccagcugaauaaggguguggcugugcagcucaaugcagcgaagguacgugucaucaaguccuguaagcacaagaagugagaagagaaacugucagccaccaguccuuggggagugaggagguggccuugaggguagggaugugugacucaugaaggugggaggagaggggaagauugaaaaucgagaaggggaugaaggaggccggccuagcgcagugacucaugccuguaaucccagcaauuugggaggccgaggcagguagaucaguugaggucaggaguuccacacacgccuggcuaacauggugaaaccccgucucuacuaaaaauacaaaaaauuagccgggcgugguggcaggcgccuguagucccagcuccucgggaggcugcggcaggagaauggcgugaacccgggaggcggagcuugcagugagccgagaucgcgccacugcacuccagccugggcgacagagauuccauaucaaaaaaaaaaaaaaaaaaaaaaacacgaggccgggcgcaguggcucacacuuguauucccagcaguuugggaggccgaggccggcagaucaggaggugaggaaaucgagaccauccuggcuaacacggugaaaccccaucucuacuaaaaauacaaaaaaaauuagccgggcgugauggcgggcgccuguagucccagcuguucuggaggcugaggugagagaauggcgugaacccgggaggcagagcuugcagugagccgagaucgcgccacugcacuccagccugggcggcagagcaagacuccgucucgagucucaaaaaaaaaaaaaaaaaaaguacaaaaacuaguuaggcgugguggcaggcgccuguaaucccagguacucugcaggcugaagcaggagaaucacuugaacccaaaaggcagacguugcagugagccaagaucacgagcgagaaucugucucaaaaaaauaaaaauaaaaaacagaugaaggaggggacgugggcaaaggccacucaccgaagaugagcuccuccugguccucuuccauguggaacaccauuggagaaugaaaguuuucgggcaggguccaccacggcuccuugcugagagcacucguucccacggccaugcugugcucccaccugauucagaauaggggaaagucuaacaaac

SEQ ID NO: 191097 - RNA, 3709 nt, Homo sapiens
uggaagcggcacucaagaugguaggagaaugagcuccuguuucggagguccggggcgcgugaagugcuggggauguggcucuggggacuuggaggcucagcggcuccggggcuccgggguuccggggcucgggagcgaguagugagugacugggccugcuguucccacagcugcgccgcgaggcccgccugcgccgcgaguaccuguaccgcaaggcccgggaggaggcgcagcgcucagcccaggagaggaaggagcggcugcggcgcgcgcuggaagguaaggcaucggccccgcgggcgucugcgugguaaaccaccccggcacgcauuuguguucgaauauccgagcgucuuuccaaaugcuugccggccguuuuccuugcccauuggguucuccuguugguuuugagaguguuucuuccgugugaugguauuaauuacuugucacugacguugcaguacccggguuuugcagcuugcccgcugugugcagugugucaaguucgucccaaguuuuaaagacuuuaucuuguccuguagaaauucucuuuagagcgguggcucacugcuguaaucccagcacuuugggaggccgaggcgggcggaucaugaggucaggaguucgagccugaccaacauggugaaaucucgucucuacuaaacauacaaaaauuagccggccgugguggcacgcgccuguaaucccagcuacucaggaggcugaggcaggagaaucgcuugaacccgggaggcggagguugcagugagccgagauccugccacugcacuccagccugggcaaaaaagcaagacuccgucucaaaaaaaaaaaaaaaaagaaauucucucuaaagacuaucuggauagcgcuggugcugcagacugcgcugcccauccucccugcaggaguuccucugagcuccguggggaacagugcuggccccgagugcgcaccuggagcgcugugcucugcgguaggcagccugugguccagggcccgcugaagccaugccuucgaagcgcugugggcaucgugaccaacgguuuugcugucugagagcuuaaaggucucugguccaccaucauacguacagaacagucuauauuucuuuucaaaaguaauuuuuaaggccgagcgcuguggcucacgccuguaaucccagcacuuugggaggccgaagcggguggaucacgaggucaggagaucgagaccauccuggcuaacacggugaaaccccgucucuacuaaaaauauaaaaaauuagccgggcgccguggcgggcuccuguagucccagcuacucgccagccugaggcaggagaauggcgugaacccaggaagcggagcuugcagugagccgagauggcaccacugcacugcucugccugggugacagagcgagacuccgucucaaaaaaaaaaaaaaucgauguuuagauuucuaccugauuauaaaagcaauacaguacauuaagauauuuuagaaaguccucaagucaugagacuaaagaaaaugaaguccuaguaaccacuguuuauggggguuggccuguagaaaguuuugucaccucuauccaugcuuuauccaagcucagaaagggcugagguauuuuuauuucaagcaugugcaggcuaauaagcugugguguauuggaugagcugaggucuccaugcuugugacucacucagccccucucucuucccucugcagaaaaccgccugauucccacugaguuacgccgagaggcucuggccuuacaggggucccuggaguuugaugaugcuggaggugaagguaacuauacaagguagcccuccccaacacugagcuggcaggucuccaguccuuccucagacacaccgggcaccaucccaucagaggaaacugcuccuggaacugucccccaugcccuugucacugcacagauggcauugcagggcucucccugagugugcccugucccacuuacauggcacacaugggagugccucacugacucugcaccuggcuuguuaauuaccucccccacuggagugccugcuggggaaagacagugucccucacacauuauuggugcccauacguuuauucacugcauuauucaagaaacaagaaaggaaucccaaacauuauagauauuuguuacgagggaaaagaguuugucaccguuggccuuagcagaguguggauuucguuguguaauggaguagcugcuuagccccaugugacuaauauagcuuaagcaaacuacaauuaaacaaaagauucuguuucucagccacgcuugugcucagcagccagaguaguuggaggcugcccucuugcccggugugcauguggagcauuccuauuguugaaggcuucggcagacagcgacauccaggcggucuuggcugccccgaaguuagcauuucauucccaagacugucauguucuugccccucgugcuccugacaggugugaccagccacguggaugaugaauaccgaugggcaggagucgaggaucccaagguuaugaucacuaccucccgagaccccaguucccgccucaagauguuugcaaagguacuggugagcagggagugagggagagacacccaggacacacagccccaguccugacuguacacugccauccacgcccaggagcugaagcugguguucccgggcgcccagcgaaugaaccgaggucgacaugaagugggggcacuggugcgagccugcaaagccaacggcgucaccgaucugcuggucguucacgagcaucggggcacaccugguaaggccggagggagggagucggggugggagccgucugagggcagacggggucucugacagccaccuuuccccgccaguggggcucaucgucagccaccugcccuuugguccuacugccuacuucacgcugugcaauguggucaugcggcaugacaucccagaccugggcaccaugucggaggccaagccccaccucaucacacacggcuucuccucccgccugggcaagcgggugagucugggggccuucaggcuggggcugcgggccaggccaggcauuugccacucuguuucccucucuuuccuugugccccaggucucugacauccuccgauaccuauuucccgugcccaaagaugacagccaccgggucaucaccuucgcaaaccaggacgacuacauaucauuccgguggguccacgggccaugccccaggaaagcauccccacccuguguaccucgugcugcuugccguugacccacagcuguucccucccaggcaccauguguauaagaagacagaccaccgcaacguggagcucacugaggucgggccccgcuuugagcugaagcgugaguuugaggcugaaucccgugucugggguggggaggggaggcuggcugugccggggcugaugccaucccugccugcaguguacaugauccgucugggcacgcuggagcaggaggccacagcagacguggaguggcgcuggcacccuuacaccaauaccgcacgcaagagagucuuccugagcaccgagugagcacacucaccacucagucaggacauggacuuggaacucaggauggggcugucauagacagacccaccaguaggaacugucacagaauggccugcugaacugggauguggaacuguggcggguggagaggucugaauaaaccgucugugucauggc

SEQ ID NO: 191098 - RNA, 45556 nt, Homo sapiens
ugcaacacaagucaaucuuuauugaaaacugcaguauuaauacauaacaauucuuguuacaauaaacgugcuuuugagauuuuuaaaucugagcucaucucaucagauugcauaaaaaauuaaaauaguaucaauugacaccuaacugaacuggcucaggauggaaauuccauuccuuggcauggauacguaaguucaaugcagaggugagggaugccuuuaacacuggaagacaaugcugacuuagcuuaaaaaaaguaccgagagaacgguguaaaaaacgguauuuaaaaaucauuuuuaaaaaaacaaaaaggaaccguuucuucuuuaguuacaauccaugaggcucucuagggccucuccguguggccagcacagcaacccugcuaggagcacaaacggcuggccugagaucuggcccagcugccuugcccacuggucugcacagggacucaugggcacagccuguggugaggaggagacaccugucaugccaguccugggagcacaccacccuucugcaggcccgggggggggucccuacacagacgccgcucauccucugucuccccuucccaagugacuucacuucaguccuguggaccaagauaaggcuauccccacaggcucucucuucuucaaauaaugaguaggaaaaagagacaaacuuucugaaacaugcaguuuccgacccaaauaggccacauaccccaacuucuguguuacuuggucaguugagccccuggagcccucaggaccuacugauaaagcauguccucugcaguauacucaagagucugcugcccuucagaaagccagagggaacacucacaaaugcagagguacuagaggggagaaauacgugcucugccuucccccaggccaaccacacucugcuuuagagacccucucagaaagcaccagagaggaggaccagacgcugccacccaccucaagccacaccccugccaccugcugcugcgcccaauggagguccuguccuguccgggcaacagccaaacuggcgacaauggacacauccaacagucagcugucggauaaggugaagguggcccaacugcucagaguaacacuguucucaaauguuuaaaaaggacaggugaagucugggucuccuuuuuuaaagcagacaccaauacuuacauaacuaguacauguuggccuuucaccagcacucacuggcacucacaggugccuuacauaccuuacgggggccaacacugacagguauuaguacgucgcaaguugcuguaauaauguauuuccucucguuacuguugugucccccaagacacaugcaaauuauuuccuagaccucauucaucacagccagaugaugccaccagaaagagcaagguacuguaugcccagcuggggaagggcaagacacucacugaccaggugcccaccccaaggcucaggaccacccccauugccugugaacacauuugcauagcacucaagaagguuucccagaauagcgacagguaggccuacaaaccacaccaagaagaacguucuuaacagauggcucacgagagacauaaaagguucuggaagugccuucaggcccauuaccaugacuggcccugacucuggcccucacagagcggcaaguucaugggucacuggcucacacuaaaugcucagccgccagcacagauccaaacaagaccuccaugagcagagaaacugcagcggcugaacacacuccccaagccucaggggagaagguguagaacaaauauuuuuuaaauagccaucaugauguccauguuuacaugaacuagguccuuugcuuaccugcugucucaacuucuaaaagaauaguaauucagcugaaggacucccaaauuaggaaugucaaacacacaaaaagcaaauuucucagaaugcuccaccauaugcuucgggacaaauuaugaagcuuuguaacagaauuuugacccaaguucuauuucuuaauugacuuuaauuuuacuagaagcgaauguugauaaaauuacaaccuaugacaguuuugugacuauuuccuaaguccagauucuuaccugauaucuaccuuucguaucugacagcugacguccuaaaaauuucaaagucagaaagauuucugcacggaugugcaaugcaaacuuauuucauaaagccucucaacuucauaaaagggaaaaaagguuaaguuacagggaggaagaaaaguguuuaugaagcugauguaaauggcguguggggggugcagcccacucuuuaaaacaccauccugugugugccaaguaccaagcaagccugaagagaugccuguaacuucuaaccuccuccugaaccccaagacuccagcccucacaggaguuguacauguauguuuccauuuuguuguguggggcuuuuuaaaagcauacacuaacauugugaguauuuuauccuaaucuauuagcacucaauugggaaaaaagacuucucugcuacuuggucagcugaaccccuggaaccguuagaaccuacuaauccugccaaccauccacuaaacagauggaauuaccaacagagacuugaagaaaggggcacaaacugugugccugcgguaaaugucugcccccacacauagacacuaagauggauuaagugcucaugaagcaauuuaaaguacuuaucaguaaacauucuauguuaauagacaucaggaauaaagaaucugcuguuuacaaugauccaugcaaaaauauuccuaaacuucuuauaaaauaagaugugaaaaagaaaauuauaagaaguacuuacuauaaaaaauaagguuaccaaaggcucaguggucagguguccccccaccaaccaacuggggcagaaugcuagugggcauccucacugggcgccagugcccugacccagcuaccagcaaaugaagaggagcagagcccccuccccaccagagcccacagcacucaaaccaccacugcacugggaagaagacgcacgcuccugcccuagaggccgcugaaagggacccaggccuuacaucccccacccccacucugacccucacugagaaccgacaugcacucucauggauacaggacgggcauauuuugggggcgggguggagggaagccuuuucauuucuuauguacaagauucagauccuaaacucaaauuccucucccacaauaaacccugccagcaaacgcacuccagcacugccuggcccucucugcugucugugcuugcuuugugccaagugcccucagcugcaaaagagauggcaggagaggcucgcagacaacagacacuggccucccccucgccccaucucuaagcguccccuccagccggccucagcagacaagucaccaccaucaggugggugaucccagaagcagcuacagguuucuacauuuccagacauauccacggcccugccuuucuacaagaaauuggaggaauuuuaaauaaaguuuuguucccuuuuaacucauucuuaaauauaccacuuucuucauaacauacagcugaaaccuuugcccuucuuuguuggggaaaaacagcaaugccuaccuguuuucagcugauucaaacauuucuccaggaaaaaaaaaaaaaaaggaaugauuuucuaagcuaaauaaagcagaggacaauaccuccugcaagcauggcuguuucucuuucacauuucuuccaucccaggaaaauaauuuaguuuuacauaggacuuuuccaauaaagacauauaaaaacaucaucucucuaagagaacuguaaugaaaauuuagauagcagagaaacugcuuugcugacacauaaaccaccccccucgccccaaauuucacuggccacacuaccauaaucuuucaugaugagcuuuaagcaugucccuguuccacugacuccaccaagccuaaacucaaagggauguccaugaaccagcugcacccaagcagcuguggcuucccuacucucucccaaaccucgcaacucccucccaggacagucagugccaaagaaacaggucgcugaaaacuaaaauguccacaucccuaacuggcaacccacaucaaccccaaaagguugaagaaucaucuaagauauuucagaugcucuaugaagaaauucacuuuaacacuuauaacuguaagacuuugcauacauuacaacagugcauuagugauacaaguuguaaaauacguuuccauuccuuuggauuuugcauaugaugguuuugcaucagucacugcagguagauugagcaagcuuuuuguguuuguuuuuuuaaacaugcauucaacuagauaugauucagaauagauuaauacucccuuuuuaucauuacaguuagcuaaaaaauugccaggcaguccacaaaacagaauuugcuuuaagaccaacccacagagucagcuggagacuaacggcgcuggggccugcugggccgggauauagucguguuuagcuaagugucgagagcauuaagaagaaaguccugguuggaggcgcaaggccugcagcaccagcuguggaauccccaauaaugugacugcacagcuccguccucaaaccugcagaaaggaagacagacacucagucacacagagcucuuccggcaccgcuauuccaaaaucucaaguaggaugaggcccagcagggucggaaagggcagcaaugggcaaaacugcuggaccugguucucacuuccuuccuagagacccccaauugcaacuggagcccuauuuccuguagcaggcaggugggggguuagagcacauuccaggcaaggcucaagauggacagugucaacaguagguauucaaugguuccuuccuuccuucuacucuguaaugucucaauaaaaacaaaaaauuuaaacacuacauugccucuggauccagggucaggcacacuuuccucguuagugcuuaaauaugugguaaauuugccacugucccauggaaaugcccuuucaucaaaggcuagcccagccuucccuggucacuuacauuugcaggugaucaccacugagggggcacauagcuguaagugggcguuccuggggcccgguacgugggcacagugaccggguggggggcgacaggaguuggggagugagcagucagcaggguaccuggaagaaagagcagcacaugacaugaggcugaccuccugcacagcuccacacugccugauacgcacacaagccuggccucuuugcaaggaggaggguauacaggaagagggauagucuugacccagauacugucagaacucugauuagauaaucccccacacccaaaaguugucuccacacagcaagcuccacagacaauauguucguaaaagccuuuuguguguccccuucauaaagcacacccaauaauuuuuauaggucagaugauaaacaaaugaguaugcuucagccuuaacaaggaaggagauucugacacaugcuacaauauagaugaaccuuaagaacauaauucugaaagaaagaagccagucacuaaaagacaaauacuuaaugauuccacuuagaugaaguaccuggaguagucaaauucagagacagaaagaaaguagaacagggaauuagcguuaaugaguacaggaguucagauuugcaggauaaagacguucuggagcucuguuucacaacaaugugaauauacuuaacacuacugaaccguacuuaaaaaggguuaagaugggcugggcacaggggcucaugucuguaaucccaacacucugggaggcuggggugggaggauagcuuaaguucaggagcuugagaugcgccugggcaacauagugagaucccagcucuacaaaaaguuuuaaaauuagccaggugugguagcauacuuauagucccagcuacucaggaagcuaaggugggaggauggcuugagcccaugaguuccagacuacagugaacugugaucgcaccacugcacucaagccugggcaaaagggcaagacccugucucaacaaaaaaaaguuaagaugguaaaaacaaauaaauaaaaaacaagaggcuggcaacagugacucacgccuguaagcccagcacucugggaggccgaggcagguggaucaccugaggucaggaguucgagaccagccuggccaacauggugaaaucccaucucuaccaaaagguacaaaaaaauauuaggcaggcaugguggcaggcgccuguagucccagcuacugggaaggaugaggugggaaaaucacuugaaccuaggaggcagagguugcaguaagcugagaucacaccacugcacuccaucuuggcugacaggaugagacccugucuuaaaaaaaaauauuaaaaauuuuaaaauuaaaaaaaaaaaaaagaaaugaggauucuaaacuacaugagcuucugaguucuuuaagagaaaucuauuuuuccuacaacugcagaaacucaacaacuacuugagucccuuuauggaccagcaccaccuccaacacaguggcacccaaccuggugccugcugcccucccucccugugccucaaaccagcaguuucugucuaugcccaguuuccuguuccuugacagauaaguauggggaaaaccaaaucagagucuacauugaagcacacauaauaacccggaaugcuuuucucucuggcauaauuuccuuacacugaagucaaguccagaaaaacaaggagggaacaguacgcuuuugugugggcaugaccuaaagguggucauauugacccagagaccaggaggugaauccacauggguggucauacagauuggguggucacccaaucccuagacaucagaucaaacccccagggcuuccgcggagaugugcccaucccagccaggggccucaucuuuccaugguuuauuuuccuuagaggaggccuugcaaaguaaaguacgguagaugaaugccaaaggauuucuacaggcagcuguuucuucuaucaacgcaagaccagcucuccuagaugcaugaaaacaucccgaugaagacaacugaccugcaaagacaagcuccccucaagggaaaggaagaaggccagagcaaccccgguacacaaaguguccuccuucuacucaagucuuacauggucauagggggugggaggagagggggcacauccugcauugccaaauggcucaguucaccaacaaagcgaguccaucagauucagagaggccuccacaaggggucacucagguaggcaaaauaaaagauaaccugcuguuucuuccccaaagaauuuucuguccuuccacacaacuacagcuaugaaaaccuagagccaagggucagaggauucgugagcucuccccucccccagcucuaggguacaccauaggacagacaccgcaggaacgaggacuuaccugcugacauggccaugguggucccagccaccaugcccauggugaccccguugccucuaggaggggggaugggagcaggguacaccguugcaggcaugccguugggcugcaccaccguggugugguggaugacgugaggaggugcugcauacagcggcuguguguaguacgugccuugcuguggggagaagagagacaacugacacagggucccagggccaaaggaugaacgcccaggugguaucaccccuucccacacagcaguguguacccaagcauaccugugcauacgggcucugcuggggguaggcacuucgcacaggguacacggcagucugguagggguucggggaggaggaguacgguggcacagccccgcuggugggggaacaggacacuuuguaaggugugccaggaguguaaccuggaacaaagaaggcaauggccugaguucacccaagccgguccaggcgcagggagaggacacaggcagggaggagcuaagcugcgugucagccccacgcaacucgccagaccugcugccacugccgcccccacucuccuccacuaagaucugacuucauucuuacuuuguguacgugugugcaugcacgugugugugguggcaggguguuggggaggaggaaaaaauaccaaaagagaacguucuacagauggaaugcucacacaaggacaggaaauaaaaacugucuuguccugcuggaauuuaaauugguauggcauuccuggggcuaaacuuggcaucuaaaguauauaugccuuuuaaucccacaauuccacuucuagaagucugucuuaaagcaauacacauggaucuauacacacacagagacuuaacuguaagcaugcucaucauaguguuguuuguuacagcaaaaacaggagaaacuugcccagcaccaggacuggcuaagcacucuaugguaaaaagcccucuggguuaagggagaaagcugaacacacauacuugcuuuuguccccacacaaaaugacaugaaaaugacaauaaagcagauuaagagaaaaaagacauaaaacucaccaagaauggaagagaagacagcauguugaagccuggcaagcugaaguggaggaugauugagcagacucgagaagaaggcacucagccagcagcgaggagcagcuggcaccaagagagccguuccccaaagcccugcaaacugcuggccaccaacccgucuccagaagcagauaaagagaccccaucuaguagagugguugaguuugcugaauaagcaguuaggugucccuuccugaccccaacagagaagagggguuuggucucaggggagggagagggucucuggacagcuauguucacagcagcuauauucacaaugaucaaaagcuggcaauggcccagaugcccaccaggagacaaauggguaaacacacuguggugcauccauacaaauccuacugagcaagccaaagggacaaacugcugauccauacaagcacaugaaugaaucacaaagccacaccaugucaaaggagccagauacaaggacacaugcuggaugcauguacugacagaagcucuaggaaagaccaaccuaauccagagucaucaaaaccccagcaauggugccaggggccagaggggcaugcgagaaccuuuccaaagagugcauucacucaaauguggugacggucauacagcuguguaugacuguccaaacauaccaaacuguacacugagaaggauuaacuuauaauauguaaaucagaccuccauacaagugcuuauggcaucucacauucccaugggugagagcaggagggguggagcacucacacacuguccgugucagacagugcaacuuugcaagccagagacacaucccgcaacauccagcaauccacucccaaaacuuccccuagaaaaaugaaaacacagguccacgaaagacuuguaaaaaguguucaaucuuauuccuaguagccaaaaaugggaacuaauccaaaucuucaucaacuggagaaaggauaaaucaugauaugucucuauaaacauuacucagcaaucaaaaggaaaaaacauggaugaaucucacaacaugcugagcuuuccaaagaagcuggaaacagaacagcacauagagcaaugaucccguuuauucccuaacaacaaagaaauuuaccuacggugacggaaaucagaggggagagggcgaagaaagcguucugggaugaucaaaguauuccauguuuuauuuggaguggugguuccaugggcauguacaacugucaaaacccacccaguugagcacuuaauauguggguguuuugugcauaaauuauaccucaaguuugaaaaaaugagcugaguauaaagaauuuuggaucaccugagccggaggucaacgcugcagugagcuguaauuaugccucugcauucugccugggcgacaaaguaagacgcugucucagaaaaauaguaauaauaauuaaaguuaauuuuuaaaaaauuuuacacaacugggcuguuagcaauauguacguguguguauuuuuuuuuuauuuuuauuuuuugagauggagucuugcucuauucccuaggcuggaguguaguggugcaaucucagcucacugcagccuccgccuccuggguucaagcaauucucaugccccagccacccgaguagcugggauugcaggcaugugccaccacauccagcuaauuuuuguaauuuuuaguauagacgggauuuugccauguuggccaggauagucuggaacuccuggccucaaaugauccuccugccucagccucccaaaguaguaggauuacaggugugagccuguauauauauaugugccugguccauauauuuuguuuuaauuugaaagggaaagagaaugauuggcccccugggaaauucacuagucuggggccuuuuguuuggggugccagugcaauucugugacauggauauauugcacaguggugaagucugggcuuuuucaccuaaauacugcacacuguaucaauuaagcaacacgaagccuucaacaucagccuucucauacuccccugcaugcccuuucauggucucacggugggaggugcuguggcugagaucugcagcagaccaaacaacaggugguccuguccuaugcagcaaagcgggugcucacacccagauuugucugcauccagaguccugacccuucuacccaaaccaagcaacucccaaccucagcuagucuccauuugaagaaagaaaagauuccuccagggcucccuguauuuugaaauucgcucaccgcuauguuaaccguaaauagaaacacugccaaaauuugaauacaacaacuuuuuaauacuggugcuuggccaaaggaaagcagaauacgcagauuuuccauuaggauuuggaaaagcaaguuucaagacaagagcaguuacagaguuuccuucucuggcugcucaucuccucgucuuuaagaaggcuaaaaaaggaaagugaaaaggaaagcuucacagguguacacagguuaaaacucaucaaacugaagcuuuaaaucuguacacuuaguuguaugccaauuacgccacaacgagguuguauaacauuuucuuuaauuauaaagaaaaagguagugugaaugccaucaaagaauuauaaaggaaaagguaguguguccggccauguacugauacucccaggagacccgggacaguccaauucccccuaagugacuagcuaacucagggaagaaaugcaaaaaggaagcaugguguguggcgggcacacaugugacuagugaauggugacuggggcauuguaccaacacagagaggcuauucaccaucaacauggggccaugcccugucacagcggagaugaucaggacagauccagcccucuccauaaggugcuuggcuucagggggaaaagaaaucacaggaaaacaaaccaccaacauagcagcauuuuaugcagucuuggcaagcaaugaggagucagcucagagaggggcagguggggcaaggaugucucaaaugaaagaaacuguggggaugagggacgucaagggucaucuuggauagcucccuucuccccagccacaccaccucuuucauuucccaccaccaugcagcagccagacaccagcggguaccuucagcuguaccuaaaggagacacugccgaaugggauccccacuguacggcuuaaucccaguuuucugccucauauuuccacuagccugaaaagagauccucccaggagucaccaaacucuuaucugaccaagaugauauuuuuuuuauaaaaaugucaaaacauagagcuacccucugugugucacauccugagaacagaugcuagacuucaaaguugggaaucucauuccaaacuuccaacaguuuaaacaaacaaacccacaggguucccuuucuucauacaauuaaaaacauucaugacagauaacuggaaauaugaacacugauuacaaucucaguagugauaaaaaaaauuuuuaggugugacaaugacacaguucuaauuuaucuuuuaaagauaauauuuaaaaagcugaugaauauaaugucugagauuugcuucaaaauaauacagaggaaaguggcaggggcccagaugaaaaagaucagccauaaggugguaacugcuaaagccaggugauguguaggugggaaguauauucccauguacuugugcuuaagccaggugaugugugagcaggaauuuuuuuuuuuggauggagucucgcugucucgcucugucacccaggcuggagugcugacaccaucuuggcucacugcaaccuccaccucccagguuuaagagauucuucugccucagccucucaaguagcugggacuacaggcgugcaccaccacacccagcuaauuuuuguauuuuuaguagagaugggguuucaccauauuggccaggcuggugucgaacucccaaccucgugauccgccugccuuggccucccaaagugcugggauuacaagcgugagccaccgcgcccggccgugaguaggaauauucccauguacuugugcuaaagcaaggcaaugugugagugggaauuauguucccauguauuucuguaaauaucugaaacguuuccuaaucacucuuuugaagucaaaguauuaaaaaauacaaggaagacugcuacagauugaaagagauaagagacauaaauucaacuuuauaaaaaauucacuaugugaugcugaguacauuauucugauuccaaacguuuuuuaaaacuuaggggguaacugggcaaauguaaauaggagcuacuuuuaaaauuagagaccugcuguuucuaaguguggacaggcaaaagcacaccucacucauguuagggagggcuacacucaaguccauuggacaagacacaaaggauucugaauugauuccacaagaauaaaagaaaaaccacacaacacucauccuuacauaagguaaauauggggaaagaucacuggggaaucuaagugguggguacuauggacauccacuguauuguccgcucaacuuuucuguauacguaauuuuuuuuuuuugagacggagucucgcucaguugccuaggcuggagugcaguggcgcaaucucagcucacugcaaacuccgccucccggguucacgccauucuccugccucagucuccugaguagcugggacuacaggcgcccaccaccaagccuggcuaauuuuuuuuuuuuuugguagagacgggguuucaccguguuagccaggauggucuugaucuccugaccuugugauccacccaccuuggccucccaaagugcugggaugacaggcgugagccaccgcgccuggcccaauuuuuuuaauaagguggaaggccgggcgugguggcucacgccugucaucccagcacuuugggaggccaaggugggcagaucacaugagcccaggaguugagacgagccuagccaagcuggcaaaaccucgccuccaaaauuuaaaaaaaaaaaaaaaguaaaaauaagcaaggugaaaaguauacaguacuuucagaugcugacacacaacugagagcguguacgcuagccagaaaaucuccauggaaacaacagucaugcaugagguaaaagaacaagcaaggaaguuagcugaaagggcccacggaucaccacacccaaacgcaccccuagaagaugaauuauagucaggcgcaguggcucaugccuguaaucccagcacuuugggaggcugaggcaggcggaucaccugaggucaggaauuugaaaccagccuggccaacacggugaaaccccaucgcuacuaaaaauacaaaaguuagccaggcuugguggccacacgacuguagucccagccacucgggaagcugaggugggagaaucagcugaaccugggagguggagguugcagugagcagagacugcggcaaugcacuccagccugggcgacagagggagacccugucucgaaaaaaaaaaaaaagaagaagaagaugaauacaaaauuuugccaagccuuuaaaaaggccaucagcaggaaggauucuauagcagucugaaagaugcugaucuggaagauggccuggcaguuaggcauaggcuggaaaaaaaguuaaacuaugccacuggacauguucaauauauacagccaaugugcaacaagaaguuacaguucuaucugauaaacugauucacuaaagaaagaaugagaagaaaaaggaaaagcuguuaaaagaagucaaaacaagcaauaaacccacgacccacauccaucaacauugcuaauaagaaaguccuugaccuuuuuaucacucuucaaacugcagaaagagcucagagugaagagaagaugcaagcugccaacccaaacaaaccucuaauacagaguauaaaaccaaagugaggaaaaucugagaacaccucucuccaaagagggagucucucagccacaagugcucaucuggcccaccacagccacugaaaaaaggugaaguccuuuuucaugccucauuuccuuaggauacacagucgaggggcccaccuacgaugucuuccuuuucuucuacuggaagccucccacugcagaaaucccugcagcuagcccuagguuucccaauccaaucacccaaggugucuuuuuuguuuuuguuuugagacggagucucgcucuguugcccagguuggagugcagcggugcuaucucagcucacugcaaccucugccucccggguucaagcgauucuucuaccucagccucccgaguagcugggauuacaagcgugcaccaccaugcuuagcuaauuuuuguauuuuuaguagagacuggauucaccuauguuggccaggcuggucucgaaguccugaucucaagugauccacccaccucggccucccaaagugcugggauuacagguaugagccgccgcguccggccuacccaaggugucuuacaacaccuacuuuacagguaggcguugcugaagcaaaaggagcgacugcuccaaggaagcaugcauaugcaacucagcaugcaaugcaugggaugcuaaacuugugcauuucacacaugcacauuuuacuuaaaaacaaaaccaaaaaggaacuaaacaaauaaugaugugcaugcucaaguuauugagguaagauauacugaggaccacaacuuacucugaaaugaaacccaucaaaaaauaagauggacugaaggauggauggaguaauguguaugugauacaaguaaaauguuacuuguaaaaguugacguuaaaaaguuuaaucguagaaucuuagcaguccauauauaggugaucacugugaaguuucugcaacuuuucugugacaucugaaauuuuuuaaauuuaaaaaauuuaaucguagaaucuuagcaguccauauauaggugaucacugugaaauuucugcaacuuuucugugacaucugaaauuuuuuacaauaaaauguugaaaaaagucaccaacgauuucuaaucacaacaaugguuuuuaauauauauuaucuuacuguuuauucuuaugacugugaggcuacguucuaaugcucaccagaaaacuuuuggucuuugguuuaggcaugaauauuacaccauuuucuagccagcacuuaagacaagugcauuucaaguaaggcaaacaggucucccuaucaauuuaagacuuaguguggggccaagagcuauggugcacaccuguaaucccaacacuuuagaaggccaagaugggaggauaacuugauuccaagaguucugagacuggccugagcagcauagcgagaccuugucucuacaaaauaaaaauuagcaaggcauggugggguguaccuguagucucagcgauuuaggaggccaaggcaggaggaucgcucauugagcacagcaauucuggguuacagugagcuaugauugugcaaccacacuccagccugggcgacugagcaagacccugucucuaaaaacuaauaauaauaauuuuaaaaauuuaaaacacuaaguaaaaaaauuuuuuuaauuaaaaauagacagugugugcuugccaccuuuuuuuuuucauucagcacuaaguccaccauaucccuccauaguaacucaacaggaacuucacaaacuuuaaauaaauacacacaauuaccucaucguacccaaaaauauacacugccucccugaaauaucaaauucauucagugcuaggucuuuccaaaacaacagcuuuucagauucucccuccccaggaagcccaucuguacugaugcaacccaggcggcgcagacaacagacgcucccuccuuccacuucaccagaccugugagugacccuggcugugcccucagggaagaggacaugcacagggucacugauuuuagaaugccaacuguucgggaaccagaaacuuuuuauuuaaauaggucauuuuuuuuuucaaaaguacuguguaccacgcggauuuuuuuauaauaauuuuuugaguaaaaaaagacauuuauuuagaaaauuuaaaaaauucagaagccugaaguacaugugaggagagaagaucugugccaaaacacagcaucaugaaauuucugaacacuggaggcaaaaauccuacagaauagcaaagaaaaaccaagguuacacucaaucaggcaccaacaagguaccccaauucucagcaacagugguggaagcuggaaagccauugagcaaacacccgaauauucuggggggaaauaacugcucucuagaauucuguauccagacaaccaucaacgaagugugcgugcagaauaaaauguuuucagacauggaaaaucucaaaauugugacuuuuccauacucucccaggugguuacugaagaaaaucccccgccaaaaccagaguaaacgaggaaaaaagaaaagaacucaggcagaagggaaaggcaaaagcaagcccugggaugaugagaacagugacccccccagggucuggcccagaggacaaccaguccagauaagagagaggaagggagggcuucagagaucaccaggaaaacaacacacaaguaucugaaauugcuaagaagagaucucaacacaucggggguagcuggagguuuaauuaaugcuauggucacagaaaccuaaucaaagacaccagauaaguacaguauuaauuccagggacaccgcaguagaugcagaagaaacugcaacagggcacaggacaacaggaucgccgcacagaagacacagccgugaacagugcugaugcggccacaauaauagaacugugaaggaaggucggggcagcaaagugagaagucaguaaagcagugccacuuuacaaaaacaaacaaaaaaagaagcagggaacagcagaaacaugucauguggaagcacggaaggcacgagcaaaagcagcuuuaaagaguuaaagagcuggaguuugcccauggggagugaaaugugggggcucccacaagggagcaggcaacugcuauuguucauuuuuaaaagccuuguggagcacugcaaucuuuuaccucuaugaauguaaaccuuuaagagggaaagaaacaggcuccacaagaccucacagacuauuaauauuccaaaggcuauucucucccccucggcugccaugcaugaaguuuaauuuuuaaacaaaccaaggguuucauuuuauggcuauaauucugaguucaaaaagaaaagaaacgccgggcaugggggcucaugucuguaaucccagcacuuugggaggcuuaggugggcgggaucgccugaggucaggaguucaagaccagccugacacacauggagaaaccccgucucuacuaacaauacaaaaauuagccggcgugguggagagcgccuguaauuccagcuucucaggaggcugaggcaggagaaucgcuugaacccagguggcaaggcuugcagugagcugagaucgcacuacugcacuccagccugggcaacagagcgagacuccagcucaaaaaaaaaagaaaaaaagaaaaaaaaaaaaaagaaaagaaagcucuacuguaaaccauuuucacuuaucauuaaauauucuccauaaacaaguaccaaaaccagauaaacacugugugauaaacaguuuaauuaaaccaucacuucguaauuaaaugcauguguaccuguacauaaauguuugcacauccaauuauugcccuuagaauacauuccuagaagugggucgaaaggguucauuuuuaagcuucuaacauacacuaccaaacugcccuccaaagaaguuucuccaauuuacccuccacccagccauacacaccaaugaccauggaagcuauuucaucacuccaucacucuuugcaacauuuguaucuuuuuuuuuuuuuuuuugagacugaguggagucucgcucugucgcccaggcuggagugcaguggugcgaucucgaucucgacucacucacugcaagcuccgccucccagguucaugccauucuucugccucaaccucccgaguagcugggacuacaggcgcccaccaccacacccggcuaauuuucuguauuuuuaguagagacgggguuucaccguguuagccaggauggucucgaucuccugaccucgugauccguccgccucggccucccaaagugcugggauuacaggcaugagccauugcacccggccuaaauuuguaccuuuuaaaaauaagugcuaauguaauaaauaucuaaacaaccuuguguguagagcuuauuacaaagaacagacuguuuugacaauuucagaucaucauuaccaauauuaguuacagguacuugugacucuaaguaggaccagaacagaggccucaaugugcuggcccagcugacaucuaugccugaucguaggcuuggggcugaaauccucccauaagaaaucaaggaguuauuuauucauuauuccaaugccaagggugaaguuaaacaacuuucccagggagugacacagucaggaguauaauccacaucuagcuaacuccacaauucaaagcucugauuccaaaaauggacagcccaguuguauuaguucauucucauacuacuaauaaagaaauacccgagacuggguaauuuauaaaggaaagagguuuaauggacucacaguuacacauggcuggggaggccucacaaucaugguggaaggcaaaggaagagcaaacgugugcaggggaacugcccuuuauaaaaccaucagaucucgugagacuuauucacuaucaugggaacagcacaggaaaaauccacccccaugauucaauuaccucccaccaggucccuccagugacauguggggauuacaggagcuacaauucaagaugagauuuggguggggacacagccaaaccauaucaccaccacucuugaugugugcauacacagccuuguucaggaggacaaaaugaaugacaccuucuccauucccagauucugaaaaacagaauucuucagcaaaagacaucucaucacaagggucucggaauccucuuauaucacaauuggaagagggcuaagaaauacguggcauuuggauuacaaaagugcucuggaagucagacuccgcauauacagcguugaaaccacaagucagcauugggugcaaacugaacggcaagaucaagaaagcagcaggggcuggguguaguggcucacuccuguaaucccaacacuuugagaggucaagaugagaggacugcuugugcucaggaauuugaaaccagcuugggcaauacagugagaccccaucucuacaaaaauuuuuaaaaaauaaucuagguguggugacuugugccuaagguuccagguacuugggaagcugaggcaggauugcuuggcagugagccaaguucaugccacugcacuccagccuaggcaacaaagugagauccuaucacacucacacacacacacacacauacacacccaccuccacacaccuucagagaaagacagagaaaaagcagcaggaagggagaaaaacuucucuuuuaaauuuuuuauacugauaauuuuggcuugcucaucagaaaaagggaaaggcucacugaaaagggaguuauaaaauucaaaacaugaagcuggguguggugguuuaugccuguaaucccaacgcuuugggaugcugcguugggaaaaucccuugaacucagcagaaaaaggcuguaacuguaccacuggacuuuacccugggugaaaccacaagacccccaucucuuaaaaacaaacacccaagacaugaaaacagagaggauaccagaaaaagaugggcacacagcugugguccagacucagguuagauggacaacagcacuugugggacaucagaaagacuuuuucuuuuuucuuuuuuugagacagagucucgcucugucacacaggcugcagugcaguggugcgauuuuggcucacugcaaccucugccucccagguucaagugauucuccugccucagccuccugaacagcugggacuacaagugugugccaccacacucggcucauuuuuguauuuuuaguagagauggggucucacuguauuggccaggcuggucuugaauuccuggccucaagugaucugcccaccuuggcaacccaaagugcuaggauuacaggaaugaaaaccaccgugcccggcugccuuauauuuuucauucaccaauuucacagcuucuccuacaagaccagaagaucuggcacuggugagccagcagucuggcaccuaacaacugccuggcacccgucagcagaugccccucuaaacaagguaggccguuugggcagcugcaguugcuaccugccugucccagcuucuggauuacaggaacaauuugagagcagucuuggaaaagggacaacacaggccuuaccucccuaugagaaaggagagauguucgagaagaugggugacaagcugggcaugguagcucacggcuauaaucccagcacuuuggaaggcugaggcaggaggaucacuuaagcccaggaguuugcgaccagccuagacaacauagugaaacccaucucuacaaaaaaauagaaaaauuagccgagugugguggugugcaccuguaaucccagcuacucgggaggcugaggugggagcauugcuugagccugaaaagucgaggcugcagugaggcgugauugcaccacugcacugcagccugggcgacagagcaagacccugucucaaaauaauaaugagauggguggcccauguuccacaggguggcccccacaggcacccaaggggggaaggugucagcagcacucagucuccacccugccucugcuaggcagugcugcacauuuuuggcaagaacagcucucagccugaaauuaacucaagguucuucuuguaaaauaaaaaaguugaaaguuuuaaguacauuuucacacugauuugugcuccaugaagaaaugaguaaaagugggcuaccucugaaaauccuagaagaguaacuuacguuaugguggucuacggcaugaucaucacaugccacauugauacguaugccaaagauauaaacuucaauccauuccuaccaucauacacaaaaauuaacugcaaaugggucacagacauaaauguaaaaccuacaaguguaaaacuucuacaagaaaaaagaagaaaaucuuugugaaguuagguuacacagguuucuuucucuuuuguuuuuuuuuuuggggacggaguccugcucugucgcucaggcuggagugcaguggcgcaaucucggcucacugcaagcuccgccuuccagguucuggccauucuccugccucagccucuggaguagcugggacuacaggagcccgccaccaugaccagcuaauuuuuuguauuuuuaguagagaggggguuucaccgcguuagccaggauggucucgaucuccugaccucaugauccacccaccccggccucccaaagugcugggacgacaggcgugagccacugcgcccagccaaguuacacagguuuauuaaguaugguaccaaaagcaugauccauaaaacgacuaacccucaucaaacuuuuuuuuuuuugguugagacggagucucacccugucgcccaggcuggaaugcuauggcacgaucucggcucacugcaaccucugucuccuggguucaagugauucuccugccucagccucccuaguagccgggauuaccggagugcgccuccaagcccagcuaauuuuuguauuuuuaguagagacgggguuucaccacguuggccaggcuggucucgaacuccugaccucaugauccacccgccucagccucccaaauugcugggauuacagacgugagccaccgcgcccagccuaaacuuuuaaaaccccugcucuuuaaaagacguuguuaaaagaaugaaaaagccacagacugggagaaaacacgcauauaucugauaagaacucucaaaaacucaacgauaagaaaacaauaacugacauacaguaaaagcaaauucuucaccaaagacauacagaaggcaaauacgcacaugaaaagauacugcuacacauucacuagaauggcuagaauuaaaaagacugaccacaccaaguguuguuaaggauguggaggaacgacaacucacaaacacugcugguaggaauguaaaaugguaccaccacuuuggaagacaguuuggcaguuucucacaaaguuaaauauacacuugccauaauaaccagccacucaaauccucuguauuuauuuacucaagagaaaucaaaguguauguucacacaauaaccugcauauaaauauuaauagcauuuucauuuguaauagcccaaaauugcaaauaacccaaauguucaucacaugguaaauggauaagcaaacugaaguauuuauuuccauacaacaaaauacuaccuaacaauaaaaaggaaugaacugcuaauauacacuacgagauggaugguucuuucaaggcaaaacacaaaaggaaaaccacucuaaagggaaaaaaugggccaauauggcaaacagcuagggacugaaagucgagacucuaggcauaacugugucucacagucaugggaaaccacugagaaaaauucaucugggagcaucgcucugguuuaaaugggaagaacacuaacccggggaaagaaagcuugggagcaggaagaccaagucaagaacguuuuucucagggugugaacuacggucugaacaaggguggucauauagggucauaguggaaguggaaauggaaacgaagagauggauguaaggacagaauauaaaggcagaauuuuaugauuaacaaaacaggaagaaucuggggaaaggacacugcuguugucuccuccucugucaaaguuaacugugugaagcuacuguugagggauaaaguugccccagcagucccaggauuaaggccaaaccacagccucagaucagagugugcaccaccacugcugcggcagaaaggcaaagccccgugugggugaaaaaaguccaaaaggaaccaacaccagagagugcaggcuccuagcaggaaaucccacuaaauaaccaaucuccucaagauucagacccaaaccaauuccacuuuuaauauuaacagugauuuccaaaaucuaaaaauauucaucuauacauuacauggaaaauaauacuuuuuuaaaaaauauuaucagagugcuaaaguagucuaaccaaaaauuaucucuaaaaacauuaacauggaaauuccaccuguuggcauggcaagaaauucuucaauuucuaguaggugauacuauuucaugaacagaugcucuggcagaguuaacaaccuagugauuacagauuugccuugugggaggacaugagaaacacaguauauaaagcuucagugcaguaagaauuaagcuuuuguugcacuuaucaacaggcuaacuuaaugaacuugagaaaucgacucaaccaaguccuaauucuauacccaccccucucaaaauccaccccuucaccuuucucucccagcuguacguacaaagcauuuuaccacccagcacauaccuguuuggaagguaggauucgcuccaggauacauguuaggagaauaggcaggagcugcugcugcauagcccaugggaaaaccagcugaagaaaaauaaagaacaaucucaugucaucaacugaaguagcgacaaucacuagagcuccugcaaagccaucgcucuuaccuucuuccccagaacuccacagacuuaagcagccccaagagcacuauguguggccaacagcaugucucuaguugucuucuucccgcagaacuuuguuuuuuuuaucguugucgucuuuugagacagaguuucacuuucaucgcccaggcuggagugcaauggcaugaucuuggcucacugcaaccucugccucccagguucaagcgauucuccugccucagccuuccgaagagcugggauuacaggugugugucaccacaccuggcuaauuuuucuauuuuuaguagagacgggguuucaucacguuagccaggcuggucuugaacuccugauuucaguugauccacccgccucggccucccaaagugcugggauuauaggugugagccaccacgccuggcuuucccucagaauuuugauagguaacaauuauauauuuuauuuuuauuuauuuuuuggagggggacagaguuucacucuuguugcccaggcuagagugcaguggcgcgaccucggcucacugcaaccuccguuucaagcgauucuccugccucagccuuccgaguagcugggauuacaggcaucuaccaccacgcccagcuaauuuuuguauuuuuaguagagacaagguuucaccauggugaccaggcuggucucgaacuccugaccucaugauccacccaccucagccucccgaagugcugggauuacaggcauaagccaccgcgccaagccucaauuauaacauuucuggaaguuucauuccaaacucuaaucacauaauuacuuagcaagaguaguaagagugcuaaggguaucacacgcuagguccuguuacccucaucugacuucacugcacaaagucuggaagaaucagaauucaagucuagcuuggacucaagggccuauuuuugcugcuaccagugaacagcuaagccuauguaaaggucacucauuuucacugaauuccgacauuuccuacauuacauauuuugacuuaaaagcuauuauuuuuuguuguaagaaacuguuuuaaacuucuaaauucauuucagguuuuuucacauucugauguucuuuuuuuuuucuaagacagagucuugcucuguugccuacgcuggagugcaguggugagaucucggcucacugcaaccuccgccuccuggguucaagcauuucuccugccucagucucccuaguagcugggacuacaggcgugcaccaccacgcccagcuaauuuuuguauuuuuaguagagaugggguuuugccaugcuggccaggcuggucucgaacuccugaccucaggugauccaccugccucggccucccaaagugcggguauuaccggcaugaguuaccacgccuugccauauuuugauguucugauccccaacuucuccagcaugaccagcuaauauguuuucauauguccucuccaaagcucacguuaaaauuugucauuuuaacagcacugagaggugggacauuuaauaggugacggcuuuauuaugaaaguggguuccugauaaaaaggacaaguucagcccccuuucucucugacgcacucgcugcccuuccaccauccaucacaagaggauagagcccaaaagcccucacgagaugccaucgccaugcucuuggacuucccuaaccuccagaaccaagagccuaauaaauuucuguucauuauccagcuugauauucugcuaaagcagcagaaaacaaauuaagacaccagucauaaacccaggcugugucuuacuuaagcuucagucuucuuacagaaggagcucuaacugggaaugcauacacacagaaaugggaaaaauccaacuacaguccacgugcaaauaagcugaccuuuauuaauacaaaugaggaaucuuauuaagacuaaaccaugaccuaguaauucauaauaugaacgaaacagaaacaucaaauaagacauugagugcuacagucagaauccuggccccaaggugcaaccaacagagggggccucaggcaucugcccuuuucgauaaggccucccuucccuuugggcugaccccucuggcucacaguacaggaggcaucacuugugacagcugagguauuagaaaguauucucucuuuuuuuuugagacagagucucgcucuguugccaggcuggagugcaauggcgugaucucggcucacugcaaccucuaccucccugguucaagcgauucuccugccucauccucccaaguagcugggauuucgggcacacgccaccauguccagcuaauguuuguauuuuuaguagagacgggguuucaccauguuggccaggauggucuccaucuccugaccucauaauccgcccuccucggccucccaaagugcugggauuacaggugugagccacugcaccuggccagaaagcguucuuucuauuuggggcacacagccaacaagaugacucagguuuccuagccuugauuacuguucccacuagcugugagaagcuguaacuucucuacugcacacuuccuucaccuguaaauaaaguugaaagagaagagcagucuucaaaagaaacuguguugaggaggccuggagaaaggugucucuuacagcacuuggacugggauuuuuaagguguuacgaucccuuaggaacaaaucauggugcuaacaguaaccaaagcaaggaagcccuaagguugagguaaaaacaggggggaucugaguggaaugccaaaaggaaaaucuuuguaggugggacagaaaguucugaauacagcuccucacgugccucccuucggcccccucagccuggaucccuugcucuauugcccugcaucccuaagccaucuugcagguuucugugggaacaggaggcaucagugucaccaagcccuagccccagaaucccuccaagugcccaguucucaucuuuauccuugcuucaaaguugcuuuccucacuucaaacugaucccccucuaccucagcagaagccauuccggguuucccuccuggacucucacccucccguuugcccucucuaauuagucagagaacagagugugguggacgucaagggcagauucaacuucaaagagacccacaauggccacuggaaagaccaggacagcaguucuggggaugcugagagacuccucagaagcccaauugugagcacaggaagaccaagaaaggucuggaacugcccucagagaccagggaaccagcaagauuuuuuuuuccaaugguuuccuucuuuuaaaaaaaaaaaaaaaguuucaacuaccacugaccuagaucauauccuguaggccucugcaauaauuuccagaaauuccaaauuccucaucucucccuaaaacucuaccaauauauucucaugggaagagggcugcucuggauuuguuugcugaagauuguguuuaacggucccugaaaaacuacugucuucuuugcuuaguccuucccauccccacuuucuuucuuuuuuuuuuuuugagacggagucuugcucugucgcccaggcuggaaugcaguggcgugaucucggcuuacugcaagcuccgccuccuggguucacgccauucuccuaccucagccuccugaguggcuaggacuacaggggcccgugcccggcuaauuuuuuguauuuuuaguagagacaggguuucaccauguuagccaggauggucucgaucuacauaccucgugauccgcccaccccggccucccaaagugcugggauuacaggcacgagccaccgcgcccggccccccaguuucuaacaagaaguuaacacauccuauaaugaaacagcaaacacacacgauaguauuuaagauggcaucacuagccaccagcaacaagaugcacuacauaccuggucucugguauggggaucaaagacucccaaucuccuagacagccucugcugcuuccgugcucccaucgccucaucccaucagccacaucccacuugcucugucaccacucugacccaagccgcagcguggcuccccucacuaucuccaaugguuucuaccuggacugcacaaaacccacaggggcagcuuugggaggacccccaacacugcuuuagcuggucucgggugcaccagccucuuuuuucucauucucuccagacagugaaucugcaggguuccaagcaauggaguuaagaaucacuguuucuuccuauuccugaucuuucuggguaccccaacccccagcagacacagagaccgucuccuucagcaucuauucuagcccucuucuggcaugguaggcuggaaaggccagacucccuacaucaaggcaccagagcgaucccaaaccugaaucauuucuacaagacugaucaccuuggccgggcgcaguggcucacgccuguaaucccagcacuuugggaggccgaggcagguggaucacgaggucaggagauugagaccacgaugaaaccccaucucuaauaaaaguacaaaaaaaaaauuagccgggugcaguggcgggcuccuguagucccagcuacucaggaggcugaggcaggagaauggcgugaaccugggaggcgcagcuugcagugagccgagaucgcgccacugcacuccagccugggcaacagagcaagacuccgucuuaaaaaaaaaaaaaaaaaaagacugaucaccuuacaaaaguaaaagcuucagaacagcaaaaaauaccauaguuaagcaaaaggacaaauucagauaaaguaucuaaauuauuuagacaaagggcuaguacacuuaauacguaaguaacuuuuaaaaccacaaaaacaaacaucccgccccacccccaccacucaaaucaauagacacagauacacagaauugcaaacuacaacuacgcugacuaacuuccgacuagcagaaauccagaagcuggaaaacacauucuguuagccaggcuguggggaaaucgucucacacugcugauaagaacucagcaguauccuaacaaucacaugugcauuugcucucugacccagcaaccccagcucuaggaacccacccugaggagaauucccagagucacacaaacauagggcuguucacagaaucauuacuaaaauagcacacacuucaaacaacuccaaugcccaucacaaggaaacuggcucaaucaacuauggaagcccacaagauggaguguauguaacgcuauuacauuuaaaaaaaaaaaaaaaaaaaagaacaaggcaaacuucugugaacuguuauggagugauuccuuacaaagcgaagugagcaacgccgccugcaucucuuuuccagaaagaaccuacuguucagccaggagaaguaugugggucaacagucucaggagcaggaccaggccgcuggugccucaugucggccuccaacugcuaacccuugccccagagcacccgugggcuggccaugaguucggcaaaugugccucacagucugaggcucucccuaauucuacuuccucccugcuggauuuuccuaugugauagcccccccaaaauguuuauguuccuaacuccaucccaguguccacuaccauuuguggaacaaaggagaaauuaggaucuacagccuuguugaccugggcggugcuugucaauucucagcaugggcaagaggccaagucuagguucucccuggacagaaggccguggcuggaggacagagaaacauggguuuuggugaucuugaagggcuguagugauaaaauuggaccucagaugagcuucaaaaccaguuaaagucugcuuuaagacauaugucaaauucuaaagcuaccccagcagacagcaaaaaccaaaaaucucugaaacgcagaguuuuccuuacuccccugguguaagagacaaagaucaggguacggauccacaagagggauggacugugcagagcaugucaggcuuauggaaacccugcgcuccagaauaagggcagaacaaagggagaccaagccuugccaaaacugaaaugcaucuaagcccagcuccaaguggauuaagaagaccauucagcaugcuaccuucccagcaaaagaagacaucaucagugaaaccacccauaauuucuaauacacugcgugagacaguuaaugaaaaacaccaggcaugccaagacaggaccaugugacggaaaaacaaaagaacagaacaaauggacaauaaaaacugacgcacaggugauccagagacugcaguuagcaaacaguuuuuaaaauaacucaguaguauguuggaaaaaacagaagauggagaaaauacauaaaaagacuugauucaauacaugaauuauagcaaauuagagcagaauuagcaggacaaauggaagcagaucaguauaaacuaucuguauuaaagcucauggagaaaaaaacagaaacuauaaaacagggugcaagagacagaaaggacagacugaaauggucuaaaacacuuauagauggaguuccaggagaggagagaaagggacaaaaacaauauuugaagagcuacugcuacugcuggaagaaaucaacucagagucaagagguucucugaacacuaugcaagguaaauacaaauaaaaucgcaucuaguuacaucaugguaaaagcaaagauauuuucaaaguagcaagguacacggguugggggaaauguagagaagaaacaugauuucaaagaggcaaaaauuauucuaggccgggcacaguggcucaggccuguacucccaguacuuugggaggcugaggugggaugagcacaggaguuugagaucagccugggcaacacagugagacccgaucucuacaaaaauuaaaauuaaaaaauuauucaggcaugguagcgcacaccuguagucccagcuacuugggaggcugaggcaggaggaucccuugaguccaaggaguuugaggcugcagugagccgugacuacaccacugcacuggggccugaaugacagagcaagacccuuucacaaaaaaaaaaaaaaaaauuauuuugacagaaaccagaugacaaauuuuaucuuuaaagugcugagaggaaauaaugugacauuauucgggaaaauaaucuucacagaugugauuaagugaaggaucuugagaugaggucauucuggaauccuggacugcccaggcuggcucuaaauccaaugacaaguguccuuauaaaaaacacacagggccgggcacgguggcucaggccuguaaucccagcacuuugggaggccaaucaccugaggucaggaguuuaagaccagccuggccaacauggugaaacccuaucucuacuaaaaauacaaaaauuagucgggcgugguggcacgcaccacauaccuguaaucccagcugcucaggaggcugaggcaggagaaucacuugaacuugggaggcagauguugcagagagccaagaucacgccacugcacuccagccugggugacaagagugagacuucgucucaaaacaaacacacaaaagacacacaggagaggaugugaccauggaggcagaaaugggagugaugcagccacaaagccacaugcuaaagacugcagacagccaccagaaacuagaagaugcaaggaauggauuuuccucugggccugcacuaggaguacagaccugccaacgccuugauuucgaaccucugggacuacaucucuauggcuuuaacccaccaaguuugugguuaccuguuauagcagccacaaaaaaaacaaacacacccggcaaaagaaugccucaaaagaaaagcaaaauaaagacaauuucacaaaacaaaauucacuaacagacuugugguuuaaaaaaaaaaauguggcucggagcaguggcucacgcuuguaaucccaacacuuugggaggccgaggugggaggaucaccugaggucaggaguucuugaucagccuggccaauauggcaaaaacccaucucuacuaaaaauacaaacauuagcugggcaugguggcaggcgccuguaaucccagcaacucaggaggcugaggcaggagaaucaccugaacgcgggaggcagagguugcagugagccaagaucacgccauugcacuccagccugggcaacaagagugaaacucugucucagaaaaaaaaaaaauguugagaguuguucagauaaaggucaaugacuccagagagaaacauguaaauagagaaagcaaugaagagcaccaaaaacaguaaaugugugaauaaauauaaauggcuguugauugcacaaaauuaaaacaguaacgucuuuuuuuuuuuuugagacagagucucgcucugucaccaggcuggaguacugugacacaaguaauaucuuaagguaaggcaacaacagaaaaagaggggcucacgcuuauaaucacagcacuuugggaggcucaggagagcggaucacuugaggucugcaguucgagaccagccuggcucacacagugaacaaaaaauuagcugggcaugguggcaugcaucuguaaucccaguuacucgggaggcugaggcuggagaaucgcuugaacccgggagauggagguuguagugagcugagaucgugccacugcacuccagccugggcaacagggcaagacggucucaaaaaaauaaaaauaaaagagguauaaucuuuauaauaagcacuaaaagaauaguaaaagaauuuuuuuuuugagacagagucuugcucugucgcccaggcuggagugcaguggcacgaucucagcucacugcaagcuccaccucccggguucacgccauucuccugccucagcauccuaaguagcuggagauacaggcgcccgccaccaugccuggcuaauuuuuuuuuguauuuuuaguagagacgggguuucaguguuagccaggauggucucgaucuccugaacucaugaucugccugccucggccucccaaagugcugggauuacaggcaugagccacuacacccagccugucacuccuuuucuuacaguuucucuacucagcccuucuggagaagagcuccagauguuucuuuacuguucuguuuuccucccuuuccuuauguugcauucugguucucucuuaaccagugucuugucuugauauuaaccugaaauuuguucauaugccauuuuguuucauuucuuaaaguuccagcuaguucuuuuuucucagcaucuuguuccccucuuauguuucugauucuuucuuuuauaucugcaauucuucuaaacuuggcuaugugacauagcaucuaccugaugguucuucuccugcagucugucauggcuggugccucuuacuugaugggaggcaucccaugcuagcaggcagaacuuugccugcaggaagcccacgcaaccuggguugugaacauaugcccccacagcaguucugcauucgcugcugucaggagccccaggaguaaccaagccuggagacuauuuuuacguuaauuucucaacuucugaaccccuggggaguauaauacaagcuagagccccaaacaucucugaaugcuuacaaagucuuaguaaagaucucccgcuucucagagcccaagcauauaaacuuccuuauggggccacuggacgacuagacuguuuagucuaucucuuugcugagaguaucacccuccagagggacgagaaugacugauaagaagucucacucucauucccugucgcaaggguccuaauacucaaucucuauccccauguggguuguuaaaacccacaaauagcacaugugcccaggacaggcacgacauuaguucaaaggccaaguuagcuggguuuaacauggccuucacauuugaccccagauaucucucuuaccuccugcaaguucaguuauacauuuguaaaauguuuuauuucacuuucugagagucuuagcaacaaaguuuugggguuaucucuucuaccauauuaucaaaacccaaaaugaaacuguaucauuauaaauaacuacuccuugugcaaagucaccgaagggaacaaccauuugcuauuuuugaccaaccagcuccuauccccucaauauccauuucgcugcaacccucacuugcaguccauauuugacuagcugacuccacuaaagggauguggaucaggccuaagucaaucagcagacuccccuuuguggcccagggauggaugcugaguuuaaucagaacaaagcccaggacugguuugaauagagaacaagcagucccaucaggcuuuccuguagaguggagguaaagaggcucuuagugagggacuacugggaggggccugaacuucagagaccacaaugagaaggagugggaccugugaccaacacuaaguuaauacugaggaagcgaagcugagaccaggagguagagaaacuagauccuggucccaacugcuggagccacuagaucaaguuuugaccaaauccaguccuaucauuugauuuuucacuuccagguauuuucuuucuugucuaagccacuuugagcugcguuugucaauagaaagcauucuuagugacaugaaaauauaccaaguauucaaaguucaaaaaugaaaacaaaauuuuacuuacuuaccuggauaaccaauuccuuuggcauuugcauagggaaccccagaagauccaggacuauaaacaggauucaugauuucaaaaacuaaaagaaaaaaaagggaauuuagccaagcacuuuugcucucagauuuuucuccaguaccaguccccaaaaagcagguagcuagaguccuuucucuaggcugcuauaaaacaaugcauuucaugcugcccccaaccagcgaagaacagaaaagggacacucgauguccuaaugggugccaaaccagggcaugauaaacuuuuuuucacaauucuccucaguccaucagaagcuaaggaguaaaaauuguuagcuauauguccacuaaaagcaaggggaaaggccagguacgguggugcacuccuguaaucccagcacuuugggaggccgaggugggcagaucaccugaggucaggaguuugagaccagccuggccaacauggugaaaccccaucucuacuaaaaauacaaaaauuggccaggcaugguggcucgugccuguaaucuuagcacuucgggaggcugagguggaggaaucaugaggucaggagaccaagaccauccuggccaacauggucaaacuccgucucuacuaaaaauacaaaaauuagcugggugugguggcgcgugccuguaaucccagcuacucagaacgcuaaggcaggagaaucgcuugaaccagguagucggagguugcagugagccaauauugcaccacugcacuccagccuggcgacagagcgagacuccgucucaaaaaaacaaaacaaaacaaaacaaaaacaaacaaaaauuagccaaguguggugacgcacaccuguaaucccagcuacuugggaggcugaggcacaagaaucacuugaauccaggagguggagauuagcagugagccaagcucaugccauugcacuccaaccuggacaacagagcgagacuuugucgcaaaaaaaacauggggaaaacccuacaaguaaccaaaauguucuucuaacagaggauaguuaaguuaaccaagacauauccagaacaugaaauaucacgcagcugcuuuucaagaaauguuuaaaaacagaauaauacaauguuaagugaaaacaaaguagaguauuauacugcauccugcauuacacaguaugaucccauauaaacaccuauguguauaaaaaugugcaucccuggcacaaacagaaaaaaagucugaaaagaaauauauaaaaauaugaacagugauugacucuagaugggaguggauuuagugguccuuuugcaauuuccuguauuuauuuauuuauuuauuuauuuauuuauuuauuuauuuauuuucccagacggagucucgcucugucgcuaggcuggagugcaguggcaugaucucagcucacugcaacuuugccucccagguuuaagugauucuccugccucagccucccgcauagcagggacuacaggcgugcgccaccacacccagcuaauuuuuguauuuuuaguagagacgggguuucaccauguuggccaggauggucucaucucuugaccucgugauccgcccaccucagccucucaaagugcugggacuguauuucuccccuccgccccccccaccccaccccaagacagggucuugcucuguugcccaggcuggagugcaguggcacaaucucagcucacugcaaccuugaccuccuggguucaagugauuaucccaccucagccucccuaggagcugggacuacagguguggugccaccacaucuggcuaaguuuuguauuuuuuuuuuuuuaaauagagaugagguuccaucauguugcccaggcugguuucagacugcugggcucaagauauccacccaccucagcuucccgaguagaugggacuacaggugugugccaccaugccacucuaguuuccuguauuucuucaaaaacuuguuaaguuuuuuuuccuaagaaagacuaacugguuacagcccagcaccucuaugaauccauucaauguuuuaucauccauggaucuuucuuuuuccugacaaguucaagaacuugcacagccacaaccaggacucuaccccuccccaacagaaguacuguugggaacugauucccauucagcucucuaguaagcuccucugaaucuuauccaggguauuauuuacuuuuauuuauuuuuuagacguggucucgcucugccagucauagcucacugcagacuugaucacccaagcuuaagugaucuucccaccucagccuccagaguagccaggacuacaggugugcaucgccacgucuggcucauuuuuaguagagacagaguuucacuacgucacucaguuuggucuugaacuccugaguucaagugauccucccgccuuggccuccuaaaaugcaguguauuaaaguguaagcuuucacuauuccucaucugguaaaucacucacugacguaugugguuauaaagauuaaggugaucuuuaagauuaaaacagcauguguggggguagggggguauaugggaacucucuguaccuucugcucaauuuugcugugaaccuaaaacugcuagaccuaaaaaaaagucuauuuuuaggcugaguacaauggcucaugccuguauucccagcacugugggaggaucgcuugaggccaggaguucaagaccagccugggcaauauaauaagguuccaucucugaaaaacauguaauaaguaacaaaacacaaaaugugcauuuuaugucugucuuccccacauccccauuuagaauguagccaaaacaagcagggaacaguugcacuugguucuguuuaaaggcaauaucuccagcaucaauaacaacaucugguacaaaauagcugcaacuaccuaccgacuuucuaaaaaacaaaugccuuucagaacacucuaggugucaaaauccauuacgaagacaaaauacaaaaagaaaccacuucaaauuuucagcucauuugucucauuuagaauauucacaaccaagcaauccuguaguaagaagaaaauauuaggucacauccuuagccucuguaacaggaaguucuggauuaaaucaggaauaaacuggcaacuuuaguaacuaaaacauucauuaccugaacugucuaauuuuuuuaaacuucuaaaccaaauccaaaugccagauuugucaugccauucacaacuacagcuacgugauaggucuugaccagcacugaccaacaaaacuuuguacaaugaccacauccuucuccaucugugcuguccccuacagcagccgccugccaagagugcugagcaucugaaaaguaaggcuaaaugaggcuacugugagauugaucuuuuagcuuuauuuaacuucaacauaaguagucacauguggcuagugguuacuauacuggacagugcaggccuacaguucagaguagggaggaaacaaguauacaaaggcauagcagguaggcaggagaaucaauugugugucuuacccuacaguuuaggaauaaacauacuagcaacugccaaucccuaguccccuguacuuuuaacccaugcuuggcggaucugcaaccaagaaauugugggggucugcaaauacuucaccuacuucucugguucaacuaucaucucucaagaagcaaauauuucccaaauguuauuucuuucuucugugccaggagcuacuaauuuuuauuucuuaauugaauuccagauaagcaaagcacuacacaaaggccacagagaaaacaaaauggcaagucacaaucucuucugaguuuuacaaucuggaaaagcgcuguccaacagaacuguucacaaagauggaaacgagcccuggcaauauggcaagacccugucucuacaaaaaguaaaaagaucagcuggaugcgguggugcacaccuguggucccagcuacuugagaucaauugaguccaggaguucgaggcugcagugagcuaugaucguuaucacugcaguccagccuagacaauggagcaagacccuaucucaaaaacaaagaugaaagccugucuguacuauccaaauaugguaagugaauuuuuaguuuaauuaacuucaacaguccuauguaggugacagccaucguauuggacagugcaaacauauacauaauaagauuaaaaguaugaauacuuucugauacaaggcaacaaguguuaagagucacaagagaaaggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgagguggcgggcgccuguagucccagcuacucgggaggcugaggcaggagaauggugugaaccccagggggcggagccugcagugagccgagauugcgccacugcacuccagccugggcgacagcgagacuccgucucaaaaaaaaaaaaaaaaaaaaaagagucacaagagaauaaaguguucugagggcugagaggggagagcaaaaauucuguggaggagggaagaaauaggaaaaacuugauuaaagggcagcguuaggccaggcacagcggcucaugccuguaaucccaguacuuuuggaggccaaggugggaggaucacuugaggucaggaguuggagaccagccuagccaacauggugaaaccccaucucuacuaaaaauacaacaaaaauuagccagguguguuggcaggcaccuguaaucccagcuacacaggaggcugacgcaggagaaucacuugaaucugggaggcagagguugcagugagcugagaucgugccacugcacuccagccugggcaacagagcaagacuccgucucaaaaaauaguaauaauaauaauuaaagggcagcauuuccaauaaacaauggauaggaucaaaucagccucagaaaugagaacaagcaagaugcauuuuaagaacauuaagcaacugaguuuguuuggagcuuaggcucuauguagggaaucaguaauagaugauuguggagacacagcuuagguacaaccaccaaguggagacccuuaaauacaggccugaguggagauguccucugguaggcaaagaagcuccugagcaacucugagguaaacagaguuaccacaugaccccacaauuccacuccuagguacauacccaagagaagugaaaacacaugcuacaccuacaguuggacaugaacauuuguaacagcauuauuccuaacagccaaaaacugcaaauucaaaugaaguacugaaggauguuaggaggcucuccuuccauaaugaccugacuuauagccuagaccaauaauaauaaaacucuacuuggcugguugcaguggcucaucccuguaaucccagcacuuugggaggccgaugagggcggaucacuugagaccacgcguucgagaccagccugggcaacauggugaaacccagucucugcuaaaaauacaaaaauuagcugggcgugguggcacacaccuguaaucccagcuacucgggaggcuaaggcaugagaaccgcuucaaccugggagguagaggcugcagugagcugaaaucgcaccacugcacuccagauggggcaacagagcaagacucugucuggggggaaaaaaaaaucaaauggagccuuuacaucuaacuuccaguuuacaagaaacgcaggaguaggagggaauaugcugaaugacaccaugaaacaaucagacaaaccccaaaagugggacauuccagaggacaaaugacccaguuucuucaauaaggcaaugguggggggaaaagggggcgggagaggaggaaggccagauaauucuaaauuaaaauagauauagacauaaaagcaauagcugaauuuuguuuggacucgauuuagacugaaacaacuguaaacagaguuuaaagauaucugggacacgacugaauacuggguaucagcugguaugaaacaauuauguuuaauccugguaacaguacugugauuauguauaguuacauaaauuuguaaagauacaauaaaguauauaaagucgaaaaugauacaucuauacuuuaaaauauuucuacaaaaagagcaaauaaucucuacaucaaguagaaauuauguaaaugcuaauaaucuuuacaucaagauguugcauauaagguuaugcacuguacugccgcauuuucaauucugcauaaugcaaaacuaaagaaaaaacacaccaucaccaaucuaccugaaauguuagugcuacuaaaaucucccugcaaccaccaacuuuccagucuaauuugcuguggacuaagaaacccaaacccaaggcuggaucuagagcguaccacuuuuuuuuuuuuuuuuugagacagaguuuucacuuuuguugcccaggcuggagugcaauggcgcgaucucagcucaccgcaacuucugacucccagguucaagcgauucuccugucucagccuccugaguagcugggauuacaggcaugugccaccacacccagcuaauuuuguauuuuuaguagagacgggguuucuccacguuggucagguuggucucgaacuuccgaccucaggugauccgccagucuuggccucccaaagugcugggauuacaggcgugagccacugcaccgggccgagcuuaccacauuuuuaguuucccauuugaaaugacucaacugucagaauucuuaugggugguuugacaccugcauuagaauagacaaaugucagauuaccuuuaaaaagaugacagcaaaaauuccuaacuugaaaaucaaaucauaaucagaagaaaacucuaucuuuaaaaugaaagaccuggccaggcgcaguggcucacgccuguaaucccagcacuuugggaggccaaggcggguggaucacaaggucaggagaucgagaccauccuggcuaacacggugaaaccugucucuacuaaaaaaaaauacaaaaagaaaauuagccacucacaacuacuuggggaggcugaggcaggagaauggugugaacccggaaggcggagcuugcaaugagccgagauggcgccacugcacuccagucugggcaacagagcgagacuccaucucaaaaaaaaaaaaaagaaagaaaaaagaaagaccuggcugggcaugguggcucacgccuguaaucccagcacuuugggaggccaaggugggcagaucacgaggucaggaauuccagaccagccuggccaacauggugaaaccccgucucuacuaaaaauacaaaaauuagccagcggugguggugcacaccuguagucccagcuacuugggaggccgaggcaggagaaucacuugaacccaggaggcagagguuucagugagccgagaucauaccacugcacuccagccugggcgacauggacgcuccaucucaaaaaaagaggccggcgcaguggcucacgccuguaaucccagcacuucgggaggccgacgagggcggaucacgaggucaggagaucgagaccacagugaaaccccgucucuaccaaaaauacaaaaaaaaaaaaaaaaaaaauuauccaggcacgguggcaggcgccuguacccagcuacucaggaggcugaggcuggagaauggcgugaacccaggaggcugagcuugcaaugagcccagaccgugccacugcacuccagccugggcgacaaagcgagacucuugucucaaaaaaaaaaaaaaaaaaaagaaagaaagaccuaucacuauauacuauuguuuccugguuuggaaacauaccaucucuaaacaaaguuccacacagagcacuaaguaugaaauacuauaacacgaggccuuuaaaauuuuauaucaacaaaucuaauuuuaagagguuuagauucacucucagaaacaccaauauacaagauacaauacucagaaaaaucaacauuggaaauucucaguaaugucuggcaacaucaacaagagcuuguagacuugguggcaagugccuguaacaccagugcuuugggaggcuggggcaggaggacugcuugagcccagaaguuugagaucagccugggcgauauagugagacucccaucucuacaaaaugaacauauauauguauaauauauacaaauuuuuuguuugagauggagucucgcuuuguugcccaggcuggagggcaguggcacaaucucggcucacugcaagcuccaccucccggguucacaccauucuccugccucagccucccccaguggcugggacuacaguugccugccaccaugcccggcuaauauuuugguauuuuuaguagagaugggguuucaccauguuauccaggaugguuuugaucaccugaccucgugauaugccagccucagccucccaaagugcaggcauuacaggcgugagccaccacaccuggacaaaaauauauuuuuaaaaaagaagcuggauacgguggcucacgccuguaaucccagcacucugggaggccaacgcggguggaucacuugaggucaagaguucgagaccagccuggccaacauagugagaugagaccccaucucuacuaaaaacacaaacauuaccugggcaggguggcaugugccuguaaucucagcuacuccggaggcugaggcaggagaaucacuugaacccgggaggaggagguugcagugagccgagaucacuccacugcacuccagccugggcgacagaacaaaacugucucaaaaaaauaaaugaauaaauaaaaaauaaagcauauaggccgagcgcgguggugucuccagcacuuugggaggccgacguagguggaccaccugaggucaggaguucaagaccagacugggcaacaugguaaaaccccgucucuacuaaaaauacaaaaaauuagcugggcgcaguggugugugccuguaaucccagcuacucgggaggcugagacaggagaaucccuugagcccgggaggcggagguugcagugagccgagaucacgccauugcacuccagccugggcgacagagcgacacuccgucucacaaaaaaaaaaaagaaaaaagaaaagaaguucucucccccaaacuuuaccuucauuaccaagguuuggguuugcauuuuacugggaggaauucauguauuucugcacaguacaaucagacagacuuaacagacuggacacaaggcaugaaaaaacuauuacucuauuacgcugguguacuguucuuuuaaaauugugcucggccaggcgcgguggcucacgucuguaaucccagcacuuuggaaggucgaggcgggcggaucacgaggucaggagauugggaccauccuggcuaacacggugaaaccucgucucuacuaaaaaaaaaaaaaaacaaauacaaaaaaauuagccaggcgugguggcgggcgccugcagucccagcuacuugggaggcugaggcaaaagacugacgugaauccgggaggcggagcuugcagugagccgagauggcgccacugcacuccagucugggaaacagagggagacuccgucucaaaaaaaaaaaaaaaagugcucaauugauccaggaaaagaaacugucuaagacaacuuggguauaauuucccuuuaaacuacggaacuccaccaaaguaagccugcuuuguaaagacaaagagaagcaagaucuucacaauuucugcaacacuagcuucaaaauuagaauagccuuacacugcucaaaucuuggcugucaaagcaaaaauaacccacuccuucaucuacaagagcuuaaaaauguguccuguuuuugccaaaaccaaaaaguuuuauuuaaucuagaaucuuucauccauaguauuugagaaaagugaucucaaauuacacaaggaugaccugaaaguuuaaggaguggaaacuauauaaaccuuuuuauuuauaaagcuuccuugcaugcgaaaacacugcaaaauauucuuguuugacuuuaaugauuaaacauuaacucaaacagcccaugagaugcacacuucauguucacauacacuauaaaacagaaauacccuuauuuguggacgucguaaaggcgcacugcacucuuuuuucaaaguuaacccaggcuaggccacgaaacguccuuucugaaggaaaucuuaaaaaucuguaauuuaaaucgugccuuuucaagcuggaaggagaacgcucagauuccgccaagcaaaaaaauaaaaauaaaaauuaucuuuacuucguggguagacaaagugagcaguuacacauuggaaaugacuauugucacaaagcucugcccccggguuucacgcucgcauuccugacggcugugaccccgaccuuuaggagaacgccccgcgccgcgaagccaccucggccaccuaggcggcaggcccgcgccgcccggaccgcaccugcacgcguacguguccggccgagcuccgcccccggcccccgcccggccuugcccgcggcacaaagcgcagcccaggccgguccagacgcccagcgaccccgagccgcgggccgaccuuggcgccgccccgagccggccgcacaaagcgccgcacuuccggccuggacgcgcagucgcccgcugcccgcccccacucaccgcgccgcggcggcgaccugggccucagugaccagcgcacgccggcccgcggcgggcuuggccguggggcgaaacaaggggggcgugccgaggagaccugcuacgauaagaggcugacccuccgagccccgcgucuccgccgccucccggacgccgcgcucccgcucgcucggcuccgcuuggcccggcccgccucuccgcagcccgcgcuccccgcc

SEQ ID NO: 191099 - RNA, 45556 nt, Homo sapiens
ggcggggagcgcgggcugcggagaggcgggccgggccaagcggagccgagcgagcgggagcgcggcguccgggaggcggcggagacgcggggcucggagggucagccucuuaucguagcaggucuccucggcacgccccccuuguuucgccccacggccaagcccgccgcgggccggcgugcgcuggucacugaggcccaggucgccgccgcggcgcggugagugggggcgggcagcgggcgacugcgcguccaggccggaagugcggcgcuuugugcggccggcucggggcggcgccaaggucggcccgcggcucggggucgcugggcgucuggaccggccugggcugcgcuuugugccgcgggcaaggccgggcgggggccgggggcggagcucggccggacacguacgcgugcaggugcgguccgggcggcgcgggccugccgccuagguggccgagguggcuucgcggcgcggggcguucuccuaaaggucggggucacagccgucaggaaugcgagcgugaaacccgggggcagagcuuugugacaauagucauuuccaauguguaacugcucacuuugucuacccacgaaguaaagauaauuuuuauuuuuauuuuuuugcuuggcggaaucugagcguucuccuuccagcuugaaaaggcacgauuuaaauuacagauuuuuaagauuuccuucagaaaggacguuucguggccuagccuggguuaacuuugaaaaaagagugcagugcgccuuuacgacguccacaaauaaggguauuucuguuuuauaguguaugugaacaugaagugugcaucucaugggcuguuugaguuaauguuuaaucauuaaagucaaacaagaauauuuugcaguguuuucgcaugcaaggaagcuuuauaaauaaaaagguuuauauaguuuccacuccuuaaacuuucaggucauccuuguguaauuugagaucacuuuucucaaauacuauggaugaaagauucuagauuaaauaaaacuuuuugguuuuggcaaaaacaggacacauuuuuaagcucuuguagaugaaggaguggguuauuuuugcuuugacagccaagauuugagcaguguaaggcuauucuaauuuugaagcuaguguugcagaaauugugaagaucuugcuucucuuugucuuuacaaagcaggcuuacuuugguggaguuccguaguuuaaagggaaauuauacccaaguugucuuagacaguuucuuuuccuggaucaauugagcacuuuuuuuuuuuuuuuugagacggagucucccucuguuucccagacuggagugcaguggcgccaucucggcucacugcaagcuccgccucccggauucacgucagucuuuugccucagccucccaaguagcugggacugcaggcgcccgccaccacgccuggcuaauuuuuuuguauuuguuuuuuuuuuuuuuuaguagagacgagguuucaccguguuagccaggauggucccaaucuccugaccucgugauccgcccgccucgaccuuccaaagugcugggauuacagacgugagccaccgcgccuggccgagcacaauuuuaaaagaacaguacaccagcguaauagaguaauaguuuuuucaugccuuguguccagucuguuaagucugucugauuguacugugcagaaauacaugaauuccucccaguaaaaugcaaacccaaaccuugguaaugaagguaaaguuugggggagagaacuucuuuucuuuuuucuuuuuuuuuuuugugagacggagugucgcucugucgcccaggcuggagugcaauggcgugaucucggcucacugcaaccuccgccucccgggcucaagggauucuccugucucagccucccgaguagcugggauuacaggcacacaccacugcgcccagcuaauuuuuuguauuuuuaguagagacgggguuuuaccauguugcccagucuggucuugaacuccugaccucaggugguccaccuacgucggccucccaaagugcuggagacaccaccgcgcucggccuauaugcuuuauuuuuuauuuauucauuuauuuuuuugagacaguuuuguucugucgcccaggcuggagugcaguggagugaucucggcucacugcaaccuccuccucccggguucaagugauucuccugccucagccuccggaguagcugagauuacaggcacaugccacccugcccagguaauguuuguguuuuuaguagagauggggucucaucucacuauguuggccaggcuggucucgaacucuugaccucaagugauccacccgcguuggccucccagagugcugggauuacaggcgugagccaccguauccagcuucuuuuuuaaaaauauauuuuuguccaggugugguggcucacgccuguaaugccugcacuuugggaggcugaggcuggcauaucacgaggucaggugaucaaaaccauccuggauaacauggugaaaccccaucucuacuaaaaauaccaaaauauuagccgggcaugguggcaggcaacuguagucccagccacugggggaggcugaggcaggagaauggugugaacccgggagguggagcuugcagugagccgagauugugccacugcccuccagccugggcaacaaagcgagacuccaucucaaacaaaaaauuuguauauauuauacauauauauguucauuuuguagagaugggagucucacuauaucgcccaggcugaucucaaacuucugggcucaagcaguccuccugccccagccucccaaagcacugguguuacaggcacuugccaccaagucuacaagcucuuguugauguugccagacauuacugagaauuuccaauguugauuuuucugaguauuguaucuuguauauugguguuucugagagugaaucuaaaccucuuaaaauuagauuuguugauauaaaauuuuaaaggccucguguuauaguauuucauacuuagugcucuguguggaacuuuguuuagagaugguauguuuccaaaccaggaaacaauaguauauagugauaggucuuucuuucuuuuuuuuuuuuuuuuuuuugagacaagagucucgcuuugucgcccaggcuggagugcaguggcacggucugggcucauugcaagcucagccuccuggguucacgccauucuccagccucagccuccugaguagcuggguacaggcgccugccaccgugccuggauaauuuuuuuuuuuuuuuuuuuuguauuuuugguagagacgggguuucacuguggucucgaucuccugaccucgugauccgcccucgucggccucccgaagugcugggauuacaggcgugagccacugcgccggccucuuuuuuugagauggagcguccaugucgcccaggcuggagugcagugguaugaucucggcucacugaaaccucugccuccuggguucaagugauucuccugccucggccucccaaguagcugggacuacaggugugcaccaccaccgcuggcuaauuuuuguauuuuuaguagagacgggguuucaccauguuggccaggcuggucuggaauuccugaccucgugaucugcccaccuuggccucccaaagugcugggauuacaggcgugagccaccaugcccagccaggucuuucuuuuuucuuucuuuuuuuuuuuuuugagauggagucucgcucuguugcccagacuggagugcaguggcgccaucucggcucauugcaagcuccgccuuccggguucacaccauucuccugccucagccuccccaaguaguugugaguggcuaauuuucuuuuuguauuuuuuuuuaguagagacagguuucaccguguuagccaggauggucucgaucuccugaccuugugauccacccgccuuggccucccaaagugcugggauuacaggcgugagccacugcgccuggccaggucuuucauuuuaaagauagaguuuucuucugauuaugauuugauuuucaaguuaggaauuuuugcugucaucuuuuuaaagguaaucugacauuugucuauucuaaugcaggugucaaaccacccauaagaauucugacaguugagucauuucaaaugggaaacuaaaaaugugguaagcucggcccggugcaguggcucacgccuguaaucccagcacuuugggaggccaagacuggcggaucaccugaggucggaaguucgagaccaaccugaccaacguggagaaaccccgucucuacuaaaaauacaaaauuagcugggugugguggcacaugccuguaaucccagcuacucaggaggcugagacaggagaaucgcuugaaccugggagucagaaguugcggugagcugagaucgcgccauugcacuccagccugggcaacaaaagugaaaacucugucucaaaaaaaaaaaaaaaaagugguacgcucuagauccagccuuggguuuggguuucuuaguccacagcaaauuagacuggaaaguuggugguugcagggagauuuuaguagcacuaacauuucagguagauuggugaugguguguuuuuucuuuaguuuugcauuaugcagaauugaaaaugcggcaguacagugcauaaccuuauaugcaacaucuugauguaaagauuauuagcauuuacauaauuucuacuugauguagagauuauuugcucuuuuuguagaaauauuuuaaaguauagauguaucauuuucgacuuuauauacuuuauuguaucuuuacaaauuuauguaacuauacauaaucacaguacuguuaccaggauuaaacauaauuguuucauaccagcugauacccaguauucagucgugucccagauaucuuuaaacucuguuuacaguuguuucagucuaaaucgaguccaaacaaaauucagcuauugcuuuuaugucuauaucuauuuuaauuuagaauuaucuggccuuccuccucucccgcccccuuuuccccccaccauugccuuauugaagaaacugggucauuuguccucuggaaugucccacuuuugggguuugucugauuguuucauggugucauucagcauauucccuccuacuccugcguuucuuguaaacuggaaguuagauguaaaggcuccauuugauuuuuuuuuccccccagacagagucuugcucuguugccccaucuggagugcaguggugcgauuucagcucacugcagccucuaccucccagguugaagcgguucucaugccuuagccucccgaguagcugggauuacaggugugugccaccacgcccagcuaauuuuuguauuuuuagcagagacuggguuucaccauguugcccaggcuggucucgaacgcguggucucaagugauccgcccucaucggccucccaaagugcugggauuacagggaugagccacugcaaccagccaaguagaguuuuauuauuauuggucuaggcuauaagucaggucauuauggaaggagagccuccuaacauccuucaguacuucauuugaauuugcaguuuuuggcuguuaggaauaaugcuguuacaaauguucauguccaacuguagguguagcauguguuuucacuucucuuggguauguaccuaggaguggaauuguggggucaugugguaacucuguuuaccucagaguugcucaggagcuucuuugccuaccagaggacaucuccacucaggccuguauuuaagggucuccacuuggugguuguaccuaagcugugucuccacaaucaucuauuacugauucccuacauagagccuaagcuccaaacaaacucaguugcuuaauguucuuaaaaugcaucuugcuuguucucauuucugaggcugauuugauccuauccauuguuuauuggaaaugcugcccuuuaauuauuauuauuacuauuuuuugagacggagucuugcucuguugcccaggcuggagugcaguggcacgaucucagcucacugcaaccucugccucccagauucaagugauucuccugcgucagccuccuguguagcugggauuacaggugccugccaacacaccuggcuaauuuuuguuguauuuuuaguagagaugggguuucaccauguuggcuaggcuggucuccaacuccugaccucaagugauccucccaccuuggccuccaaaaguacugggauuacaggcaugagccgcugugccuggccuaacgcugcccuuuaaucaaguuuuuccuauuucuucccuccuccacagaauuuuugcucuccccucucagcccucagaacacuuuauucucuugugacucuuuuuuuuuuuuuuuuuuuuuugagacggagucucgcugucgcccaggcuggagugcaguggcgcaaucucggcucacugcaggcuccgcccccugggguucacaccauucuccugccucagccucccgaguagcugggacuacaggcgcccgccaccucgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccuuucucuugugacucuuaacacuuguugccuuguaucagaaaguauucauacuuuuaaucuuauuauguauauguuugcacuguccaauacgauggcugucaccuacauaggacuguugaaguuaauuaaacuaaaaauucacuuaccauauuuggauaguacagacaggcuuucaucuuuguuuuugagauagggucuugcuccauugucuaggcuggacugcagugauaacgaucauagcucacugcagccucgaacuccuggacucaauugaucucaaguagcugggaccacaggugugcaccaccgcauccagcugaucuuuuuacuuuuuguagagacagggucuugccauauugccagggcucguuuccaucuuugugaacaguucuguuggacagcgcuuuuccagauuguaaaacucagaagagauugugacuugccauuuuguuuucucuguggccuuuguguagugcuuugcuuaucuggaauucaauuaagaaauaaaaauuaguagcuccuggcacagaagaaagaaauaacauuugggaaauauuugcuucuugagagaugauaguugaaccagagaaguaggugaaguauuugcagacccccacaauuucuugguugcagauccgccaagcauggguuaaaaguacaggggacuagggauuggcaguugcuaguauguuuauuccuaaacuguaggguaagacacacaauugauucuccugccuaccugcuaugccuuuguauacuuguuuccucccuacucugaacuguaggccugcacuguccaguauaguaaccacuagccacaugugacuacuuauguugaaguuaaauaaagcuaaaagaucaaucucacaguagccucauuuagccuuacuuuucagaugcucagcacucuuggcaggcggcugcuguaggggacagcacagauggagaaggauguggucauuguacaaaguuuuguuggucagugcuggucaagaccuaucacguagcuguaguugugaauggcaugacaaaucuggcauuuggauuugguuuagaaguuuaaaaaaauuagacaguucagguaaugaauguuuuaguuacuaaaguugccaguuuauuccugauuuaauccagaacuuccuguuacagaggcuaaggaugugaccuaauauuuucuucuuacuacaggauugcuugguugugaauauucuaaaugagacaaaugagcugaaaauuugaagugguuucuuuuuguauuuugucuucguaauggauuuugacaccuagaguguucugaaaggcauuuguuuuuuagaaagucgguagguaguugcagcuauuuuguaccagauguuguuauugaugcuggagauauugccuuuaaacagaaccaagugcaacuguucccugcuuguuuuggcuacauucuaaauggggauguggggaagacagacauaaaaugcacauuuuguguuuuguuacuuauuacauguuuuucagagauggaaccuuauuauauugcccaggcuggucuugaacuccuggccucaagcgauccucccacagugcugggaauacaggcaugagccauuguacucagccuaaaaauagacuuuuuuuuaggucuagcaguuuuagguucacagcaaaauugagcagaagguacagagaguucccauauaccccccuacccccacacaugcuguuuuaaucuuaaagaucaccuuaaucuuuauaaccacauacgucagugagugauuuaccagaugaggaauagugaaagcuuacacuuuaauacacugcauuuuaggaggccaaggcgggaggaucacuugaacucaggaguucaagaccaaacugagugacguagugaaacucugucucuacuaaaaaugagccagacguggcgaugcacaccuguaguccuggcuacucuggaggcugaggugggaagaucacuuaagcuugggugaucaagucugcagugagcuaugacuggcagagcgagaccacgucuaaaaaauaaauaaaaguaaauaauacccuggauaagauucagaggagcuuacuagagagcugaaugggaaucaguucccaacaguacuucuguuggggagggguagaguccugguuguggcugugcaaguucuugaacuugucaggaaaaagaaagauccauggaugauaaaacauugaauggauucauagaggugcugggcuguaaccaguuagucuuucuuaggaaaaaaaacuuaacaaguuuuugaagaaauacaggaaacuagaguggcaugguggcacacaccuguagucccaucuacucgggaagcugagguggguggauaucuugagcccagcagucugaaaccagccugggcaacaugauggaaccucaucucuauuuaaaaaaaaaaaaauacaaaacuuagccagaugugguggcaccacaccuguagucccagcuccuagggaggcugaggugggauaaucacuugaacccaggaggucaagguugcagugagcugagauugugccacugcacuccagccugggcaacagagcaagacccugucuuggggugggguggggggggcggaggggagaaauacagucccagcacuuugagaggcugaggugggcggaucacgaggucaagagaugagaccauccuggccaacauggugaaaccccgucucuacuaaaaauacaaaaauuagcugggugugguggcgcacgccuguagucccugcuaugcgggaggcugaggcaggagaaucacuuaaaccugggaggcaaaguugcagugagcugagaucaugccacugcacuccagccuagcgacagagcgagacuccgucugggaaaauaaauaaauaaauaaauaaauaaauaaauaaauaaauaaauacaggaaauugcaaaaggaccacuaaauccacucccaucuagagucaaucacuguucauauuuuuauauauuucuuuucagacuuuuuuucuguuugugccagggaugcacauuuuuauacacauagguguuuauaugggaucauacuguguaaugcaggaugcaguauaauacucuacuuuguuuucacuuaacauuguauuauucuguuuuuaaacauuucuugaaaagcagcugcgugauauuucauguucuggauaugucuugguuaacuuaacuauccucuguuagaagaacauuuugguuacuuguaggguuuuccccauguuuuuuuugcgacaaagucucgcucuguuguccagguuggagugcaauggcaugagcuuggcucacugcuaaucuccaccuccuggauucaagugauucuugugccucagccucccaaguagcugggauuacaggugugcgucaccacacuuggcuaauuuuuguuuguuuuuguuuuguuuuguuuuguuuuuuugagacggagucucgcucugucgccaggcuggagugcaguggugcaauauuggcucacugcaaccuccgacuaccugguucaagcgauucuccugccuuagcguucugaguagcugggauuacaggcacgcgccaccacacccagcuaauuuuuguauuuuuaguagagacggaguuugaccauguuggccaggauggucuuggucuccugaccucaugauuccuccaccucagccucccgaagugcuaagauuacaggcacgagccaccaugccuggccaauuuuuguauuuuuaguagagaugggguuucaccauguuggccaggcuggucucaaacuccugaccucaggugaucugcccaccucggccucccaaagugcugggauuacaggagugcaccaccguaccuggccuuuccccuugcuuuuaguggacauauagcuaacaauuuuuacuccuuagcuucugauggacugaggagaauugugaaaaaaaguuuaucaugcccugguuuggcacccauuaggacaucgagugucccuuuucuguucuucgcugguugggggcagcaugaaaugcauuguuuuauagcagccuagagaaaggacucuagcuaccugcuuuuuggggacugguacuggagaaaaaucugagagcaaaagugcuuggcuaaauucccuuuuuuuucuuuuaguuuuugaaaucaugaauccuguuuauaguccuggaucuucugggguucccuaugcaaaugccaaaggaauugguuauccagguaaguaaguaaaauuuuguuuucauuuuugaacuuugaauacuugguauauuuucaugucacuaagaaugcuuucuauugacaaacgcagcucaaaguggcuuagacaagaaagaaaauaccuggaagugaaaaaucaaaugauaggacuggauuuggucaaaacuugaucuaguggcuccagcaguugggaccaggaucuaguuucucuaccuccuggucucagcuucgcuuccucaguauuaacuuaguguuggucacaggucccacuccuucucauuguggucucugaaguucaggccccucccaguagucccucacuaagagccucuuuaccuccacucuacaggaaagccugaugggacugcuuguucucuauucaaaccaguccugggcuuuguucugauuaaacucagcauccaucccugggccacaaaggggagucugcugauugacuuaggccugauccacaucccuuuaguggagucagcuagucaaauauggacugcaagugaggguugcagcgaaauggauauugaggggauaggagcugguuggucaaaaauagcaaaugguuguucccuucggugacuuugcacaaggaguaguuauuuauaaugauacaguuucauuuuggguuuugauaauaugguagaagagauaaccccaaaacuuuguugcuaagacucucagaaagugaaauaaaacauuuuacaaauguauaacugaacuugcaggagguaagagagauaucuggggucaaaugugaaggccauguuaaacccagcuaacuuggccuuugaacuaaugucgugccuguccugggcacaugugcuauuuguggguuuuaacaacccacauggggauagagauugaguauuaggacccuugcgacagggaaugagagugagacuucuuaucagucauucucgucccucuggagggugauacucucagcaaagagauagacuaaacagucuagucguccaguggccccauaaggaaguuuauaugcuugggcucugagaagcgggagaucuuuacuaagacuuuguaagcauucagagauguuuggggcucuagcuuguauuauacuccccagggguucagaaguugagaaauuaacguaaaaauagucuccaggcuugguuacuccuggggcuccugacagcagcgaaugcagaacugcugugggggcauauguucacaacccagguugcgugggcuuccugcaggcaaaguucugccugcuagcaugggaugccucccaucaaguaagaggcaccagccaugacagacugcaggagaagaaccaucagguagaugcuaugucacauagccaaguuuagaagaauugcagauauaaaagaaagaaucagaaacauaagaggggaacaagaugcugagaaaaaagaacuagcuggaacuuuaagaaaugaaacaaaauggcauaugaacaaauuucagguuaauaucaagacaagacacugguuaagagagaaccagaaugcaacauaaggaaagggaggaaaacagaacaguaaagaaacaucuggagcucuucuccagaagggcugaguagagaaacuguaagaaaaggagugacaggcuggguguaguggcucaugccuguaaucccagcacuuugggaggccgaggcaggcagaucaugaguucaggagaucgagaccauccuggcuaacacugaaaccccgucucuacuaaaaauacaaaaaaaaauuagccaggcaugguggcgggcgccuguaucuccagcuacuuaggaugcugaggcaggagaauggcgugaacccgggagguggagcuugcagugagcugagaucgugccacugcacuccagccugggcgacagagcaagacucugucucaaaaaaaaaauucuuuuacuauucuuuuagugcuuauuauaaagauuauaccucuuuuauuuuuauuuuuuugagaccgucuugcccuguugcccaggcuggagugcaguggcacgaucucagcucacuacaaccuccaucucccggguucaagcgauucuccagccucagccucccgaguaacugggauuacagaugcaugccaccaugcccagcuaauuuuuuguucacugugugagccaggcuggucucgaacugcagaccucaagugauccgcucuccugagccucccaaagugcugugauuauaagcgugagccccucuuuuucuguuguugccuuaccuuaagauauuacuugugucacaguacuccagccuggugacagagcgagacucugucucaaaaaaaaaaaaagacguuacuguuuuaauuuugugcaaucaacagccauuuauauuuauucacacauuuacuguuuuuggugcucuucauugcuuucucuauuuacauguuucucucuggagucauugaccuuuaucugaacaacucucaacauuuuuuuuuuuucugagacagaguuucacucuuguugcccaggcuggagugcaauggcgugaucuuggcucacugcaaccucugccucccgcguucaggugauucuccugccucagccuccugaguugcugggauuacaggcgccugccaccaugcccagcuaauguuuguauuuuuaguagagauggguuuuugccauauuggccaggcugaucaagaacuccugaccucaggugauccucccaccucggccucccaaaguguugggauuacaagcgugagccacugcuccgagccacauuuuuuuuuuuaaaccacaagucuguuagugaauuuuguuuugugaaauugucuuuauuuugcuuuucuuuugaggcauucuuuugccggguguguuuguuuuuuuuguggcugcuauaacagguaaccacaaacuugguggguuaaagccauagagauguagucccagagguucgaaaucaaggcguuggcaggucuguacuccuagugcaggcccagaggaaaauccauuccuugcaucuucuaguuucugguggcugucugcagucuuuagcauguggcuuuguggcugcaucacucccauuucugccuccauggucacauccucuccugugugucuuuuguguguuuguuuugagacgaagucucacucuugucacccaggcuggagugcaguggcgugaucuuggcucucugcaacaucugccucccaaguucaagugauucuccugccucagccuccugagcagcugggauuacagguauguggugcgugccaccacgcccgacuaauuuuuguauuuuuaguagagauaggguuucaccauguuggccaggcuggucuuaaacuccugaccucaggugauuggccucccaaagugcugggauuacaggccugagccaccgugcccggcccuguguguuuuuuauaaggacacuugucauuggauuuagagccagccugggcaguccaggauuccagaaugaccucaucucaagauccuucacuuaaucacaucugugaagauuauuuucccgaauaaugucacauuauuuccucucagcacuuuaaagauaaaauuugucaucugguuucugucaaaauaauuuuuuuuuuuuuuuuugugaaagggucuugcucugucauucaggccccagugcagugguguagucacggcucacugcagccucaaacuccuuggacucaagggauccuccugccucagccucccaaguagcugggacuacaggugugcgcuaccaugccugaauaauuuuuuaauuuuaauuuuuguagagaucgggucucacuguguugcccaggcugaucucaaacuccugugcucaucccaccucagccucccaaaguacugggaguacaggccugagccacugugcccggccuagaauaauuuuugccucuuugaaaucauguuucuucucuacauuucccccaacccguguaccuugcuacuuugaaaauaucuuugcuuuuaccaugauguaacuagaugcgauuuuauuuguauuuaccuugcauaguguucagagaaccucuugacucugaguugauuucuuccagcaguagcaguagcucuucaaauauuguuuuugucccuuucucuccucuccuggaacuccaucuauaaguguuuuagaccauuucagucuguccuuucugucucuugcacccuguuuuauaguuucuguuuuuuucuccaugagcuuuaauacagauaguuuauacugaucugcuuccauuuguccugcuaauucugcucuaauuugcuauaauucauguauugaaucaagucuuuuuauguauuuucuccaucuucuguuuuuuccaacauacuacugaguuauuuuaaaaacuguuugcuaacugcagucucuggaucaccugugcgucaguuuuuauuguccauuuguucuguucuuuuguuuuuccgucacaugguccugucuuggcaugccugguguuuuucauuaacugucucacgcaguguauuagaaauuaugggugguuucacugaugaugucuucuuuugcugggaagguagcaugcugaauggucuucuuaauccacuuggagcugggcuuagaugcauuucaguuuuggcaaggcuuggucucccuuuguucugcccuuauucuggagcgcaggguuuccauaagccugacaugcucugcacaguccaucccucuuguggauccguacccugaucuuugucucuuacaccaggggaguaaggaaaacucugcguuucagagauuuuugguuuuugcugucugcugggguagcuuuagaauuugacauaugucuuaaagcagacuuuaacugguuuugaagcucaucugagguccaauuuuaucacuacagcccuucaagaucaccaaaacccauguuucucuguccuccagccacggccuucuguccagggagaaccuagacuuggccucuugcccaugcugagaauugacaagcaccgcccaggucaacaaggcuguagauccuaauuucuccuuuguuccacaaaugguaguggacacugggauggaguuaggaacauaaacauuuugggggggcuaucacauaggaaaauccagcagggaggaaguagaauuagggagagccucagacugugaggcacauuugccgaacucauggccagcccacgggugcucuggggcaaggguuagcaguuggaggccgacaugaggcaccagcggccugguccugcuccugagacuguugacccacauacuucuccuggcugaacaguagguucuuucuggaaaagagaugcaggcggcguugcucacuucgcuuuguaaggaaucacuccauaacaguucacagaaguuugccuuguucuuuuuuuuuuuuuuuuuuuuaaauguaauagcguuacauacacuccaucuugugggcuuccauaguugauugagccaguuuccuugugaugggcauuggaguuguuugaagugugugcuauuuuaguaaugauucugugaacagcccuauguuugugugacucugggaauucuccucaggguggguuccuagagcugggguugcugggucagagagcaaaugcacaugugauuguuaggauacugcugaguucuuaucagcagugugagacgauuuccccacagccuggcuaacagaauguguuuuccagcuucuggauuucugcuagucggaaguuagucagcguaguuguaguuugcaauucuguguaucugugucuauugauuugagugguggggguggggcgggauguuuguuuuugugguuuuaaaaguuacuuacguauuaaguguacuagcccuuugucuaaauaauuuagauacuuuaucugaauuuguccuuuugcuuaacuaugguauuuuuugcuguucugaagcuuuuacuuuuguaaggugaucagucuuuuuuuuuuuuuuuuuuuaagacggagucuugcucuguugcccaggcuggagugcaguggcgcgaucucggcucacugcaagcugcgccucccagguucacgccauucuccugccucagccuccugaguagcugggacuacaggagcccgccacugcacccggcuaauuuuuuuuuuguacuuuuauuagagaugggguuucaucguggucucaaucuccugaccucgugauccaccugccucggccucccaaagugcugggauuacaggcgugagccacugcgcccggccaaggugaucagucuuguagaaaugauucagguuugggaucgcucuggugccuugauguagggagucuggccuuuccagccuaccaugccagaagagggcuagaauagaugcugaaggagacggucucugugucugcuggggguugggguacccagaaagaucaggaauaggaagaaacagugauucuuaacuccauugcuuggaacccugcagauucacugucuggagagaaugagaaaaaagaggcuggugcacccgagaccagcuaaagcaguguuggggguccucccaaagcugccccuguggguuuugugcaguccagguagaaaccauuggagauagugaggggagccacgcugcggcuugggucagaguggugacagagcaagugggauguggcugaugggaugaggcgaugggagcacggaagcagcagaggcugucuaggagauugggagucuuugauccccauaccagagaccagguauguagugcaucuuguugcugguggcuagugaugccaucuuaaauacuaucguguguguuugcuguuucauuauaggauguguuaacuucuuguuagaaacuggggggccgggcgcgguggcucgugccuguaaucccagcacuuugggaggccggggugggcggaucacgagguauguagaucgagaccauccuggcuaacauggugaaacccugucucuacuaaaaauacaaaaaauuagccgggcacgggccccuguaguccuagccacucaggaggcugagguaggagaauggcgugaacccaggaggcggagcuugcaguaagccgagaucacgccacugcauuccagccugggcgacagagcaagacuccgucucaaaaaaaaaaaaagaaagaaaguggggaugggaaggacuaagcaaagaagacaguaguuuuucagggaccguuaaacacaaucuucagcaaacaaauccagagcagcccucuucccaugagaauauauugguagaguuuuagggagagaugaggaauuuggaauuucuggaaauuauugcagaggccuacaggauaugaucuaggucagugguaguugaaacuuuuuuuuuuuuuuuaaaagaaggaaaccauuggaaaaaaaaaucuugcugguucccuggucucugagggcaguuccagaccuuucuuggucuuccugugcucacaauugggcuucugaggagucucucagcauccccagaacugcuguccuggucuuuccaguggccauugugggucucuuugaaguugaaucugcccuugacguccaccacacucuguucucugacuaauuagagagggcaaacgggagggugagaguccaggagggaaacccggaauggcuucugcugagguagagggggaucaguuugaagugaggaaagcaacuuugaagcaaggauaaagaugagaacugggcacuuggagggauucuggggcuagggcuuggugacacugaugccuccuguucccacagaaaccugcaagauggcuuagggaugcagggcaauagagcaagggauccaggcugagggggccgaagggaggcacgugaggagcuguauucagaacuuucugucccaccuacaaagauuuuccuuuuggcauuccacucagauccccccuguuuuuaccucaaccuuagggcuuccuugcuuugguuacuguuagcaccaugauuuguuccuaagggaucguaacaccuuaaaaaucccaguccaagugcuguaagagacaccuuucuccaggccuccucaacacaguuucuuuugaagacugcucuucucuuucaacuuuauuuacaggugaaggaagugugcaguagagaaguuacagcuucucacagcuagugggaacaguaaucaaggcuaggaaaccugagucaucuuguuggcugugugccccaaauagaaagaacgcuuucuggccaggugcaguggcucacaccuguaaucccagcacuuugggaggccgaggagggcggauuaugaggucaggagauggagaccauccuggccaacauggugaaaccccgucucuacuaaaaauacaaacauuagcuggacaugguggcgugugcccgaaaucccagcuacuugggaggaugaggcaggagaaucgcuugaaccagggagguagagguugcagugagccgagaucacgccauugcacuccagccuggcaacagagcgagacucugucucaaaaaaaaagagagaauacuuucuaauaccucagcugucacaagugaugccuccuguacugugagccagaggggucagcccaaagggaagggaggccuuaucgaaaagggcagaugccugaggcccccucuguugguugcaccuuggggccaggauucugacuguagcacucaaugucuuauuugauguuucuguuucguucauauuaugaauuacuaggucaugguuuagucuuaauaagauuccucauuuguauuaauaaaggucagcuuauuugcacguggacuguaguuggauuuuucccauuucuguguguaugcauucccaguuagagcuccuucuguaagaagacugaagcuuaaguaagacacagccuggguuuaugacuggugucuuaauuuguuuucugcugcuuuagcagaauaucaagcuggauaaugaacagaaauuuauuaggcucuugguucuggagguuagggaaguccaagagcauggcgauggcaucucgugagggcuuuugggcucuauccucuugugauggaugguggaagggcagcgagugcgucagagagaaagggggcugaacuuguccuuuuuaucaggaacccacuuucauaauaaagccgucaccuauuaaaugucccaccucucagugcuguuaaaaugacaaauuuuaacgugagcuuuggagaggacauaugaaaacauauuagcuggucaugcuggagaaguuggggaucagaacaucaaaauauggcaaggcgugguaacucaugccgguaauacccgcacuuugggaggccgaggcagguggaucaccugaggucaggaguucgagaccagccuggccagcauggcaaaaccccaucucuacuaaaaauacaaaaauuagcugggcgugguggugcacgccuguagucccagcuacuagggagacugaggcaggagaaaugcuugaacccaggaggcggagguugcagugagccgagaucucaccacugcacuccagcguaggcaacagagcaagacucugucuuagaaaaaaaaaagaacaucagaaugugaaaaaaccugaaaugaauuuagaaguuuaaaacaguuucuuacaacaaaaaauaauagcuuuuaagucaaaauauguaauguaggaaaugucggaauucagugaaaaugagugaccuuuacauaggcuuagcuguucacugguagcagcaaaaauaggcccuugaguccaagcuagacuugaauucugauucuuccagacuuugugcagugaagucagaugaggguaacaggaccuagcgugugauacccuuagcacucuuacuacucuugcuaaguaauuaugugauuagaguuuggaaugaaacuuccagaaauguuauaauugaggcuuggcgcgguggcuuaugccuguaaucccagcacuucgggaggcugagguggguggaucaugaggucaggaguucgagaccagccuggucaccauggugaaaccuugucucuacuaaaaauacaaaaauuagcugggcguggugguagaugccuguaaucccagcuacucggaaggcugaggcaggagaaucgcuugaaacggagguugcagugagccgaggucgcgccacugcacucuagccugggcaacaagagugaaacucugucccccuccaaaaaauaaauaaaaauaaaauauauaauuguuaccuaucaaaauucugagggaaagccaggcgugguggcucacaccuauaaucccagcacuuugggaggccgaggcggguggaucaacugaaaucaggaguucaagaccagccuggcuaacgugaugaaaccccgucucuacuaaaaauagaaaaauuagccagguguggugacacacaccuguaaucccagcucuucggaaggcugaggcaggagaaucgcuugaaccugggaggcagagguugcagugagccaagaucaugccauugcacuccagccugggcgaugaaagugaaacucugucucaaaagacgacaacgauaaaaaaaacaaaguucugcgggaagaagacaacuagagacaugcuguuggccacacauagugcucuuggggcugcuuaagucuguggaguucuggggaagaagguaagagcgauggcuuugcaggagcucuagugauugucgcuacuucaguugaugacaugagauuguucuuuauuuuucuucagcugguuuucccaugggcuaugcagcagcagcuccugccuauucuccuaacauguauccuggagcgaauccuaccuuccaaacagguaugugcugggugguaaaaugcuuuguacguacagcugggagagaaaggugaagggguggauuuugagagggguggguauagaauuaggacuugguugagucgauuucucaaguucauuaaguuagccuguugauaagugcaacaaaagcuuaauucuuacugcacugaagcuuuauauacuguguuucucauguccucccacaaggcaaaucuguaaucacuagguuguuaacucugccagagcaucuguucaugaaauaguaucaccuacuagaaauugaagaauuucuugccaugccaacagguggaauuuccauguuaauguuuuuagagauaauuuuugguuagacuacuuuagcacucugauaauauuuuuuaaaaaaguauuauuuuccauguaauguauagaugaauauuuuuagauuuuggaaaucacuguuaauauuaaaaguggaauugguuugggucugaaucuugaggagauugguuauuuagugggauuuccugcuaggagccugcacucucugguguugguuccuuuuggacuuuuuucacccacacggggcuuugccuuucugccgcagcagugguggugcacacucugaucugaggcugugguuuggccuuaauccugggacugcuggggcaacuuuaucccucaacaguagcuucacacaguuaacuuugacagaggaggagacaacagcaguguccuuuccccagauucuuccuguuuuguuaaucauaaaauucugccuuuauauucuguccuuacauccaucucuucguuuccauuuccacuuccacuaugacccuauaugaccacccuuguucagaccguaguucacacccugagaaaaacguucuugacuuggucuuccugcucccaagcuuucuuuccccggguuaguguucuucccauuuaaaccagagcgaugcucccagaugaauuuuucucagugguuucccaugacugugagacacaguuaugccuagagucucgacuuucagucccuagcuguuugccauauuggcccauuuuuucccuuuagagugguuuuccuuuuguguuuugccuugaaagaaccauccaucucguaguguauauuagcaguucauuccuuuuuauuguuagguaguauuuuguuguauggaaauaaauacuucaguuugcuuauccauuuaccaugugaugaacauuuggguuauuugcaauuuugggcuauuacaaaugaaaaugcuauuaauauuuauaugcagguuauugugugaacauacacuuugauuucucuugaguaaauaaauacagaggauuugaguggcugguuauuauggcaaguguauauuuaacuuugugagaaacugccaaacugucuuccaaaguggugguaccauuuuacauuccuaccagcaguguuugugaguugucguuccuccacauccuuaacaacacuugguguggucagucuuuuuaauucuagccauucuagugaauguguagcaguaucuuuucaugugcguauuugccuucuguaugucuuuggugaagaauuugcuuuuacuguaugucaguuauuguuuucuuaucguugaguuuuugagaguucuuaucagauauaugcguguuuucucccagucuguggcuuuuucauucuuuuaacaacgucuuuuaaagagcagggguuuuaaaaguuuaggcugggcgcgguggcucacgucuguaaucccagcaauuugggaggcugaggcggguggaucaugaggucaggaguucgagaccagccuggccaacguggugaaaccccgucucuacuaaaaauacaaaaauuagcugggcuuggaggcgcacuccgguaaucccggcuacuagggaggcugaggcaggagaaucacuugaacccaggagacagagguugcagugagccgagaucgugccauagcauuccagccugggcgacagggugagacuccgucucaaccaaaaaaaaaaaaguuugaugaggguuagucguuuuauggaucaugcuuuugguaccauacuuaauaaaccuguguaacuuggcugggcgcaguggcucacgccugucgucccagcacuuugggaggccgggguggguggaucaugaggucaggagaucgagaccauccuggcuaacgcggugaaacccccucucuacuaaaaauacaaaaaauuagcuggucaugguggcgggcuccuguagucccagcuacuccagaggcugaggcaggagaauggccagaaccuggaaggcggagcuugcagugagccgagauugcgccacugcacuccagccugagcgacagagcaggacuccguccccaaaaaaaaaaacaaaagagaaagaaaccuguguaaccuaacuucacaaagauuuucuucuuuuuucuuguagaaguuuuacacuuguagguuuuacauuuaugucugugacccauuugcaguuaauuuuuguguaugaugguaggaauggauugaaguuuauaucuuuggcauacguaucaauguggcaugugaugaucaugccguagaccaccauaacguaaguuacucuucuaggauuuucagagguagcccacuuuuacucauuucuucauggagcacaaaucagugugaaaauguacuuaaaacuuucaacuuuuuuauuuuacaagaagaaccuugaguuaauuucaggcugagagcuguucuugccaaaaaugugcagcacugccuagcagaggcaggguggagacugagugcugcugacaccuuccccccuugggugccugugggggccacccuguggaacaugggccacccaucucauuauuauuuugagacagggucuugcucugucgcccaggcugcagugcaguggugcaaucacgccucacugcagccucgacuuuucaggcucaagcaaugcucccaccucagccucccgaguagcugggauuacaggugcacaccaccacacucggcuaauuuuucuauuuuuuuguagagauggguuucacuauguugucuaggcuggucgcaaacuccugggcuuaagugauccuccugccucagccuuccaaagugcugggauuauagccgugagcuaccaugcccagcuugucacccaucuucucgaacaucucuccuuucucauagggagguaaggccuguguugucccuuuuccaagacugcucucaaauuguuccuguaauccagaagcugggacaggcagguagcaacugcagcugcccaaacggccuaccuuguuuagaggggcaucugcugacgggugccaggcaguuguuaggugccagacugcuggcucaccagugccagaucuucuggucuuguaggagaagcugugaaauuggugaaugaaaaauauaaggcagccgggcacggugguuuucauuccuguaauccuagcacuuuggguugccaaggugggcagaucacuugaggccaggaauucaagaccagccuggccaauacagugagaccccaucucuacuaaaaauacaaaaaugagccgagugugguggcacacacuuguagucccagcuguucaggaggcugaggcaggagaaucacuugaaccugggaggcagagguugcagugagccaaaaucgcaccacugcacugcagccugugugacagagcgagacucugucucaaaaaaagaaaaaagaaaaagucuuucugaugucccacaagugcuguuguccaucuaaccugagucuggaccacagcugugugcccaucuuuuucugguauccucucuguuuucaugucuuggguguuuguuuuuaagagaugggggucuugugguuucacccaggguaaaguccagugguacaguuacagccuuuuucugcugaguucaagggauuuucccaacgcagcaucccaaagcguugggauuacaggcauaaaccaccacacccagcuucauguuuugaauuuuauaacucccuuuucagugagccuuucccuuuuucugaugagcaagccaaaauuaucaguauaaaaaauuuaaaagagaaguuuuucucccuuccugcugcuuuuucucugucuuucucugaagguguguggagguggguguguaugugugugugugugugugagugugauaggaucucacuuuguugccuaggcuggagugcaguggcaugaacuuggcucacugccaagcaauccugccucagcuucccaaguaccuggaaccuuaggcacaagucaccacaccuagauuauuuuuuaaaaauuuuuguagagauggggucucacuguauugcccaagcugguuucaaauuccugagcacaagcaguccucucaucuugaccucucaaaguguugggauuacaggagugagccacuacacccagccccugcugcuuucuugaucuugccguucaguuugcacccaaugcugacuugugguuucaacgcuguauaugcggagucugacuuccagagcacuuuuguaauccaaaugccacguauuucuuagcccucuuccaauugugauauaagaggauuccgagacccuugugaugagaugucuuuugcugaagaauucuguuuuucagaaucugggaauggagaaggugucauucauuuuguccuccugaacaaggcuguguaugcacacaucaagagugguggugauaugguuuggcuguguccccacccaaaucucaucuugaauuguagcuccuguaauccccacaugucacuggagggaccuggugggagguaauugaaucauggggguggauuuuuccugugcuguucccaugauagugaauaagucucacgagaucugaugguuuuauaaagggcaguuccccugcacacguuugcucuuccuuugccuuccaccaugauugugaggccuccccagccauguguaacugugaguccauuaaaccucuuuccuuuauaaauuacccagucucggguauuucuuuauuaguaguaugagaaugaacuaauacaacugggcuguccauuuuuggaaucagagcuuugaauuguggaguuagcuagauguggauuauacuccugacugugucacucccugggaaaguuguuuaacuucacccuuggcauuggaauaaugaauaaauaacuccuugauuucuuaugggaggauuucagccccaagccuacgaucaggcauagaugucagcugggccagcacauugaggccucuguucugguccuacuuagagucacaaguaccuguaacuaauauugguaaugaugaucugaaauugucaaaacagucuguucuuuguaauaagcucuacacacaagguuguuuagauauuuauuacauuagcacuuauuuuuaaaagguacaaauuuaggccgggugcaauggcucaugccuguaaucccagcacuuugggaggccgaggcggacggaucacgaggucaggagaucgagaccauccuggcuaacacggugaaaccccgucucuacuaaaaauacagaaaauuagccgggugugguggugggcgccuguagucccagcuacucgggagguugaggcagaagaauggcaugaaccugggaggcggagcuugcagugagugagucgagaucgagaucgcaccacugcacuccagccugggcgacagagcgagacuccacucagucucaaaaaaaaaaaaaaaaagauacaaauguugcaaagagugauggagugaugaaauagcuuccauggucauugguguguauggcuggguggaggguaaauuggagaaacuucuuuggagggcaguuugguaguguauguuagaagcuuaaaaaugaacccuuucgacccacuucuaggaauguauucuaagggcaauaauuggaugugcaaacauuuauguacagguacacaugcauuuaauuacgaagugaugguuuaauuaaacuguuuaucacacaguguuuaucugguuuugguacuuguuuauggagaauauuuaaugauaagugaaaaugguuuacaguagagcuuucuuuucuuuuuuuuuuuuuucuuuuuuucuuuuuuuuuugagcuggagucucgcucuguugcccaggcuggagugcaguagugcgaucucagcucacugcaagccuugccaccuggguucaagcgauucuccugccucagccuccugagaagcuggaauuacaggcgcucuccaccacgccggcuaauuuuuguauuguuaguagagacgggguuucuccaugugugucaggcuggucuugaacuccugaccucaggcgaucccgcccaccuaagccucccaaagugcugggauuacagacaugagcccccaugcccggcguuucuuuucuuuuugaacucagaauuauagccauaaaaugaaacccuugguuuguuuaaaaauuaaacuucaugcauggcagccgagggggagagaauagccuuuggaauauuaauagucugugaggucuuguggagccuguuucuuucccucuuaaagguuuacauucauagagguaaaagauugcagugcuccacaaggcuuuuaaaaaugaacaauagcaguugccugcucccuugugggagcccccacauuucacuccccaugggcaaacuccagcucuuuaacucuuuaaagcugcuuuugcucgugccuuccgugcuuccacaugacauguuucugcuguucccugcuucuuuuuuuguuuguuuuuguaaaguggcacugcuuuacugacuucucacuuugcugccccgaccuuccuucacaguucuauuauuguggccgcaucagcacuguucacggcugugucuucugugcggcgauccuguuguccugugcccuguugcaguuucuucugcaucuacugcggugucccuggaauuaauacuguacuuaucuggugucuuugauuagguuucugugaccauagcauuaauuaaaccuccagcuacccccgauguguugagaucucuucuuagcaauuucagauacuuguguguuguuuuccuggugaucucugaagcccucccuuccucucucuuaucuggacugguuguccucugggccagacccugggggggucacuguucucaucaucccagggcuugcuuuugccuuucccuucugccugaguucuuuucuuuuuuccucguuuacucugguuuuggcgggggauuuucuucaguaaccaccugggagaguauggaaaagucacaauuuugagauuuuccaugucugaaaacauuuuauucugcacgcacacuucguugaugguugucuggauacagaauucuagagagcaguuauuuccccccagaauauucggguguuugcucaauggcuuuccagcuuccaccacuguugcugagaauugggguaccuuguuggugccugauugaguguaaccuugguuuuucuuugcuauucuguaggauuuuugccuccaguguucagaaauuucaugaugcuguguuuuggcacagaucuucucuccucacauguacuucaggcuucugaauuuuuuaaauuuucuaaauaaaugucuuuuuuuacucaaaaaauuauuauaaaaaaauccgcgugguacacaguacuuuugaaaaaaaaaaugaccuauuuaaauaaaaaguuucugguucccgaacaguuggcauucuaaaaucagugacccugugcauguccucuucccugagggcacagccagggucacucacaggucuggugaaguggaaggagggagcgucuguugucugcgccgccuggguugcaucaguacagaugggcuuccuggggagggagaaucugaaaagcuguuguuuuggaaagaccuagcacugaaugaauuugauauuucagggaggcaguguauauuuuuggguacgaugagguaauuguguguauuuauuuaaaguuugugaaguuccuguugaguuacuauggagggauaugguggacuuagugcugaaugaaaaaaaaaagguggcaagcacacacugucuauuuuuaauuaaaaaaauuuuuuuacuuaguguuuuaaauuuuuaaaauuauuauuauuaguuuuuagagacagggucuugcucagucgcccaggcuggagugugguugcacaaucauagcucacuguaacccagaauugcugugcucaaugagcgauccuccugccuuggccuccuaaaucgcugagacuacagguacaccccaccaugccuugcuaauuuuuauuuuguagagacaaggucucgcuaugcugcucaggccagucucagaacucuuggaaucaaguuauccucccaucuuggccuucuaaaguguugggauuacaggugugcaccauagcucuuggccccacacuaagucuuaaauugauagggagaccuguuugccuuacuugaaaugcacuugucuuaagugcuggcuagaaaaugguguaauauucaugccuaaaccaaagaccaaaaguuuucuggugagcauuagaacguagccucacagucauaagaauaaacaguaagauaauauauauuaaaaaccauuguugugauuagaaaucguuggugacuuuuuucaacauuuuauuguaaaaaauuucagaugucacagaaaaguugcagaaauuucacagugaucaccuauauauggacugcuaagauucuacgauuaaauuuuuuaaauuuaaaaaauuucagaugucacagaaaaguugcagaaacuucacagugaucaccuauauauggacugcuaagauucuacgauuaaacuuuuuaacgucaacuuuuacaaguaacauuuuacuuguaucacauacacauuacuccauccauccuucaguccaucuuauuuuuugauggguuucauuucagaguaaguugugguccucaguauaucuuaccucaauaacuugagcaugcacaucauuauuuguuuaguuccuuuuugguuuuguuuuuaaguaaaaugugcaugugugaaaugcacaaguuuagcaucccaugcauugcaugcugaguugcauaugcaugcuuccuuggagcagucgcuccuuuugcuucagcaacgccuaccuguaaaguagguguuguaagacaccuuggguaggccggacgcggcggcucauaccuguaaucccagcacuuugggaggccgagguggguggaucacuugagaucaggacuucgagaccagccuggccaacauaggugaauccagucucuacuaaaaauacaaaaauuagcuaagcaugguggugcacgcuuguaaucccagcuacucgggaggcugagguagaagaaucgcuugaacccgggaggcagagguugcagugagcugagauagcaccgcugcacuccaaccugggcaacagagcgagacuccgucucaaaacaaaaacaaaaaagacaccuugggugauuggauugggaaaccuagggcuagcugcagggauuucugcagugggaggcuuccaguagaagaaaaggaagacaucguaggugggccccucgacuguguauccuaaggaaaugaggcaugaaaaaggacuucaccuuuuuucaguggcuguggugggccagaugagcacuuguggcugagagacucccucuuuggagagagguguucucagauuuuccucacuuugguuuuauacucuguauuagagguuuguuuggguuggcagcuugcaucuucucuucacucugagcucuuucugcaguuugaagagugauaaaaaggucaaggacuuucuuauuagcaauguugauggaugugggucguggguuuauugcuuguuuugacuucuuuuaacagcuuuuccuuuuucuucucauucuuucuuuagugaaucaguuuaucagauagaacuguaacuucuuguugcacauuggcuguauauauugaacauguccaguggcauaguuuaacuuuuuuuccagccuaugccuaacugccaggccaucuuccagaucagcaucuuucagacugcuauagaauccuuccugcugauggccuuuuuaaaggcuuggcaaaauuuuguauucaucuucuucuucuuuuuuuuuuuuuucgagacagggucucccucugucgcccaggcuggagugcauugccgcagucucugcucacugcaaccuccaccucccagguucagcugauucucccaccucagcuucccgaguggcugggacuacagucguguggccaccaagccuggcuaacuuuuguauuuuuaguagcgaugggguuucaccguguuggccaggcugguuucaaauuccugaccucaggugauccgccugccucagccucccaaagugcugggauuacaggcaugagccacugcgccugacuauaauucaucuucuaggggugcguuuggguguggugauccgugggcccuuucagcuaacuuccuugcuuguucuuuuaccucaugcaugacuguuguuuccauggagauuuucuggcuagcguacacgcucucaguugugugucagcaucugaaaguacuguauacuuuucaccuugcuuauuuuuacuuuuuuuuuuuuuuuaaauuuuggaggcgagguuuugccagcuuggcuaggcucgucucaacuccugggcucaugugaucugcccaccuuggccucccaaagugcugggaugacaggcgugagccaccacgcccggccuuccaccuuauuaaaaaaauugggccaggcgcgguggcucacgccugucaucccagcacuuugggaggccaagguggguggaucacaaggucaggagaucaagaccauccuggcuaacacggugaaaccccgucucuaccaaaaaaaaaaaaaauuagccaggcuugguggugggcgccuguagucccagcuacucaggagacugaggcaggagaauggcgugaacccgggaggcggaguuugcagugagcugagauugcgccacugcacuccagccuaggcaacugagcgagacuccgucucaaaaaaaaaaaauuacguauacagaaaaguugagcggacaauacaguggauguccauaguacccaccacuuagauuccccagugaucuuuccccauauuuaccuuauguaaggaugaguguugugugguuuuucuuuuauucuuguggaaucaauucagaauccuuugugucuuguccaauggacuugaguguagcccucccuaacaugagugaggugugcuuuugccuguccacacuuagaaacagcaggucucuaauuuuaaaaguagcuccuauuuacauuugcccaguuacccccuaaguuuuaaaaaacguuuggaaucagaauaauguacucagcaucacauagugaauuuuuuauaaaguugaauuuaugucucuuaucucuuucaaucuguagcagucuuccuuguauuuuuuaauacuuugacuucaaaagagugauuaggaaacguuucagauauuuacagaaauacaugggaacauaauucccacucacacauugccuugcuuuagcacaaguacaugggaauauuccuacucacggccgggcgcgguggcucacgcuuguaaucccagcacuuugggaggccaaggcaggcggaucacgagguugggaguucgacaccagccuggccaauauggugaaaccccaucucuacuaaaaauacaaaaauuagcugggugugguggugcacgccuguagucccagcuacuugagaggcugaggcagaagaaucucuuaaaccugggagguggagguugcagugagccaagauggugucagcacuccagccugggugacagagcgagacagcgagacuccauccaaaaaaaaaaauuccugcucacacaucaccuggcuuaagcacaaguacaugggaauauacuucccaccuacacaucaccuggcuuuagcaguuaccaccuuauggcugaucuuuuucaucugggccccugccacuuuccucuguauuauuuugaagcaaaucucagacauuauauucaucagcuuuuuaaauauuaucuuuaaaagauaaauuagaacugugucauugucacaccuaaaaauuuuuuuuaucacuacugagauuguaaucaguguucauauuuccaguuaucugucaugaauguuuuuaauuguaugaagaaagggaacccuguggguuuguuuguuuaaacuguuggaaguuuggaaugagauucccaacuuugaagucuagcaucuguucucaggaugugacacacagaggguagcucuauguuuugacauuuuuauaaaaaaaauaucaucuuggucagauaagaguuuggugacuccugggaggaucucuuuucaggcuaguggaaauaugaggcagaaaacugggauuaagccguacaguggggaucccauucggcagugucuccuuuagguacagcugaagguacccgcuggugucuggcugcugcaugguggugggaaaugaaagaggugguguggcuggggagaagggagcuauccaagaugacccuugacgucccucauccccacaguuucuuucauuugagacauccuugccccaccugccccucucugagcugacuccucauugcuugccaagacugcauaaaaugcugcuauguuggugguuuguuuuccugugauuucuuuucccccugaagccaagcaccuuauggagagggcuggaucuguccugaucaucuccgcugugacagggcauggccccauguugauggugaauagccucucuguguugguacaaugccccagucaccauucacuagucacaugugugcccgccacacaccaugcuuccuuuuugcauuucuucccugaguuagcuagucacuuagggggaauuggacugucccgggucuccugggaguaucaguacauggccggacacacuaccuuuuccuuuauaauucuuugauggcauucacacuaccuuuuucuuuauaauuaaagaaaauguuauacaaccucguuguggcguaauuggcauacaacuaaguguacagauuuaaagcuucaguuugaugaguuuuaaccuguguacaccugugaagcuuuccuuuucacuuuccuuuuuuagccuucuuaaagacgaggagaugagcagccagagaaggaaacucuguaacugcucuugucuugaaacuugcuuuuccaaauccuaauggaaaaucugcguauucugcuuuccuuuggccaagcaccaguauuaaaaaguuguuguauucaaauuuuggcaguguuucuauuuacgguuaacauagcggugagcgaauuucaaaauacagggagcccuggaggaaucuuuucuuucuucaaauggagacuagcugagguugggaguugcuugguuuggguagaagggucaggacucuggaugcagacaaaucugggugugagcacccgcuuugcugcauaggacaggaccaccuguuguuuggucugcugcagaucucagccacagcaccucccaccgugagaccaugaaagggcaugcaggggaguaugagaaggcugauguugaaggcuucguguugcuuaauugauacagugugcaguauuuaggugaaaaagcccagacuucaccacugugcaauauauccaugucacagaauugcacuggcaccccaaacaaaaggccccagacuagugaauuucccagggggccaaucauucucuuucccuuucaaauuaaaacaaaauauauggaccaggcacauauauauauacaggcucacaccuguaauccuacuacuuugggaggcugaggcaggaggaucauuugaggccaggaguuccagacuauccuggccaacauggcaaaaucccgucuauacuaaaaauuacaaaaauuagcuggaugugguggcacaugccugcaaucccagcuacucggguggcuggggcaugagaauugcuugaacccaggaggcggaggcugcagugagcugagauugcaccacuacacuccagccuagggaauagagcaagacuccaucucaaaaaauaaaaauaaaaaaaaaauacacacacguacauauugcuaacagcccaguuguguaaaauuuuuuaaaaauuaacuuuaauuauuauuacuauuuuucugagacagcgucuuacuuugucgcccaggcagaaugcagaggcauaauuacagcucacugcagcguugaccuccggcucaggugauccaaaauucuuuauacucagcucauuuuuucaaacuugagguauaauuuaugcacaaaacacccacauauuaagugcucaacuggguggguuuugacaguuguacaugcccauggaaccaccacuccaaauaaaacauggaauacuuugaucaucccagaacgcuuucuucgcccucuccccucugauuuccgucaccguagguaaauuucuuuguuguuagggaauaaacgggaucauugcucuaugugcuguucuguuuccagcuucuuuggaaagcucagcauguugugagauucauccauguuuuuuccuuuugauugcugaguaauguuuauagagacauaucaugauuuauccuuucuccaguugaugaagauuuggauuaguucccauuuuuggcuacuaggaauaagauugaacacuuuuuacaagucuuucguggaccuguguuuucauuuuucuaggggaaguuuugggaguggauugcuggauguugcgggaugugucucuggcuugcaaaguugcacugucugacacggacagugugugagugcuccaccccuccugcucucacccaugggaaugugagaugccauaagcacuuguauggaggucugauuuacauauuauaaguuaauccuucucaguguacaguuugguauguuuggacagucauacacagcuguaugaccgucaccacauuugagugaaugcacucuuuggaaagguucucgcaugccccucuggccccuggcaccauugcugggguuuugaugacucuggauuagguuggucuuuccuagagcuucugucaguacaugcauccagcauguguccuuguaucuggcuccuuugacaugguguggcuuugugauucauucaugugcuuguauggaucagcaguuugucccuuuggcuugcucaguaggauuuguauggaugcaccacaguguguuuacccauuugucuccuggugggcaucugggccauugccagcuuuugaucauugugaauauagcugcugugaacauagcuguccagagacccucucccuccccugagaccaaaccccucuucucuguuggggucaggaagggacaccuaacugcuuauucagcaaacucaaccacucuacuagauggggucucuuuaucugcuucuggagacggguugguggccagcaguuugcagggcuuuggggaacggcucucuuggugccagcugcuccucgcugcuggcugagugccuucuucucgagucugcucaaucauccuccacuucagcuugccaggcuucaacaugcugucuucucuuccauucuuggugaguuuuaugucuuuuuucucuuaaucugcuuuauugucauuuucaugucauuuuguguggggacaaaagcaaguauguguguucagcuuucucccuuaacccagagggcuuuuuaccauagagugcuuagccaguccuggugcugggcaaguuucuccuguuuuugcuguaacaaacaacacuaugaugagcaugcuuacaguuaagucucuguguguguauagauccauguguauugcuuuaagacagacuucuagaaguggaauugugggauuaaaaggcauauauacuuuagaugccaaguuuagccccaggaaugccauaccaauuuaaauuccagcaggacaagacaguuuuuauuuccuguccuugugugagcauuccaucuguagaacguucucuuuugguauuuuuuccuccuccccaacacccugccaccacacacacgugcaugcacacacguacacaaaguaagaaugaagucagaucuuaguggaggagagugggggcggcaguggcagcaggucuggcgaguugcguggggcugacacgcagcuuagcuccucccugccuguguccucucccugcgccuggaccggcuugggugaacucaggccauugccuucuuuguuccagguuacacuccuggcacaccuuacaaaguguccuguucccccaccagcggggcugugccaccguacuccuccuccccgaaccccuaccagacugccguguacccugugcgaagugccuacccccagcagagcccguaugcacagguaugcuuggguacacacugcugugugggaaggggugauaccaccugggcguucauccuuuggcccugggacccugugucaguugucucucuucuccccacagcaaggcacguacuacacacagccgcuguaugcagcaccuccucacgucauccaccacaccacgguggugcagcccaacggcaugccugcaacgguguacccugcucccauccccccuccuagaggcaacggggucaccaugggcaugguggcugggaccaccauggccaugucagcagguaaguccucguuccugcggugucuguccuaugguguacccuagagcugggggaggggagagcucacgaauccucugacccuuggcucuagguuuucauagcuguaguuguguggaaggacagaaaauucuuuggggaagaaacagcagguuaucuuuuauuuugccuaccugagugaccccuuguggaggccucucugaaucugauggacucgcuuuguuggugaacugagccauuuggcaaugcaggaugugcccccucuccucccacccccuaugaccauguaagacuugaguagaaggaggacacuuuguguaccgggguugcucuggccuucuuccuuucccuugaggggagcuugucuuugcaggucaguugucuucaucgggauguuuucaugcaucuaggagagcuggucuugcguugauagaagaaacagcugccuguagaaauccuuuggcauucaucuaccguacuuuacuuugcaaggccuccucuaaggaaaauaaaccauggaaagaugaggccccuggcugggaugggcacaucuccgcggaagcccuggggguuugaucugaugucuagggauugggugaccacccaaucuguaugaccacccauguggauucaccuccuggucucugggucaauaugaccaccuuuaggucaugcccacacaaaagcguacuguucccuccuuguuuuucuggacuugacuucaguguaaggaaauuaugccagagagaaaagcauuccggguuauuaugugugcuucaauguagacucugauuugguuuuccccauacuuaucugucaaggaacaggaaacugggcauagacagaaacugcugguuugaggcacagggagggagggcagcaggcaccagguugggugccacuguguuggagguggugcugguccauaaagggacucaaguaguuguugaguuucugcaguuguaggaaaaauagauuucucuuaaagaacucagaagcucauguaguuuagaauccucauuucuuuuuuuuuuuuuuaauuuuaaaauuuuuaauauuuuuuuuuaagacagggucucauccugucagccaagauggagugcaguggugugaucucagcuuacugcaaccucugccuccuagguucaagugauuuucccaccucauccuucccaguagcugggacuacaggcgccugccaccaugccugccuaauauuuuuuuguaccuuuugguagagaugggauuucaccauguuggccaggcuggucucgaacuccugaccucaggugauccaccugccucggccucccagagugcugggcuuacaggcgugagucacuguugccagccucuuguuuuuuauuuauuuguuuuuaccaucuuaacuuuuuuuuguugagacagggucuugcccuuuugcccaggcuugagugcaguggugcgaucacaguucacuguagucuggaacucaugggcucaagccauccucccaccuuagcuuccugaguagcugggacuauaaguaugcuaccacaccuggcuaauuuuaaaacuuuuuguagagcugggaucucacuauguugcccaggcgcaucucaagcuccugaacuuaagcuauccucccaccccagccucccagaguguugggauuacagacaugagccccugugcccagcccaucuuaacccuuuuuaaguacgguucaguaguguuaaguauauucacauuguugugaaacagagcuccagaacgucuuuauccugcaaaucugaacuccuguacucauuaacgcuaauucccuguucuacuuucuuucugucucugaauuugacuacuccagguacuucaucuaaguggaaucauuaaguauuugucuuuuagugacuggcuucuuucuuucagaauuauguucuuaagguucaucuauauuguagcaugugucagaaucuccuuccuuguuaaggcugaagcauacucauuuguuuaucaucugaccuauaaaaauuauugggugugcuuuaugaaggggacacacaaaaggcuuuuacgaacauauugucuguggagcuugcuguguggagacaacuuuugggugugggggauuaucuaaucagaguucugacaguaucugggucaagacuaucccucuuccuguauacccuccuccuugcaaagaggccaggcuugugugcguaucaggcaguguggagcugugcaggaggucagccucaugucaugugcugcucuuucuuccagguacccugcugacugcucacuccccaacuccugucgccccccacccggucacugugcccacguaccgggccccaggaacgcccacuuacagcuaugugcccccucaguggugaucaccugcaaauguaagugaccagggaaggcugggcuagccuuugaugaaagggcauuuccaugggacaguggcaaauuuaccacauauuuaagcacuaacgaggaaagugugccugacccuggauccagaggcaauguaguguuuaaauuuuuuguuuuuauugagacauuacagaguagaaggaaggaaggaaccauugaauaccuacuguugacacuguccaucuugagccuugccuggaaugugcucuaaccccccaccugccugcuacaggaaauagggcuccaguugcaauugggggucucuaggaaggaagugagaaccagguccagcaguuuugcccauugcugcccuuuccgacccugcugggccucauccuacuugagauuuuggaauagcggugccggaagagcucugugugacugagugucugucuuccuuucugcagguuugaggacggagcugugcagucacauuauuggggauuccacagcuggugcugcaggccuugcgccuccaaccaggacuuucuucuuaaugcucucgacacuuagcuaaacacgacuauaucccggcccagcaggccccagcgccguuagucuccagcugacucuguggguuggucuuaaagcaaauucuguuuuguggacugccuggcaauuuuuuagcuaacuguaaugauaaaaagggaguauuaaucuauucugaaucauaucuaguugaaugcauguuuaaaaaaacaaacacaaaaagcuugcucaaucuaccugcagugacugaugcaaaaccaucauaugcaaaauccaaaggaauggaaacguauuuuacaacuuguaucacuaaugcacuguuguaauguaugcaaagucuuacaguuauaaguguuaaagugaauuucuucauagagcaucugaaauaucuuagaugauucuucaaccuuuugggguugauguggguugccaguuagggauguggacauuuuaguuuucagcgaccuguuucuuuggcacugacuguccugggagggaguugcgagguuugggagagaguagggaagccacagcugcuugggugcagcugguucauggacaucccuuugaguuuaggcuugguggagucaguggaacagggacaugcuuaaagcucaucaugaaagauuaugguaguguggccagugaaauuuggggcgaggggggugguuuaugugucagcaaagcaguuucucugcuaucuaaauuuucauuacaguucucuuagagagaugauguuuuuauaugucuuuauuggaaaaguccuauguaaaacuaaauuauuuuccugggauggaagaaaugugaaagagaaacagccaugcuugcaggagguauuguccucugcuuuauuuagcuuagaaaaucauuccuuuuuuuuuuuuuuuccuggagaaauguuugaaucagcugaaaacagguaggcauugcuguuuuuccccaacaaagaagggcaaagguuucagcuguauguuaugaagaaagugguauauuuaagaaugaguuaaaagggaacaaaacuuuauuuaaaauuccuccaauuucuuguagaaaggcagggccguggauaugucuggaaauguagaaaccuguagcugcuucugggaucacccaccugaugguggugacuugucugcugaggccggcuggaggggacgcuuagagauggggcgagggggaggccagugucuguugucugcgagccucuccugccaucucuuuugcagcugagggcacuuggcacaaagcaagcacagacagcagagagggccaggcagugcuggagugcguuugcuggcaggguuuauugugggagaggaauuugaguuuaggaucugaaucuuguacauaagaaaugaaaaggcuucccuccaccccgcccccaaaauaugcccguccuguauccaugagagugcaugucgguucucagugagggucagagugggggugggggauguaaggccugggucccuuucagcggccucuagggcaggagcgugcgucuucuucccagugcaguggugguuugagugcugugggcucugguggggagggggcucugcuccucuucauuugcugguagcugggucagggcacuggcgcccagugaggaugcccacuagcauucugccccaguugguugguggggggacaccugaccacugagccuuugguaaccuuauuuuuuauaguaaguacuucuuauaauuuucuuuuucacaucuuauuuuauaagaaguuuaggaauauuuuugcauggaucauuguaaacagcagauucuuuauuccugaugucuauuaacauagaauguuuacugauaaguacuuuaaauugcuucaugagcacuuaauccaucuuagugucuaugugugggggcagacauuuaccgcaggcacacaguuugugccccuuucuucaagucucuguugguaauuccaucuguuuaguggaugguuggcaggauuaguagguucuaacgguuccagggguucagcugaccaaguagcagagaagucuuuuuucccaauugagugcuaauagauuaggauaaaauacucacaauguuaguguaugcuuuuaaaaagccccacacaacaaaauggaaacauacauguacaacuccugugagggcuggagucuugggguucaggaggagguuagaaguuacaggcaucucuucaggcuugcuugguacuuggcacacacaggaugguguuuuaaagagugggcugcaccccccacacgccauuuacaucagcuucauaaacacuuuucuuccucccuguaacuuaaccuuuuuucccuuuuaugaaguugagaggcuuuaugaaauaaguuugcauugcacauccgugcagaaaucuuucugacuuugaaauuuuuaggacgucagcugucagauacgaaagguagauaucagguaagaaucuggacuuaggaaauagucacaaaacugucauagguuguaauuuuaucaacauucgcuucuaguaaaauuaaagucaauuaagaaauagaacuugggucaaaauucuguuacaaagcuucauaauuugucccgaagcauaugguggagcauucugagaaauuugcuuuuuguguguuugacauuccuaauuugggaguccuucagcugaauuacuauucuuuuagaaguugagacagcagguaagcaaaggaccuaguucauguaaacauggacaucaugauggcuauuuaaaaaauauuuguucuacaccuucuccccugaggcuuggggaguguguucagccgcugcaguuucucugcucauggaggucuuguuuggaucugugcuggcggcugagcauuuagugugagccagugacccaugaacuugccgcucugugagggccagagucagggccagucaugguaaugggccugaaggcacuuccagaaccuuuuaugucucucgugagccaucuguuaagaacguucuucuuggugugguuuguaggccuaccugucgcuauucugggaaaccuucuugagugcuaugcaaauguguucacaggcaaugggggugguccugagccuuggggugggcaccuggucagugagugucuugcccuuccccagcugggcauacaguaccuugcucuuucugguggcaucaucuggcugugaugaaugaggucuaggaaauaauuugcaugugucuugggggacacaacaguaacgagaggaaauacauuauuacagcaacuugcgacguacuaauaccugucaguguuggcccccguaagguauguaaggcaccugugagugccagugagugcuggugaaaggccaacauguacuaguuauguaaguauuggugucugcuuuaaaaaaggagacccagacuucaccuguccuuuuuaaacauuugagaacaguguuacucugagcaguugggccaccuucaccuuauccgacagcugacuguuggauguguccauugucgccaguuuggcuguugcccggacaggacaggaccuccauugggcgcagcagcagguggcagggguguggcuugagguggguggcagcgucugguccuccucucuggugcuuucugagagggucucuaaagcagagugugguuggccugggggaaggcagagcacguauuucuccccucuaguaccucugcauuugugaguguucccucuggcuuucugaagggcagcagacucuugaguauacugcagaggacaugcuuuaucaguagguccugagggcuccaggggcucaacugaccaaguaacacagaaguugggguauguggccuauuugggucggaaacugcauguuucagaaaguuugucucuuuuuccuacucauuauuugaagaagagagagccuguggggauagccuuaucuugguccacaggacugaagugaagucacuugggaaggggagacagaggaugagcggcgucuguguagggacccccccccgggccugcagaaggguggugugcucccaggacuggcaugacaggugucuccuccucaccacaggcugugcccaugagucccugugcagaccagugggcaaggcagcugggccagaucucaggccagccguuugugcuccuagcaggguugcugugcuggccacacggagaggcccuagagagccucauggauuguaacuaaagaagaaacgguuccuuuuuguuuuuuuaaaaaugauuuuuaaauaccguuuuuuacaccguucucucgguacuuuuuuuaagcuaagucagcauugucuuccaguguuaaaggcaucccucaccucugcauugaacuuacguauccaugccaaggaauggaauuuccauccugagccaguucaguuaggugucaauugauacuauuuuaauuuuuuaugcaaucugaugagaugagcucagauuuaaaaaucucaaaagcacguuuauuguaacaagaauuguuauguauuaauacugcaguuuucaauaaagauugacuuguguugca

SEQ ID NO: 191100 - RNA, 104496 nt, Homo sapiens
gaaguaaaagggcggccggcagcugggcaauugcuuugcgaggcuggguguugagucgagccgcgggaaaggcgcgugucggccucucacuggcgcagccugcacugccgcugccgccucgccccgcccugcccuggcguugucucuggcacuguggcggacugaccacggcccgggcaugggcugcaagggagacgcgagcggugcgugugccgcgggugcgcugccggugacagguacccagggguggcgugaggaggccucguggacaaagagaggguuuggggcacaaggcgacccugugccccugucacauugagcuuccgccucuaccgugacucaguuuacccucugguguccuaucccuuccccuauucgcgagcgccccgaguugcccucaguggucuucuuggcaagguaucgcuuccgcggggguggcggcgggcucuguucagcggucuugaaccuucuuugaagagcuuuagauccuugugccaagugcagaaggaaaugggggagguauccuaccauggauuuagaccaagcuugauccucagugaguugagaagcagcacuuugcaggacccugauugcagaacgacgugcuuuuuaaaauagauuucaauuuuuccuaaaaugaauucggguugaugcguauugguuacuguuuucuuuuaacacugugaucuguuggcuggaaauuggaugauaugguuucacuuuuagcgugggaccugccagaaugagaucugcguccgucgccaauaacuuauagaugugaacuguuuuuguuccuuggccagaaucugcaguuguuuugcauuucuugccagauuugagaaggagcaauuuuguucguuugaaguccuggggucuuuugccuuauugugcuacacuaacuguuuuggaaacauucauugauguacuugccagccaauuuuaguguaaagugcccucuuuccuucaagaaucuuacacuugcaggcguuugaagacauuuuaaauagcuauuuaacagcaccacaaaacuuggaauaauuguagccuuuucacuuugcuuuuuuuuuuuuuaagccagucgaauuuagcaacacuugacuugcuuuugauaaacuuagcugaagcuuauuuuaaaaaaauucuuauuuauuuauuuauuuauuuauuuuguagagaugaggucuuguuaccuaccagucugaucuugaacuccuggccacaugaaacuuauuaaaggaagugaccauaauacuuuguacaguagcauagcacauuuauaaugcacauugaacuucaggggaauauaugaaaguaagaagaaaauuugcuuagaacuuuccugcagcugucugugagcauuuucuuuuuuuaucuaaguuucccuguaacaauacaagaugaugugauaauuuucuuucuuucuuucuuuuuuuuuuuuuuuuugagauggaguuucacucuuguuacccaggcuggagugcaauggugcaagagauaguguuuuaauuuauuuuuuuauuuuuuguuggugaggcagagucuugcucuguugcccagguuagagaauagugacaugaucuugcuagcugcagccuccaccuccugggcucaggugguccuccuaccucagccuccuacggaugguuguugauaguugggccuagaacuuguuaaagaguguuuucuguuuauucaucaugccgcaaguauaaugcuuaucaugcaaagccacauggcacauucuguuggccauuaucucagacuguuugucuuuauaagcaacauuuaagaaccccuagggucagaaugauaagggauccuauaaaaugaagacauacucaaagcagagaccacuucagugagauucuuacgucugcuucucuggacagucuuuuccucugguuuuaccuguagaguuaagaauguggggucagaguggcaaagcucuuuuuuaauguauagcuuuccuccuuuuuucaucucaaauggugcugcaucucuccccaagaacacguacucucucuccuuuuugaaaacaguguagggggaucucgaggcaggccacagguucauaggauuuucauuuuaccuaucuugcaguccuaggcauuuuauagcaucuucacucuuggugccacacuccuuuccuguuguuuccauucaugccuuaaugaaugaggccuguguuuauuucauuuugagagccuucuauguuucaggcauaaugcuaggcguggagaccaugauagacaaaacacccugcucuugaggagcucccaucgguccccaaagccagcguaaguguggaucugucagauugguugguuggauugcuucggucccagcuucaggccuccucccuugguuucagguuaaaacuauuccuuucucagccaccugucucccaagaacuguggccacugaaaauccuuggacuugccuugguucucacaagcacuuuucucagucugagucugcacagaguauggcuuuuuacccuuuuguaaagccagagaaccagagaagagagcacgguauuguagaacuuuaaaagcaggaagguguggguucuaagcacugcuauuuauuaguuaggcaagguacucagcaucuucgagcuuucacuuauuuuuaaaguggagaugcaugcagcauauucauggacugucuucugagugccaggcaucaugcugugcacuuugguaaacgaaguagacaugguugcuccccucagagaacguuagugcccuggguuguuguauguaaggauuagauaacacuguguauguaaagcaccuaauacaauguuuagcucagagucauugcuuguuaaaugcugggguuuccucaggggacuuugucauacccccaauuuccuccccacucuacaugccauccaccugggguuacagugcaguggcguccaauucgucaucaggaaucaccacuuucugggguguacacaucuagaccccuucaggacaaauuguaaacauagcuaauagcguaauacugcuagacaguucauaugaugcgcugucuccaguuuauaaacucauugacucaggccagauuaaaaaaaaaagaaaaacucuguaacuuuuggggagaauuuuuucucucagccacagaggauauauuuccaauguguauuuuugaggcuauuuaauaacgaugauguacuauucuguaauuuagaagauaguuuuuucuuacgauaaaauguuuuacuacaacaaucaauucugguauaguacuuggcacuuuacaaagugauuuuuuuauugccucuucauuuucacauugacccugugaggcagauacuauuauuccuacuuugauagucuucgagacuaagggccugggaaguuagguaacauauaugugguuaaacugcuaguacguagcaaacucaggaauugaucacagcugcccugaugcuaaaagguucccuuuuuuuacaaaccgugucuauuguguccuguagagcagguuucugaggcugcagucugugggccugugggaaagggugucuaugguuaguccuaagagaaugcuuuuuuuuuuuuuuuuuuuuuuuuuuuuuugagacggagucucucucugucgcccaggcuggagugcaguggugcgaucucgacuuacugaaaccuccaccucccggguucaagcgauucuccugccucagccuccugaguagcugggauuacaggcaccugccacuaugccuggcuaauuuuuguauuuuuaguagagacgggguuucaccacauuggacagacuggucuugaacuccugaccucaggugauccacccaccucagccuccuaaagugcugggauuacaggcgugagccacugcgcugggccagucccaagagaauucuuaaguuguacauaaaauuuggguccuuguuugcuccucugugggaaaugucaguaacuuuacuagauuccagaaaaggccuauauccucuucacucaaccagccaggaaucacugcuaucagguuucauuguguaaaaucuaguuugguuaucucuaauuucaguagguuucauuuuuguguguguauucuuucauuucugcagccucuauagcaguuuuuacaaacguugauuuugaaaaacacuucugaguguuuuuauuuauaagugggauguucuucuucuucuccuuccucuucuucuuccucuuccccuuccccuuccccuucuccuuccccuuccccuuuaccuuccccuuccccuccuccuucucuuccuccuucuuucuucuuucuuuccucuuccuccuccuccucuuccuccuccuccucccccacucuccuccuguccugcucuccuccugucccguaacuccuccugucccgcucuguugcccagaugcagcauggaccuccuaggcccaagcuaucuucccaccuuagccucccaaguagcugggaccauaggugcaugccaccaugccuggcugauuuauuaauuuuuuuugguuuccaaagaagcuggcagugccugaacuuaaaaugcuucugaaagccacuuuucuauuuguuauaauuuauuuugcuuuugaccaucguucuucagagauacuguauguucuaugaagcaggauguuaacacaaaugaugcuuuuuauaaaaagcagcuauugacuaguccccaauguggacagccucccucagugauagauuuuguaaccaauauuaaagaacugggaugagaccgaagugagccuuaccagagcuaacauucugaagcccaaggauagcuuagugcuucccacauauucacacccccuuuuaguucucauucaaauggguagagcucaggggagguccgauuaggguucuguuagguggacuuuggagaugaaaaucagagaaaucugcagcuggagaccuuuuucugaaacugucuggaugcugucugagaggaucuugacaggcuuggagcggcugcggagggugucaagaggccugcauucuguggccauccacuuugccagugacccuagaucccucauuuuguagaugggacaguuggcuugggaagccacuaaaauuuuacauuucuuuauuucagaaccugucugaguuuacauuugggacccauuauguuaguuuccuagggcuaccacaacaaaguaucacaaacuggguggcuuagaacaauagauauuuacugucucacagugcuagaaauccuuacucaggguuucacaggaccacguucccgcugaaaucuuuggaggaagaaucuuucuuugacucuucagcuucugguaguuucaggcauuccuuagcuuacaguauaauuuuagugugugccucugucuucaccugguggucuccugugucucuacauaguuuucccucugugcugucuuucucuguccagauuucuccucuuuauaacaucagucauuggguuagugcccaccuaauaaccuuguuuuaacugaugaccucuguaaagacuguauuuacaaauaaguugacauuacgagguaccgggggauaggauuuccauaucuuuuuugggggacacaguucaacccuuaauaccuaucauuuauauuuucaucuaucucagcuuuauuugcuuucauccuuuauaaaauaugguugugugcaaccuggugugccaccaacugauuuuuauaccccuguaugguguagauugcuugggaaaugaagcagagccuuuguaggaaagaauguaauaaccuaagugccuucaguuacauaucagucacucagcaaauaucuguuggacuagcuagauauuaagugcuauuauaugucagaagcauuucuguuucgcuaacuuauguuauuuugugucuccaaguauuauuaggauuguuauuuugugucuccaaguaugagguuaaaauuaccuuguagcaggccaggcaugguggcucaugccuguaaucccaacacuuugggaggcugaggcgggcagaucacgaggucaggaguuugagaccagccuggccaacauugugaaacccugucucuacuaaagauacacaaaauuagcagggugugguggugcgugccuguaaucccagcuacuggggaggcugaggcaggagaaucgcuugaaccugggaggcagagguugcaugagccgagauugcaccacugcacuccagccugggcgacagggcgagacugcgucucaaaaaaaaaaaaaauuuccuuguagcaaaacuucuuuucuuuuuuuccuuuuaggaguuugcuauaaaaugggaguucugguuguacucacuguucuguggcuguucuccucaguaaaggccgacucaaaagccauuacaaccucucuuacaacaaaaugguuuuccacuccauuguuguuagaagccagguaagagaacauuuuuuuucccuucguguauuugaguauaaauauaggcucugacagugaacauucaggagcuuuuuaaggagugagauuaucaucaaaugcauuuaugaagagccucuuucaguguauacuguaggauguauuguacaaaggcuguuaggacauagcaucauucaguaggacaagggcuauguggguuuauagagcuauguaggaacuuuggacaaauaacuguguuggauaaguuaguauguuacuuuccaaaaagcauaacaaggaaagagaggguuauguuuauuuauuuauuuauuuuuggagacagggucucgcucuguugcccaggcuggagugcaguggugagaucuuggcucacugugaccuccgccuccuggguucaagggauucucaugccucugccuccugaguagcugggaucacggaagugccccaccacacccugcuaaucuuuguauuuuuaguagagaagggguuucgccauguuggccaggcuggucucaaacuccuuagccucaugugaucugccuaccuuggccucccaaagugcugggauuacagaugugagccacugugccuggccaguuguauucaaauuuucuccuuauuugaaggaaguuuuaagaggugauugauaaaaggaagagaagagggcuuagcaacgugggggaaagaggacauuuuucccuuaagaacguggaagaaggcugggcacgguggcucacgccuauaaucccaacacuuuggguggacaagguggguggaucaccugaggucaggaguucgagaccagccuggcaacaauuagcugagcgugcuggcaugugccugagcaucagauuaggagauuaugcccaugcagcucaaucuuucuuuuuaaaugauaaaacgguggcuagguacgguggcucaugccuguaaaucccagcucuuugggaggcugagguggguggauugcuugaguccaggaauuugagaccagccugggcaacauggggaaaccccgucucuccagaaaaaaauagcugaguguggugguucgugccuauagucccagcuacuugggaggcugaccgggaggaucacuugagcccaggaggcggagguugcagugagcccagaucacgccauugcaguccagccugggcagcagagcaagacuccgucucaaaaaaaaaaaaaaagggaaagaaguuaucuuacgauuaaaauggguagaauuuuucauaaaacaauaguugucuuaaaauuagugaaacauaguaauuucaugagaaauuuuguauuccaagugugcuuuuuagcuaguguuuguaaauaaauauaaugagauaccugucuguauagguagggcuuaaaugcuuauggauggaagguuauuugauuguaucucaagugauguagagguggaacuagcagagacuuuccaaaggauaaauguggguagauugagcagcaagcacuugguaagucuuaguguuugaacgugcuagaaauuuggacugucacaucacuccaaucagccuuguggucugucuucuucaucuucaauuuauauauauauauuuuuuugagaguuuuugagacaaggccugucucuguuguucaggcuagaguguaguggugugaucucagcucccuguaaccucugccuccuggacucaagccauccucccaccuaggccucccuaguagcugggacuacaggugugagccacuaccccuggcuuauuuuuguauguuuuauagagaugggcuuucaccaucuuggccaggcuggucuggaacuccugagcucaagugaucuaccugccuuggccucccaaagugguggaauuacaggugugagccaccaugccuggccucuagaauuuuguauucuaacauuuuccccuuaauuccuagaaaaauguggaugaagaauuuugccauguugauugugugaacgaaugguugcaccucuuaaggaaaaagccucauuugauacugcuaaaaggaccagugggagggggcauguggcagccggucuuggcuagcucaggagccuagcagacuuucugcuaaauagacuuccuuccaucgccucucucugccuuucuuucucagcauagaaguggcaaaacaaagacaaaaccauuguauguauuucauggugauaacuaacuugauaaaugggucaagcuugucaaaugucagaacuuuauuugauacagcauaguuguaaaagugaaguggcucuuuuuuaagaguucuuauuaugggggaaaaaagcccaacaaagcaaauaacaaacaaaaaagcagugacugaagauauuuugagacugccugagcuggacugccugagcuggacucuaaaaacuaaaguuuuucuuuuccuuuuugcuaaucuuauuuuggaugauuuguuugguauaaaaucugucauugagauuuacaacccccccccccacccuacuuauuuuuuuugagacagaguuucauuuugucacccagacuggaguucaguggcgccaucuuggcucacugcaaccucugccucccagguucaagcccauucucauucuccugccuuagccucccaaguagcugggauuaccggcgugugccagcaugccuggcuaauuuuuauauuuucaguagagaugggguuuuaccauguuggccgccaggcuggucugaacuccugaccucaggugaucugcccuccuuggccucccaaagugcugggauuacaggcgugagccaccgggccuggccaagauuuacuaucacuuucugaaucauuuuguacaauuaacuguaacagguguuuuugugauauucuguuuaacauucuuuuuuugagauggaguuucgcucuuguugcccaggcuggagugcaauggcgugaucucggcucaccgcaaccucugccucccagguucaagcgauucucuugccucagccuccugaguagcugggauuacaggcaugcaccaccaaguccggcuaauuuuguauuuuuuuuuuuuuuuuuuuuuaguagcgauggaguuucucuauguuggucaggcuggucuggaacuccccaccucaggugauccacccaucucggccucccaaagugcugggauuacaggugugagccaccgcgccaggccucuguuuaacauucuuacccugaauuacauuuuguuacuuucacuuuuauuuacacuaauuucuugauaguuguacauucuugaucauuguccuagaagauucuuacagcauaaaacuauggacuuuugagaaagaaugcuaaaauugccagcccuaauugcucaauauuuucaguuucuuugaucacugugaaguggacaggguauacuguuuucuucaccaacuuccuuaucacagacaucucccccuuucaugauaucccuggucauuugccauuuuguuuuauuuuuauuaauuuuuuuccuuggcaugugaaguaagagcuacauuugcccuuuugguuuacuauuuuuaggccccuucuccuguggcuauuuguauacaguuucccaagguaauacgacauguaggcaacucauagaaaugagcuaugcuuauuagaauccacuuaguauucaccuccagagcuagcagagcccaccauucuuccuucuuaugucugugggagacccugauguuggaucaagguacuauguccaucugguuaaggaugaagggucaaaauauuuuacuacacuuuauggcaugccaccaccacagaucuuuugccuuccuugcaucuaucccuuagggacuaaaaauauuccuguuguguauuuuuagauuggaccugauguuugugaaggaguuguagcuuugugauugucuaugaagugauauuuaucuuuaauugaaguaaaacacuaaauauguuuucugcagcuguagcuacagaaauauuauauaaggagguauuauuaaaaucaaaaccaauaaucauuuacugagugcuaaauuuuguaaugacccaagaauguagcauguuagagguauaaauuaaauagacaugaauuuauauuccagcuuuuccauugacuaacucuaugucccuaagaaagucaguagcaucucugaauggcagcuucuuuauuugaaaaacgguuauaucugaggguggcuguguggguuugcggacacgaguaaauaugccaagcuuagugacuguaacaucguagagccuccuuaaauauuaguuucuucccuccuaguuccacauagaaggaagaccaaugcugaucucccgcaauagcuuuggaaaucuaagaaaacaaguugucaccugauuuguacuaucuugugggcauucauucugguuguuuguaguuuuuuuuguguuguagauuaaaaacuuguccuggauuauggcauuucaaaacauuuauauauggagagaaugguauaauguacucucucuguacccaucauccuguuuuaacaauuaucaauuuaaguacaauaaccaccaucaccacccccuucucuccucccgcacuagaauauuuuaaagcaaaucccagacaucauauaguuuguaaaaucauaauuuuuuuuuuuuuugggauggaguuucacucuuguugcccaggcuggagugcaauggcacgaucuuggcucacugcaaccuccaccuccuggguucaagcgauucuccugccucagccuccugaguagcugagacuacaggcgcccgccaccacccucgacuaauuuuuuguauuuuuaguagagaugggguuucaccauguuggccaggcuggucuggaacuccugaccucaggugguccacccaccucagccucccaaagugcugggauuacaggcgugagccacggcgccuggccuguaaaaucauaauuuaugcucaguggaauaaguauuauauaagaagcuaaaaaaacaaaaagcaacaaaaauaugcuguaaaaaaaggcagcauuucuuuaauaauaucuuguauuguuauucucuccucuggguuguuucaguggaucuaguaaguaauauuaggacuguuccaaguuuagaccuuguaagaccuuauguaugcaguggggugaaaagaauguauguuucaagaaguuucccuguaauuguaugaaaagcauguauuuauucguguguggccuuuacugggagagucuuagucugauugaaucuuaguucucaccacacuggugagugugucaccuugccccucucugcuuaucuugugaaugugccuuuaauuaauuaauuuaguguuuauuugcacauccugauguaucugucuuaggacuuguuuucuuagacuauaagcuaugccaagcuugguguggugucuaugucaguuacuagaaagccuagaaaaauacuacuuucaaggaggcauugagaaauuuaauauauuaugauaauggguauuuucagaaaccuauuuuuagagaagcugugcauuaccaggaaauguuucuuauuuuucccauauuucugugucuagcuguggaguagagugagauuguacaccccaguguucacaaguaaugggaaagucuuccuuuggcuagguaagcugagauccagaucuguaguuugcuuuaagacagugaaagaucaccacugcauuaguauuauggcucagaggagaagauaagcaauugacaugaaucauucaauuacuacaugcauuuccucguagggguuuuagacucuugaaugaagggaaauuuagacuggccauuauuuuaguaggauaaagucgaaaaaaauuaagauggcauuaaguucuuggaucugauuuuguuagaucagugcuaauuuuaaacuaaguuuggugaucuugaaaauuuggauuuaagaguguuaaaagauuacaacaugcugccuuuauucucagaaauuuuucuacgguucauauuuuacugugggagaacuuuaggcaaaacauauuuuuuguucuuuguaaggccuuucagaaaauaaguaagcagaacuaguacuagaaucaucaguuccuaauucuucuuccacuacucauaguauuuuugucaaugggguuucauaagcuuucuuuauauugagacuucccuuuuauguuuuuauuauuccagguuucuuaagaaauagcuauuaagugaaaaaauucauaggcuaaguuauuaauaacuaauaagauaggacuugauuaucauuaaaaauauauauauuauacauaaaagaguauuauauauuauagauuaaaagucaaacuauggacauuuggaaacuucaaaacuuauuuuuacucucuuuaguaauauaguuuauauuagaaaauuuuauuaaguuguuuuauuucugaucuuuucucccagugaguuuuuagcagaagacagucaagagaaauuuuggaauuuuguagaagccagucaaaauauuggaucaucagaucaugacgguaaaauugaagcaaaugcuucuuugacuuuggugucugggaaaauauuaggaaaaaauugucucuuuauaguauguguggcauggcaguuaauggaaaacauuguugucuuuaaugacuggaguuaugaugguggucaggaagagccaacacaacacaaauuauuauuuuugaagcaauguauaccuuuggcuauaagugguaccuuuguuuuuuuccccucuuguuuuuguucuaucgugauccuuuauuaaagugcuaugugaauauuuuguggaaguacauuucauuuuaaaucauucaguauuaauaaccaucuaaucugauucacuauuuuuguuaugaacuacacaacugagcuauuaucuguuaaguucauuaucauuaaguuaguaucauccagaguguuuuccauuaugccugccagccacccacaacuugaguguuaagguaucaaaugaaugauuauccuguaaaaccucauuugcaguuuuuaugaugugcuuucacauuuuuuaaacuucguauaagcuauauaggguguaaacauuaauaguuggagaugcugauaugugaguaguuaaaaccuugaauauuaauuuacauugacagauauagguuauuauuauuuuuuuuuaauuuuuauuuuuugagaugaagucuugcuuuguuuccaggcuggagugcagugguacgaucugggcucacugcaaccuccaucucccagguucaaucauuucuccugacucagccuugcaaguagcugggauuacaggcauucgccacuacgccuggcuaauuuuuguauuuuuaguagagaugggguuuccccauguuggccaggcuggucucgaacuuuugaccucaagugauccacccgccucagccucccaaagugcugggauuacaggcaugagccacugugccuggccagauauaaguucuuacagaagaggaaauguuucaaaauugugugacugcugcugauguuaauggguuguuuuuuuuuucuucuuuuaaaauuauuuaauuauuauuuuuuuaauacaacggagaugaggucucacuguguugcccaggcuggucucaaacuucugggcucaagugauccucccaccucggccuccuaaaguucugggauuacaggcaugaaccacugcaccuggccuguauugauuuuuuuaacuuuuuaauuuuuauuaaaauaauucauauuuuaaaaauugucugaaucuuuuuguuuuauuuuuauuuuauuucacuuuuuucacucugugaucuagccaaagauuuauuuuauuuauuauuauuuuuuauuugggcuaauuaaaaaaauuuuuuuuuguggagacagggucucgcuguguugcccaggcuggucucagacuccuagggcucaagcgauccuccugccuuggcauuccaaagugcugggauuacaggcgugagugacugcacccagcuagauuuuacuuuauuuuauuuuauuuuauuuuauuuuauuuuauuuauuuuuucgagacagagucuuacucuguugcccaggcuggagugcaguggcgcgaucucgacucacugcaaucucugccacuugagcucaagcuguucuccugccucagccucccgaguagcugggauuacaggugcccaccaucgcgcccagcuaauuuuuguaguuuuagcagagacgggguuucgccaugcuggccacgcuggucucaaacuccugaccucaggcaauccacccaccucagccucccaaagugcuaggauuaugggugugagucaccaagcccggccuaguuuugauuuuagaaacagagucuggcucuggaggcuggagugcagugguguaguucacuauaaucuugaacuccugcucaagcaguguuccugcuucaucuuccucaguagcugguauuauagguguguacaaccaggccuggcuaauuuuuaaauuuuguaaagaugggucuagcuguguugcacaugcuggucucaaacuccuggccucaagacaucccugcccugccucucgccuuggccuccuaaagugaugggauuacaggcgugggccaccaugcccagccugaaucuuuuuuuuuuuuuuuuuuuggagauauagauauguaaauauuuuaaacaagcaucuguagguuuuacuaauuuagaggcaacuagaauuaaguuaucaaaaaauacuuuauuuuuaagauuuuauagaacaaauuuaucaaaguggguuuauaaucaaauuugaacuuugacauuuaaaauaacauuuuuucaguaaaaaugauaauauuaauuaaagcuauaggaguaugaauucuaugaacaacauaaaagcauguuaaacauuuuauuuguuugaaauauuauuuauauuccugccacccaaagauugacaccauuaacauucuggcaucauuuugagauauuucuuaucuaguuuuacguagaggaugcuguugcaguauaaaaccuuuuauauucuggcucauaaaauguuaauauuuauauuuuguuuuuuacauggaacauuuuauuuucauuauuuacuuauuuauuuuuugagacagucuccucuugcucaggcuggagugcaguggcguaaucucgcugcaaccucugccucccggauucaagugauuuuccugccucagcugggauuacaggugcaugccaccucccguggcuaauuuuuauauuuuuaauagagaugggguuucaccauguuggccaggcuggucuugaacuccugaccucgggugauccacccaccugccccuuccaaagugcugggauuacaggcaugagccaccgugcccugccuauuucuauuuuuuuuaaaaagagacgcacuauguuaccaaggcugaucucuugagcuccugggcucaagcaauccuccugccucggccuccuaaaguuuugggauuacaagcaagagccacugugcuuguccuuuaaaauggaaaauuuaaguuuuuugcauggauauaugugauuccgaagucaaagcuguauaaaagguuauacacagagaaaucuuguuucuuccuugacccuguuccuucuguuucuuuccugcuuuuuauaacauuuuaaauuaauuuguuuagccuuaaguguuuuuuacagcaaauauauacauauguauucuuauuucucauucuuucuacugguuuaaaaaaaaaguuacuauguacauuguuuugugccuuugcuuuucauuuauccuggggauuuuuucacauucguauuuggauuuuuuuuucuuuaaaauaauuugguccaacuuuuuguuuaaaugcuucuuuucaaacuuuacaauuucauuaguauucuuuaauacuguguaacuuccucaugacacugcucaguuuuguuuaguuuuuggaguaguuaccauaugcuaggcaucauggauauaaggauaaauaggucauagccucuuccucuggggaccagaagucuaagugggguauagauagacagugaauaaauaauuuaguaaaugauaugauaagugaaagagguaaacaaagacguguucugggauugaggaagagguuuaacugguccauugaagcaugggguagggauuguggagacuuucuggaguagguaauuucacagcugaauuauuucugaggaaguauguagcuguaagucauccagguaagugggaaaauagcgguccaggggagggaauaguucgaaaggugagaagagaggaagagcccaacugcauuuuguacuccagggaguuuuaagcauuuguugagaguucaagacaauauacugguaaaacuugccuucacauaccuuuguaaacacagcuuugugcuucaugaacuaucuucuuuagauaucucuagucauacgcaauuacuuugguuaauguucuuccuugacagguaccgauuauuccuacuaucaugcaauauuggaggcugcauuucaguuucugucaccccuccagcagaauuuguuuaaauuuugucugucccuucguucuuacucagcuacaauccaagccuuccagcagguggguccagugcucuuaaagaacagcauuuuagaguguauaucaugaugaauggauggaccccaguuguccuggaauugaauuacagagcuauuaucacuuuuuugccugaaauuuucuaggauuuaugauuuuuaaaaaaaauaauaagcaaaauugauguuaagucuucaacccacagauuuaaaaaaauaaaagaauaucuauauagaaaaaagacagcaauauuuuauuuaugcauugcagccugggagauguaaucuuguuaaaccaaugagccagcaucuaauuacagccuguaguucuaaaagcaguucacaggaaauacaggaggcaagaaauguuuagcaucaccacagggaugcagucaggaaaaucuagaauucaggaaucguuguaguaaaguaaucuaguuucuucaguacauaaauuauggaaauuucuauuguaauugaaaagaaaaagagggacagaggaaccucaaguuaagagagacuuaagaagagacagucaaagaugucuucaccaacuugauauuugauauaaaagcaaugcuaauuuuaaaauuauuuuuuauuauaaaauaaaacauggaaaaacuccucacaaaaaauauauaguaauggacuauuauaaugugaacauccuuguaauuuucacccaagucaagaagcaggacuuagucuggcaccauggaaagcccuccguguacuuuguccugauuguggccaccuuucaccccugaaaccaaccacccuguuaauuucuguuggaaucacuugcuuguuacuguauuguauugcccaaagguacaucuucacacaauaaagugauuuuuuuuuucauuuuucuuuauuuugugacacagucucgcccugucacccaggcuggagugcaguggcgcaaucacagcucacugcaaccuccaccuccuggguuuaagugauucuccuaccugagcugggguagccugcuaccacacccagcuaauuuuuguauuuuuaguagagacaggauuucgccguguuggcuaggcuggucucgaucuccugaccacaggagaucugccugccucugccccgcaaauugcugggauuacaggcaugagccacuguggcuggccuguuuuugcauuuauugauuuuguuuuuuugagacagggucuuguucuguugcccaggcuggaguguaguucugugauuacggaucacugcagccucaacuuuucaggcucaagcaauccuccuaccucagccuccuuaguagcugggacuacaggcguaugccacugugccuaauuuuuuauuuuuuuuauuuuuuguagagauggggucucacuaugcugcccaggcuuaaguggcaggcuuaacugcccaggcuugggcuuaagugaugcucccacucuggucucccaaagugcugggauuacaggcacgagcuaccacacucagccaguuucaacaauguuguuuugucauaauuuaaucaccuauuuugauuauacaugucuuuaucucgucuuugguuagaaauuuaaaaaguauguguugugucuuaugugacagauagcagcugaugaaccuccaccagaaggauguaauucguuuuuuucagugcauggaaagaagacuugugaaucugauacccuugaggcucuucuacugacagccucugaaagguagauuauguguuucuuuauuuucaugucaugcauuuccagugcugcuucugcauuuggucuaccuucugauuuucucaucuguuuuguaucauuagguguaaugguuuagaguauggcuucuggaaccagacugacuauauuugaaucucagcuccgucacuuaaaauaguuuugugaaauguggcaaauuacuuucuuuccuaaucucauuucaaaauggagaugauacaaguauuuaguauuaacuguuacuguuuaguaaugacugcaucugagcaaugacauagauuuugucauuggcuuaguaaggaauacuguguguauuaaagccaaugccugaaauaaugauauuaaugauaauaucucucaggauauuauuaguuucagacaaaggaggauauuugaaagauaauugcaggcuugauuugaauauuaauuugguaacuaauguaccagcuuuuugcccaaagguggguuuccugugguagacaacucugcuauguaucauuuugcugacuggcuagggcagcaagcccucuguaccuccucuaaugcuguucauaaacagaaccgugaucucuccgugggguuggccggcccucucaguacugcuaauggcaguuaggugguguaggucuucuuuagugagauuggcuccccagcacccauccucugcccaccaaauggcauuagugcuucuuacucagagugccgaccaaaaaacagcgugcguuccagccaucuccgggucaaggcauggacauucagaaauggcugcauggugauacaguagugcugucucuugggggaaacaaaauugauggcuuuguaauucuuuuaaaaaacuuuaauuugcuacaacaauaaugcacaccuuuaugaagaaaagaacaacggugucuccucucucugagaggcgguaacugcuuuuaaugguuuggcauauauaccuucagacuuuuuucuaugguuuuaaauuuauacauguagguaguuuuauuuuuauaaaagguaucuuucaauuuaguacaaguggguauaccucguuauuuuuaacacaugcauaaccuagguaagacugucccguaauugguaauuuaccucuuaccgauggauuuuuaagucauuuccuccuguuacaauaaggcuauauggagcaucuguauucaugucuuuacuuucugcugaguuguauaguuuauuauaauagagacugguaggucauaaagucugugcauuaagaucuguuaauaucuugaugccauccuuagauaaguuuuuuugggagaaguuuuaaaguuuaugaggaaaacugaaauguuaaguccauugggggcacaagccuguagucccagcacuuuggcaggcugaggcaggaggaucacuugaucccaggaauuccagaccaaccggugcaacaaagugagacccaguuucuccaaaaaguagcugggugugguggcaguaaccacgcacacgccuuuggucccagcuacucgggaggcuguggugggaggaucacuuuagcccaggagguagagacugcagugagcccuguucaugccacugcacucuaccuugggcaacagagugagacccugacuccaaaacaaaaacagaaacaaaaacguccauuaggaagaucauaguaguaaaaauaguagaggagauagacuuaguagaauuggcaaguaauaugcugaaugucauccugugcuuuuugcauuauuuauacuuauauuuuuauuuauuuauuuauuauuuauuuauuuuugagacggagucucgcucugucgcccaggcuggagugcaguggugccaucuuggcucacugcaagcuccgccucccagguucaugccauucuccugccucagccucccaaguacaggcacccaccaccaugcccggcuaguuuuuuguauuuuuaguagagacgggguuucacuguguuagccaggauagucuugaucuccugaccucgugauccgcccgccucggccucccaaagugcugggauuacaggcgugagccaccacgaccggccuauacuuauauuuuuaaauaaaaagcuaaucauauucuauuuauaugguagaaaaauauacuuggccagccgugguggcuuacgccuguaaucccagaacuuugggaggcugagguggguggaucgcuugagucaggaguuugagaccagccugggcaacaugacaaaacccaugucuacaaaauauacaaaauuuaguugggcaugaugucgugcaccuguagucccuccuugagcucuggaggucgaggcugcagugagcugagcgaucacgcgacugugcucuagccuaagugacagacugaggacuucucaaaauauaacauaauauaacauauuauauuggccaggccugguggcuuuugccuguaaugccagcacuuugggaagcugagguggguggaucaccugaggucaggaguuugagaccagccuggccaacaugaugaaacacugucucuacuaaaaauacaaaaauuagccggguguggugguggaugccuguaaucccagcuacugaggaggcugaggcaggagaaucacuugaacccaggagggagaguugcagugagcugagaccaugucauugcacuccagccugagcaacaggaaugaaacuccaucuccaaaaaaaaaaaaaccccccaaaaaauacuauguuauauauauauauauauauuacauacauacauacucaaguuuuaguagucauuugaauauguauccuguuuuggcccuuuuccuccccuuuuaggaauugguagcuguuauuaauugagauuuauuuuauucguuuuuuuuuuuuugagacagggucccguucugucacccaggguggaguccaguggaaugaucauggaucacugcacccucgaccucuggggcucaggugauccucucaccuuagccucccaaguagcuaggacuacaggugcaugccaccauacccagcuaauuuucguuauuuauuguagagucgagguuuugcuauguugcccaggcuuugucuuaguuaugauuacaggcaucaugcacuggaccugccaguguuuacauuuuauaguuaguauuuuuuauaauguacuuuuguuauuuuuaaucaugaauaaauaagacucauaccugauaguaaucuuaguaagugaaaaauauuuaagaucaugcuacccuucauauuaagaugcuuauaaucuuuauuugaauuuucauaacuguacuuuauauuuugugacauuuuuaguguuucacaauuauuuuuaaaguuuugagcuuuuauuauuuauuuucagacccaaaccuuuauuguucaaaggagaucacagauaucccucgucuaauccugaaagcccuguggugauuuucuacucugagauuggcucugaggaauuuuccaauuuucaccgccagcuuauaucaaaaagcaaugcaggcaaaaucaauuauguauucagacauuauauauuuguaaguauugacuuauuuuacaccuguuuugaauguaauuugccuagcaugacuuuagaacauaagcuaauaaucucccucuuuauaaaaaaaucuaguuauuugaaucccuuuuuugacaaauccaguaguuucauugagucuauuauuugcacauaugaugugcuuugcuuggcuuucugaagaaauauaaaacaugcuaaaaaaguagcucgauaaaguuuacauuuuauuucaaaaugaaccauguaaauaaucuuuucugauuuuaauauggucaucauacuauggaacugauuguugaauucaguuuccuuuccaaccuuuuuucuucuguuuucucuuugccaccuuuuuauuugguggaagggggaggauuuucuaaacaggcgauucauagguagacuugauguaauauuaagcuuuuaagacucuguguaggccgggcgcgguggcucacgccuguaaucccagcacuuugggaggccgaggcgggcggaucacgaggucaggagaucgagaccauccuggcuaacacagugaaaccccgucucuacuaaaaaauacaaaaaauuagccgggcgugguggcgggcgccuguagucccagcuacgcgggaggcugaggcaggagaauggcgugaacccgggaggcggagcuugcagugagccgagaucgcgccacugcacuccagccugggcgacagagcgagacuccgucucaaaaaaaaaaaaaaaaagacucuguguaauauuuagucauuuaaaauauuuauauguaaagguuguuagcccuuuaaaguuucuaugucauaauaagcucaguacuaaguucaugcaaaaaaaauaaaauuuuauuuauugauuuauuuauuuuugagacagagucucgcucugucgcccaggcuggagcacaguggcgcgauuucagcucacugcaaccuccgccuccugaguucaagugacucuccugccucagccucccgaguagcugggauuacaggcacucaccaucaugccggcuaauuuuuuguauuuuuaguagagaggggguuucaccauguuggccaggcuggucucaaauuccugaccucaggugaucugaccgccucagccucccaaagugcugggauuacaggcgugagucacugugcuuggccauaaaauuuuaaaugaaaauuuguacaagcagaaaguuuuauugaaguccaguuuuugauucucccucugcccccuucauugcuguuaggauggauguuaaugucugaagggccaucuucagucaggaugcuggugagccugugacaucuggucacuccaagcuccgcucgaaggcauuuaaauuuaauaaaaagcauacucccaugggccucaaaaaacaccucugggacugagaccucaccagcuuucaacccugcucuguagguucuggaacuucuuuuucucuuucuccauuucuuaugguugggaccauagcacuuucagcuguccauucaucugguuuugcuucuaccuuggaauuccauucccacaguuguggcagccuacaacauguaaaggagccuaggauuuuauaaggagagaauauagacucuggauugauuuuuaaaacauauaaucaauauuuuaaugguagauacgugcuuuuauuacucuugaguuuuugguagguuuuggacuaaaaaaauuuguuuagugaacuuucuuagccauauaguuaauaucguuaaaaaacaauuuaaagauauuuugagggcauaauccgagguaauggcuaguagaugcaacauuaacauggucaugccauguacacugugacauagaaagagcuaggugguaaugauggaauucuugcuuuacuugcagaaucccaggaaggagccuguuuaccucucuggcuauggcguggaauuggccauuaagagcacugaguacaaggccaaggaugauacucaggugaaaggugaauuuguaaaaaugggaccagugugcuuucuucaaauaugaguuaaaggggaguuuguuuccauaugaaaaauaauagauuuagguguaugcugaaccuguguuugcauccugguucuguuacaccugagugggugacccuuaagcagauucucuagaucccaguuuucucuuguguaaaguacagguaaugauacaugucucuuccaguauuggggaggaauaaauaagguguguaaggaaagaauuuuuucauguacuaaaaaaaaaaaaaaaaaaaaaacaaaaacccucaaaaaaagaaccuggcacagugguuugcccaaaaacguucagcaaguaguagcuauuguuguugauguuauaggggauuuacaaauagccauuuauuugugacuccaacgugaaaucuuaaaguauccuauauuuaacaaacaauuuuauguuguuuauuauuucuguacauggaacaguuuacuguggauacuuucuguuguaauacucuaggguuuugaauuuauuauuuuaucuacaaguuuuaaaugcuauuuuuucauuucuuuuaugcuuauuuuaaagauaaaaaaucaauuugaguaguaaagcagauggaaaauaaacuacuaccucauucuauuuucuucaauaauuguauuaggauuaaguugacuaauuauaaauucuucagaauuuuaauauugaaaaauucuuuguucauaguguuugacuauuaauuucauaauuguccauaauguuuaaauguauuaauuuugaaguuuuuagcauguaaaauuuuccaaaguuuaaggaaaaaugcauucuuuauccaggaacacaggagauauuaaaaugcauuuauccuguuuguuuaaagaaccauugccaaaggguaauugugauagucagcauuuuaaaugguauaauuucagggguuucugauuuuuuucacauuauucaauuuuaugaaguuuaugagacuaguaacguuuuuguuucaaaucugagcaauuauuaauaauauguauuuucuauucuuucauaggaacugagguaaacaccacagugauuggugaaaaugauccuauugaugagguucagggguuccucuuuggaaaauuaagguauguauguucuguguauuuugggaaacgcccucauuuucuuuaagccuccaggcuuucuugcauuuuaagcaucaucuuacucauuacugucugaguuucucaucuccuaacaguacuuuauguaugcaauccuacguggagagucaaccacuuaguuuauaguacaguuuaugauuucacauuauucuuuuuuuuuuggagacagggucucgcugugucgcccagguuggugcaguggcgugaucucgacucacugcaaccuccacuuuccacguucaagugauuauucugucucagccucccaaguagcugggauuacaggcaugcaccaccacacccggcuaauuuuuguaucuuuagcagagaugguguuucgccacguuggcuaggcuggucucaaacuccuggccucaagugauccacucgccucagccucccaaagugcugggauuacaggcaugagccacugcguccagccugaagcacauuauucuuaauugauaguauggcuaccugcccacaguuuaagugcguuuuucuugccucucaguugauggcauuaaguuacauaccauuuuuugauugccauaagaggagaaauugaauuguuucacuuaauauuuucccaggaaaaaauguauuuaaaaguuuuuuucaaacauagucugagcaaaaaugcgaaauagauauaguaaauuuuauacaugcucaaugggaaaaacauuuuauuauuauuuuuuauuuauuuauuuauuuuuuuugagacagagucuugcucuuuugcccaggcuggagugcaguggugcaaucucaguucacugcaaccuccgucuccuggguucaagugauucuccugccucagcccccugaguagcuaggauuacaggcacccaucaccaugccuggcuaacuuuuguauuuuuaguagagacgggguuucaccauguuggccaggcuggucuugaacuccuggccucaaguggucugccugcuucgcucucccagagugcugggaauacaggcgugagccauggcccccagcucagaaaaaacauuuuauuagaauuugcuuuaugugaaaggaaaugguauuuuaaaaaauuccauaauuauguaaucauuuaaugaaagcaucaucauaaccuguuaauguaagcaucauaguauuuuauagcuggaaagucuucuuaacuguuauucuuuuuuuuuuuuuuugagacggagucuugcucuguugccuaggcuggagugcagugccacgaucuuggcucacugcaagcuccgccuccuggguucacgcuauucuccugccuuagccucccaaguaguuggaacuacaggcauccgccaccacacccggcuaauuuuuuguauuuuuuuuuuuaguagagaugggguuucacuguguuagccaggaugaucuugaucuccugaccuccugguccgcccgccuuggccucccaaagugcugggauuacaggugugagccaccgugccuggccuggaacgucuucuuagcuguuauucuaaaaguugaaguuauuucccucauggcuugauaauuguuuagagcccugaauucugcuuuaucuggcaguuuuuauuaggacauuuugugugugugugugugucugugugugugugugugagagagagagagagagagagagggaaagagagagaaagugaucaaauagaaauaguauaugcuagacucaguuuuauauacuucagcuuugagauuuggccaagugaaauaaccagauuaacaauuuagaagagauaucuuaguuuacauugaauuacauguugaguucauccuacauguauauacauuucuucucguuuaacaucaguuuugaccuuguuagaauguaaucauauucuauuuuuauuugacucaggcuuucagaauccuuuucuaaaaaaauuuuuucgagacagggcuuugcucugucacucagacuggagagcaguggcacaaucacggcucacugcagccuugacuuccugggcucaagggauccuccuaccucacccucucgaauagcugggacuacaguugugugccaccaugccuggcuaauuuucaaauguuuuguagagauagagucuugcuauauugccuaggcuggucuugaacuuuggguucaagugauuguccugccuuggcuucccaaaguguuagaauuacaggugugagcuaccacucccagcuucagaaucuuuuuucacauuugugguguuuauguuuauuuuuuggguagcaugaugauuuuaugcauucacagcacaaagguauuaucaagaauauugaggcuguuuuaccuuuuggacauucagaauaguuauuuagcuauccaaaguaauuagaccuuuuuuuuuuguuugagacaggcucagucugucaccaaggcuggagugcaguggcgccaucauggccugcugcagccuccaccucccgaggcucaggugauccucucacuucaguuuuuguauuugugguagagaugggguuuugccauguugcccaggcuggucuugaacuccugggcucaagggaucugcccaccuuggccucccaaagugcuaggauuacaggugugagccaccgcgccuggccucauuuuugguauuuaagaguuuguauagguugagugucuuuuuucugaaaugcuuaaacuagaacuagagugucagauuucaauuuuggaauauuugcaugauacuuaccaguugggcaccccaagucugaaaaucugaaaccugaaaugcuucaaugaacauuuacuuugaugucauguugacauuuaaugaguuuuggauuuuggagcauuuuggauuucagaauuucggauuugggaugcucaggcuguaguaacugacaggaaguggguugguuggacagugaacagucugagggaauuuuaauuucuguauguuguauuaagaaauuuugaguuagccgggcgcgguagcucacgccuguaaucccagcacuuugggaggcugaggcgggcggaucacgaggucaggaguucacgccauugcacuccagccugggcaacaagagugaaacucugucucaaagaaaaaaaaaaagaaauuuugaguuuauggcauuuaaaagaaaaaaguaauguacuagccgucugucugauguaaauguuauaucucugccccagaucaccucugcuuuacuauaguggaauaugcuauauuuaaagauaaaacccaguaacuaugguuagccuaaauuguauucauguuacuaagagauuuaugagcauguaggcuaaaggaaacucauuuugggacuggcagcaguuuuuuucccuucaguuuuacuuugagaaauuacagugauucacaaaagcauagagaaaaauuuauucccacauacuuacaacccagaauagauugcuguugucauacuugcuuuucucuucuauagaacuauuuauuaagcuuucuuuuuuucccaguauaagccuuuuuuuacuuuaagaacaaaggaaaacaaacaaaaaauaaaacaggucaguaaacacugcagguauagccgaagucuccuuuguuccuuucuuucuuucuuuuuuucuuuuuuuuuuuaagagacaaggucuugcuguguugcacaggcugaccuggaacuccugggcucaagugauccuccugccuuggccuccucaguggcugggauuacaggcgugagccaccacaccuggccugaaaagucuccuuuguuaaccacucucagucuccuuaucuaccucauagggaaucacuauucuagcaauuuuucuauaaauuuuaugaguuuuaaacuagcuucuaauuuucuauuuuuuuuaaagaggaauaauuauacuucauuuuuucccccuaugucguagaaaauuuccuaggguugggagaggaaaaccaugaagauaaaguugguuuacuucuucuuaugcuccgggaaagaaaaaauaaugaaaaggacugauuuuuauguuucuuuuagagaucugcaccccgaccuggagggacaguugaaagaacucagaaagcaucuuguagagagcaccaaugaaauggcaccuuuaaagguuuggcaguugcaagguaaugaaaacagggagaggucauuggccuacuuuuuggcuaaguuuuauggcuuuaaaaaaugcaaaauuugaauuuaauuguauguaguacgugauucugaaggugccucagauuuuaaagauaagagugauuaauuacgauuaaucagggaagaaaggaaguccuuuuguaaacagauaacacuagguagaaguaauauauauaaacaaauggcaagucuuucugugugaccauacauaaacuuguaauacgagaagcaggucauaguccuaaguuccuauauauauacauuucuucaacuguuuaucuauagaguguuuaagacaugucauuguggcaggauguauguguuuuucucuguuccaaagaacuauuuuucaaguuuuuuuccccaacgucauuuacuaaaagucuucaugcuguauuuugugauguauuguaaauuuagaaaagggaaaaggacuugggccugauuuagccugugcuacaugcguuaguguagcguuagugugugcccuaguguuuucugcagauauaucagaaacggcucaacugaauacuccagagaucuuugaagugaauaaaaccugaaauuaaaucaugggcacucucuggaaugguugcauucgaagauauucuuaauuaccaugaaaagagugggaaguaaauuuggauuuuguuuucugcuucucauugcauuagauuaauccacuuuuaauuauauuugacauuguugcagaucucaguuuccagacugcugcucgaaucuuggcuucuccuguugaguuggcuuugguugucaugaaggaucuuagucagaauuuuccuaccaaagccagguaauguagaauaaugcucuucuccuuaacaucauacccagucaucgucauguucacuugccaaaugagguaauaacaauaugaaaauuccuagaaaauuaagauucuuuuuuuuuuuuuuuuugagauggagucucacucuuguugccgaggcuagagugcaguggugcaaucucggcuuaccacaaccuccgccucccagguucaagcgauucuccugccucagccucccaaguagcugguacuacagacgugcgucaccaugcccagcuaaguuuuuguauuuuuaguagagacaggguuucacuguguuggccaggcuagucuugaaugccugaccucaagugaucugcccgccuuggccucccaaagugcugagauuacaggcgugagccaccacgccuggcgaaaauuaagauucuuuaugaccaccaccacuacuauugcagauggugcucugugucuugaagauggcaagaccaugcauugugugguugaagugacagauuuagguuauguucuuagcacuuccacuuauuaguugugugaccuuugcaaauaaacaaccucaguuuccucagcaguggaacgagaauuaaaauaccugccuuucaggauuggaugagucuugcucauauaacuaacuaaucuagagucugucccagaccauagugguuuucuucaugaaagguuuuacauaugucaucuuauugaaucuugaagaaacugagucauagaggcuaagugacuaguucauagugacagaauaagauuuuguuuggaccgggcuugguggcucaugccuguaaucccagcacuuugggaggccaaggccuggcuaauuuuuguauuuuuaguagagacaggguuuugccauguugaucagacuggucuggaacuccugaccucaggugauccacccgccuugucuggugcucaaaagggggaagugggccaggcaugguggcucacaccuguaauaccagcacuuugggacgacaagguggguggaucacuugaggucaggaguuccagaccagccuggccaacauggugaaaccgcuuuucuacugaauauacaaaaaauuagcugggcgugguggcaggggucuguaaucccaguuacucgggagucugaugcaggagaaucgcuugaacccgggaggugaagguuacagugagccaagaucaugccauugcacuccagccugagcaacaagaacgaaacuccgucuaaaaaaaaaaaaaaagauuuuguuuguacguuuucugacauugccuucaauucuguaauauugcugcacaucucauaaaugcaaggcaaaauuguuuuaaaagccacauuuuuagaaacuauugacuugaaugguucccagucauuuucuugagucacugaaugaaguguuuugacuucugaugugagauauuuuauaacuaaguuuguuuauuugggacuuagacaucauguagugaauucucauuuaguccagcugcuacuugaagguauacaugaaugauuccaccuccaccauaagugcuuaagugggaagagcaaucugcugccuugguguauucaacauuauccuuuuagccugagaguaguagagaucauauauagaaauggggugcauauguuuuaagaacuuggaaacaacugcaccuguuuuauaaugcuauagcugcuacauuucuuugauuuuguaucuuacaaaaaauauacacaucugagaaaggagaaauauauuuaucaauuauaaaaauuuaagguuuuucccauucaguuuuuucuaauuuauugaauaauguguuucauauuuuaaaauauggaaauugaagacuuuauaucaaauauuaagccaagcacucauaauguuuuuauuuccuuagagcaauaacaaaaacagcugugagcucagaacuuagaaccgaaguggaagagaaucagaagguauucaccgauagaaaauacugaccuguuuuguauucuaucuuuaaagauaaggaaaucugaguuuaaucagcagcauuuaacagugucacucuucuuuuaucuaagauggugauuuuuucauuucugugaucuuugcauuuuuaguuuuuaaugaaaguucaguaugcacauaacugaaagcaugaaguggugcuaccguguuguuuaggaaagcagcaccccuaacaugucucaccccguuccugaagacauucacuuucgacauuuagcugauucuucugauauuucucuccagaauucuagcuuacauugguacuuuauuuuucacguucagacauuauauauuggccuccuauuuaaacagugugguuuaacuuucuuucacugccucccccucagugucccaccacuauucuauauuggcacuguuccugucuauccaucuucucaauauuggauguugugguuuuaccugguuuugauguggucugagauggacugguugcucuuuaugcccagggcaugccggucauccugagaccuuccuuuaaccuccuuuguuggauccucuguugcuugauuccaugucuuuuguguuuuugguuuauuuccuuguuuugguacagcucaucauucuuugugagaaaaguugccugggaggcaaauuugaaauucugagaaaucaacuuucuacuuguuuuuguuuuuguuuuggagauggaguuuugcucugucacccaggcuggagugcaguggcgugaucucagcucacugcaagcuccgccuuccagguucacgccauucuucuuccucagccucccaaguagcugggaccacaggcgccugcuaccacucccggcuaauuuuuuuguauuuuuaguagagacgggguuucaccguguuagccaggauagucucgaucuccugaccucaugauccacccgccucggccucccaaagugcugggauuacaggcaugagccaccgcgcccagccaacuuucuacuuguuuuuauugauagcucguuauacaauauuggcagguuauacaauuuuagguuggaagucauuucaaaauuugaaacaaggcaucgccucuuggaauuuuaguuuccauuguggcuguugagaaaucugaagccuuuguaugagaucucuuaaggaucuuuucuuugacucuagcuaucugaaauuucauaauuauguguguuuuuaaaaaaaucucuguacuguuaggugguucgugggcccuuaaaaucuugaaaaucauuuccuuuagcuuugggaaauuuucuuaaauucuuuguuuguguuucuucucucugguuucucuuuccucuuuuccuagaaauauguauuuauuuauuuuuuaaauguugcaccucugacuaguuuggccuuuuaaaagucucuucuuuccuauucuuuucucuuuuucaaaaaaaaaaaacacuuucugguaagaguuuuuaaccuguguguaucuuuuuuccuuuaguugucaaauauuuaauuuucagggguuuuuuuuguucuuuuuaugguguucccguguaucucugaagauaauggugcuuguguuuucugucugcaaagucuguuuccucuuaagcugcguuuuuggguuuuggucuuuucagugguggaggccuuccuuaggugucuggugaucacacucagagugaggcacuaaggaccugguuggaaguccuaaugauguggcuuugugacuguaagguguucuguugugaccauuuccuagggaaccccaguuacaguaucuuuguuccuuuucuuuuggguuggucaguccuugucagucuccagaaaaggauccgucagucuucuggcuggugggugaaaucuguuugcuagagcuguagaagcacaguagggaagagcguuuggugacuugccuucgauuccccauuauguguguggggucccuguccuccuugugcuugauuugccauuguccacagauguucuguuuuguucuuuuccagggaaugagccuucauuuugcuggaguaggggguagcaccgaccucaggcaccuggcugugggaaaucaguuggggggcugggggguuuugucuuaaagggcuuuauaucagaacuuagcuaauaaucaccccuuguacauguccugugugcugccaguuccugagccuuuggugaguuccacagggugacacagguuucuuguugaccuuuccuguuguuggucuaacauucagcuuucucagggcuguugggacagugacuccucacccaccucucuuccagcuuccaaaauuugguggccuuuuucuuuccuguucucuuugucuuuguggauuuauaacugaaaaaguagcucuagugacauuucaguagaauucaggagggaaaaauguucuuauguucaauucacuaucuuuaccccaaauuuccuuaaucuuuauaucugagauauuagugaauuaaguacaucugagggauaaauaaauguuucucaaauguuuacuaaauugaaaaaccuuauugggaguuuuuauuuacuuuuuaguuuccaaaguaaaaauaucaaauauuaucuuaaauuuagggccuuuuuccccacuaaggaagacaaaauuauacuauauugcuguuucauggagucuuaauuuuuuuugaguaaaacauuuuauuaaagcauaaauauauacuuuuuuuuuuuuuuuuuugagauagagucuugcugugucgcccaggcuggagugcaguggcaugaucucagcucacuguaaccuucgccucccgguucaagugauucuccugccucagccucccgaguagcugggacuacaggcgcgugccaccacgcccagcuaauuuuuuuauauuuuuaguagagacgggguuucaccauguuggccaggaugaucucgaucuccugaccucaugaucugccugccuuggccucccaaaguggugggauuacaggcaugaaccaucaugcuugaccaaaauguauuuuuuuuuugagacagagucuugcucuguugcccaggcugaaugcaguggcaugaucuaggcucauggcaaccucugccucccagguacaagcaguuauccugccucagccuccuaaguagcuagaauuacagguaccugccaccacgcccagcuaauuuuuuguaauuuuaguagagaugggguuucaccauguuggucaggcuggucucaaacuccugaccucagguaauccacccgccucggccucucaaagugcugggauuacaggcaugagccacugugcccugcccaaaauguauauaugaaacacaaagagggaagcacacaaauucucagucauucguuugaugaacuuucccaaaaugaacccaucuauauuaccaguguccagaccuagaaauagauaugcuauucaccagcucagggucagucuuuuuuuuuuuuuuuuuugagacagucuugcucugucguucaagcuggagugcaguggugcuaucucggcucacugcagccucuaccuccuggguucgagcgguucuugugccucagccuccuaggcagcugggacuauaggaguacaccaccauagcugguuaauuuuuguauuuuuaauagagacgggguuuugccacguuguccaggcuggucuccaacuccuggccucaagugauccaccugccuuggccuccccaagugcugagauuacaggugugagccucugugccuggccuggaucagccuuuuuuuaucgucugauggugcugugcacucagccagcgagugaguagaugugaauuccucucucucggaagaaauuccaguucacaauugauacaccuuuccaugaucuccuuauuuuuuucucuucuuuuuaaaaucgagaaguaaaaauugcauauuuuugugguguacaacauguuucgaaauguguauacacugugguauuauccccugucuuacuugccauugaaucccaacagcaucuugaagcaaaucuuagcccugccuuaggaugccaagauuuguacagguagugaagcccagaaacaauaaaauuuuuuuuaaaacauucucucacagcucccuaauaauuauuaaaauuuuucaguauuucaagggaacuuuaggauuacaaccuggagauucagcccucuucaucaauggacuucacauggauuuagauacacaggauauauucagguauggauaauauuuuucauucucugaaaaguuuuuguaaugcguagcaccuuguaacauguucauauugccguuccuucuugauauggcaugaugcaaagucugauggcuuaccagcccccacuggguggacguagguaguaggcacaugccaugauggguaggcaggaugacauaucuccaucuuguguuacaguguguguucaaggccugaguguuuucugaggcuguccuuuuagaagcuauacuuuuccacuuaaccaugggaacauagaaaagaacagguucuuuggcuuuuggaacagugugaaguagauuuauuaaaaauaacugccucugggccuggcacgguggcucaugccugaaaucccagcacuuugggaggcugaggccggcggaucacuugaggucaggaguucaagaccagccuggccaacauggugaaaccccaucucugcuaaaaauacaaaaauuagccaugccuaguaguguguaucuguaguaccaacuacuuggaaggcugaggcaggaggaucacuugaaccugggaggcggagguugcagugagcugagauugcaccccugcacuccagccugggcaacagagugagaauccaucucaaaaaacaaaaaacaaaaaaaaacugucucuugugucucagaagguguucugucuacauauauuauuugaauauccacuuuuugguaaaaugugguucaguauuaaauugcauucgauugucuucaugauuuugggguggguagcagacaggcacaauucagacuuuauucauuuguuguuuugagauggagucucaaaagaaauuuuuuuaaucacaucuuauuucuccuuccuuucuaucuuuuuuuuuuuuuggagacggagucucacucuguugcccaggcuggaguccaguggcauggucuuggcucacugcaaccucugccucccggguucaagagauucuccugccucacccuucugaguagcugggauuacaggcaccugccaccaugcccagcuauuuuuuuuguauuuuuaguggagaugggguuucaccauguuggccaggcuggucucgaacuacugaccuugugauccgcccgccuuggccucccaaagugcugggauuacaggcaugagccaccgcgcccagcccuucaucucuaucucuucugucucucccagcaaaccucuaaguuggguguggauucuuucaggcuuuuuucuguggucauauguuugccucugugaauugguacugacauugaaacauauauuaagcauauauaauguaguaucucuuuuuaaucuuuauuuugagauaauuguaaauacauaugcaguuauaagaaagaauacagagagauuaauguacuguuuuuaaaaucaugugguguaaaaguauagauuuaggguuauuuuauccucaauuuguguguuuauugcuuuuuuaaauuucucaauuaauuugauuuggcauugagguugaacugauacauuuuuuuucauggugagaauuuuuuuuaaaagcuuuuuuuccuaguaaauaucucuuuuuguuuuuccccccagucuguuugauguguugaggaaugaagcucggguaauggagggucugcauagauugggaauagaaggccuuucucugcauaauguuuugaagcugaacauccagcccucugaggcagacuaugccguagacauccggaguccugcuauuucagugaguauuuuguuagggugaucaaaggacuuucugaccaggaaucuuuuuuaugguuucugauuugucucuuaugagggugaaguuacucccaccaucucuuuuguuggugugaaagauuuauaauugcuuauaugggacuuuguguauguaauaaaguaggcccuuaaaugcuucaaaaaguugaguuauuguugcuaaugugguuaagacagugauuuuuuuuuuuuuuuuuucaagacagagucuugcucuguuguccaggcuggagugcaguggcgcgaucuuggcuuacugcaaccucugccucccagguucaagcaauucuccugccucagccucccgaguagcuggcauuacaggagccugccaccacgccugacuaauuuuuguauuuuuaguauagacgggguuucacaauauuggucaggcuggucucaaacuccugaccucaggugauacacccaccucugccucccaaagugcugcgauuauaggcgugaaccagugcgccuggccaagacagugauuuuuuucacuugagcaugccccugguauucagcugagcaucucuugggaaaaagcguuuaguuuguauuuucucaauugcauacagaucuugugugaugucgugacaucuguaaauuaaaacuacuauugaaaaugucacuuuuuagcuaagaaccuucuuuaguaggauuuugauauuugagauuugaaggauuuauauagacuuuugccugccauaugaucuuucugagccuuugucuugucaucugucagagaauguggggaauagggcugggcuugguggcucgugccuguaaucccagcacuuugggaggccaaggcggguggaucaccuaaggucaggagauugagaccagccuggccaacauggugaaaccccgucuguacucaaaauacaaaaauuagccgggugugguggcacacaccuccuaaucuuagcuauucgggaggcugaggcaggagaauugcuucaaccuggggguggagguuacagguagcugagaucacgccacugcgcuccagucugggugacagagcaagacuccgucacaaaaaaaaaaaaaaaaauagagaauguggggaauagugccaucuugggcaguugugguaaaaaauaaggugaguggagagcugaucuuauuuuuucuugguuucuguacugcauucauuuuagaaaaauuuuauuuaagagaaauaauguagaauguagauaaucauuacuugaauucauacuuggugauauaacuuauuuugaugaagacauuguuaaugucauuugcuuuucuguuaaaaguacuuauaaagaguaaaagauaauaacaucaacaugacauguuuaugcaaacauaaagggacuaacaaccauaggacccaucaucaugcuuacuaaauguuaacauuuaaucauuuugugucagauuuaacuguuuucuugggggaagaaacaguuuuaguugaagcccuucuuugucccuuaccaaccaccccucuccuuccugaaguucauaucuuuucucaaguuggugugcauucccuugucccuuauuuuauccuuuuauuuucuaucaaauauauuuuucuuucuuucuuuuguuuuuuuagagaugagucucacuauguugcccaggcuggacucaaauuccugcggucaagcaauccucuugcuucagcuuccugaauagcuggaaccauaggcaugcaccaccuuaccugacuccuauuuaauauucuaaaaauuugaggccaggcacaguggcucacgccuguaaucccagcacuuugggaggccgagguggguggaucauuugaggugaggaguucgcgaccagccugggcaacauggugaaaccccaucucuacuaaaaauacaaaaauuagcugggcguggugguacacaccuguaaucccagcuccuugggaggcugaggcaggagaauugcuugaauucgggaggcagagguugcagugagccgagaucaagccacuguacuccagccugggcgacagagugagacucuugucucaaaaaaaaaaaaaaaaaaaaaaaaaauugggauaauccagucaggcgcgguggcucacgccaguaaucccagcacuuugggaggccguggugggcggaucacuuuagcucaggaguuggagaccugccuggccaacauggugaaacccugcuggaaugcaggaaugcaaucauagcucaccacagccuuaaacuccuguguuugagagguccuccugccucagccuccugaacaauugcucuuuguggacaugaaguuguuucugauguuuugcuguuguaaacacuacuuuaauuaggcucuuuuuuccucucuuuuuguguauacaugugaauuuauuugggguagauaucuggaacuagaguauuguauuguguuguguuguguugcauuguguugcauugcguuguguugcauugcagucucgcucucuugccaggcugaagugcaguggugugaucucagcucacugcaacuuccgccucccagguucaaacgauucuccugccucagccucccgaguagcugggacuacaggcgcacaccaccaugcccagcuaauuuuuguauuuuuaauagagauggggcuuucaccauguuggccaggauggucucaaucucuugaucucaugaucugcccacuuuggccucccaaagugcugggauuacaggcgugagccaccacacccggcaguacugcauuuauuuuagaaaaauuaguacuaauauagucuucaacuuuauuagauccaguucucuaaaguguuuguccacauaccagcauugcaugagaguucucuuugcucuauaucuuuuccuauucuuggucuugacaaacuuucacuuuuucugucuagcgaguaugaaauuucauugaggucuuagcucauaguuccuagauuacaauugaggguguacacauuucuuauguuuauugcccauuuggguuuccgcuguuuauuuuucauauucuuuuuuuuuuuccgauuuuuuuuuacauuuucuuuuuuccuuuguucuuaaaaaguuuagggcugggugcuguggcucacaccuguaaucccagcacuuugggaggccgaggugggcggaucacuugaggucaggaguucaagaccagccuggccaacauggcgaaaccccaccucuacuaaaaguacaaaaauucacugggcguguuggugggugccuguaauuccagcuacucggggggcugaggcacgagaaucguuugaacccaggaggcagagguuucagugagccgagauugcuccacugcacuucagccucgucaauagagagacuucaucucaaaaacaaaaacaaacaaacaaaaaaaauuucgcuucuuucuuuuauuuuuaugucuucuucauucuugacgcuaguccuuuauuggguuuguagguuacaaaugucuucaucuauucuguggcuuaucuuuuagucacucauuuuuccacucgaucuuuguaucuuuuuuguuuguuuuuuugagauagggucuugcucuguuguucaggcuggagugcaguggcacaaucauggcucauugcagccucgaaccccuugggcucaggugaucaucccgccucagccuccugaguggcugggacagcagccaccaugccuggcuaauuuuuauauuuuuuugcagagaugggggucucauaauauugcccaggcuggucuugaacuccugggcucaagugauccuccugccuuguccuuccaaagugcuaggauuacagaugugagccacucacugcagccaaucuuuuuaucuuugaaaauggucuugucucacaugauucuucuuaaaauauuuuaaagucuuauugauauuauugcagguuuuacuaacugguuccuaaugugcauguauccuguuguguuauuuuuuguagugggucaacaaccuggagguugauagcagauauaauucguggccuucuaguuuacaagaguugcuucgacccaccuuuccugguguuauucggcagaucaggaaaaacuuacauaauaugguaaguaaaacuuauugucuggcugugaacucuguuucucccuugccuagucccucuuuuuuugucauguagaauggucacuucucaccuuuacuagcugcuuccucccccacccuucaccaaauacucuucccuguucacacuggaaaggcuuuguaguguacugaccacuuguggggcugugggauguaacaggagcauuacagccccccucagaguguggggaaaugcucauuuuuaacacgaagguuuagacuauuguuuuagucuuuuaauuuguuuuuaauuuuaaaacauuuuuaauuuuuuaauuuuuauuuuuucuaaucagcuuuuccagauugaauaaguuuccuuuucauacucuucacaccauucagugauguguuuguuuuuauuuuaagacuuuauauuuuuuagggcaguuuuaguuucauagcaauauuguuuuacuaguuuuaagauagcucuuuuuuuacaguauauuacagcauauugcuacuguuuuucuuuaauaucuuaaucccuaaaauucagcaguuuaauuuauucccuuaaauaugguuguuugccaacuccuacuuguuauuccuucuugcacugcuuuagagagagagagagagaggguucuucauuggcccacuuuuucccucucauuucuuucccuucccucacacagccgggaaagagauagugguaggguuagugccaagguuggccuccucagaacuugcagggaagauuacccucucuacuuuucuucuugucugucucuuuucuuccccccacucccgcagaaagagucuugcucuguugcccaggcuggagugcaguggcaggaucucggcucacugcaaccucugcccccugggguucaagugauucuccugccucaccucccaguagugggaauuacaggugcaugccaccacaccuggcugauuuuuguauuuuuaguagagacgggguuucacuacauuggcugggcugguuucaaacuccugaacucaggugauccaccugccuuggccucccaaagugcugggauuacaggugugagccaccaugccuggccacuuuucugucucuugaaaccacuucuuuccuuucuagucagaauuuaaaucucauucuguuuuaccacaugucugaacuuuauuaagcgagagaauacgucuaaguugcuuaacacguaauacguguuuauaugcuugccugacagcuguggcuguggucuaagaauuagguucuaagugaauucuuaauucagagauccucagaaaugaauauacaaaaaggcaggcuccauuuuuuaaggugagagaguugcuaaacuugguuuucauuugguguaguagaaaaagcggcaucaucacuuuggaguacaguucccuuguuaucagcguaaguccaugagaaaaucaccuagcccuucaguaccagguuuuuugaacauagagggagguagcugcuauguguguaauucaucuuuuaugugguucaagcguagcucgaaaaagguuggcuucauguacagugacucauaacauuuuucucggcccacagauacuugaauaaaugucauuucauguguucuuuucccuuucuucaacagguuuucauaguugauccugcacaugagaccacagcagaguugaugaacacagcugagauguuccuuaguaaucauauaccacuaagguaacacugguauugauuugaugauguaucuaauuuagcugagguuuuauuugucauuuuuaaaugcaagucuggugcuacugaguuguaggauaauuaauagugcacaucacuaauggcaauuuuaucuucuggucaguaugaagccagugucuuuugggacugagaauuugcuucucaaugaauagaagcuuaccaccaaugaauuaucaauaaauagcccauguaaaaauaguuucuggcugcagcuugcuucccaauggaagggaauuuuccuaggugaguguccacaucacaaaaccuauuuccacuuucagcagagauauagagcauugccaauaacuuguuagccugucaaggacuaaacauauacacagccuuuuguagaugcaaacaguaacaguuacuucacuuguguugccaaaccugccuacaggguacugaguggcuggauuuccacugucuuuuuaagaacaguuuuuuuuauuuuuuaaagguuuuacauauaaaugcuaagauauuuucaccuacauucuaaauaauucugguaauuuuacauguuggugaaauuuuaauucuuagaaaaugugaaaauaaagaagaaaauaacucuuuauucaauaaauauuacuguguguuccaugauuacuacugggcuaaaugcuguaaacauguaugccuuauucuaccuucuuggaaaagauccucuguauacuuucaaacccuuuagggagauauaugaucaacugcuagguuauguccuacugguuaguuauaagugcguuaggauuucagggaaacaaaaaaaaucauugagauauuugggaagccaaagguuuuuggagaaguuggauuucaaauaggcuuugaggaaaacagaggguucugauaguuggaaaugcagagauuuugaguuucaugacauuuuucauauaaagcaugaauacaucugguuagauggaagaaccuauuacuggaucacaaccagagcuauguuuugaucaaaagagaaauauaaggacacagaagaaguugggucgugguacacaguuggcacuaauacaauauuucuugaauugagggacgagaagagggcauguggucuucugauugcaaaggcaggugagaagaaggcacuugaacuccuaggcaacugagagauugugaauaguuggagagagccaggcauacaggcugcucuuuccuucuuuguaggagcucaugugguccugcauguuggcugcuaaauauugauacauuauuauuaacuaaacuccauaguuuacauuaagauuuguuauuuguguugaugacacaaauguaugauguaaaguauucacauuacaauacaguuuaauacagauuaguuucacugcccuaaaaaucuccugugcuucacuuguuuaucucuuccucccuuccccuaaaucuuuggcaacuacugaucuuuuuacugucuucauaguuuugcauuuuccagaacuagguugcagucauacggcgugugccuauucagauuggugucuuucacugagcaaugugcauuuaagcuuccucugugucuucuaguggcuugauagcucauuucuucuuaucacuggauaauagucauuauguggauguccccccauuuauuuauccauucacuuaauugaaagauaccuugguugccuacaaguuuuggcaguuaugaauaaaccugcuauaaacaucugggugcagguauuuguguggacaugucuacagcuucuucggguaaauaccgaggagcgugauugcugcaucguguguuaauaguaugcuuaguuuuguaagaguaugcuuaguuuuguucuaaaguagcgguaccauuuugcauuuccaccagcaaugaaugagagauccuguugcuccacagccuugccagcauuugguuuuaccaguauuuaggauuuuggucauucugauagguguguggugguaugucauuguuguuuaauuugccguucccuaaugacauaugauguucaggaucuacuuauauuuaucaccuaucuguauaucuuguuuggugaagugucuguucagauuuuuuguccuuuucuuuuuucuucuuuuuuucccccugcccuuuugucuccauuuuuaaaacuuugguuguuuucuuauuguugaguuuuaagaguucuuuguaagccaggugcaauggcucaugccuauaaucccaggacuuugggaggccaaggugggaggaucgcuugaggccaggauuugagaucaccaugggcaacaugagaagaccuccaucucuacagagaacuaaaaaagaguagccaggcgugguggcacacaccuguagucccagcuacuugggaggcugaaguggaggauuguuugagcccagagguuugaggcugcaaugagcugauugugccacugcacucuggccucggcaacagagcaaggcccuguugaaaaacaaacaagaagaguugcauauuuuguuuaccuguccuuuaucagaugguuguuuugcaaagauuuucugccacucuauggcuuguccuuucauucuguuaauaguaucuuucacagggcagacauuuuuaauuuuagugaaguccaaauuaaccaaguguugucuuucauggauugugcuuuuggaucuaacaucauugccaagcucgagaccaccuaaauuuucuucucugcuaucgucugggaauuuuuguuuuuguguuuuacauuuagaccugugauccacuuugaaugaauuuuugugaaagauauaaagucuggucuagacugauuaauaugcaugugcauguccaguuguucagcaccauuuauugaaaagaugauucuuuguccauugaaaugccuuugccccaguauguucagugcaaagucuuuuuugccagcccaucuauagauacauaauaguaucucugugguuaauuccuuuauuuuaaaauuuaaaaucugauaaacuuuaaccuugguuauugcuuuuugucgugggacaguuguaaaccuuuuuuggcuuuucuuuuaccaauaauucucauacugcaugugcuaaaugucacaaucccccccuuucuguuuacuuugaaagugugaaaauuuuuauucuaguuuuuguuuaaaaucagaaaaaaaaaaucucuuaaaacuauagcaacgcucuucaugucaguaaaggaaucuuuucaugacguggaaauggcuugcuuuaacaguagaaaggccuaagccacguuugagagccugcuuuuuuauuaauacuuuguaaguggccgggcaugguggcucaugccuguaaucccagcacuuugggaggccgaggcugauggaucaccugaggucaggaguucgacaccagccuggccaacauggugaaaccccaucucuacuaaaaauacaaaaaauuagccagggguaguggcguauaaucgcagcuacuugggaggcugaggcaggagaaucgcuugaaccugggagacggagguugcagugagccgagauugcaccauugcacuccacccugggcaacaagagugaaacucugucuaaaaaaaaaaaaaaccuuuguaagugguguauguauaccuuugccaaucauguuagaguagaguaggcugugaacugugcuuuucacucaaagaguuuuccucuguuagcuauaauguaugagaaggguacaaggaugucauucuuuuuaaccauuugcauucuuugacauguuucuuuuuuucuuuucccuuucccuccagaauugguuuuaucuuugugguuaaugacucugaagauguugaugggaugcaagaugcuggaguggcuguucuuagagcauauaauuauguugcccaagaaguggaugauuaucaugccuuccagacucugacacauguacguuuuuguucagaauggcaaauaauuuuuucagaucuaacuuacucuuaauaacaauguguggucauuguaugcuaggcagcugggguguauagagcucagggguggguccugaauuuaaaagucaugucugcugcaguguauagagauggaucugaggaagggcaaagcaaaguggcagggaugccaguugaugagcuguugcagugaucuccaugagaaguaauggggaagguaguuaagcagggcugcggagaaugaaauagguucaaaagaagucacucagaauaguaaguauuuuauacuuuguuauuuuauucacuuuaucucugcuaaagguuugcuuuuguuuguuuguuugaauauaucuuccacaacggcuaccuuaaaauuuuauuuauuuauguacuuuuugagaccagaucuuguuguguugcucaagcuggucucaaacuccuaggcuuaagggauccucccaugucagucccaaauagcugggauuacggccgugcaccaccaugcccagagaauauuuuaacucugcuuuuuaaaguuuuuauuuauuuauuuauucauuuauuuuuuauuguuauaaguacacauguuugaucgagggggccaaagaagauagagagaugguacuguacacagcugguauaggcuuggaggccgaaugucacacagagacagacacagaaacaguccagcacucagcagggaaagcugggcaguauucugaggcuuguaacacuugguuggcaggugacagucagcaggggaucuggccuagggcugaaggggcgcaggcauccuggaggcucccagaucugagaucccggguggcaccugcuguggcgccuggguucagcucacaucauucagggacuugcaggcaaacuugggcaguacgaaggcagcacuguacacaucugagcagcugcaccugcuccaccugcugccgugucacuuguugcaugggcuucuggaaguuggugcucggguuuuugcugcagagcaugaaggcaaucuggccacugggauagguggggacagugcaguaggcgugugccaccauggagaagagugacuggcagaacuaccgugucugcuugaugagguccaggugcagccacugguacucgcccuggcagcagagaaugcuguccucguugagggccaucuucaugagugguaauaggauuccuugaagaggcucucagcggaucccaggagucagugaucauaauauugaaggcauccugguucugcuucacgaaaucaaaaucgucacccauaugcagggucagcuuagagcuagagaagccaauggccauacccggcaggaauuucuuagagaccugagugccauccuuuucagucuaucaucggaccacagacuccacagaggggugcuucaccaccuugugcaggaugccgucuuuguccccgacgaucagcaccuuuugugggauggggugguugcugaauggcagguugauucucaucuaguaggagaacuugucccuguccaugcaggggaugaugccauccaacaccagcacacugcugugggucuuacuguggaaaacaaggauauccugggagcgugagcgcuggcaguggagcagcugcuccaucuguagcaacaaggcuucccugggcucaggcugcagaucucauggaaccagcccuccuaaauggcagcgugaccauugaagccaggcuccaugucucuugggcucugcggccugagacugcaggcugugcagagccacagcacaacaggaccagcuacacccaccacccacuguuuauuuuauuuuauuaaaaaauuuuuuuuagagacaggaucucacuguugcccaggcuggauugcagcagcgcagucaggguuuacuacagccuugaacuccuggcccuaagugauccuccugccucagcuuccuggaauagcugagacuacaggcaugcaucaccauacccagcuaauuuuguuguuguuuuuaauuuuugguagagaugaugucucacuauguuucccaggcuggucucgaacuacugagcuuaaacaaucuuacugccuuggccucccaaagugcugggauuuuacgugugagccacuggggcuuggcugcuguuuuuuauuucagaagugaaguaauacugcucacuguaaaaacacuugaggccaggcgcaguggcucacaccuauaauuccagcacuuugggaggccaagggagggagaucaccugaggucaggaguuugagaccagccuggccaacauggugaaaccccguuucuacuaaaaauacaaaaauuggccaugugugguggcucaugccuguaauuccagcacuuuggguggccgagguggguggaucauuugaggucaggaauucgagaccagccuggccaacauggggaaaccucaucucuacuaaaaauacaaaaauugggccgggcacgguggcucaugccugcaauccuaguacuuuggggaggccgaggcagguggaucacgagaucaggagaucaagagaucaagaccauccuggcuuuaacacagugaaaccugucucuauuaaaaauuaaaaaaaauuaaaugggcgugguggcaggcgccuguggucccagcuacucgggaggcugaggcaggagaauggcaugaaccuggcaggcagagcuugcaaugagccaagaucgagccacugcacuccagccugggugacgaagcgagacuccaucucaaaaaacaaaacaaaaauuaaccagacauaguggcaggcaccaugucucagccuccagaauagcugggauuagacgccugccaccacgcccagcuaauugggaggcugaggcuggagagucucuugaacccaggaggcggagguagcagugagccaagauggugccauugcacuccagccugggugaugaguggaaacuccaucucaaaaaaaaaaaaaaaucaaauaaauaauacuggagucaauuuagauuucucuaucucuccccucucccuuuccucaucccuccuaaacaucguggauguaguuuuuauuucaaggacuacuuauaaguguugagauuuuucucuuuuuuuugagacagucucacuccaucauccaagcuagagugcaguugugugaucuuggcccacagcaaccucugccuccuggguuuaagggauucgccugcugcagccuccugaguagcuggaauuacaggugugcacuaccacggcaggcuaauuuuuguguuuuuaguaggguuucagcauguuggccaggcuguucucgaacuccugaccucaagugauccacccgccucacccucccaaagugcugggauuacaggugugagccaccaugccugccuggccuauuuagauuuuucuuaacuaauauauuuuuucauuugacacuuaacaagacugagcugauuccggccaggugugguggcucaugccuguaaucccagcacuuugggaggccgaggcgggcgaaucacgaggucaggaguucaagaccagccuagccaguauggugaaaccccgucucuacuaaaaaauacaaaaauuagcugggcguggaggcgugugccuguagucccagcuacucaggaggcugaggcaggagaagcgcuugaaccugggagguagagguuguagugagccaagauugugccacugcacuccaaccugggugacagagugagacuccaucucaaaaaaaaaaaaaaaaagaauauuuaauuuccaaccuaggaagccaucuuaguaagguauauggaaaaggaagaauugcuaacaugucccaauuugaccuuucaagaaaaguaauuggccaggcgcaguggcucaugccuguaaucccagcacuuugggagacugaggcggguggaucaccugaggucaggguuucaagaccagccuggccaacauggugaaaccugucucuacuaaaaauacaaaaaauuagcugggcgugguggcaggugucuaaucccagcuauucuggaggcugagacaggagauucacacgaauccggaaggcggagguucagugagccgagauugugccauugcacuccaaccugggugacagcaaaacuccgucucaaaaaaaaaaaaagaaaaauaaguauauuuuccucuaaauucagaaaaauguggaauaaacacuuugaaauuugaacuuaaaaguguaguuaaccaacuguuuuuucuuucuucagaucuauaacaaggugaggacuggagaaaaagugaaaguugaacauguggucaguguccuggagaagaaauauccguauguagaagugaauagcauuuuggggauugauucugcuuaugaucggaaucggaagguaaaaaauuucuuuguguuucuuauuugauugcaacauuguacuguccuuaaccccguguuugggggcuuugguuaauaauggcgauggugguuaaaguguuucaguacuuagcauuuaaaaguuuagaaaccagaucacuuuucaguguuugaaaaaguuuuuauuucagucuugugaagauaugacugauuuuuaacuugcuuauuaacuuuuaauggaacuguuuaagucucauuuucucuuauccuguugaagagaaaguaccaguagcuuuuuauuguggaugauuaugauaucaaaaguauuuacuugaaaaaugaugaguagaguggacaaacuggggaaaggaguauuuuuauaucuuuacaugugucgaaaucuugauugugcugaaaaauugaaugagaguaucacacaccaugcuccuuaguuuccuagacuuggccaucuguacugauuagaggcucuucuguauacaaacaggucauauuauuuauauuucauccauuuaauugucuagcuuuuugaauagaaguacucuuaaggcagggauguggagaguaucccagaaguccuaacaaucuaaugacuaaugagauuuuuuuuuuuuuuaacuacagcagcuuuaccccuauacaaaaaguccaauggaauggauucuuuugaaaugguuaauuuuaggaaaaauggcugcuucuaauaaaugucauugcacuuguaaaucuguuccuuuuguuauagugaagcuaugauaucuucugugucugaaagaaguaauuauuuuaaaaaguaggcaaugcaauuaaaguagaaauuuuaaacugaugagaauauauagucugauagguauauauuuauaucuuucaaagccaguaagauaaugauauuaggaaaaguucuaaccuacgugggcaaacacuuuaccuuuagcauauuaucuucgaguccuuacuaaucucaguuguuugugaguggcucaguauaaaacuaccaaaaauuaauguuuguuaauuauuuaucauuauuuaauauuuuuaguuagcuguugauagaaaauuuguccauaugaauuuucaguuuggcuguuugauaauugugcugcauucuguuauuuggucuuguaaacuauuucugaguggugaaaaaggaagcuacauaguccaaacaccucccugucacuccugacuuccacucaguuacuguuugcagacaaaaccaauguuauuuaucuuauuguaucuuggaauuauaauguaaguuuucuggucuuguuuuaauugguugacagggaugauuuucaaaacuaaaguuagaugaaaauugaguuuuaauggauaucuaugaaauagucgagaugucaaagaacagaauuaacaugguaagaguuuuaggaguguauauuuaaaacauuuaaacuaugauguagagaaguggcuugaaccaaccuagaaggcuuuuuaggcugugccauguuuuaggcugucaguuucugugcuguuaccuguuauugagcuugucugauuagaaaguaagcagucuguuaccgaugacucggauuaguuacccaaugggaguucuuuucuacuggugcuaucuaaaaugguuauaaauaauuaaauucugcuauuuucagaaaauggcaauuacaaggugugcgauagacauuuguaaaguugcccacuuuacaucuugggugguaauacaguuuuuacucugaaaaguuaaucugagggacaagcaccuauguugacagucaggaaaaaugucugucuuagguacauuugccguuuuguugccccaguauuuucuggccagugaaccucuuuuguccuggagaagggaaaagauuggauguauugugucuuagagcaauuguugagcacuguuuccccacaaaccuuguuuuguuuucugcagguguaauuucuuuguuagugauauggacccuuauuuagaauugggugcaaauauuuaccucaggcuuuuugcauagagcgcuuauaauuuaugguagcaaaaccugugcaccucauuuuggcagcccauggucacauguagauuuuaaaauggaaauuaauuaaagauuuaguuacuuggucauaguuggcagguuucaggugcucaguaguuacaugagguuagugacuacugcauuggacagcacagacaagcacagauagaauauuuccaucauugcagaaaguucuguuguauagugcugaccguagaauauguaguucaguuuugacagccugugcuacacacacacacaaacacacacacacacacacacacauacacaaacacacguacacacacacgcacuucauaauuugcaagcuuuuguggucuuguaaaaacuugaacucaguaauucaaucucagauuuacauaguaggauauuaacuuugaugucauuuuucauuuuuuuaaaaagaaauaucuugaguuauuuuuucuuuacaauauuucuauugauuguuguuagaacaggcauguaagaaaaauaugcuguguuccauuugucucacaaaaggcaaaaauauacuguuuuugugguuacuuguguuucaggaagcaagaggcuacuaugagcagacuggaguuggaccucugcccguugugcuguucaauggaaugcccuuugaaagggaacagcuagacccugaugaguuagaaaccaucacaaugcauaaaauccuggagaccaccaccuucuuccaaagagcgguguacuuggugagucacguuucaaggcugauuuuuuaaagagaacaguuggcuuauauuuuuuguugccucuauaguaggcaguaaaauucuuaguaucacuauuugggaggcugaggcgagaggaugguuugaggguaggaagucugagaccaaccugggcaauauggcaagaccccauuucuaaaaaagaaauuaaaaaauuagcuaggcuugguggugcacgccuguaguccuagcuacucaggaagcuuagguggaaggaucgcuugagcccaggaguuuaagguugcagugagcugugauuaccccacuguaccccagccugggugauggagugagacccugucccguuaaaaaaaacaaaacaaaacaaaaaacuauuuucuguaagucacuuguaauugguuugcaaacucuuggcaaguccuaugaugaaaauauucauaaaucuucuauauaugguaauuuaaauaacuaguauuauugauuucaggauuaaauguuuauuuuaaaaauugcaggcaguucuaagaaacauuuauucuauuuguagggaauuuuggcuuuggagagacucaauauuauuuuucauuuauauauaaauauuaauauauauaguucuugagauauaauucagacaguauaaaagucagucuuuugaacgguacaauucaguaguuuuuauucucuacacacaguuauguaacuaccaccucuaauuuucagaacauuaucaucacccccaaaagaaaccccacauccaguagcaauuacuccucuccauuuugcccauuuuguccuacucccagccacccugccauuggcaaacacaaaccuacuuucugcuuaauagauuugcuuguucuggacguuguauacaaaucaaauuugcagagaacaggaugauauuggacagauagcuuguugcucagaaccccaacucucuaaucaugugguuggucuuucuaguguuaccagcccccaaccugagucauugcauuagcacagacucucgggccccacugugcaucaacccguaguauaaaccaccauguguguccuaaggggcucaccaugaaugacaaagacacuccuaucacuggauuuagaguuuacaucccagaaacuagggccagccaaauuauuuaccacacacaguccuuuucucuucccuccucucauucuggaaauaugcacauggugguacucucucaugucccacagaucucuuuauguuccucagacuggauaaucucaguuuaucuaucuucaaauucacuuauucuuucuucugucaacuaaaaucugcuauugagccucucuagugaaugcuucauuucaguuauuauaaauccagauuucuauuugguucuuuuugauaauuuccuuugguuuauagauauuauuuggugagauguuggucuuaaacuuuacuuugguagacaugguuucuuuuaguucuugaauauauuugaaaucauuuauuuaaauucuuuuucuaauuaaguccaauguuuggacuuacucagaauaauaugaacauaauguaagaauauacauuacacauuuuacuuauauaauaguaagaauaguaugucuuggccucuucucuuccugaguauacaccauacuuuuuucuuucugcaugucuuuuuuuuuuuguuucugauacagggucucgcucugucacccggguuggaguacagugacaugaucuuagcucacuguggccuccaacuccuggacuuaaaugaucuucccaacucagccucucgaguagcugggacuauaggugcaugccaccauacauggcuaauuuuuguaucuuuuuguggagaugagaucuuucuauguugcccaggcaggucucaggucgcgaacuccugggcccaagugaucuuuccgccuuggccucccacagugcugggauuacaggcaugagccaccauuucugcauauuuaauaauuuuguuuuugacaacuaggaauuugaaauaauauaaugugacacuucuucaccguaccaggguuuauguuguucuuuguuguuguuguaacuguuauuuguuuagugacuuuccugaaccaauucuuucuuuuauuuucuuuccuuuuuuugagacagaguuucgcucuauugcccaggcuggagugcaguggugccaucucagcucacugcaaccuccgccuccuggguucaagugauucuccugccucagccucccgaguagcugggauuacaggagcacaccaccacacccaacuaauuuuuauauuuuuaguagagaugggguuuuaccacaucggccaggcucuaauuucagaacauuggucucgaacuccuguccucaagugauccacucaccucggccuuccaaagugcugugacuacaggcaugugccaccaugcucggcccugaaccaauuccuuaacaucuguauucuuuuucauguguggcuucugaaguuucagcuuguuuaacuuacuggucagcugaugaacgaacagagauuuccuuugaugcaugaauucaaaaagucucccaguuuuccccaagggucucuguguuguguuggggcacacuuuccacacucaaccaggcaguuggcaacucugccuuagucuuccauuuuugcuugcacagagccccaagguuagaggcaaggguuuaagaccuucuaagauuuucccugggcauucacguaccccugggcauggugcuuauggucucucaaauuccaagaaguuugucagagcuuuucaaagucccuuauggacaucccauuccccagccuuuuuuuuucuuuguuuuuugaccagcuuuguguuagcccauguguuaucugccaccucaggcagcuaagauguuaaacaauugcccaguuguguuugacagauacccccagggaaaaggcuguuggcacugagugaggucugguucagcccaaauaaagagaaccccugagaauucucuaguguccuaguuguuuuauuuuggggccauugauuuucaaggcuuugugcagcuggggagauguaaauaguaguggggcaaauuaauuguuacaaaggucacuuuccuuaccaaaacuuuuuuugagacagggucucucugucacccaggcuggaguguagggauugugaucauagcucacugcagccuugaacuucugggcucaagcaguccuccugccacagccuuccaaguagcugggaccauagguguaugccaccacaugcagcuaauuuuuguauguuuugaagaguugggauuuugccagguugcccaggcuguucuccaacucuugggcucaagcaauuugucuaccuuggccucccaaagugcugggauuauaggcaugagccaucgugccuggccaguauuccauuauaaaaaauaggccgggcgcgauggcucaugccuguaaucccagcacuuugggaggccgaggcgggcggauaaugaggucaggagauugagaccauccuggcuaacacggugaaacccugucucuacuaaaaacacacaaaaaaaauuaggccgggcgcgguggcucacuugggaaaccgaggugggcggaucaugaggucaggagaucaagaucauucuggcuaacauggugaaaccccaucucuacuaaaaauccaaaaaaaaaaaaaauuagcuggacaugguggcgggcgccuguagucccagcuacucaggaggcugaggcaggagaaucgcuugaaccugggaggcagagguucccucugggaaccaagugcagccgagauugcgccacugcacuccagccagggugacagagcaagacuccgucucaagaaaaaaaaaaaauaauaauaauaauuagcugggcgugguggcucaugccuguaaucccagcuacucgggaggcugaggcaggagaaucgcuugaacgcaggaggccgagguugcagugagccaagaucgugacauugcacuccagccugggcgacaagagugaaacucugucucaaaaaauauauaaguaaaauaaaauaaacauuuacuucauucccuaguauuggacauuacuucuacauuuucacuaguuacagacagugcuacagugaauauucuaauauguauauaccuuuguacauugucuugaaaaauaccaaguacuggaaaauuugaacuaaaugcacuacaaaaagauguguuaucagccaguugugguggcugacgccuguaauacaacacuucgagaggcugaggcuggaggauuaguugagcccaggagauugagaccagccuggcuaacauaacgagaccucaucucuacaaaauaaaaaaaauuagccaggcauuguggcaugcaccuguagucugagcuacuucgggagacuaaggcaggaggguugcuugaggauugaggcuguagugggcuauaaucaugccacugcacucuagucugagcaacagggcaugaccuuguuucuuuaaaaagaauuaagagauaugcuaugccagugguaugaaauucaaaacagaaauguaaaugaagagaaacuuuuagccauacaccccugugcuguacuacucaugauuucuuccucaagacaacuaccaugugugugugugugugucugugugugcacgcaugugugcauguguguguauacaagggcuggucagaagguguuacauuuacaauuauuuauuuuuuuuaauuaauaacuuuuuuuuuuuuuuuuacaaauguuuauucuuauauguacaacaggcuucaggacaacacuucauuccagcuauagguggcaaaagaugcuauggcagggaauacagauguuuaaauaugaaugaaaucaagggucaccaucuccucaggcacaaggcacagcuuacuuguugccagauuuuuuuuucuuuucuguuuuugagauggagccucgcuuugucacccaggcuagaguucaguggugugaucucgguuuacugcaacuucugcaucccagauucaggugauucaccugccucaggcuccugaguagcugagauuacaggcgcccgccaccaugcccggcuaauuuuuguauuuuuaguagagacaggguuuugccauuuuggcuaggcuggucuugaacuccugaccucagguuauccacccgccucagccucccaaagugcugggauuauaggcaugagccauugcacccggcccagauuucuuaauuucaccugcagccaggggucccuuccccauagccuucuauuuuagcuccuauuuuuguuucuucugcuccucuuuuuguuucugcuugaaagucuuaccuuccucguccaucuccuuggccugcuucuugggcuguuucagcagcaccuucacaggcagacauggcgccugccacgccuuccccaggcccugcaacccuacuuuuaaaauuuuuauagacuuugccaaauuccccuccuugaacucgaugggcuucuaauuggagucaaguagauuuauaauauugaccaaaguuguauacaugggccaacauguacagugagccaucuaauaucuuugucuuuugauuuguaugauugguucauaugcuccuuauuaaauagcuacaaauaaugucuaauuggaauuauuuagacuugaauguguauauuugauucacaucuuuuaucuugaaaaugacuucaggucgggcacggugagagaggaucucuugagcccaggaguuugagacuagccugggcaauguggugaaaccccaucucuacaaaaauacaaaaauuagcugggugugguggcacaugccuguagucccagcuauuugggagguuaagguaggaagaucccuugagcccuggaggucaaggcugcagugagcugugguuuugauuauacuacuacacuccagccuggaugaaagagcaagaccuugucucaaaggaaaaaaaaagaaaaugacuuuaaaguauaccuguguguuaaauauuuuaaguuugauaaaucugcacauuugcacaguuguugacacauggcucugagaucaccuucaagaaguauaacuauuucuguaauauuagcugugcaaaagggaagaauaaaugacaaugauuuccuauccucucauuguaauucugacucuggagauguaaguuuauuuggauggcugagauugaacaaagaugggagugguuuuuauuacaaaguauauuaacugcuugagagaagaccuuuuccuauuuuuuuuuuuuccuugggacagagucucacucuguagcccagugcaguggcaugaucuuggcucacugcaaccucugccucccagguucaagugauucuccugccucagcuuccugagaagcugggauuaccggcaccugccaccaugcccggcuacuuuuguauuuuuaguaaagauggcauguuggccaggcuggucuugaacucauaaccucaagugaucugccuuccucagccucccaaagugcugggauuacaggcaugagccaccauuccuggccuggguuugcauuucauaaucacuuugcauuagcuuugugaguuugaguaaguuauuuaaccuuucugugccuuagcuuccucaucuuuacaaugaaugucaacaauaucugccucacguuguugauagagguagagaugcuguaggugaugugcccagguauacucggcagugacagggaccaauaacauaguaacuucugucuuaacuauuauuagcacagaggaagccauuuauaaaguuaauaauuuuuugguuccuaaugaauuauuauugcuaaaauuugcuuuacccuccccccucaaccuccuuuuuuuuucuugcagggugaacugccccaugaucaagaugugguagaguauaucaugaaucagccaaauguuguuccacgaaucaauucuaggauuuugacagcugaacgagacuaccuggauuuaacagcgaguaguaaggagcauuucaggaacaaccuuaugcuuuuuuugacuugugcuucagaaucuuuacauuuuucagauuuuaauauucugauuaucuucugcaguguucagaagauagcccaagauugugacaaaauuuuauguguaaacucuuugcaccuuuaguucauaauaugagauucuaaauucacaagaguuuccuccuaaagaagaaaacaucuucugggcaaaacccugugaacuuugaaaaauauuuagugccauuuaaaugccaacuaaacagacaauagaugaugagaauggaccuggauuguucgcuucucuagucauaaagcaguucucuuucuucauccucauucuagagucagucagccauaaugucaacaaauaucucagugaauuuuacucugagaacuuaggaaggccuuuagcagcuucaucaagauaugauguauaugccauaaaacucaaccuuuuaaaguauacaauucaaugguuuuuuuaaugaaaaaaaccccacaaaguuugugcagucaucaccacugucuaaugauacaucauuaucaucaccccccaaaaauuccccagaauuccauguaccuauuaguagucacucucuguuccucccuuccccuauccucuggcaacaacuaaucuacuuucugugucuauggauuugccuauucuagacauuucauauaauuggaagccuuuugugccuggcuuguuuaauuuagcauauuguuaaggcuuaugcauguuguuguguaugucagcauuucauuccuuuuuauaguccacuuuauggauaguccacauauaucuguuccucaguugguggacaguuggcaguuuucugcuagaauaccuuauaagagccaaauauguuaagcccaggugcaauuuguuccuugugccuuccucgagauucugaggccucuucagcaaacaccuggaaauaagauggaacugucaucacuagcccaugaaaucucacuggggaaggaaagauguguguaaugaagucauaaccagcuauuuauuguuauaguugaguauaaugaacauaucaaucuauuuaugguuguuaacguaaugcacuaucucuaauagacuugaaacugaaaguuuguuuuagguagaggaaaaauacauguauauauacacacacacacacacacacacacacuccuauacauaagcacacacacacugaggaaaaaguguaaauauaggcuuauauuugagaaagaaacuacccagaaagugagcuuuuucuucacagccggguuuuccuuucuucccugaaguuucaguagagcaaggugagcguguuguggcucuucauccuaaguguuuauuguuuucaucauuuuuauuuaaauuugaaggguugucucuggaauacacaugaauaaggaacauaauagcgguuuuguuuuugaauuuccuuuuccauugaguguugcagcaaugagcuaugaaacagugcuaguccacaguggcaaagugccaccugucagcugaacauagugcagacaucaauuaggaggcucuggcauccucuugaccugguggugguggcauugucacucagguuucuuuggcuuuggcuguccuggaaccuuuuuaguaggauacuaauuuuuaccagcaugguaaaauuuuuaauuuuauacuaauuuuuaucggcauggugugcucucccuucccccacgugauaucauggaccgugugugacuuauuuucuacgguuuuccuggauaguauucuauggauaguagguguucagugugcauugucaagugacaguguagauggaugagcaugugcacagaugaauaaaugaguggguaggcaggcaagcugugucugacagacugugaugagaagacugacauuuguauagggugcaauaauguuuaagauuggggagauuguuagagacagagaguuuacaguacuaggcuguaagaaauuacuggguaguuuagagcaagagaaugacuugaugaaacuggaauucuaggaauaauaauuugagggaaaaugaguaaugaggauugcccuuugacacuaauuggagaagggacauaugcaaaaagagugaaaaugaccuuuuauuucuguuaaggguuuaaaaggugauauuuuguuagaccugaaaaauaaaaaucaguuuucuuacguauuuucucuuuuaccccugcuuccucuguaggaacaggaagagcuuacuccacugguuggacuagggaagggagaaaugaguuaaggggaucucuuugagauuguccuccaguugacaagugacaggaaugggaauaggaugaauucagccauuaaacugacacauacuuauaugauagcugugugagauauguauguuuccaucaaccuugugucuuugaugugugacuucaguagggauaggggccauguugugaaguuguucaguaaacauggaacuuaauauacuucacucacgcauuucuauaaaucuuauauuaugaucaagucagguuaucaguugaauauuaagaauagauugaacuggaacuaauauauacguauuucauuuuuucucccagauaacuucuuuguggaugauuaugcuagauuuacuaucuuggauucccaaggcaagacugcugcuguagccaauaguaugaacuaucugacaaagaaagguaauccauuugaggcuuauuaucuugcauucaacauuuuuuugaaaguauuugcauauucaucuuaaugugcaaauuaagagagaaaagggaaagagacuucauaauuuuucuuauuucuuauaaagcuuugagucuagaacauaucuauuuaaaguuuaauucuuuguauauuuguugaaaguauauauuuguuuaaaaauucagaugucuucauaaauuuuguauuaccuguuuuaccuuuugacuaaagucaaaaggaaaaauauuucauaguucaaauggaaaaacauuugugauguaaaaauggguuaaugaauuaaaaaugacuguacaggguuaauauuauuuugggguuuauaagauaaaguugguuuuagaaagccuuguauaaucuuugaagcugauuuuaugcagagguauuuauuuaggcuaagauuguguaaaaugacgcccuguaguggcggacagauucugucgcccucgggucagugcuucagaaaagcacuggcuguuauuuuaagucagcuauuuuuaccgccuuuuuaaauccccgcuguggucucuccccaagagaaguucugguuucucagcuguauguaaaguacaagcaauuacuccauuugguucuuuaaagaaacuguuucuuaggguacugggacagcgccaugacaccgacaggacuaagcagcaggaagaaccauagaccguguuagccauuguuuagacuuucaauuuuuacaguaggcauucauuccagaaaugauacuuuuuuucuacucuuuucucuuuaccuuuguucaggaauguccuccaaggaaaucuaugguaacuuaaaacuucagaauguucuauuucuuaauuuucuucuuugguuucagugaccauuguaauuuagaauuuaucaacacuuaauuguacuguuuccggaaucuguggguaacaggaagcuauaucaauguagauaauuuuuuuuuuuuuuuuuuuugagacagagucucauucugucacccaggcuggagugcaguaccaugaucucggcucacugcaagcuccgccuucuggguucaagugauuucaagugauucuccugccucagccuuccaaguagcugggauuacaggcacccgccaccacguccagcuaacuuuuuuguauuuuuaguagggaugggguuuuaccauuuuggccaggcugguuuugaacuccugaccucaagugauccacccuccugaaccucccaaagugcuaggauuacaggcgugagccacugcacccggccaauguagauaaauuuuguauaaacauuuguaaagaauuaguuucagaaaauuacaaauuaguaugauuaaaaaugacaauauguuacccacauguucaaaggcuguuuuucauuuuacaugcuaacagaugcccagaccagugcauuaaucaguagaauuaaucagugcauguuccuagucuguaacuaaacucuguggaagauuccccugcuuuccuauaguaaagguuuacgacuuuuucuucuaucuuuauuaagcuugucauuuucuucuuuuugcaugguucuuacaaauuauuuggucaauuucauuuucagaauguugaaacacagaaugugcuucucuccucugacucaauuagcuguuuuuguuuuucuacagaugauucuuuuauuaggccaguaacuuuuuggauuguuggggauuuugauagcccuucuggacggcaguuacuguaugaugccaucaaacaucaggcaaguaucuaugacuucauuuuauauuuuuguuuguggcuguaguugucuucaugggcuucgcugugcggcuaggauuguucagugggaguugggaguccugcuuucuuaaugcucgagggaacggagaauuguaucucuagagaucugccagcucucaagaaaagagaucuaagacuacaguauccaggcuuuguugaacgggauagauucuuauagagaaaaaaauaaauagcgagauccucaucauagacaaguuuuauugcauaccuguucauguucuuggagcagaguugcuccaacaauuguguuguguacuguaucggggagaugggguccuuaccacgacagaggucuggacaugggggcaguagcacacaggaaugguaguguguguguuuaguagaaguagauccagaugcacugagggauacacacauagguguucugaaaagauaugcugccauuaauaguugggcuugagugaguggcaauggcaggugguugggaagcagcugauucuucuggagagugucaucguuagaggaugagaugucaaaauucuuuuuccugggcuguuucaguuugcaucuucauccauaccucacaacccuccucaugguccccuuuccacccuguaccugggaagguuuacugaaauaaagaaauauccaggugguuucaguuuuacucauaugccgaguuccuuuauuguucaaggaguggaccaaaugcuguggucaauuugaaguuagaacagggcaguucuagcuaagggcgauaguuauaugugaaaggcacucuaacacaaaugcguaaaucuucaaaugguaguaggguaggagaauggggaaggagaguugcauuuuuuaauaacuauuuuaauugaaguaaaauguagguucacaagaagugcucaaaucauaggacacacagugucacaaagagaacacacucuugugaccaccacucaggucaaaaaauagagaauucucaaguuccugaaagcccucccacacuugugcccacccacacuugugcccagacacuacgccucuucccucuucucauauuagggaauagguuugccuaucuuuuaguuuauuaaaauggaauguuaugcaauuucauuuguguuugguuucuuuacccaaucuuuuguaagauuuauucaugauguuacaaguagggguauagaguccuuuuucauucuguaguauuauaucauauggcuguaccacaaaguuuuauuuguuuaagcuauuugaaggacaguuggguuuuuagcuuggugcuauuauaagacugcugcaaugaauauucucguaugucuuuugguacacccaaauauaaaugucuguugcuuauguuauugguacaagcccuuuuuuggcuuuguguguccuggguguauucuuccacuuggauucuugucuuuucacccagggagagauugaauuguacuaggaaugugggaaggcuguaugaaugaagaaggguuugaggagagcacugaaaacacuucuaaaacaagugcguuagaagaauacaaaauguguggcauaagaauauaaacuguguuggguaaagauaggacucugagggucuguaauuuaugcuauauuuaccgggaagguaagaaaugaaguuggaaaggugggcugggggccacuucauguaggguuuugaaugcuugaugauggcauuuuuaauuuuauuuugaaugaggaggagaacuaucugagacuuuuuuuuuuuuuuuuuuuuuaaugagacggagucuuacucugucauccaggcuggagugcaguggugugaucuuggcucagugcaaccuccaccucccgaguucaagcgauucuccugccacagccuugcgaguagcuggaauuacaggcgcccaccaccaugccuggcuaaucuuuuguauuuuuaguagagacagaguuucacucuguuggccaggcuggucucgaacuccugaucucgugguccgcccgcuuuggcuuuccaaagugcugggauuacaggcaugagccacugcgcccggccugagacuuuuaagagagauauuauuugcuacuuauugaacaugacugauguuaaugcugcuuuuuaaguucaaaaauaucuacaauaugacucccguuucccauuuugugaacagaaauccaguaacaauguuagaauaagcaugaucaauaauccugccaaagagauaagcuaugagaacacucagaucuccagagcaaucugggcagcucuccaaacucagacuuccaacgcugcuaagaacuucaucaccaaaauggccaaggagggggcugcagaggcccuggcugcaggagcugacauugcggaguucucuguugggguaaggcucugagccucucaugaggcugccccauuuugucugccacggaagcucacccacugcagcuuacguguccgguucaugaucacgauuugucauuuuaguccugagucucagggaauuuuuuuuuuuaauuuggaaguuucccuuuauuacuuuuaaccuugccuagcuuucauguggugcaugauuugaguuuuuguguguuuuaaguauggagccauuuguuaugcacaguuuuuaagagagacaauauggcuuauuuauagagcaaaaaacggagauuugaaccacuuauagguucaaggcuuauauguucuugauguguuuccagaauaagccuguguuuauucauuuauauuuuauguuacuuauuuuuuugacacaguuuuguaguuuuuaaauuuuuuacagaaugaugaguauauacuauuugacguuugaguuaggaaaacaggcugucacuggaaauuagcaggauuuaaaaaugcagaguaaaggaaugaugaauagucugcuagucgaacaaaucacaggaaaagauaaggaaauagcaguuacucuaaguaguagggagauggcggggagacuggagaauugacacaucuuaauguuaauuaugaaaauuaguuauuacuuuccagggaaagaaauuuuuaugguuuauucacuguguuuauuuguuuauaugguuugcuuaguaacgacuauuuuuccuuaauaaugauuacuuuccuagggaauggauuucagucuuuuuaaagaggucuuugagucuuccaaaauggauuucauuuugucucaugccguguacugcagggauguucugaagcugaagaagggacagagggcagugaucagcaauggaagggugaggauuugucaagcuugacuucacauuagauccgugaacagucuuugcagcauucuccucugaagcuaguaaacucuucagacagagccacucuuuuuucaaaggugauuggggcuuaugaagugccauugauguuucugccuccuauuuccaaggagcugugcuuuuugacauagacaaauauccccauauggagccuuccugcugucggugagagugugguggcucucagaaagucagucaguauggacuuugacacauaaaguagccuuuguuguuuuuauucagguagaauuaaugaaaacuacuuuacgauuuuauuuuacuuuguccuugaggaauugauaaguaaauaacuacaaguauuugcuuugggcuucacuuuguauuauuucacugauuuuaucuaaacauguaccugucucaggucuuuaagauguucuggcguaugagguagccugaggacgccagaggguuccuuaccagcuugcugagugcaggcagccuuccagagcuaagcgccugcucuucucuccuucacagaucauugggccacuggaggauagugagcucuuuaaucaagacgauuuccaccuccucgaaaauaucaucuuaaaaaccucaggacagaaaauaaaaucucauauucaacagcuucggguagaagaagauguguaaguuuugccauaggaggaauuacagggguuauauaauuggacuuuccucauugaucaguuagaauuauauguuguuacucauacuacauaucccaaggaguuuuauuuccaguuuaaaaucuaauaauacucuucaauuccaguuuuaauguaugcuucuguugaaacaagauaauuuauuuuguaggguacuauuuaaggaacugaacuaguucucucuuuuuauuuuuauaauuuuugguuguggaaaauuucaaauauaugcagaaguaaagaggcuaguuuauuuauuaccuggaauacuuauguaaagugauacuuuucaucauuaucuauuugguuacccuucaguuuuauuuuguucaggaaaggaaaggcaguuuaaauguuucuuuuauuuaccagugcagaauacugaguuguuucccuuguaucuucaaaggugaugaugaauugguuguugucgguuuuuaauuuuaauuuucaguguuauuauaagcugauguguuuuaguguguuauuuucuuaauggaagaaaauaaauuguuuggauggacccuggaguccauuguuacauauauguaguuucugcauuaaauaucaaaugacuauguaguuggaggaucuauuucuauguuuaauuguuugaggaaccacaauaccuuucccacaguggcuguaccauuuuacauucccacuggcaaugcucaagggugccgguuucuccacauccucacaacacuuguaauuuucugggggguuuuuuguuuguuuguuugcuuuuuauaauagccauccucguggguaugaagugcugucuccuugugguuugauucacauuucccuaaugauuggugauguugagcaucuugucaugugcagauuggccauuuauauaucuuugggaaaaugucuauucaagucuuuugcccauuuuuaauugcguuuuuuuuuuuugucguugagauguagcaguucuuuauacauuuuggaugucacuuucuuacuagauacaugauuuguaaacauuuucuccuauucuguggagauguguucuuugaugcauaguuggaggauauaaaauuuuaaaguucugcuugcgagguugcaaugagcugagauugcgccacugcacuccagcuugggugacaaagugagacugugucuccaaaaaaaaaaaguucugcuggguuuuuuucuuacaucaucaugcugcagaguucaagagcauguuuuagagaaguguugacuuggauagcugucaaagucagcuguugccaugucuuguaugaccugggaagaaaucuuuucucauuuuggccaauacuggggcuacaaauaaggaggauccaucccucuuaccucaguggcuccugagugaugccccuugucccgaccugugaaaugcuucccugauguaggucaggagguacucgugacucgaagcagccaugucacaggcauaggcuugguguggcaugcuguuggaccacugcagggagcuccuuggggucuucuugggcuauauaacugccagacugugccuagaagacuugccuuuugccaaugagagauggcucucgaucuuuccugggugaauuuagggaaaucagguagucauggggccaaaagacuaaugcuaaaacucuuaggcuucccaaaauuaccuugucugcaucagguuuucauuagcgccagagcugcuccaccuuggaguggcccccuuccccgugacagccacagcuaucauucaugacccagucugcauccccaaggcugcccugaagcuuggcuguguauacuuugaucauuguucuucaucagccuucagggaguuucuuguuggccugcucacuccaguccacguaaccaagugccccuugacauguuuuguaaccguguugacacaucacaggaagagaauggccuguauuauauauauuuggcauuuauauugagaaguugaaccaaaauaguuaauuuuauauauuugcuggguucauaggaaauguauguaggcuuaauuacaguucaaauacauucacagugcucuuuuaaaauucuuauucaggauuuagucuuugguucagcaaauuggaguguuuuuuuuuuuuuuuuuucagguuuaguucaagaucuuuuucaguuagaaaucaauuuuaggcugggcgugguggcucacaccuguaaucccagcacuugggaaggccgaggcgggcggaucaugaggucaggagaucgagaccaucuuggcuaacacggugaaaccccgucucuacuaaaaauacaaaaaauuagccgggcaugguggcgggcgccugugaucccagcuacucaggaggcugaggcaggagaauggcgugaacccgggaggcagagcuugcagugagcgagaucgcgccacugcacuccagccugggcgauagagugagacuccgucucaaaaaaaaaaaaauuaauuuuagaagaggcagggacaauaaaauucuuuuuaaagugguuuacuucaguguuaauuguaauagugaaauuagaaacaacacagauguucaguaguuggcuuaauauuuagauuauuuuguauccauaaauguaacauuaugcagucauaaauauauugaaauaggcugggcacgguggcucacaccuguaaucccagcacuuugggagguugagaugggcagauugugugagcccaggaguucaagaccagccuggccuguacuaaaacccugucuguacuaaaaauacauaaaaauuagcugggccuggugcugcaugccuguagucccagccagucgggaggcugaggugggagaaucaccugagccuggaaggucgaggaugcugagaucaagcccugggcaacuagagugagacccugacucaaacaaacaaacaaacaaacaaaaauauugaaauaucacuguauuuauuaaccaaggaaaggauuuuuauaauauguuuuuaagugaaaaagcaggcugccaguauaauuuguuuauauguauuuaaaaguauagaauuaugagccaaaauaucagaccuuguuacuugauauuauguguaauuucaauuuuuggcuuuuauguuuauuuuccagugaauuauuacucuaauagucauaaaaaguaauaguuuuaaaaggacaagggagaauguaaauaauacugacagccuguaaugggccagggccucagcuaggugcauugcagaguugugcaguuuuacuagagucaugcagcgugggugcugucuccauuucacaugugggaaagugaguaacuucuccaagguuauaccacuaaucacucuuucucaugccuaucaguacggacuuuauaccuuguucaaaccaucuuguuagaauucaguauuugggcugaugauauguuuggcaauaauuggaaaacuuucaguuaaaaagauguuaagauuucucuaaccccuucuuucagggcaagcgacuugguaaugaagguggaugcucuucugucagcgcaaccaaaaggagauccaagaaucgaguaccaguuuuuugaagacagacacagguauagaauuaauguugaauuugugcauauucuugaauauuaaacucuuauguuugcuuuaccucagcuccuucauuuuuccauauaagauuuauauauaaguucuuacaggaauugaacauuuguuuggugugcaguuuucacauguauauauuuguguucauauauaaaauucauaugcaaaucucaguuguaugaaaacugacauuuauuucuaaaugaaucugaaauaacucugagugcacccuuguaguagaaaauagacugcauuuaauuaaacagagaaguuguacuuuucuuaaauucgagaauaaacacaggcaggucaagauagcucaugcuuguaauuccagcacuuugggaggccagugugggaggaucgcuugagcccagaagcucgagaccagcaaacaaagggagacccugucucuacaaaaaaauuuuaaaacauuagcugggugugguggcaugugcauguugucccagcuacucuggagguagaggcugcagugagccaugaucucaucacugcacuuccagccugagcaacagacugagacccugucucacaaaaaaauuaaacagagauuggcugggcgugguggcucaugccuguaaucccagcacuuugcgaggcugaggccagcggaucaccugaggucaggaguuugagaccagccuggccaacauggugaaaccccaucucuacaaaaauacaaaaauuagccagucaugguggcagaugccuguaauaccagcuacucaggagccugagacaggagaaucgcuugaacccaggagguagagguugcagugagcagagaucgugccauugcacuccagccuuggagacagagcaagacuccaucucaaaaucauaauaauaguaagauaaacagauuauuaaaguacuugucucauucaucuuuuauugaaaacuuuuuuuaaaaaaaaaaaacaggguuucauucugucaucugggcuagaaugcaguagcgugaucucagcucacugcaccuuccgccuucugggcucaagugaucuuccuaccucaaccuccuguguggaagagaccacaggcgcuugccaccaugccuggcuaguuuuuguauuuuuuauagagauggggucucacuguguugcccaggcuggucucaaacuccuaggcucaaguuauucaucugccucagccucccaaggugcuuggccgaaaacuuuuguuuuaaauaagcuuagcauagugagggaguuugccuuuuuguucuucacuuuuuuguuuugaaaaguuuaaaaccuagaaauaguugaaagacuaauauaaugagcacccaaauauccuucacuuagauucaccaguuguuggugugucacauuugcuuuaucucugucaucugcacacgugcauguugugugcgugugucugcauguguguguuuguguaguacuucuaguaacugcuuuaguaguuuauuuauauguuugcauacacacggucauauuuuuuccugcaccauuuggaaauacguugcagacauccugauguaacaugucugacguuuuccgcauguguauccugagugcuaggacuucuccgcaguacuguuagcugaccucagaaauguaaccuugauacaguaauauuaaaacacaauuucuguucacaugacuccaguaucuuuguaaugaccuucuacaacuguuuuuuguauuuguuuugguccagauuacauauuacagaguugugucucuuuggucuccuuuaaucuggaagaguucuuugccauuuuuuuuccuagucuuuugucuuuuaugaugacauuuuuuaagaguccaggacaguugucuuauggaaugucucacagucugaguugcuuccucaugauuagauuuaauuguuucuaggaaagagcccugcgcaguaauguauauagccuuugcuguagcuggcaaguauauacauauacacugauugugccucggaauccccagggaggcuuuaaauauagaugccuguguccuauuccucuguguuucugagcugaucagucuggcauggauuggacuuugguuuagugggccuguguuuuuuaugacccauccuuguggggaucaggugugcguggugagaucauuugaugauuguaggcuggaauggaggcccucucuguuugcacugguuguguguccuaauuuuuuaugucagcagugggugaagauucuuauggcuccuggauaauccuuguugaauuuggccauuagcacccagauugcacccauuuucucaacauuuugugaacuuucaggaaguaacucauuagucaccagcgggaggaaaccuuuccuaaucaaccugccaucuuguuuacccuucuugcccaagguagcgaguccugagcaaagaccucuucccuuuucagaaaucuucuucuccaugggucuccauguuuuguauaauuaaaauaccuuaauuauaaauucuauuaugagacaaauuauaauuccuauuagagaaguuccucuuauugggaguugugucaguuaaaugaauguuuauuacauuuaacucagaaguuucucauuuaugcuagaaauagaaagaucugaaccaucaguuauguauauucuugcccucaaagugugguccauggaccagcagcaagacauugucugggagccuguuggaaaugcaggcuuuggacccaccccaguccugaggaaucagcaccugcauuuuaacaaguugcuccugggggauucccgugugcauucaugcuacuaagcacaguauucguugacauuuacucuacgaaccauaggcaaauguguauaaucuccaaaucuuguuccugucucugucacuuuuaguuuuauucuggucuuuucucugcacaauauagugaauacauuuaaacaugauguuguucauauuguucccauuuccacacaaauacuccucuuuccuuguuuuuuuucgagucccuuuuucuuguucuagagaugugggguaaguaaaggaccucacaaggucaauuuguggugugccuguugcugaucaccuagaacacugcuggcucagaaugugaacauguugugugaaucucuaccccaaaccuggugugggcaggcaugaccagauguuacacucuuguguagaguccuuuuugagacucucucucugguucccuugugagccuuuguauaaugcuauuuucuaaugaguuuuuccuucuagaauucuagaauagcagagaggugcaaauuauauuagggcaguggcucucaaaauuuggcuuuuacuuagaguuuguuaaaaugcagauugcuggacccguccccagaguuucugauucaguaagucuggguuggauccugacuugcuucucacaaaugcccaggggaagcugaugccacugcucuggagucacacuuugagaacaguuguauuagaguaacagaaguuuuguuguguuagaagaauaaugauuggcaguggacuuaaucugaaauuguuaauaaugccagagaucgaaagcaccuaccucaacacagauacaaagcuauucucaugguuauuuccaaagcagugaagaugugaaguaaccuccaugagcauguaaauuguuuccaguuuucuucguuaugcuguuuugugguauucuuuuguauucaucccacuuagguaaauguuguuugguaaaaaaaaaguaaaaguagugguuaguauuguaaccacauuauaguauuguucagagcaaacaaaguauaaugguuuaaacaguuaaugguuuucaaaaauuggguauaauuuuaaauccuuucaaguugaguccuuuuaaaaguucauuagagguuccugcuccuuuuaagucaccagucugugugacuucacagggaguccaugcaacaggaaguuaccauucaguuaagaacagacaagggggcugggcaugauggcucaugccuguaaucccagugcuuugggaggccaaggcaggcagaucacuugaggccaggaguucaagaccagccuggccaacauggcaaaacaccgucucuacuaacaauacacaaauuagcugggcaugguggcaugugccuguaaucccagcuacuuugguggcuggggcgcgaggauugcuugagccggggagguggagguugcagugaaccgagaucacgccacuauacucccagccugggugaaugagcgagacucugucuuuaaaaaaaaaaaaaaaaaaaaaaaaaaaaaaaaaaaaaaaaaaagacaaggaccaggugugguggcuuaugccauugcuuugagaagccaaggcaggaggaucacuugaggccaggaguuugagacuagucuggucaauauggugagacccguaucucuacaaaaaaauauaaauuagcccggcaugguggcaugugucuguaguccuagcuacuuaggaggcuaaguugagaggaucauuucaacccagaaguuagaggcuucagugaaccaugaucacgccacugcacuccagccugggccacagagugagaccuugucucuaaaaaaguaaauaaggaaaagaacaggcaaaauaucuaucuauaacuuaaugcugacgaaggauguggugaaauuuauuuuuuggccuuguaaauuuguuuaguucuucaggaaaugugguugacaauacuuauuagccgcaaaguauuuguauccuuugucuccauaaucucaugucuagcacuuccuugacucuaaagaaauuuccaaauguggagaaaguugguuguacaaauuguuuacagguugaaagccaucucuauguccagcaguaaagaaaagcuggaguaaacucugacagcuucauuuggugaauagcauauuauuucuuauagaggaugcuuguuguguaacagcauguggaaaucuuuaugcuacaguagugagagacggaaggaaauuguuuugaaauugcuaaucuguaucuacaacuaauguuuauacaggcaucuagaaaggauuacguagagaugcagcuaagugggcugggauagugaauauuuugugauuauauuuuuccuuuuucuuuguuuugcagguuuucuggaauguucuuucauuauuuuuuaaaaauugauuuauuccuuuucuuuuuguacucuucuugccaagaaguaaaaacuggcauaauguuaucagaagcuaacuucaguagcuuuucucaguuuuugguuaaauacaguuucaagcugcuuuuccucucuuuacauggaccuuucaguccauuucagauccauuauuaagguuuugcaaucuuugggauagacagaaucauauaguuggccacugucauagucuagucuuucuagaucuaaaguucuuugaaaugcuaagaagguugaagguuauauuguacaaaaaaaacuuuuguuuccuguguccuccagguuaauguuuuauccuugugaucuuucagugcaaucaaacugaggccgaaggaaggggagacauacuuugauguuguggcugucguugacccugucaccagagaagcacagagacuugcuccuuugcucuugguaggaacgcugugcaggaaguguacaucaccuuuguuugaaguugucacaugcucugaaauucacugagagcuucguuuuccuugaguugccuucaacaggcacuggacaaugcuaugggguucuagggcagagcaaucuuuacaaagauugacaguggcugugaaacagccucacagcccuagaaaguuggugcaagugugguuggcugccucauguaauuuaaaaaagugauuaacauccucauuuagaguaaaacauccuggaauuaagguaugcuauauuuuaauuuauaauaucagagauaaaauaaauauguuuuuucauuuuuccuuuuuuauaacuaccauggauuuuuugucuuggcaugucuuuuagacauguacaguguguuacaauuuuaggacauuuaaaagaccuuugacaaagacagucgcuccaacauucauugccgaauaaaucucuaaccuuuuuugugaguauugguaucucuguuuuuucauccuuuggcaugugagcggugacucugaggccuguaguuuuuccaugaucugccugcugcuuccccacaggaacugccuucgugugaggagcagugagcugcagcagccuacuucccauugcuuuuggccacguccuauguaugugugauguagauugugcaguagaguugugauuuccagaaguuucgccagugcagacucuguggcuguuaucuuuauaucuuuucuugagauauuaauagcucagugucaaauaauaaauuucugaagaaaaaaauccuaaauauuuugucaucugguuuuccuucuagguuuuggcucagcugauaaacaugaaucugagaguauuuaugaacugccaauccaaacuuucugacaugccuuuaaaaagguaaaacaugcuauguaagaaaacaguugaagaaauuguacugaauccaaguucugauauugcauguuagaggaucagauggauuuauagguggacaucauguuugaaauggucauuuacuaaauguucaguuuugccaaauuucauucuaaucagaaguucuaagaacauaguguguuuguagcauuuagguggcauuaacccaggcugcuugcauuugugccuuuucuuucuuuuuuucgagauggagucucgcucugucgcccagauuggagugcaguggcaugaucuuggcucacugcagccucugccucccggguucaagggauucuccugcuucagccuccuuaguagcugggauuacaggugcacacuaccaugcccagcuaauuuuuguauuuuuaguagagacgggguuucaccauguugaccagccuggucucgaacuccugaccucaagugauccgucugccucacuucccaaagugcuggguuuacaggugugagcuaccacgccuggccccauuugugcuuuucaucuuaaaagaagaauauucauuucaaguuggaauauacauguuagaggaagcuugcuuagcuauauauugucaugagcuuuggaauggucauuuaugaaaaaagugauacagaaagcaguuagcguuguggcuaugggaaauuucuaacuugccagugugcuguguuuuauagguuagcuucuaaguggauugaaacagcauuugaaaguaaccaaaggguucccagcuuccaccauuauucucguauaggggaaauguuuacauuauuaguguuuucaggacuagccugagagcccaaucaguauuuaggaauugguuuuaaagagaaaaaugaguccuccuugaagggaggaaaaugcccaggaccuaacugugacccugacagccauccaugugaacgaguggccuccguucaagugauuggauuuuggcuugcagguggacaguauaguggcugcugaguaugagcuagaguaccuguuacuagaaggucauugcuacgacaucaccacaggccaccacugagcacuccuccucagugcuguccuuguuugccuuuucuugcaucugcagcaaccacaaggaggcaucauaaggucaaagaugguuuuggaaacacuuuucccaaucuggaaggguacuccuccaaaucuaauuuguuuuaaccaguuguuaccuguguaagggcugugcacucaaguccuguugucacaucgaaaauuaucuaacacuuuccuuuucaauuucagcuuuuaccguuaugucuuagaaccagagauuucuuucacuucagacaauaguuuugcuaaggguccaaucgcaaaauuuuuggauaugccucagucuccacuguucacucugaauuugaacacaccugagagcuggaugguagaaucugucagaacaccauaugaucuugauaauauuuauuuagaagagguaagaccauaucuauugcuuccaaauaccuaaucauguauaauacagcagauugaaucauagucuaggugggccucugagacaucaguguucagguaugauauuuuuuuaaacaacagcuuuauucacauggaacucauauaccauaaaauucuccccauuaacguguacaguugagagguuuuaguaucuucacggaguugugcagccaucaccacuauguaauuguaggauguuuucagcauccccagugaaagccccauacucauuagcagucacucuucauuuccccagccccuggcaacugcuggucuacuuuguaucucuauggauuugccuauucugacauuuugucuaaauagaaucaaauguggucuucuguaacuggcuucuuucacauaacaaauuguuuucaagauccauccaugcuguaguauguaucgacgcuucacucuuuuuaacuugccagauaauauuuuauuuauggacauaucacguuucauuuauccuuucacgaauggacauuugaguuguuuucacuuuuugguuguuaugaauaaugcugcuaugaauguugugugcaaguuuuucuacugauacgugaguacaggaugucuuugcauuuaggucuuuaauuuuuuucaacauuuaguaucuuauccucguucguauuuuuagaauaacguccuuauuguuuuuuucuccuuucucuuuccaaccuaguuuuuauaauuguauacagucauuaaccaccacuauagccacgaugcagaacauuuccauuaccccaaaaaguucuuuuauaccccuuugcagacaguagccuccucucgccugguuucaggcaacaacugaucugcuuucugucauuauacuuuugucuuuucuugaauuucuuaaaauaugaucauauauuauguaaguccuuuuugucugcuuccuuuacuuugcauaaugcauuucagauuuauucauguugucucugagugcauucaagugauuggauuuuggcuugcagguggacaguguaguggcugcugaguaugagcuggaauaccuguuacuggaaggucauugcuacgacaucaccacaggccagccuccacggggacuacaguuuaccuuaggaacuucagccaacccggucauuguggacaccauuguuauggccaaucugguaaauaaucuguucaucagauagugauauuguaguuacguuaauuugggcacuauaauuuaugauggagcaauuagcauucuuaaccauagagugagauuaaaauucauuaugggcugaauuuggucaauauagaaaucauuaguucagcuaaauuuguagguuagaauuacaugucaaaagaaaaaacaugcuggaauacucagcuauaacugaauuggcccccugaaaauagauugcucaugagcugacagccuuuuucuuuucuuuggaagugcaacacuuauucaugcaucacacguugauucuucccugaagcacagcuaaagagcagaugauuuauuggugugacuggccuuuauuguacuaguuuuuuuuuuuuuuuuuuugagacuccugcccaggcuggagugcaguggugugaucucagcucacugcaaccuccgccucccagguucaagcaauucuccugccccagccuccugaguagcugggauuacgggcacccaccaccaugcccggcuaauuuuuguccuuuuuuaguagagaugggguuucaccauguuagccaggcuggucucgaacuccucaccucaguugauccaccugccguggucucccgaagugcugggauuacaggcgugagccaccgcaccuggucugugcuagaguuuuuaauguguaguuuugguuuuuuaagaguugcauugauuuguuuacuguguuauucacauuauaguugauugauauuucagaaauagaaguaacuguuccucagaaauaacauuuugguguuuugaagagagcuaacuggacuuuucuucuuguccuagggcuacuuucagcugaaagccaacccaggagcuuggauccucagacuuaggaagggacgcucugaagauauuuauagaauuuacagguaggaguaagugaugcaguuacauuaucccagaacuuuuagaaaugagcauuagcucuaauugaauacuacccuggcaguuagccaggcaacaugaauuuaauuugcaguuguaugugaugaaacagugguuuuuccaggaaauuaaauauggaagaauuguuagaauagaauuagauaauaagagguauagaugcuaaugaguauagucaggcuuuauucuuuaauuauuccuuugugcuaacaauaucccagaaucaaaucauucuaucagugugaugcggcucauagauaggcagaugagaaacuugaagaaaggagaaaagaaagaaagaacagccacacuuuucugcccagagaguguauguguugacccugagugauuugcaaaugcacaguacauggaagcuuuggucuugaagcugugcuguuagugcugguauuccuuggucugugguggcauaguaagaacauucccucuauagccagcuuuuaccuuaagguuuacugcacauauuuauuaguuuaaaaauaauuauguugccuuuaaaaaaguuugauauaaauucugcuuaacacaauuuaaauuaguuuuaaacugugugaagaggcuucccgucagguuguguaggggaugauuuccauuagggcacauuugaagcacucuguaguauguccuugccuuaauuagcuccguagcgacacacaugaaacaguggauuagugccugguucuuacccaggaaauagaagaauucuguauuauaauaacaccauuguaaacaguagaagguuuuuucccacauaacauuuuccucagauaagguuuuacaaaauuugggaugcacuuccgaacuccuucccuuuuggaugcccuggcccuugccagcccuccccuucccaggagcauggugcccccucuuccuagcuguucagggccccacccccauuagaaucuuccuuugccugagaacccuacucucugcuagaugacagcaaaugcagugaauucauguuguaauuaugacuuucugcaccuugaaauuuggugacuggaaauuuuaggcauugcuguugauuaguagggaaacauacauuuaauuuuucuuccucugcuccugucugccugcaaauagaauuuguuacaguuuuucugguagcguauagacaccagguugaguacagggccuauuguugacugauuguugccuccggcagaaagagcgagcagauuuccuuuacaacacuauuccaguuaaagaguaguggccgggagugaugggugauggcucacgccuguaaucccaacacuuugggaggccgaggaggguggaucacuuaaggucaggaguuugagaccagccuagccacuauggugaaacccugucucuacuaaaauacaaaaauuagccaggcgugguggugggugccuguaaacucagcuaccugaaggcugaagcaggagaaucacuugaaccccggagguggagguugcauugagccgagauugcucuacugcacuccagggcaacagagcaaaacucugucucaaaaaaaaaaaaaaaaaaaaaaaagagcggaggcagugugguuccaauaaugguucagggggccuguucccugcauuccuuuaucgaaggcucugugcuuggcucagagcuugugaacacaggcgguuguuuaguacucaccaugugguuaccacacaugggugccucucacuacgugauggguaauuugcaagaggacucacaaaggagguuugggcaugcaccuuauauaaagagagguuucaacacgugcuucugugcagcucgaaggagcuuaaggagcaagaagauagcuggaucuggaaaacuccuuuaugagaaggaugauggacucagaugcucugagagcauuugcugccuuuugagaauugugccuuguaauauugaucuuucuuuucucgcaaagccacgauggcacugauucucccccugaugcugaugaggugguuaucguccucaacaacuucaaaagcaaaauuauuaaagugaaggugaguuugguaaaaguaguggcauucuguuauuggacagcugucauuuaaaaauauguaucuuggaaccagcccaagagucucuuuggaauuugcuauggcaauuauagggauacugcuuuaaggcaaaaugucuuuguaacugugaguuuguggcuucccucaacugaaagauuguaccuuuuggguaaucucggugugcagaacaugucccaucuuauauaaaauauucucauagaugcuauguuguuuauauagccacaauucauaguguuguugaugauucuuuucucaauauugggggaacuggcaauggaaauuuucaacaauaauaaaaugauaguccuauuuaauuucuuuugacuuguacuuuccguucucugaauguugaagcucuuagugccuuaaauucaaguacaguauauucuugaagaaagaaucauuacacacagugaaaccuaaaauaggccauccauuguugagaagaaaaauggucacuguacugccaagaagaaaccccuguuugugcuagugaauccugaaaacuggucauaacaugaaauaccucccucccaacagcuagagcccccagcagccacacucuucccuggaacuagcuguugacucauugaaucgugcuucugguuucacugcacaguugaguuugcggcucuuugccuauguugcaagcugaaaaugggguucaucuaauuaaaagagguugcugucuccucacauaagguuaugaugugaauguccuggcgaagauacuucuauugaauccuucuagacucugggugggguugugccuguuugugagagaauugauugauaauucccuauugaugacaggcucacaguguauauccagugagaggcaguuuuaugccugugagacauacugggaguaagguuuaucacauuugauugcagguucagaagaaggcagauauggugaacgaagacuugcugagugauggaacgagugagaaugaaucuggauuuugggauuccuucaaaugguaaguugacauuguaagaguuauguuuuuaaggaaaaacugagauauaagcaccauccaucccuccuuuuugcaucuugugauucugucugggccuuucacauucuacuuugugcagcuacaucucacacuuauauuuggcauagaugaguauuuuccacucgauugauccaaaagagguucaugucuccuaguggggaaguuacuucugcuccauacuuugugacucucauugccuguaccugcucuuuggaaauuugacugcucccugcucaguuuacuucccguuguguaaguugcauucuggugcagccuguguucagucucuuccuaaaacaacacugucggagagugaacauucuuuuuguagguugguuuugucagucuuguggucucuccagggugugagggaagcuucauaaccacuccugcugcagcucacccgcuagggaaggaugggaagcgcagucucuuuccucuuacuuucaaaggccgugugucuguaugaguguuucaaguggucuuuuuuuuacccuuauuguuauaggggcuuuacaggacagaagacugaggaagugaagcaagauaaagaugacauaauuaauauuuucuccguugcaucuggucaucucuacgaaagauuucuucggucagucuuguugauuauuucauuauauaugaugaaugaauuggucaguguucuuauuuagagaggaaagguuuugugggauucugcucauuauacuccugugucuuugaagcacucugagcauugugacuggcuugccauuuaucauuggauuuguuuugaucccgccgucucugugaaguugaacuauguagugagugcuucuggauauuacaaggcugcagcccuuuaacgucacuguacacauucauagacuguacuguuuacugccugccaaacauugcuuaacccagagauuaggagguugacauagagaauagaaucagaacagaaccauggaauacuucacugccuuguaaagauucacaggauuuuagagccaggagagagcuuaguucuuacaugugaacacuucuguuuuauaaacaggcugaggccccgagugugaagggacuugucuaaggucacacagcuacagccagaagaggccacgggcuagggcugccugauguaguggucaccagaggcacugucaggaaggccugagagucacuuuucucauugccagggcucuguucacucuuaauuuuucacuacagaucuaguauagaaaaucaaaaugucauuugucucauuuuuagcccucuuauuuccaagaaauaauauccuaccuaaaauagugacaauaauaacaaccgaauuugguuaaauuccuccauucaaaaaugugguuuuguuuucugaguaaggaggccggagcugguagccuuccucucuaaagcagggccucuguguaggcugcaggaggcgcugugguuacacauucuucccuuagcaccagaugcugaugucaugugacaggaguuuuggggagugaugucaguuaccccgauuuccaggguucaucuggaccauaacuaauauaucaguucaugaagcaguuuauuuagagguguaacagaauuaaaacauuugccucugucaguuaaguguaguuuuauaggugaggaaugccccuucucuuuagugauaacuucauaaguuggaguaaguacaauuuuucauuuuccaucacugagcgucucccucggccuaauugagccauuaguuagcucugccguaaagagcauuuaggugucucgugauugacucuacauaauguugagguuaaauaacauuggaaagcuguuauuaauuaccugcuuuuguuuggcagcauaaugaugcuauccgugcugaagaauaccaagacuccugugaaauucugguucuugaagaauuacuugucccccacauuuaagguuuguuucacagagaaagggaaaacauucuuauuaaggagauauuuacuguauauuuuucaugacuuuuguuuuaucuguauacuuuagcaaauuuuccauuuacuaagauacccuaauuugguugcauauuuuuauuuugauuauucuuccagauuggucuauuugaaggaaacaguuaaauuguguuuaaaaacuuggaugauaugguaggagagucuuuuguuguuguuauuauuagcagugucuuacugagauaacguuuccuuccucugaagccugcaugcuugcuuuaauuuagaaagcacagcgaugguuuacauugaagagaaugauugguguuagcaugaaccacuccuagaugauguauggaaguagugcuuccucugugcaaaacaaaacacguacuuggaauguuuucugcauuacuuauaucagucaguauuugucaucuaaguugauuuauuugcauccuuuuuuuuucuuguagaauuuacuaagugacuuuuaauauauucaauaaccauucuccuugauaagcacuuuacugcuggcgccuaaaggugcuuauacuuagaaucugaaagacuuauucaaaaaggacaacacauuuguccagaguucuggcuuugcaguguuauucccuggguuagaucuggccucgaggaaggcuugucaucaagcucaguaaaugccuuacugaaaucaaguuuagacaaauggacuuaaaguucaugugcuguaaaaacacacacagagggauauacaucuaaaauccuucucuugaacauucugucauuucauguggugaccagaagucauaaagaaauggggauuugacaaagguuuauaucuguucuucuauguagucaugagugggucacggccggucuuuguaagaccacuguuuugguaaauguguuuuauuugucccguaucauggugguuggcuuacauuaugaaagcaguuuucuuaaucagaagaaaugauuauuuguuguucccaugucuaaaaauaggaguuuauaccuuacauggcaaaugaauacaauuuccaguaugagcuuguucaguacaaauggccccgguggcuucaucaacaaacugaaaaacagcguaucaucugggguuacaagauccucuuccuggauguacuuuucccacuaguuguugacaaguuccuguuuguggaugcugaucagguaggcccuuaaaggccaaguuuugacaguuuguauuaaaagcaacaaauugcuucuuuuuaaaugcuauuuuuuccacuuauggaaaaggacaugcuuauuuuacauuuagaaaauaugaaaauauguaucacauagaugucaucacuuuuuaaauuugcauuuagcuuaucuccuuuacaucuuuuucucugucuuuuuaacaucauugugaugacauaaugugugcaguuuuguaucugacuuaauucauuuaacaugaaaacuaaaaauuagaaaauuaacauuuagcagugcuugccaucaucucuaauuaucugcccaaaagauaggaguuauugucauggguaauagacgaagcuuaaguggauacauggcuuuggcaguagggaaccuccggauauucuuccggccgucaggguuugacuuagugaaagggaacaugugauuuuagagcauacaaacucaaacagcauaaguguacgucugcccacagccuuccacuucagcccgagcgggcggaaacccaagucagccaccugaguggaaggauguaaugugugugaaagucacugggacagagacuucacucaccucuuuggaauucucuuccacuggcuuagccugaagugugccuuccugauuguaacauagccacauuuaauccuuguugaguacuuacgaugggcaaggcauuauucuacaucuguccauccauauguuaacuuacauaauccucccagcaacccugugagauagguacugucauuaucauuaucuccauuuuacagaugaagaaacugaggcacagaaaggcuaagcaguugaaauuuguuuuauuccuacucccacacaccuugcuaagaagugucuuacauguuagugagucaaccagguaauaaguggagcaaucaaagugcaucugccccuagugccugugccacuaaccacggagcagccuuccaugcugccuuaagcgagccacucuguaucugaaggaaaccgcauuagagcugucugcaugguugcuuaacaaaugacuuuuuauauucuccagauuguacgaacagaucugaaagaguuaagagauuucaauuuggauggugcuccuuaugguuacacuccuuucugugacagccgaagagaaauggacggcuacagguucuggaagucaggguacugggccagucauuuagccgggcgaaaguaucauaucagguacugaaaagaagcacuccuaacacuguuacgggguuuuccuuaaaauugauuuugugugguuaaaauugugaauagguaauacauugguaugguugaaaaauaaaaaugauaaaaaauacacaguggcugggugcaguggcucaugccuuaaucccagcacuuugggaugccaaggcagguggaucaccugaggucaggauuucaagaccagccuggccaacauggcgaaaccccgucucuacuaaaaauacaaaaauuagcugggcaugguggugggcgccuguaaucccagcuacucgggaggcuaaggcaggagaauugcuugaacccaggaggcggagguugcagugagcugagaucacgccgcugcacuccagccuggaugacagagugagauuccaucucaaaaaaaaaaaaaaauacaguguaaaaaaaacuuccuaauccugucucucucuuuccuacucaguuccuguucucacagcagauaaccucccaacuuauugacugucuauccuuccagauuuucuuaauucuuacagaaacagcugugaauguguauucuuuuuuuuuuuacacaaaauaugcuaccuauuuauacauuuuguaacuuggcuuuuuuuuuuuuuuuuuuacuuaaugucauauacaucuucucagugaauagagagagaccugauuccuuuucauagcugcauauuauuccagugugugaguguuauuuauaguuuucccugugaccuacaauguugcaaugaauaaucuacuaaauaauuuuucauaucucauauauuugugagauaaauuccuagacguagaccuuuuaggucgaacaguguguguguuguuacauuucuaaugagcaccccauucucuucucugcgagaagugugauuugaagaugugcagggaagaggaacguguaggaagcggcacaugcagagaucacugcugggguuuagugaugguggcuucauucuuuacauuccugguccaaaagaacuguaaggacuguaacacucugggguuuuccccccccuguaacauugaagacaucaucaggauaucauugaauaaugguuguuuaucaguuacuauggcuuuuguuacugccgcauaugcuagaaaucuuuggucugagauuauuucuuucggauggcaaauacagaacaguaacaaaagcauagcacaguauagauuuugcagugacuuucuuagagaucuuuaaaguagcacacuuuaacuccacuguagggcuguagcauaccuuuucaaagaaaagccagaauauuuggcuaguggccuguuccauuauucauuggguuuaguuuuccugucguaauccaugguugguuguaacaagcgggucuucuuuauucagugcacuauauguuguggaucugaagaaguuuaggaaaauagcugcuggugacagacucaggggacaguaccaaggucugagucaggacccuaacagccuuucaaaucuugaucaaguaaguguccauuuuuuaugguuaacugugagugacggguauacaguguugcaucagaaaaugaaguauuacuugugucuucaguccucuccucacaggauggcgucuuguuuuuucauggugugugugugugugugugugugugugugagagagagagagagagagagagauuuuuaucugcccucaagacauaucagcgugaaaaaugucauagauuugaugcuggcuggggagagagauggaaggagaaugcugccucucugaaccauuagcauaucuuuguauuuuguacucaaacuaaucucauagguuuguuucucuaccuacuagggucaguuuguuuuucugcuguaggaacuaaauagcucaggauucguaguauagaaucacaguauaguaucacagcuuccccuuuuucuaugucagaaaccaugauguguuucaaggcuagcuaaauuacuguuuguuaauguuaagcauuuuucagaggugagauuguaguuuaaggguuuuggauacauauuucacauauuuuaagcauuuuauuuugcuuaagucuacuuaaauguuuuuaaaccuuuauugugauauguagcauccauaaagaaaaguauacaaaaaacauacauacauauucacauacauccaggaauuauuaugaagcaaauacccagauaccacaaccuaguucaagaacuagaacauuaucagcaucccagaagccauccuuccucccuaacaaaagugucuagcaucacgacuuuuaugguaaucauuuuuguuucuuuauagauuuacuguuuaagcauguauccauaaacacuaguuuaauuugcucauuuucuucuccucuaucucaauggaauaauaaaagguaaacuuuuuuguuuguuuguuuguuuugagacagaaucucacucuguuucccaggcuggagugcaguggcaugcucuggguugcacucacugcaaccuccaccucccggguucaagugauccuccugccucagccuccugaguaacuaggauuacaggcacgcaccaccacuccuggcuaauuuuuguauuuucaguagagacaggguuucaccauguuggccaggcuggucucaaacuccugaccucaagugauccacccgcuuuggccucccaaagugccgggauuacaaucacgagccacagugcccggcucuacuuacuuuaaaauuugugugauaccugguaucuucuaauuuauggagcuacuauggaucugauucuguuguauuauuucuguuauucuuuuguucauacugucuaucacauauuuguuuaucuucuguagugugucaggcguuguuuuugcagaauuauuuuggggaauaauuugaguucaaaaaugguaucacccaacaguauuuguuucucucuuuuuuuuuuuuuuuuggagauggagcuuuguucuuguagcccaggcuggagugcaguggcguaaucucagcucacugcaaccucagccucccgagcaggugggauuacagaggcgugccaccacacccagcuaauuuuucuguauuuuuaguugagacaggguuucaccauguuggccaggcuggucuugaacuccugaccucaggugauccacccaccuuggccucccaaagugcugggauugcaggugugagccaccgugcccggccuuuuuuuuuuuuuuuuuuuuuuuagacaaggucucacucugucacccaggcuggagugcagugaugcgaucauggcucacugcagccucgaacucccaggcucaggcgauccucccaccucagccuccugagcagcugggacgacaggcucacaccaccaggcccagcuaauuuuuuguauuuuuuauagagaugggguuuugccauguugcccuggccagucuuggaacucccgggcucaagcgaucuacccacuucagcagcuauuuuuaaauuuuagucuguuggcaggguuuuguagagaaguaucaucuauuuauuuuuguaccaucauggaacauucuuuacaaguaucgcagucaaucauuucuguacauuuccuuguuccauguaagucuuaggacaauggaacauuuuauuguggcaaagucagaaggacuccacaggaaaaagguuuaaagcauaggguagcauuggcuagaaaaaaugucgucuauuugggagcaagucucaauagacaagguagauucagaacuuccuugacagaagccugcaaaauuuacgaaccaccacucuauuuaguugacuuucagaagucaguaggaguauuuuucucaggauugcccuaaugaagggaggguuaggugcaggcuguuuguaaguuuuaagccaaagcuuuucaguugcuuauuaugggcagauguuuuauggauccucuaaaauuuguaguuuugaauaacuucucuaaggcauugguaaggaccuuuuccauuuuaaacauuugugauuggcaugugaucuguaacgagcagcuguacaucacugauguucuauacguuugucuccacacgaacuggcugggugcaguggcucaugccuauaaucucagcacuuugugaggcuaagguggguggaucgccuaagcucagcaguuugagaccaaccuggggcaacauggcaaaacgcaucucuaguaaaaauacaaaaauuggccaggcaugguggcgggccccuguagucccagcuacucaggaggcugaggcaggagaaucucuugaaccugggagguggaggcugcagugagccgagaucguacuacugcacuccaaccugggugacagagugggaccccaucucucaauaaauaaauaaauaaauaucgccagaacuuuagauacauguauuuuauuuuuauuuuuuuuuaaccaaacaggaucugcccaauaacaugauucaucaggugccaauuaaaucccucccucaagaauggcuuuggugugaaacguggugugaugacgccucuaagaaaagggcaaaaaccauugauuugguaagccguauguggugugcuucugcauguucauccacuggaugugugagugaaucacgauuaaugauuuuuauuuagauucuuaaauuuaagaauuuccuagauucuuauuuagacuuucucuguaauuguguaguuugucggggcuauucuuaucuuacagaauauucuuauaaauauucuuaucuuauagaauuaguaucguuuguuguauaguaagcauaaguauauaguuuguuggggcuauucuuauagaauauucuuauaaauauucuuaucuuauagaauauuucacugguuuuauuucccugcuuacauuaggaaaccaaaucccuuagcacuuaaugggacuguuuucacaacuuacaaucugcugagucacuccuuggcuuccaguuuaucucugugccuuguaauuuuuccaaauggacuuucacuuuuccugccuuccauuagccacucacacauucuuuguagauguaaauacagcuuuacauagcccacuaccauauugcuucugguaguauaucauuugguuccuuacuauuguuuucuuguccaguuaggacuuguaacccaagaaccuuugaauucucuaucauguggccuuucuucaacucagcugaaguguguucuuuugguuucacaguguaauaauccgaugaccaaagagccgaaacuggaagcagcugugcggauugucccggaguggcaggacuacgaccaagagaucaaacagcuacagauccgcuuucagaaggagaaagaaacgggagcacuguacaaagagaagacaaaagaaccaagccgagaagguaagcacaaaccguugguuuuaggacaguacuucuuuccauuucugauuucugcuuguuguaaagacaauagaauaauggauaaaaggaagagaaaaaucuccuauuaauccuuccauucuaacaucaaccaguauauauuuuucauuuuccuuuuauguuggucuucuaaacaguauuuauuagugcaauugcuauguuuuuuuuuuuuucucguuuuucuggugagggggagaaaggguauuuuaauugugauuauaguuauuuagguucaugaguuuugugauacauaaaccaaaccuuuugcagaguucuucuuagauuccuuguuuuuuuuuucauuaaaucugucaguguacuagugaaugaaaaaauuuagaucaacacaaauauguaguugaagaaacuuuuuuuuuuuuuuuuugagacagagucucacucuguugcccaggcuggagugcaguggcaugaucuuggcucacugcagccuccaccucccagguucauguguuucucaugccucagccucccaaguagcuggaauuacaggcaugcaccaccacacccagcuauuuuuaaauuuuauuuauuuuuuauuuuuuguaguuuuaguagagacaggguuucaccauguugcccaggcuggucucaaacuccugacccaagugauccgcccgccucagccucccaaagugcuaggauuacagacgugaggcacugcgccuggccgaaaaaaguauucuuuaaaacaagcauguugggauggagauggaaugcuuguauuuaauuuaguguuaagucuuuaaugucuucccuguugugugugucuugaaugauagcuacuugaaaaaaucauuagaauacgaaauugacuuuuuaaaauauuaauaaguugggcucuagauuuaagaaaaauuuuaaauguauuuauuuuuaaauugucacguaauaauuguacauauuuguggaguccauagugauguuuugguauguacaugggcucuggauuuuuaagauuuauucugcuuuagacuaauucuaaaaaaguggcugggcacaguggcucaugccuauaauccuagccucucaggaggcugaagucggaggauugcuugagccuggaggucaagguugcagugagcgacugcacuccagccuagguaacagagagagaaccugugaccaagcaagacccugucucaaaauaaaaaaauccagaacauggaucuugggugauuugccuauacaucccucagacuguacuaugauauuaaauaucacagcuggaagguuauauaguaaccauaaaaguaauuaauuccgauucaucaguaaaacccugaggauuuccauagauaaaugggcaaagaauguggacacacuguucaaguaagaggaaacacaaauaauaaaugaauuugaggaaacaguaaucaaauuaaagcagucuaucacuaguaucugcuacauggaagaaaacagacauagugauaaugccauuuguuugggaggcggugaugaaaccguuguggauguagcuugaugaagcuuuguguauuggaauagcccuuguuacaaagcaguacaucugccauuagaagcccguaaggcguuuauauacccucaagaauuacucucuugagaauauaucugaaagaaauaauucaacagaaaaaacaaaguuguauacaugaaaaaauuuauuuuacuauuacuuauaagccagaagcaucaaaaacaguuuaaacauccaagaaugagcuacacugauacauagaaaauguuuagaugcuauuaaaugauaaaagaaaaaucccgacuaaaaaaaugcaugcaacguuuacugaaaguaaauauuguauuugugaaaacaauucaguuggagugggguuuacagauaguuuccauuuuuaaaaaaucuuuaauuuaguuuuugcuuucaaaauacaguacaaaagcacaaaucccaaagauuuaguaagugagauaagaugaagguggagguacaaagaauagguuccagugaugaaaaaugcccacucagugguguuuguaauuugaagaucaucuguuuucuuuucugugguucuccuuuuccuuagguccucagaaacgugaagaauuaugaucucuggagaaggacaggaaaucaccccauuugaaaaacaguuuuuauaauaaaugcuaguuuuuucugaucugucuauacaacugcugauaagccggcugggcaggagugccacaccuuuugauucugagcauuugauucugacuucuguacucugguggccacuggaucuuugggauuaaagcucuguuggauuuguaccucagaggaagaccaaguggcugauccuuuggacucuguaaagagcauucuucuagucagaggguggaauggcagcagcaacuggaagaaaaugaguuuuuuggugcccacacccaagagcacacacaugcugcacugucucggaaagcagggccagcuagagccaccauguucuuccuuaccucaguuuaccugcggccugcgcugcacugcagaugcccacccugcccugggucuggccggcggaagcucuguccaagguccacacaccuccagguuuacgccaacauccuugugcccuccccaccuucucuuccaacgcauuaggugcauuguuuaauugaaauccaaccaacaauugugugucaaggcugguuuggugcaguggcugggcaaauuaauuuugggccaggauggggguggguugcagugaggguagggaaaaugucaggaguaggaagguucggggguuaagggaagggaaggaagaccagaacuggccauccucuuuuauaauccauuaguagcaccauggcucauuugaaaugaaaauauuacacuuauuccccacccaaccgcagugaacuuucuagguaauuguuuugaaaacaauuuuuguaucugugaaagucuuugcuuuuucuuuccaccuucuagaaaagucugcuaccaguuuccuuacugaauacagccauacucagccccucucgcauccagcccgucagggucagggucagggucaggcucccucaagacgagcaccgcauugucugcccucuuuugcguaggauuuuucucucagacccaggggacauugccuuggacuuuucucuacaaaugcccucagauguaagaccagaaaugauucugcuuguggaacucguggcuuucuguccuauuuuccuuuuaugugagcccugcagguugccuuuggcgcccacaccaguucugucuucaugucgcugcaucgugaagccccauuugccuuuagucccugcuuugugugucuucacuuccacagccaguguugccccucagggcauacuuugcuggugaacgggcuguagagucuugaguauguuauuggccuaagugggcaugaggccccagcauccgacuccaucugccaggcugcagggcacagcagcacuggcauagacaggcacgcucugucuuccaacgugcaccagccuuuucuuacauauuuugccuguuuuuaaaaaauacgaggagagggugcagauggauacugugcccucacccuccuaagccagguaauauauugaugugcagacuuuuaagaaaucuuagucuuaucacaaauaucaaguaauuuauuuuuuccauuuucaaaugcaaaaguuagccuaggaagccucccagucauccugaaggaccuuuugacuuugcuuuuauaauucuguuaaaaauugaggaggggauuaaugaguacaaugaaaacaaaacaaaacaaaaaauuaagaagaggaaagcucaaaagaggauaagagacugaaaaggcaccucagaauggcugcugugggcagagucugugacaugacuuuccccgcccugccccucuguucagagcagcuggaaagaugggaucaguaagauuaaaaaacuuuuguucggccaggcgugguggcucacaccuguaaucccagcacuuugggaggcugaggcggacggaucaugaggucaggaguucaagaccagccuggccaauauggugaaaccccgucucuacuaaaaauacaaaaauuagccggguguuguggcucacccucuauucccagcuacucgggaggcagagacaggagaaucgccugaacccaggaggcagagguugcagugagcugagaucgugccacugcacuccagccugggugacagagcgagacuccaucucagaaaacaaacaaacaaaaagaaacuuuuguucaagcugcaucuucacauugaaugaaagcauucagacgggugacugcugcuguccacaacugugggcggaagugugccuuuucccaguuucucguccaggagguugcauagcaaauacucaagucacugggauauaugcuuuccaaaugcuggcccccauagcaccuuuccccaugucuuucuaccaagccucuuauguuuaaucugugcagggaagacaagaguagaccauauucucugugugcugugcauguccuggugucacucauugccucuuaucugucgccauucuaauauaagucagcuuaauaguugacucugaauaaugcaaaacccagcuugcuuccagaauggccuaggacccuccuccuccugccaguuuuuuuuuuuuuuuuugguucauguggcauaaucaucuuucaaaauuaaccaaaugccccagaaaaugauguuaccacuaaaauauuuucuccaagaaggcauacuguaacagaaaagauagguaagauauuuuuuucccaagaaguaagaauugauugugcugaauguucaaacucuggaaacuguucacaguauguuguucuuagcuguuauuuauauaaagugaauuauuuucucucucaaucaugccauaguggagacuuuuguuugugaguaagugacagaguaauaugaaauaaugugauaugucagagugacaugcagcauccugagccuguuuuuauguucuguguacaguggcauuugauugagaucaaagccugucacagccugcugcuggggguguggggauaugccagaguccuguguuugguuuuagaaguuuacugaauguuucccacauggagaauaauggauggcauguuaguuucuuuaagagugguaaaguuguacaucugucauuguugcauuucgaauugaacacauagaugcuugccugucugcuugggugaaugccucuugggagagcgaagauuacgugcaugauguauguuaagaaacaguuuccggucaggcacaguggcuuacaccuguaaucccagcacuuugggaagccgaggcgggcggauuaugaggucaagagauagagaccauccuggccaacacggugaaaccccgucucuacuaaaaauacaaaaauuagcugggcaugguggcacacaccuguagucccagcuacucgggaggcugaggcaggagaaucacuugaacccgggagguggagguugcagugagccgagaucaugccacugcacuccagccuggcaauagagcgagacuccgucucaaaaaaaaaaaaaaaaaaaaaaaaaaaauuaaaacaguuuccauaaauggagcuuaauuugcucugcuguccuuaagcccucguggguuuuuuuuuaagagagucucauucugucacccaggcuggagugcaguggugcgaucuuggcucacuucaaccucugccucccaaguucaaacaauucuccugccucagccuccugaguagcugggauuacaggcgccugccaccaugccugguuaauuuuuguauuuuuaguagagaugggguuuuaccauguugguuggccaggcugaucucaaacuccugaccucagguggugaucugcccaccucggccucccaaagugcugggauuacaggcgugagccacuauguccggucaagcccucguguucugaaccuugucaaggcucugccugaaugaguuuucaucugauuguggggaccaagucccugaguagagggccaagagcuagggacagggggaagagacuggcccaggugguagggaggaaagaacucccagaguuuccuuuagccaggaaaccugcucuacugaccccgugacuuggacagucagacaucacccugagagugacaaguguaaaaugacucccuuccucccccgcccuccggaaguauauuuagauacuugaaagcaguccuuuucuaaaauggccuuaccuauguggccugaacgauuaaaagaaagaacucagaguuacaagggaaaaagaaaaagaguuacaagggaauuguagucuuuuucugaauagaauauuaguacugugguauugcauuucaugggaauggaaauguauugguaaagcuaccugauggaagcuuucucuugguaacaaaaauggaggguguauuaugugcaguuauuuaaauauauguauuccauuguugcgugguuuuuuuccccccucaagacagagauuugcucuuguugcccaggguggaguacaauggugugaccuuggcucacugcaaccucugccuccuggguucaggugauucuccugccucagccuuccgaguagcugggauuacaggugugcgccaccacacccggcuaauuuuugcuuuuuuuuuuuuugagacagaaucucgcucuguugcucaggcuggaguggagugcaguggcacaaucucagcucacugcagccucugccucccggguucaagagauucuccugacucaaccuccugaguagcugggauuacaggugccugccacuaugccuagcuaauuuuuguauuuuuaguagagacgggguuuugccauguuggccaggguggucucgaacuccugaccucaagugauccacccgcaucggccccccaaagugcugggauuauaggcgugaaccaccgcgccugucccauuguuguguaauuuuaauaauuaguuuuuuaaguacuugauuuuaugggcacauuuuugugggaugauuggaguuaaucaaauaaagcuugucauguguguaguuugguaagauaacuucuuuaaauucauguuuucucugccuugagguagugagggaaagaucuuaaucaguauuuugguaauuaacugauugaauucaagcaaaugagacaucaugaacuucagugguuauugauauuucaggguauauaccugaaaugccuagaggauacagauuucucauuucauucuuuggucuuucauuucucuauauacagaaaugaaaugacacuucugggaggcaguagaagcaggaagucaaugaauugaguagagggucccauucccucaggcugucauugaucagugacaauuuauaaaaacaaacugcaaagucuguggcaaguggcugccugcuuccuagaaggagcccaugaagguuaaacucuguggucgguauuugcaagcgccgggcgugguggcucacgccuguaauccuagcaccuugggaggccaaggcaggcggaucacccgaggucaggaguuugaggauuugcaagcaaaagguccucuccugagucuuucccagauacccagcagugcagaggcuagcuguggaagguugcagugggacaggaauguauuguaugccuugccuuacuugucaccauugagauuuccagagaaaugggcauaacgucucuuaacaacaacagcagaaagcaaaauacauuaacuuaagguugacaacaaaagauuaucaaguaccauguuuuccaaccaaccaguuauucgugguaauaauaaaauaaaggugggaaaauguuauaauuuuuaaggaaacuguguacuuuaaaaaucuucuuuaugaauauccaauguuacuguaauccugcuccauuaaaugcagcauuguugucaggugcugccucuugcuugggaacagcauugggcuuuuaaaugucugcagaaucucugcguucgaagggaauugagaaugaacuuccugguacuguaaugaaaauaaggucugcucaacacaguaaacguuuccucucuucuuuaa

SEQ ID NO: 191101 - RNA, 104496 nt, Homo sapiens
uuaaagaagagaggaaacguuuacuguguugagcagaccuuauuuucauuacaguaccaggaaguucauucucaauucccuucgaacgcagagauucugcagacauuuaaaagcccaaugcuguucccaagcaagaggcagcaccugacaacaaugcugcauuuaauggagcaggauuacaguaacauuggauauucauaaagaagauuuuuaaaguacacaguuuccuuaaaaauuauaacauuuucccaccuuuauuuuauuauuaccacgaauaacugguugguuggaaaacaugguacuugauaaucuuuuguugucaaccuuaaguuaauguauuuugcuuucugcuguuguuguuaagagacguuaugcccauuucucuggaaaucucaauggugacaaguaaggcaaggcauacaauacauuccugucccacugcaaccuuccacagcuagccucugcacugcuggguaucugggaaagacucaggagaggaccuuuugcuugcaaauccucaaacuccugaccucgggugauccgccugccuuggccucccaaggugcuaggauuacaggcgugagccaccacgcccggcgcuugcaaauaccgaccacagaguuuaaccuucaugggcuccuucuaggaagcaggcagccacuugccacagacuuugcaguuuguuuuuauaaauugucacugaucaaugacagccugagggaaugggacccucuacucaauucauugacuuccugcuucuacugccucccagaagugucauuucauuucuguauauagagaaaugaaagaccaaagaaugaaaugagaaaucuguauccucuaggcauuucagguauauacccugaaauaucaauaaccacugaaguucaugaugucucauuugcuugaauucaaucaguuaauuaccaaaauacugauuaagaucuuucccucacuaccucaaggcagagaaaacaugaauuuaaagaaguuaucuuaccaaacuacacacaugacaagcuuuauuugauuaacuccaaucaucccacaaaaaugugcccauaaaaucaaguacuuaaaaaacuaauuauuaaaauuacacaacaaugggacaggcgcggugguucacgccuauaaucccagcacuuuggggggccgaugcggguggaucacuugaggucaggaguucgagaccacccuggccaacauggcaaaaccccgucucuacuaaaaauacaaaaauuagcuaggcauaguggcaggcaccuguaaucccagcuacucaggagguugagucaggagaaucucuugaacccgggaggcagaggcugcagugagcugagauugugccacugcacuccacuccagccugagcaacagagcgagauucugucucaaaaaaaaaaaaagcaaaaauuagccgggugugguggcgcacaccuguaaucccagcuacucggaaggcugaggcaggagaaucaccugaacccaggaggcagagguugcagugagccaaggucacaccauuguacuccacccugggcaacaagagcaaaucucugucuugaggggggaaaaaaaccacgcaacaauggaauacauauauuuaaauaacugcacauaauacacccuccauuuuuguuaccaagagaaagcuuccaucagguagcuuuaccaauacauuuccauucccaugaaaugcaauaccacaguacuaauauucuauucagaaaaagacuacaauucccuuguaacucuuuuucuuuuucccuuguaacucugaguucuuucuuuuaaucguucaggccacauagguaaggccauuuuagaaaaggacugcuuucaaguaucuaaauauacuuccggagggcgggggaggaagggagucauuuuacacuugucacucucagggugaugucugacuguccaagucacggggucaguagagcagguuuccuggcuaaaggaaacucugggaguucuuuccucccuaccaccugggccagucucuucccccugucccuagcucuuggcccucuacucagggacuugguccccacaaucagaugaaaacucauucaggcagagccuugacaagguucagaacacgagggcuugaccggacauaguggcucacgccuguaaucccagcacuuugggaggccgaggugggcagaucaccaccugaggucaggaguuugagaucagccuggccaaccaacaugguaaaaccccaucucuacuaaaaauacaaaaauuaaccaggcaugguggcaggcgccuguaaucccagcuacucaggaggcugaggcaggagaauuguuugaacuugggaggcagagguugaagugagccaagaucgcaccacugcacuccagccugggugacagaaugagacucucuuaaaaaaaaacccacgagggcuuaaggacagcagagcaaauuaagcuccauuuauggaaacuguuuuaauuuuuuuuuuuuuuuuuuuuuuuuuuuugagacggagucucgcucuauugccaggcuggagugcaguggcaugaucucggcucacugcaaccuccaccucccggguucaagugauucuccugccucagccucccgaguagcugggacuacaggugugugccaccaugcccagcuaauuuuuguauuuuuaguagagacgggguuucaccguguuggccaggauggucucuaucucuugaccucauaauccgcccgccucggcuucccaaagugcugggauuacagguguaagccacugugccugaccggaaacuguuucuuaacauacaucaugcacguaaucuucgcucucccaagaggcauucacccaagcagacaggcaagcaucuauguguucaauucgaaaugcaacaaugacagauguacaacuuuaccacucuuaaagaaacuaacaugccauccauuauucuccaugugggaaacauucaguaaacuucuaaaaccaaacacaggacucuggcauauccccacacccccagcagcaggcugugacaggcuuugaucucaaucaaaugccacuguacacagaacauaaaaacaggcucaggaugcugcaugucacucugacauaucacauuauuucauauuacucugucacuuacucacaaacaaaagucuccacuauggcaugauugagagagaaaauaauucacuuuauauaaauaacagcuaagaacaacauacugugaacaguuuccagaguuugaacauucagcacaaucaauucuuacuucuugggaaaaaaauaucuuaccuaucuuuucuguuacaguaugccuucuuggagaaaauauuuuagugguaacaucauuuucuggggcauuugguuaauuuugaaagaugauuaugccacaugaaccaaaaaaaaaaaaaaaaacuggcaggaggaggaggguccuaggccauucuggaagcaagcuggguuuugcauuauucagagucaacuauuaagcugacuuauauuagaauggcgacagauaagaggcaaugagugacaccaggacaugcacagcacacagagaauauggucuacucuugucuucccugcacagauuaaacauaagaggcuugguagaaagacauggggaaaggugcuaugggggccagcauuuggaaagcauauaucccagugacuugaguauuugcuaugcaaccuccuggacgagaaacugggaaaaggcacacuuccgcccacaguuguggacagcagcagucacccgucugaaugcuuucauucaaugugaagaugcagcuugaacaaaaguuucuuuuuguuuguuuguuuucugagauggagucucgcucugucacccaggcuggagugcaguggcacgaucucagcucacugcaaccucugccuccuggguucaggcgauucuccugucucugccucccgaguagcugggaauagagggugagccacaacacccggcuaauuuuuguauuuuuaguagagacgggguuucaccauauuggccaggcuggucuugaacuccugaccucaugauccguccgccucagccucccaaagugcugggauuacaggugugagccaccacgccuggccgaacaaaaguuuuuuaaucuuacugaucccaucuuuccagcugcucugaacagaggggcagggcggggaaagucaugucacagacucugcccacagcagccauucugaggugccuuuucagucucuuauccucuuuugagcuuuccucuucuuaauuuuuuguuuuguuuuguuuucauuguacucauuaauccccuccucaauuuuuaacagaauuauaaaagcaaagucaaaagguccuucaggaugacugggaggcuuccuaggcuaacuuuugcauuugaaaauggaaaaaauaaauuacuugauauuugugauaagacuaagauuucuuaaaagucugcacaucaauauauuaccuggcuuaggagggugagggcacaguauccaucugcacccucuccucguauuuuuuaaaaacaggcaaaauauguaagaaaaggcuggugcacguuggaagacagagcgugccugucuaugccagugcugcugugcccugcagccuggcagauggagucggaugcuggggccucaugcccacuuaggccaauaacauacucaagacucuacagcccguucaccagcaaaguaugcccugaggggcaacacuggcuguggaagugaagacacacaaagcagggacuaaaggcaaauggggcuucacgaugcagcgacaugaagacagaacuggugugggcgccaaaggcaaccugcagggcucacauaaaaggaaaauaggacagaaagccacgaguuccacaagcagaaucauuucuggucuuacaucugagggcauuuguagagaaaaguccaaggcaauguccccugggucugagagaaaaauccuacgcaaaagagggcagacaaugcggugcucgucuugagggagccugacccugacccugacccugacgggcuggaugcgagaggggcugaguauggcuguauucaguaaggaaacugguagcagacuuuucuagaagguggaaagaaaaagcaaagacuuucacagauacaaaaauuguuuucaaaacaauuaccuagaaaguucacugcgguuggguggggaauaaguguaauauuuucauuucaaaugagccauggugcuacuaauggauuauaaaagaggauggccaguucuggucuuccuucccuucccuuaacccccgaaccuuccuacuccugacauuuucccuacccucacugcaacccacccccauccuggcccaaaauuaauuugcccagccacugcaccaaaccagccuugacacacaauuguugguuggauuucaauuaaacaaugcaccuaaugcguuggaagagaagguggggagggcacaaggauguuggcguaaaccuggagguguguggaccuuggacagagcuuccgccggccagacccagggcagggugggcaucugcagugcagcgcaggccgcagguaaacugagguaaggaagaacaugguggcucuagcuggcccugcuuuccgagacagugcagcaugugugugcucuugggugugggcaccaaaaaacucauuuucuuccaguugcugcugccauuccacccucugacuagaagaaugcucuuuacagaguccaaaggaucagccacuuggucuuccucugagguacaaauccaacagagcuuuaaucccaaagauccaguggccaccagaguacagaagucagaaucaaaugcucagaaucaaaagguguggcacuccugcccagccggcuuaucagcaguuguauagacagaucagaaaaaacuagcauuuauuauaaaaacuguuuuucaaauggggugauuuccuguccuucuccagagaucauaauucuucacguuucugaggaccuaaggaaaaggagaaccacagaaaagaaaacagaugaucuucaaauuacaaacaccacugagugggcauuuuucaucacuggaaccuauucuuuguaccuccaccuucaucuuaucucacuuacuaaaucuuugggauuugugcuuuuguacuguauuuugaaagcaaaaacuaaauuaaagauuuuuuaaaaauggaaacuaucuguaaaccccacuccaacugaauuguuuucacaaauacaauauuuacuuucaguaaacguugcaugcauuuuuuuagucgggauuuuucuuuuaucauuuaauagcaucuaaacauuuucuauguaucaguguagcucauucuuggauguuuaaacuguuuuugaugcuucuggcuuauaaguaauaguaaaauaaauuuuuucauguauacaacuuuguuuuuucuguugaauuauuucuuucagauauauucucaagagaguaauucuugaggguauauaaacgccuuacgggcuucuaauggcagauguacugcuuuguaacaagggcuauuccaauacacaaagcuucaucaagcuacauccacaacgguuucaucaccgccucccaaacaaauggcauuaucacuaugucuguuuucuuccauguagcagauacuagugauagacugcuuuaauuugauuacuguuuccucaaauucauuuauuauuuguguuuccucuuacuugaacaguguguccacauucuuugcccauuuaucuauggaaauccucaggguuuuacugaugaaucggaauuaauuacuuuuaugguuacuauauaaccuuccagcugugauauuuaauaucauaguacagucugagggauguauaggcaaaucacccaagauccauguucuggauuuuuuuauuuugagacagggucuugcuuggucacagguucucucucuguuaccuaggcuggagugcagucgcucacugcaaccuugaccuccaggcucaagcaauccuccgacuucagccuccugagaggcuaggauuauaggcaugagccacugugcccagccacuuuuuuagaauuagucuaaagcagaauaaaucuuaaaaauccagagcccauguacauaccaaaacaucacuauggacuccacaaauauguacaauuauuacgugacaauuuaaaaauaaauacauuuaaaauuuuucuuaaaucuagagcccaacuuauuaauauuuuaaaaagucaauuucguauucuaaugauuuuuucaaguagcuaucauucaagacacacacaacagggaagacauuaaagacuuaacacuaaauuaaauacaagcauuccaucuccaucccaacaugcuuguuuuaaagaauacuuuuuucggccaggcgcagugccucacgucuguaauccuagcacuuugggaggcugaggcgggcggaucacuugggucaggaguuugagaccagccugggcaacauggugaaacccugucucuacuaaaacuacaaaaaauaaaaaauaaauaaaauuuaaaaauagcugggugugguggugcaugccuguaauuccagcuacuugggaggcugaggcaugagaaacacaugaaccugggagguggaggcugcagugagccaagaucaugccacugcacuccagccugggcaacagagugagacucugucucaaaaaaaaaaaaaaaaaguuucuucaacuacauauuuguguugaucuaaauuuuuucauucacuaguacacugacagauuuaaugaaaaaaaaaacaaggaaucuaagaagaacucugcaaaagguuugguuuauguaucacaaaacucaugaaccuaaauaacuauaaucacaauuaaaauacccuuucucccccucaccagaaaaacgagaaaaaaaaaaaaacauagcaauugcacuaauaaauacuguuuagaagaccaacauaaaaggaaaaugaaaaauauauacugguugauguuagaauggaaggauuaauaggagauuuuucucuuccuuuuauccauuauucuauugucuuuacaacaagcagaaaucagaaauggaaagaaguacuguccuaaaaccaacgguuugugcuuaccuucucggcuugguucuuuugucuucucuuuguacagugcucccguuucuuucuccuucugaaagcggaucuguagcuguuugaucucuuggucguaguccugccacuccgggacaauccgcacagcugcuuccaguuucggcucuuuggucaucggauuauuacacugugaaaccaaaagaacacacuucagcugaguugaagaaaggccacaugauagagaauucaaagguucuuggguuacaaguccuaacuggacaagaaaacaauaguaaggaaccaaaugauauacuaccagaagcaauaugguagugggcuauguaaagcuguauuuacaucuacaaagaaugugugaguggcuaauggaaggcaggaaaagugaaaguccauuuggaaaaauuacaaggcacagagauaaacuggaagccaaggagugacucagcagauuguaaguugugaaaacagucccauuaagugcuaagggauuugguuuccuaauguaagcagggaaauaaaaccagugaaauauucuauaagauaagaauauuuauaagaauauucuauaagaauagccccaacaaacuauauacuuaugcuuacuauacaacaaacgauacuaauucuauaagauaagaauauuuauaagaauauucuguaagauaagaauagccccgacaaacuacacaauuacagagaaagucuaaauaagaaucuaggaaauucuuaaauuuaagaaucuaaauaaaaaucauuaaucgugauucacucacacauccaguggaugaacaugcagaagcacaccacauacggcuuaccaaaucaaugguuuuugcccuuuucuuagaggcgucaucacaccacguuucacaccaaagccauucuugagggagggauuuaauuggcaccugaugaaucauguuauugggcagauccuguuugguuaaaaaaaaauaaaaauaaaauacauguaucuaaaguucuggcgauauuuauuuauuuauuuauugagagauggggucccacucugucacccagguuggagugcaguaguacgaucucggcucacugcagccuccaccucccagguucaagagauucuccugccucagccuccugaguagcugggacuacaggggcccgccaccaugccuggccaauuuuuguauuuuuacuagagaugcguuuugccauguugccccagguuggucucaaacugcugagcuuaggcgauccacccaccuuagccucacaaagugcugagauuauaggcaugagccacugcacccagccaguucguguggagacaaacguauagaacaucagugauguacagcugcucguuacagaucacaugccaaucacaaauguuuaaaauggaaaagguccuuaccaaugccuuagagaaguuauucaaaacuacaaauuuuagaggauccauaaaacaucugcccauaauaagcaacugaaaagcuuuggcuuaaaacuuacaaacagccugcaccuaacccucccuucauuagggcaauccugagaaaaauacuccuacugacuucugaaagucaacuaaauagaguggugguucguaaauuuugcaggcuucugucaaggaaguucugaaucuaccuugucuauugagacuugcucccaaauagacgacauuuuuucuagccaaugcuacccuaugcuuuaaaccuuuuuccuguggaguccuucugacuuugccacaauaaaauguuccauuguccuaagacuuacauggaacaaggaaauguacagaaaugauugacugcgauacuuguaaagaauguuccaugaugguacaaaaauaaauagaugauacuucucuacaaaacccugccaacagacuaaaauuuaaaaauagcugcugaaguggguagaucgcuugagcccgggaguuccaagacuggccagggcaacauggcaaaaccccaucucuauaaaaaauacaaaaaauuagcugggccugguggugugagccugucgucccagcugcucaggaggcugaggugggaggaucgccugagccugggaguucgaggcugcagugagccaugaucgcaucacugcacuccagccugggugacagagugagaccuugucuaaaaaaaaaaaaaaaaaaaaaaaggccgggcacgguggcucacaccugcaaucccagcacuuugggaggccaagguggguggaucaccugaggucaggaguucaagaccagccuggccaacauggugaaacccugucucaacuaaaaauacagaaaaauuagcugggugugguggcacgccucuguaaucccaccugcucgggaggcugagguugcagugagcugagauuacgccacugcacuccagccugggcuacaagaacaaagcuccaucuccaaaaaaaaaaaaaaaagagagaaacaaauacuguugggugauaccauuuuugaacucaaauuauuccccaaaauaauucugcaaaaacaacgccugacacacuacagaagauaaacaaauaugugauagacaguaugaacaaaagaauaacagaaauaauacaacagaaucagauccauaguagcuccauaaauuagaagauaccagguaucacacaaauuuuaaaguaaguagagccgggcacuguggcucgugauuguaaucccggcacuuugggaggccaaagcggguggaucacuugaggucaggaguuugagaccagccuggccaacauggugaaacccugucucuacugaaaauacaaaaauuagccaggagugguggugcgugccuguaauccuaguuacucaggaggcugaggcaggaggaucacuugaacccgggagguggagguugcagugagugcaacccagagcaugccacugcacuccagccugggaaacagagugagauucugucucaaaacaaacaaacaaacaaaaaaguuuaccuuuuauuauuccauugagauagaggagaagaaaaugagcaaauuaaacuaguguuuauggauacaugcuuaaacaguaaaucuauaaagaaacaaaaaugauuaccauaaaagucgugaugcuagacacuuuuguuagggaggaaggauggcuucugggaugcugauaauguucuaguucuugaacuagguugugguaucuggguauuugcuucauaauaauuccuggauguaugugaauauguauguauguuuuuuguauacuuuucuuuauggaugcuacauaucacaauaaagguuuaaaaacauuuaaguagacuuaagcaaaauaaaaugcuuaaaauaugugaaauauguauccaaaacccuuaaacuacaaucucaccucugaaaaaugcuuaacauuaacaaacaguaauuuagcuagccuugaaacacaucaugguuucugacauagaaaaaggggaagcugugauacuauacugugauucuauacuacgaauccugagcuauuuaguuccuacagcagaaaaacaaacugacccuaguagguagagaaacaaaccuaugagauuaguuugaguacaaaauacaaagauaugcuaaugguucagagaggcagcauucuccuuccaucucucuccccagccagcaucaaaucuaugacauuuuucacgcugauaugucuugagggcagauaaaaaucucucucucucucucucucucucacacacacacacacacacacacacacaccaugaaaaaacaagacgccauccugugaggagaggacugaagacacaaguaauacuucauuuucugaugcaacacuguauacccgucacucacaguuaaccauaaaaaauggacacuuacuugaucaagauuugaaaggcuguuaggguccugacucagaccuugguacuguccccugagucugucaccagcagcuauuuuccuaaacuucuucagauccacaacauauagugcacugaauaaagaagacccgcuuguuacaaccaaccauggauuacgacaggaaaacuaaacccaaugaauaauggaacaggccacuagccaaauauucuggcuuuucuuugaaaagguaugcuacagcccuacaguggaguuaaagugugcuacuuuaaagaucucuaagaaagucacugcaaaaucuauacugugcuaugcuuuuguuacuguucuguauuugccauccgaaagaaauaaucucagaccaaagauuucuagcauaugcggcaguaacaaaagccauaguaacugauaaacaaccauuauucaaugauauccugaugaugucuucaauguuacaggggggggaaaaccccagaguguuacaguccuuacaguucuuuuggaccaggaauguaaagaaugaagccaccaucacuaaaccccagcagugaucucugcaugugccgcuuccuacacguuccucuucccugcacaucuucaaaucacacuucucgcagagaagagaauggggugcucauuagaaauguaacaacacacacacuguucgaccuaaaaggucuacgucuaggaauuuaucucacaaauauaugagauaugaaaaauuauuuaguagauuauucauugcaacauuguaggucacagggaaaacuauaaauaacacucacacacuggaauaauaugcagcuaugaaaaggaaucaggucucucucuauucacugagaagauguauaugacauuaaguaaaaaaaaaaaaaaaaaagccaaguuacaaaauguauaaauagguagcauauuuuguguaaaaaaaaaaagaauacacauucacagcuguuucuguaagaauuaagaaaaucuggaaggauagacagucaauaaguugggagguuaucugcugugagaacaggaacugaguaggaaagagagagacaggauuaggaaguuuuuuuuacacuguauuuuuuuuuuuuuuugagauggaaucucacucugucauccaggcuggagugcagcggcgugaucucagcucacugcaaccuccgccuccuggguucaagcaauucuccugccuuagccucccgaguagcugggauuacaggcgcccaccaccaugcccagcuaauuuuuguauuuuuaguagagacgggguuucgccauguuggccaggcuggucuugaaauccugaccucaggugauccaccugccuuggcaucccaaagugcugggauuaaggcaugagccacugcacccagccacuguguauuuuuuaucauuuuuauuuuucaaccauaccaauguauuaccuauucacaauuuuaaccacacaaaaucaauuuuaaggaaaaccccguaacaguguuaggagugcuucuuuucaguaccugauaugauacuuucgcccggcuaaaugacuggcccaguacccugacuuccagaaccuguagccguccauuucucuucggcugucacagaaaggaguguaaccauaaggagcaccauccaaauugaaaucucuuaacucuuucagaucuguucguacaaucuggagaauauaaaaagucauuuguuaagcaaccaugcagacagcucuaaugcgguuuccuucagauacagaguggcucgcuuaaggcagcauggaaggcugcuccgugguuaguggcacaggcacuaggggcagaugcacuuugauugcuccacuuauuaccugguugacucacuaacauguaagacacuucuuagcaaggugugugggaguaggaauaaaacaaauuucaacugcuuagccuuucugugccucaguuucuucaucuguaaaauggagauaaugauaaugacaguaccuaucucacaggguugcugggaggauuauguaaguuaacauauggauggacagauguagaauaaugccuugcccaucguaaguacucaacaaggauuaaauguggcuauguuacaaucaggaaggcacacuucaggcuaagccaguggaagagaauuccaaagaggugagugaagucucugucccagugacuuucacacacauuacauccuuccacucagguggcugacuuggguuuccgcccgcucgggcugaaguggaaggcugugggcagacguacacuuaugcuguuugaguuuguaugcucuaaaaucacauguucccuuucacuaagucaaacccugacggccggaagaauauccggagguucccuacugccaaagccauguauccacuuaagcuucgucuauuacccaugacaauaacuccuaucuuuugggcagauaauuagagaugauggcaagcacugcuaaauguuaauuuucuaauuuuuaguuuucauguuaaaugaauuaagucagauacaaaacugcacacauuaugucaucacaaugauguuaaaaagacagagaaaaagauguaaaggagauaagcuaaaugcaaauuuaaaaagugaugacaucuaugugauacauauuuucauauuuucuaaauguaaaauaagcauguccuuuuccauaaguggaaaaaauagcauuuaaaaagaagcaauuuguugcuuuuaauacaaacugucaaaacuuggccuuuaagggccuaccugaucagcauccacaaacaggaacuugucaacaacuagugggaaaaguacauccaggaagaggaucuuguaaccccagaugauacgcuguuuuucaguuuguugaugaagccaccggggccauuuguacugaacaagcucauacuggaaauuguauucauuugccauguaagguauaaacuccuauuuuuagacaugggaacaacaaauaaucauuucuucugauuaagaaaacugcuuucauaauguaagccaaccaccaugauacgggacaaauaaaacacauuuaccaaaacaguggucuuacaaagaccggccgugacccacucaugacuacauagaagaacagauauaaaccuuugucaaauccccauuucuuuaugacuucuggucaccacaugaaaugacagaauguucaagagaaggauuuuagauguauaucccucuguguguguuuuuacagcacaugaacuuuaaguccauuugucuaaacuugauuucaguaaggcauuuacugagcuugaugacaagccuuccucgaggccagaucuaacccagggaauaacacugcaaagccagaacucuggacaaauguguuguccuuuuugaauaagucuuucagauucuaaguauaagcaccuuuaggcgccagcaguaaagugcuuaucaaggagaaugguuauugaauauauuaaaagucacuuaguaaauucuacaagaaaaaaaaaggaugcaaauaaaucaacuuagaugacaaauacugacugauauaaguaaugcagaaaacauuccaaguacguguuuuguuuugcacagaggaagcacuacuuccauacaucaucuaggagugguucaugcuaacaccaaucauucucuucaauguaaaccaucgcugugcuuucuaaauuaaagcaagcaugcaggcuucagaggaaggaaacguuaucucaguaagacacugcuaauaauaacaacaacaaaagacucuccuaccauaucauccaaguuuuuaaacacaauuuaacuguuuccuucaaauagaccaaucuggaagaauaaucaaaauaaaaauaugcaaccaaauuaggguaucuuaguaaauggaaaauuugcuaaaguauacagauaaaacaaaagucaugaaaaauauacaguaaauaucuccuuaauaagaauguuuucccuuucucugugaaacaaaccuuaaaugugggggacaaguaauucuucaagaaccagaauuucacaggagucuugguauucuucagcacggauagcaucauuaugcugccaaacaaaagcagguaauuaauaacagcuuuccaauguuauuuaaccucaacauuauguagagucaaucacgagacaccuaaaugcucuuuacggcagagcuaacuaauggcucaauuaggccgagggagacgcucagugauggaaaaugaaaaauuguacuuacuccaacuuaugaaguuaucacuaaagagaaggggcauuccucaccuauaaaacuacacuuaacugacagaggcaaauguuuuaauucuguuacaccucuaaauaaacugcuucaugaacugauauauuaguuaugguccagaugaacccuggaaaucgggguaacugacaucacuccccaaaacuccugucacaugacaucagcaucuggugcuaagggaagaauguguaaccacagcgccuccugcagccuacacagaggcccugcuuuagagaggaaggcuaccagcuccggccuccuuacucagaaaacaaaaccacauuuuugaauggaggaauuuaaccaaauucgguuguuauuauugucacuauuuuagguaggauauuauuucuuggaaauaagagggcuaaaaaugagacaaaugacauuuugauuuucuauacuagaucuguagugaaaaauuaagagugaacagagcccuggcaaugagaaaagugacucucaggccuuccugacagugccucuggugaccacuacaucaggcagcccuagcccguggccucuucuggcuguagcugugugaccuuagacaagucccuucacacucggggccucagccuguuuauaaaacagaaguguucacauguaagaacuaagcucucuccuggcucuaaaauccugugaaucuuuacaaggcagugaaguauuccaugguucuguucugauucuauucucuaugucaaccuccuaaucucuggguuaagcaauguuuggcaggcaguaaacaguacagucuaugaauguguacagugacguuaaagggcugcagccuuguaauauccagaagcacucacuacauaguucaacuucacagagacggcgggaucaaaacaaauccaaugauaaauggcaagccagucacaaugcucagagugcuucaaagacacaggaguauaaugagcagaaucccacaaaaccuuuccucucuaaauaagaacacugaccaauucauucaucauauauaaugaaauaaucaacaagacugaccgaagaaaucuuucguagagaugaccagaugcaacggagaaaauauuaauuaugucaucuuuaucuugcuucacuuccucagucuucuguccuguaaagccccuauaacaauaaggguaaaaaaaagaccacuugaaacacucauacagacacacggccuuugaaaguaagaggaaagagacugcgcuucccauccuucccuagcgggugagcugcagcaggagugguuaugaagcuucccucacacccuggagagaccacaagacugacaaaaccaaccuacaaaaagaauguucacucuccgacaguguuguuuuaggaagagacugaacacaggcugcaccagaaugcaacuuacacaacgggaaguaaacugagcagggagcagucaaauuuccaaagagcagguacaggcaaugagagucacaaaguauggagcagaaguaacuuccccacuaggagacaugaaccucuuuuggaucaaucgaguggaaaauacucaucuaugccaaauauaagugugagauguagcugcacaaaguagaaugugaaaggcccagacagaaucacaagaugcaaaaaggagggauggauggugcuuauaucucaguuuuuccuuaaaaacauaacucuuacaaugucaacuuaccauuugaaggaaucccaaaauccagauucauucucacucguuccaucacucagcaagucuucguucaccauaucugccuucuucugaaccugcaaucaaaugugauaaaccuuacucccaguaugucucacaggcauaaaacugccucucacuggauauacacugugagccugucaucaauagggaauuaucaaucaauucucucacaaacaggcacaaccccacccagagucuagaaggauucaauagaaguaucuucgccaggacauucacaucauaaccuuaugugaggagacagcaaccucuuuuaauuagaugaaccccauuuucagcuugcaacauaggcaaagagccgcaaacucaacugugcagugaaaccagaagcacgauucaaugagucaacagcuaguuccagggaagaguguggcugcugggggcucuagcuguugggagggagguauuucauguuaugaccaguuuucaggauucacuagcacaaacagggguuucuucuuggcaguacagugaccauuuuucuucucaacaauggauggccuauuuuagguuucacuguguguaaugauucuuucuucaagaauauacuguacuugaauuuaaggcacuaagagcuucaacauucagagaacggaaaguacaagucaaaagaaauuaaauaggacuaucauuuuauuauuguugaaaauuuccauugccaguucccccaauauugagaaaagaaucaucaacaacacuaugaauuguggcuauauaaacaacauagcaucuaugagaauauuuuauauaagaugggacauguucugcacaccgagauuacccaaaagguacaaucuuucaguugagggaagccacaaacucacaguuacaaagacauuuugccuuaaagcaguaucccuauaauugccauagcaaauuccaaagagacucuugggcugguuccaagauacauauuuuuaaaugacagcuguccaauaacagaaugccacuacuuuuaccaaacucaccuucacuuuaauaauuuugcuuuugaaguuguugaggacgauaaccaccucaucagcaucagggggagaaucagugccaucguggcuuugcgagaaaagaaagaucaauauuacaaggcacaauucucaaaaggcagcaaaugcucucagagcaucugaguccaucauccuucucauaaaggaguuuuccagauccagcuaucuucuugcuccuuaagcuccuucgagcugcacagaagcacguguugaaaccucucuuuauauaaggugcaugcccaaaccuccuuugugaguccucuugcaaauuacccaucacguagugagaggcacccaugugugguaaccacauggugaguacuaaacaaccgccuguguucacaagcucugagccaagcacagagccuucgauaaaggaaugcagggaacaggcccccugaaccauuauuggaaccacacugccuccgcucuuuuuuuuuuuuuuuuuuuuuuuugagacagaguuuugcucuguugcccuggagugcaguagagcaaucucggcucaaugcaaccuccaccuccgggguucaagugauucuccugcuucagccuucagguagcugaguuuacaggcacccaccaccacgccuggcuaauuuuuguauuuuaguagagacaggguuucaccauaguggcuaggcuggucucaaacuccugaccuuaagugauccacccuccucggccucccaaaguguugggauuacaggcgugagccaucacccaucacucccggccacuacucuuuaacuggaauaguguuguaaaggaaaucugcucgcucuuucugccggaggcaacaaucagucaacaauaggcccuguacucaaccuggugucuauacgcuaccagaaaaacuguaacaaauucuauuugcaggcagacaggagcagaggaagaaaaauuaaauguauguuucccuacuaaucaacagcaaugccuaaaauuuccagucaccaaauuucaaggugcagaaagucauaauuacaacaugaauucacugcauuugcugucaucuagcagagaguaggguucucaggcaaaggaagauucuaauggggguggggcccugaacagcuaggaagagggggcaccaugcuccugggaaggggagggcuggcaagggccagggcauccaaaagggaaggaguucggaagugcaucccaaauuuuguaaaaccuuaucugaggaaaauguuaugugggaaaaaaccuucuacuguuuacaaugguguuauuauaauacagaauucuucuauuuccuggguaagaaccaggcacuaauccacuguuucaugugugucgcuacggagcuaauuaaggcaaggacauacuacagagugcuucaaaugugcccuaauggaaaucauccccuacacaaccugacgggaagccucuucacacaguuuaaaacuaauuuaaauuguguuaagcagaauuuauaucaaacuuuuuuaaaggcaacauaauuauuuuuaaacuaauaaauaugugcaguaaaccuuaagguaaaagcuggcuauagagggaauguucuuacuaugccaccacagaccaaggaauaccagcacuaacagcacagcuucaagaccaaagcuuccauguacugugcauuugcaaaucacucagggucaacacauacacucucugggcagaaaaguguggcuguucuuucuuucuuuucuccuuucuucaaguuucucaucugccuaucuaugagccgcaucacacugauagaaugauuugauucugggauauuguuagcacaaaggaauaauuaaagaauaaagccugacuauacucauuagcaucuauaccucuuauuaucuaauucuauucuaacaauucuuccauauuuaauuuccuggaaaaaccacuguuucaucacauacaacugcaaauuaaauucauguugccuggcuaacugccaggguaguauucaauuagagcuaaugcucauuucuaaaaguucugggauaauguaacugcaucacuuacuccuaccuguaaauucuauaaauaucuucagagcgucccuuccuaagucugaggauccaagcuccuggguuggcuuucagcugaaaguagcccuaggacaagaagaaaaguccaguuagcucucuucaaaacaccaaaauguuauuucugaggaacaguuacuucuauuucugaaauaucaaucaacuauaaugugaauaacacaguaaacaaaucaaugcaacucuuaaaaaaccaaaacuacacauuaaaaacucuagcacagaccaggugcgguggcucacgccuguaaucccagcacuucgggagaccacggcagguggaucaacugaggugaggaguucgagaccagccuggcuaacauggugaaaccccaucucuacuaaaaaaggacaaaaauuagccgggcaugguggugggugcccguaaucccagcuacucaggaggcuggggcaggagaauugcuugaaccugggaggcggagguugcagugagcugagaucacaccacugcacuccagccugggcaggagucucaaaaaaaaaaaaaaaaaaacuaguacaauaaaggccagucacaccaauaaaucaucugcucuuuagcugugcuucagggaagaaucaacgugugaugcaugaauaaguguugcacuuccaaagaaaagaaaaaggcugucagcucaugagcaaucuauuuucagggggccaauucaguuauagcugaguauuccagcauguuuuuucuuuugacauguaauucuaaccuacaaauuuagcugaacuaaugauuucuauauugaccaaauucagcccauaaugaauuuuaaucucacucuaugguuaagaaugcuaauugcuccaucauaaauuauagugcccaaauuaacguaacuacaauaucacuaucugaugaacagauuauuuaccagauuggccauaacaaugguguccacaaugaccggguuggcugaaguuccuaagguaaacuguaguccccguggaggcuggccuguggugaugucguagcaaugaccuuccaguaacagguauuccagcucauacucagcagccacuacacuguccaccugcaagccaaaauccaaucacuugaaugcacucagagacaacaugaauaaaucugaaaugcauuaugcaaaguaaaggaagcagacaaaaaggacuuacauaauauaugaucauauuuuaagaaauucaagaaaagacaaaaguauaaugacagaaagcagaucaguuguugccugaaaccaggcgagaggaggcuacugucugcaaagggguauaaaagaacuuuuugggguaauggaaauguucugcaucguggcuauaguggugguuaaugacuguauacaauuauaaaaacuagguuggaaagagaaaggagaaaaaaacaauaaggacguuauucuaaaaauacgaacgaggauaagauacuaaauguugaaaaaaauuaaagaccuaaaugcaaagacauccuguacucacguaucaguagaaaaacuugcacacaacauucauagcagcauuauucauaacaaccaaaaagugaaaacaacucaaauguccauucgugaaaggauaaaugaaacgugauauguccauaaauaaaauauuaucuggcaaguuaaaaagagugaagcgucgauacauacuacagcauggauggaucuugaaaacaauuuguuaugugaaagaagccaguuacagaagaccacauuugauucuauuuagacaaaaugucagaauaggcaaauccauagagauacaaaguagaccagcaguugccaggggcuggggaaaugaagagugacugcuaaugaguauggggcuuucacuggggaugcugaaaacauccuacaauuacauaguggugauggcugcacaacuccgugaagauacuaaaaccucucaacuguacacguuaauggggagaauuuuaugguauaugaguuccaugugaauaaagcuguuguuuaaaaaaauaucauaccugaacacugaugucucagaggcccaccuagacuaugauucaaucugcuguauuauacaugauuagguauuuggaagcaauagauauggucuuaccucuucuaaauaaauauuaucaagaucauaugguguucugacagauucuaccauccagcucucagguguguucaaauucagagugaacaguggagacugaggcauauccaaaaauuuugcgauuggacccuuagcaaaacuauugucugaagugaaagaaaucucugguucuaagacauaacgguaaaagcugaaauugaaaaggaaaguguuagauaauuuucgaugugacaacaggacuugagugcacagcccuuacacagguaacaacugguuaaaacaaauuagauuuggaggaguacccuuccagauugggaaaaguguuuccaaaaccaucuuugaccuuaugaugccuccuugugguugcugcagaugcaagaaaaggcaaacaaggacagcacugaggaggagugcucagugguggccuguggugaugucguagcaaugaccuucuaguaacagguacucuagcucauacucagcagccacuauacuguccaccugcaagccaaaauccaaucacuugaacggaggccacucguucacauggauggcugucagggucacaguuagguccugggcauuuuccucccuucaaggaggacucauuuuucucuuuaaaaccaauuccuaaauacugauugggcucucaggcuaguccugaaaacacuaauaauguaaacauuuccccuauacgagaauaaugguggaagcugggaacccuuugguuacuuucaaaugcuguuucaauccacuuagaagcuaaccuauaaaacacagcacacuggcaaguuagaaauuucccauagccacaacgcuaacugcuuucuguaucacuuuuuucauaaaugaccauuccaaagcucaugacaauauauagcuaagcaagcuuccucuaacauguauauuccaacuugaaaugaauauucuucuuuuaagaugaaaagcacaaauggggccaggcgugguagcucacaccuguaaacccagcacuuugggaagugaggcagacggaucacuugaggucaggaguucgagaccaggcuggucaacauggugaaaccccgucucuacuaaaaauacaaaaauuagcugggcaugguagugugcaccuguaaucccagcuacuaaggaggcugaagcaggagaaucccuugaacccgggaggcagaggcugcagugagccaagaucaugccacugcacuccaaucugggcgacagagcgagacuccaucucgaaaaaaagaaagaaaaggcacaaaugcaagcagccuggguuaaugccaccuaaaugcuacaaacacacuauguucuuagaacuucugauuagaaugaaauuuggcaaaacugaacauuuaguaaaugaccauuucaaacaugauguccaccuauaaauccaucugauccucuaacaugcaauaucagaacuuggauucaguacaauuucuucaacuguuuucuuacauagcauguuuuaccuuuuuaaaggcaugucagaaaguuuggauuggcaguucauaaauacucucagauucauguuuaucagcugagccaaaaccuagaaggaaaaccagaugacaaaauauuuaggauuuuuuucuucagaaauuuauuauuugacacugagcuauuaauaucucaagaaaagauauaaagauaacagccacagagucugcacuggcgaaacuucuggaaaucacaacucuacugcacaaucuacaucacacauacauaggacguggccaaaagcaaugggaaguaggcugcugcagcucacugcuccucacacgaaggcaguuccuguggggaagcagcaggcagaucauggaaaaacuacaggccucagagucaccgcucacaugccaaaggaugaaaaaacagagauaccaauacucacaaaaaagguuagagauuuauucggcaaugaauguuggagcgacugucuuugucaaaggucuuuuaaauguccuaaaauuguaacacacuguacaugucuaaaagacaugccaagacaaaaaauccaugguaguuauaaaaaaggaaaaaugaaaaaacauauuuauuuuaucucugauauuauaaauuaaaauauagcauaccuuaauuccaggauguuuuacucuaaaugaggauguuaaucacuuuuuuaaauuacaugaggcagccaaccacacuugcaccaacuuucuagggcugugaggcuguuucacagccacugucaaucuuuguaaagauugcucugcccuagaaccccauagcauuguccagugccuguugaaggcaacucaaggaaaacgaagcucucagugaauuucagagcaugugacaacuucaaacaaaggugauguacacuuccugcacagcguuccuaccaagagcaaaggagcaagucucugugcuucucuggugacagggucaacgacagccacaacaucaaaguaugucuccccuuccuucggccucaguuugauugcacugaaagaucacaaggauaaaacauuaaccuggaggacacaggaaacaaaaguuuuuuuuguacaauauaaccuucaaccuucuuagcauuucaaagaacuuuagaucuagaaagacuagacuaugacaguggccaacuauaugauucugucuaucccaaagauugcaaaaccuuaauaauggaucugaaauggacugaaagguccauguaaagagaggaaaagcagcuugaaacuguauuuaaccaaaaacugagaaaagcuacugaaguuagcuucugauaacauuaugccaguuuuuacuucuuggcaagaagaguacaaaaagaaaaggaauaaaucaauuuuuaaaaaauaaugaaagaacauuccagaaaaccugcaaaacaaagaaaaaggaaaaauauaaucacaaaauauucacuaucccagcccacuuagcugcaucucuacguaauccuuucuagaugccuguauaaacauuaguuguagauacagauuagcaauuucaaaacaauuuccuuccgucucucacuacuguagcauaaagauuuccacaugcuguuacacaacaagcauccucuauaagaaauaauaugcuauucaccaaaugaagcugucagaguuuacuccagcuuuucuuuacugcuggacauagagauggcuuucaaccuguaaacaauuuguacaaccaacuuucuccacauuuggaaauuucuuuagagucaaggaagugcuagacaugagauuauggagacaaaggauacaaauacuuugcggcuaauaaguauugucaaccacauuuccugaagaacuaaacaaauuuacaaggccaaaaaauaaauuucaccacauccuucgucagcauuaaguuauagauagauauuuugccuguucuuuuccuuauuuacuuuuuuagagacaaggucucacucuguggcccaggcuggagugcaguggcgugaucaugguucacugaagccucuaacuucuggguugaaaugauccucucaacuuagccuccuaaguagcuaggacuacagacacaugccaccaugccgggcuaauuuauauuuuuuuguagagauacgggucucaccauauugaccagacuagucucaaacuccuggccucaagugauccuccugccuuggcuucucaaagcaauggcauaagccaccacaccugguccuugucuuuuuuuuuuuuuuuuuuuuuuuuuuuuuuuuuuuuuuuuuuuaaagacagagucucgcucauucacccaggcugggaguauaguggcgugaucucgguucacugcaaccuccaccuccccggcucaagcaauccucgcgccccagccaccaaaguagcugggauuacaggcacaugccaccaugcccagcuaauuuguguauuguuaguagagacgguguuuugccauguuggccaggcuggucuugaacuccuggccucaagugaucugccugccuuggccucccaaagcacugggauuacaggcaugagccaucaugcccagcccccuugucuguucuuaacugaaugguaacuuccuguugcauggacucccugugaagucacacagacuggugacuuaaaaggagcaggaaccucuaaugaacuuuuaaaaggacucaacuugaaaggauuuaaaauuauacccaauuuuugaaaaccauuaacuguuuaaaccauuauacuuuguuugcucugaacaauacuauaaugugguuacaauacuaaccacuacuuuuacuuuuuuuuuaccaaacaacauuuaccuaagugggaugaauacaaaagaauaccacaaaacagcauaacgaagaaaacuggaaacaauuuacaugcucauggagguuacuucacaucuucacugcuuuggaaauaaccaugagaauagcuuuguaucuguguugagguaggugcuuucgaucucuggcauuauuaacaauuucagauuaaguccacugccaaucauuauucuucuaacacaacaaaacuucuguuacucuaauacaacuguucucaaagugugacuccagagcaguggcaucagcuuccccugggcauuugugagaagcaagucaggauccaacccagacuuacugaaucagaaacucuggggacggguccagcaaucugcauuuuaacaaacucuaaguaaaagccaaauuuugagagccacugcccuaauauaauuugcaccucucugcuauucuagaauucuagaaggaaaaacucauuagaaaauagcauuauacaaaggcucacaagggaaccagagagagagucucaaaaaggacucuacacaagaguguaacaucuggucaugccugcccacaccagguuugggguagagauucacacaacauguucacauucugagccagcaguguucuaggugaucagcaacaggcacaccacaaauugaccuugugagguccuuuacuuaccccacaucucuagaacaagaaaaagggacucgaaaaaaaacaaggaaagaggaguauuuguguggaaaugggaacaauaugaacaacaucauguuuaaauguauucacuauauugugcagagaaaagaccagaauaaaacuaaaagugacagagacaggaacaagauuuggagauuauacacauuugccuaugguucguagaguaaaugucaacgaauacugugcuuaguagcaugaaugcacacgggaaucccccaggagcaacuuguuaaaaugcaggugcugauuccucaggacugggguggguccaaagccugcauuuccaacaggcucccagacaaugucuugcugcugguccauggaccacacuuugagggcaagaauauacauaacugaugguucagaucuuucuauuucuagcauaaaugagaaacuucugaguuaaauguaauaaacauucauuuaacugacacaacucccaauaagaggaacuucucuaauaggaauuauaauuugucucauaauagaauuuauaauuaagguauuuuaauuauacaaaacauggagacccauggagaagaagauuucugaaaagggaagaggucuuugcucaggacucgcuaccuugggcaagaaggguaaacaagauggcagguugauuaggaaagguuuccucccgcuggugacuaaugaguuacuuccugaaaguucacaaaauguugagaaaaugggugcaaucugggugcuaauggccaaauucaacaaggauuauccaggagccauaagaaucuucacccacugcugacauaaaaaauuaggacacacaaccagugcaaacagagagggccuccauuccagccuacaaucaucaaaugaucucaccacgcacaccugauccccacaaggaugggucauaaaaaacacaggcccacuaaaccaaaguccaauccaugccagacugaucagcucagaaacacagaggaauaggacacaggcaucuauauuuaaagccucccuggggauuccgaggcacaaucaguguauauguauauacuugccagcuacagcaaaggcuauauacauuacugcgcagggcucuuuccuagaaacaauuaaaucuaaucaugaggaagcaacucagacugugagacauuccauaagacaacuguccuggacucuuaaaaaaugucaucauaaaagacaaaagacuaggaaaaaaaauggcaaagaacucuuccagauuaaaggagaccaaagagacacaacucuguaauauguaaucuggaccaaaacaaauacaaaaaacaguuguagaaggucauuacaaagauacuggagucaugugaacagaaauuguguuuuaauauuacuguaucaagguuacauuucugaggucagcuaacaguacugcggagaaguccuagcacucaggauacacaugcggaaaacgucagacauguuacaucaggaugucugcaacguauuuccaaauggugcaggaaaaaauaugaccguguguaugcaaacauauaaauaaacuacuaaagcaguuacuagaaguacuacacaaacacacacaugcagacacacgcacacaacaugcacgugugcagaugacagagauaaagcaaaugugacacaccaacaacuggugaaucuaagugaaggauauuugggugcucauuauauuagucuuucaacuauuucuagguuuuaaacuuuucaaaacaaaaaagugaagaacaaaaaggcaaacucccucacuaugcuaagcuuauuuaaaacaaaaguuuucggccaagcaccuugggaggcugaggcagaugaauaacuugagccuaggaguuugagaccagccugggcaacacagugagaccccaucucuauaaaaaauacaaaaacuagccaggcaugguggcaagcgccuguggucucuuccacacaggagguugagguaggaagaucacuugagcccagaaggcggaaggugcagugagcugagaucacgcuacugcauucuagcccagaugacagaaugaaacccuguuuuuuuuuuuuaaaaaaaguuuucaauaaaagaugaaugagacaaguacuuuaauaaucuguuuaucuuacuauuauuaugauuuugagauggagucuugcucugucuccaaggcuggagugcaauggcacgaucucugcucacugcaaccucuaccuccuggguucaagcgauucuccugucucaggcuccugaguagcugguauuacaggcaucugccaccaugacuggcuaauuuuuguauuuuuguagagaugggguuucaccauguuggccaggcuggucucaaacuccugaccucaggugauccgcuggccucagccucgcaaagugcugggauuacaggcaugagccaccacgcccagccaaucucuguuuaauuuuuuugugagacagggucucagucuguugcucaggcuggaagugcagugaugagaucauggcucacugcagccucuaccuccagaguagcugggacaacaugcacaugccaccacacccagcuaauguuuuaaaauuuuuuuguagagacagggucucccuuuguuugcuggucucgagcuucugggcucaagcgauccucccacacuggccucccaaagugcuggaauuacaagcaugagcuaucuugaccugccuguguuuauucucgaauuuaagaaaaguacaacuucucuguuuaauuaaaugcagucuauuuucuacuacaagggugcacucagaguuauuucagauucauuuagaaauaaaugucaguuuucauacaacugagauuugcauaugaauuuuauauaugaacacaaauauauacaugugaaaacugcacaccaaacaaauguucaauuccuguaagaacuuauauauaaaucuuauauggaaaaaugaaggagcugagguaaagcaaacauaagaguuuaauauucaagaauaugcacaaauucaacauuaauucuauaccugugucugucuucaaaaaacugguacucgauucuuggaucuccuuuugguugcgcugacagaagagcauccaccuucauuaccaagucgcuugcccugaaagaagggguuagagaaaucuuaacaucuuuuuaacugaaaguuuuccaauuauugccaaacauaucaucagcccaaauacugaauucuaacaagaugguuugaacaagguauaaaguccguacugauaggcaugagaaagagugauuagugguauaaccuuggagaaguuacucacuuucccacaugugaaauggagacagcacccacgcugcaugacucuaguaaaacugcacaacucugcaaugcaccuagcugaggcccuggcccauuacaggcugucaguauuauuuacauucucccuuguccuuuuaaaacuauuacuuuuuaugacuauuagaguaauaauucacuggaaaauaaacauaaaagccaaaaauugaaauuacacauaauaucaaguaacaaggucugauauuuuggcucauaauucuauacuuuuaaauacauauaaacaaauuauacuggcagccugcuuuuucacuuaaaaacauauuauaaaaauccuuuccuugguuaauaaauacagugauauuucaauauuuuuguuuguuuguuuguuuguuugagucagggucucacucuaguugcccagggcuugaucucagcauccucgaccuuccaggcucaggugauucucccaccucagccucccgacuggcugggacuacaggcaugcagcaccaggcccagcuaauuuuuauguauuuuuaguacagacaggguuuuaguacaggccaggcuggucuugaacuccugggcucacacaaucugcccaucucaaccucccaaagugcugggauuacaggugugagccaccgugcccagccuauuucaauauauuuaugacugcauaauguuacauuuauggauacaaaauaaucuaaauauuaagccaacuacugaacaucuguguuguuucuaauuucacuauuacaauuaacacugaaguaaaccacuuuaaaaagaauuuuauugucccugccucuucuaaaauuaauuuuuuuuuuuuugagacggagucucacucuaucgcccaggcuggagugcaguggcgcgaucucgcucacugcaagcucugccucccggguucacgccauucuccugccucagccuccugaguagcugggaucacaggcgcccgccaccaugcccggcuaauuuuuuguauuuuuaguagagacgggguuucaccguguuagccaagauggucucgaucuccugaccucaugauccgcccgccucggccuucccaagugcugggauuacaggugugagccaccacgcccagccuaaaauugauuucuaacugaaaaagaucuugaacuaaaccugaaaaaaaaaaaaaaaaaacacuccaauuugcugaaccaaagacuaaauccugaauaagaauuuuaaaagagcacugugaauguauuugaacuguaauuaagccuacauacauuuccuaugaacccagcaaauauauaaaauuaacuauuuugguucaacuucucaauauaaaugccaaauauauauaauacaggccauucucuuccugugaugugucaacacgguuacaaaacaugucaaggggcacuugguuacguggacuggagugagcaggccaacaagaaacucccugaaggcugaugaagaacaaugaucaaaguauacacagccaagcuucagggcagccuuggggaugcagacugggucaugaaugauagcuguggcugucacggggaagggggccacuccaagguggagcagcucuggcgcuaaugaaaaccugaugcagacaagguaauuuugggaagccuaagaguuuuagcauuagucuuuuggccccaugacuaccugauuucccuaaauucacccaggaaagaucgagagccaucucucauuggcaaaaggcaagucuucuaggcacagucuggcaguuauauagcccaagaagaccccaaggagcucccugcagugguccaacagcaugccacaccaagccuaugccugugacauggcugcuucgagucacgaguaccuccugaccuacaucagggaagcauuucacaggucgggacaaggggcaucacucaggagccacugagguaagagggauggauccuccuuauuuguagccccaguauuggccaaaaugagaaaagauuucuucccaggucauacaagacauggcaacagcugacuuugacagcuauccaagucaacacuucucuaaaacaugcucuugaacucugcagcaugaugauguaagaaaaaaacccagcagaacuuuuuuuuuuuggagacacagucucacuuugucacccaagcuggagugcaguggcgcaaucucagcucauugcaaccucgcaagcagaacuuuaaaauuuuauauccuccaacuaugcaucaaagaacacaucuccacagaauaggagaaaauguuuacaaaucauguaucuaguaagaaagugacauccaaaauguauaaagaacugcuacaucucaacgacaaaaaaaaaaaacgcaauuaaaaaugggcaaaagacuugaauagacauuuucccaaagauauauaaauggccaaucugcacaugacaagaugcucaacaucaccaaucauuagggaaaugugaaucaaaccacaaggagacagcacuucauacccacgaggauggcuauuauaaaaagcaaacaaacaaacaaaaaaccccccagaaaauuacaaguguugugaggauguggagaaaccggcacccuugagcauugccagugggaauguaaaaugguacagccacugugggaaagguauugugguuccucaaacaauuaaacauagaaauagauccuccaacuacauagucauuugauauuuaaugcagaaacuacauauauguaacaauggacuccaggguccauccaaacaauuuauuuucuuccauuaagaaaauaacacacuaaaacacaucagcuuauaauaacacugaaaauuaaaauuaaaaaccgacaacaaccaauucaucaucaccuuugaagauacaagggaaacaacucaguauucugcacugguaaauaaaagaaacauuuaaacugccuuuccuuuccugaacaaaauaaaacugaaggguaaccaaauagauaaugaugaaaaguaucacuuuacauaaguauuccagguaauaaauaaacuagccucuuuacuucugcauauauuugaaauuuuccacaaccaaaaauuauaaaaauaaaaagagagaacuaguucaguuccuuaaauaguacccuacaaaauaaauuaucuuguuucaacagaagcauacauuaaaacuggaauugaagaguauuauuagauuuuaaacuggaaauaaaacuccuugggauauguaguaugaguaacaacauauaauucuaacugaucaaugaggaaaguccaauuauauaaccccuguaauuccuccuauggcaaaacuuacacaucuucuucuacccgaagcuguugaauaugagauuuuauuuucuguccugagguuuuuaagaugauauuuucgaggagguggaaaucgucuugauuaaagagcucacuauccuccaguggcccaaugaucugugaaggagagaagagcaggcgcuuagcucuggaaggcugccugcacucagcaagcugguaaggaacccucuggcguccucaggcuaccucauacgccagaacaucuuaaagaccugagacagguacauguuuagauaaaaucagugaaauaauacaaagugaagcccaaagcaaauacuuguaguuauuuacuuaucaauuccucaaggacaaaguaaaauaaaaucguaaaguaguuuucauuaauucuaccugaauaaaaacaacaaaggcuacuuuaugugucaaaguccauacugacugacuuucugagagccaccacacucucaccgacagcaggaaggcuccauauggggauauuugucuaugucaaaaagcacagcuccuuggaaauaggaggcagaaacaucaauggcacuucauaagccccaaucaccuuugaaaaaagaguggcucugucugaagaguuuacuagcuucagaggagaaugcugcaaagacuguucacggaucuaaugugaagucaagcuugacaaauccucacccuuccauugcugaucacugcccucugucccuucuucagcuucagaacaucccugcaguacacggcaugagacaaaaugaaauccauuuuggaagacucaaagaccucuuuaaaaagacugaaauccauucccuaggaaaguaaucauuauuaaggaaaaauagucguuacuaagcaaaccauauaaacaaauaaacacagugaauaaaccauaaaaauuucuuucccuggaaaguaauaacuaauuuucauaauuaacauuaagaugugucaauucuccagucuccccgccaucucccuacuacuuagaguaacugcuauuuccuuaucuuuuccugugauuuguucgacuagcagacuauucaucauuccuuuacucugcauuuuuaaauccugcuaauuuccagugacagccuguuuuccuaacucaaacgucaaauaguauauacucaucauucuguaaaaaauuuaaaaacuacaaaacugugucaaaaaaauaaguaacauaaaauauaaaugaauaaacacaggcuuauucuggaaacacaucaagaacauauaagccuugaaccuauaagugguucaaaucuccguuuuuugcucuauaaauaagccauauugucucucuuaaaaacugugcauaacaaauggcuccauacuuaaaacacacaaaaacucaaaucaugcaccacaugaaagcuaggcaagguuaaaaguaauaaagggaaacuuccaaauuaaaaaaaaaaauucccugagacucaggacuaaaaugacaaaucgugaucaugaaccggacacguaagcugcagugggugagcuuccguggcagacaaaauggggcagccucaugagaggcucagagccuuaccccaacagagaacuccgcaaugucagcuccugcagccagggccucugcagcccccuccuuggccauuuuggugaugaaguucuuagcagcguuggaagucugaguuuggagagcugcccagauugcucuggagaucugaguguucucauagcuuaucucuuuggcaggauuauugaucaugcuuauucuaacauuguuacuggauuucuguucacaaaaugggaaacgggagucauauuguagauauuuuugaacuuaaaaagcagcauuaacaucagucauguucaauaaguagcaaauaauaucucucuuaaaagucucaggccgggcgcaguggcucaugccuguaaucccagcacuuuggaaagccaaagcgggcggaccacgagaucaggaguucgagaccagccuggccaacagagugaaacucugucucuacuaaaaauacaaaagauuagccaggcaugguggugggcgccuguaauuccagcuacucgcaaggcuguggcaggagaaucgcuugaacucgggagguggagguugcacugagccaagaucacaccacugcacuccagccuggaugacagaguaagacuccgucucauuaaaaaaaaaaaaaaaaaaaaagucucagauaguucuccuccucauucaaaauaaaauuaaaaaugccaucaucaagcauucaaaacccuacaugaaguggcccccagcccaccuuuccaacuucauuucuuaccuucccgguaaauauagcauaaauuacagacccucagaguccuaucuuuacccaacacaguuuauauucuuaugccacacauuuuguauucuucuaacgcacuuguuuuagaaguguuuucagugcucuccucaaacccuucuucauucauacagccuucccacauuccuaguacaauucaaucucucccugggugaaaagacaagaauccaaguggaagaauacacccaggacacacaaagccaaaaaagggcuuguaccaauaacauaagcaacagacauuuauauuuggguguaccaaaagacauacgagaauauucauugcagcagucuuauaauagcaccaagcuaaaaacccaacuguccuucaaauagcuuaaacaaauaaaacuuugugguacagccauaugauauaauacuacagaaugaaaaaggacucuauaccccuacuuguaacaucaugaauaaaucuuacaaaagauuggguaaagaaaccaaacacaaaugaaauugcauaacauuccauuuuaauaaacuaaaagauaggcaaaccuauucccuaauaugagaagagggaagaggcguagugucugggcacaagugugggugggcacaagugugggagggcuuucaggaacuugagaauucucuauuuuuugaccugagugguggucacaagaguguguucucuuugugacacuguguguccuaugauuugagcacuucuugugaaccuacauuuuacuucaauuaaaauaguuauuaaaaaaugcaacucuccuuccccauucuccuacccuacuaccauuugaagauuuacgcauuuguguuagagugccuuucacauauaacuaucgcccuuagcuagaacugcccuguucuaacuucaaauugaccacagcauuugguccacuccuugaacaauaaaggaacucggcauaugaguaaaacugaaaccaccuggauauuucuuuauuucaguaaaccuucccagguacaggguggaaaggggaccaugaggaggguugugagguauggaugaagaugcaaacugaaacagcccaggaaaaagaauuuugacaucucauccucuaacgaugacacucuccagaagaaucagcugcuucccaaccaccugccauugccacucacucaagcccaacuauuaauggcagcauaucuuuucagaacaccuauguguguaucccucagugcaucuggaucuacuucuacuaaacacacacacuaccauuccugugugcuacugcccccauguccagaccucugucgugguaaggaccccaucuccccgauacaguacacaacacaauuguuggagcaacucugcuccaagaacaugaacagguaugcaauaaaacuugucuaugaugaggaucucgcuauuuauuuuuuucucuauaagaaucuaucccguucaacaaagccuggauacuguagucuuagaucucuuuucuugagagcuggcagaucucuagagauacaauucuccguucccucgagcauuaagaaagcaggacucccaacucccacugaacaauccuagccgcacagcgaagcccaugaagacaacuacagccacaaacaaaaauauaaaaugaagucauagauacuugccugauguuugauggcaucauacaguaacugccguccagaagggcuaucaaaauccccaacaauccaaaaaguuacuggccuaauaaaagaaucaucuguagaaaaacaaaaacagcuaauugagucagaggagagaagcacauucuguguuucaacauucugaaaaugaaauugaccaaauaauuuguaagaaccaugcaaaaagaagaaaaugacaagcuuaauaaagauagaagaaaaagucguaaaccuuuacuauaggaaagcaggggaaucuuccacagaguuuaguuacagacuaggaacaugcacugauuaauucuacugauuaaugcacuggucugggcaucuguuagcauguaaaaugaaaaacagccuuugaacauguggguaacauauugucauuuuuaaucauacuaauuuguaauuuucugaaacuaauucuuuacaaauguuuauacaaaauuuaucuacauuggccgggugcaguggcucacgccuguaauccuagcacuuugggagguucaggaggguggaucacuugaggucaggaguucaaaaccagccuggccaaaaugguaaaaccccaucccuacuaaaaauacaaaaaaguuagcuggacgugguggcgggugccuguaaucccagcuacuuggaaggcugaggcaggagaaucacuugaaaucacuugaacccagaaggcggagcuugcagugagccgagaucaugguacugcacuccagccugggugacagaaugagacucugucucaaaaaaaaaaaaaaaaaaaauuaucuacauugauauagcuuccuguuacccacagauuccggaaacaguacaauuaaguguugauaaauucuaaauuacaauggucacugaaaccaaagaagaaaauuaagaaauagaacauucugaaguuuuaaguuaccauagauuuccuuggaggacauuccugaacaaagguaaagagaaaagaguagaaaaaaaguaucauuucuggaaugaaugccuacuguaaaaauugaaagucuaaacaauggcuaacacggucuaugguucuuccugcugcuuaguccugucggugucauggcgcugucccaguacccuaagaaacaguuucuuuaaagaaccaaauggaguaauugcuuguacuuuacauacagcugagaaaccagaacuucucuuggggagagaccacagcggggauuuaaaaaggcgguaaaaauagcugacuuaaaauaacagccagugcuuuucugaagcacugacccgagggcgacagaaucuguccgccacuacagggcgucauuuuacacaaucuuagccuaaauaaauaccucugcauaaaaucagcuucaaagauuauacaaggcuuucuaaaaccaacuuuaucuuauaaaccccaaaauaauauuaacccuguacagucauuuuuaauucauuaacccauuuuuacaucacaaauguuuuuccauuugaacuaugaaauauuuuuccuuuugacuuuagucaaaagguaaaacagguaauacaaaauuuaugaagacaucugaauuuuuaaacaaauauauacuuucaacaaauauacaaagaauuaaacuuuaaauagauauguucuagacucaaagcuuuauaagaaauaagaaaaauuaugaagucucuuucccuuuucucucuuaauuugcacauuaagaugaauaugcaaauacuuucaaaaaaauguugaaugcaagauaauaagccucaaauggauuaccuuucuuugucagauaguucauacuauuggcuacagcagcagucuugccuugggaauccaagauaguaaaucuagcauaaucauccacaaagaaguuaucugggagaaaaaaugaaauacguauauauuaguuccaguucaaucuauucuuaauauucaacugauaaccugacuugaucauaauauaagauuuauagaaaugcgugagugaaguauauuaaguuccauguuuacugaacaacuucacaacauggccccuaucccuacugaagucacacaucaaagacacaagguugauggaaacauacauaucucacacagcuaucauauaaguaugugucaguuuaauggcugaauucauccuauucccauuccugucacuugucaacuggaggacaaucucaaagagauccccuuaacucauuucucccuucccuaguccaaccaguggaguaagcucuuccuguuccuacagaggaagcagggguaaaagagaaaauacguaagaaaacugauuuuuauuuuucaggucuaacaaaauaucaccuuuuaaacccuuaacagaaauaaaaggucauuuucacucuuuuugcauaugucccuucuccaauuagugucaaagggcaauccucauuacucauuuucccucaaauuauuauuccuagaauuccaguuucaucaagucauucucuugcucuaaacuacccaguaauuucuuacagccuaguacuguaaacucucugucucuaacaaucuccccaaucuuaaacauuauugcacccuauacaaaugucagucuucucaucacagucugucagacacagcuugccugccuacccacucauuuauucaucugugcacaugcucauccaucuacacugucacuugacaaugcacacugaacaccuacuauccauagaauacuauccaggaaaaccguagaaaauaagucacacacgguccaugauaucacgugggggaagggagagcacaccaugccgauaaaaauuaguauaaaauuaaaaauuuuaccaugcugguaaaaauuaguauccuacuaaaaagguuccaggacagccaaagccaaagaaaccugagugacaaugccaccaccaccaggucaagaggaugccagagccuccuaauugaugucugcacuauguucagcugacagguggcacuuugccacuguggacuagcacuguuucauagcucauugcugcaacacucaauggaaaaggaaauucaaaaacaaaaccgcuauuauguuccuuauucauguguauuccagagacaacccuucaaauuuaaauaaaaaugaugaaaacaauaaacacuuaggaugaagagccacaacacgcucaccuugcucuacugaaacuucagggaagaaaggaaaacccggcugugaagaaaaagcucacuuucuggguaguuucuuucucaaauauaagccuauauuuacacuuuuuccucagugugugugugcuuauguauaggaguguguguguguguguguguguguguauauauacauguauuuuuccucuaccuaaaacaaacuuucaguuucaagucuauuagagauagugcauuacguuaacaaccauaaauagauugauauguucauuauacucaacuauaacaauaaauagcugguuaugacuucauuacacacaucuuuccuuccccagugagauuucaugggcuagugaugacaguuccaucuuauuuccagguguuugcugaagaggccucagaaucucgaggaaggcacaaggaacaaauugcaccugggcuuaacauauuuggcucuuauaagguauucuagcagaaaacugccaacuguccaccaacugaggaacagauauauguggacuauccauaaaguggacuauaaaaaggaaugaaaugcugacauacacaacaacaugcauaagccuuaacaauaugcuaaauuaaacaagccaggcacaaaaggcuuccaauuauaugaaaugucuagaauaggcaaauccauagacacagaaaguagauuaguuguugccagaggauaggggaagggaggaacagagagugacuacuaauagguacauggaauucuggggaauuuuuggggggugaugauaaugauguaucauuagacaguggugaugacugcacaaacuuugugggguuuuuuucauuaaaaaaaccauugaauuguauacuuuaaaagguugaguuuuauggcauauacaucauaucuugaugaagcugcuaaaggccuuccuaaguucucagaguaaaauucacugagauauuuguugacauuauggcugacugacucuagaaugaggaugaagaaagagaacugcuuuaugacuagagaagcgaacaauccagguccauucucaucaucuauugucuguuuaguuggcauuuaaauggcacuaaauauuuuucaaaguucacaggguuuugcccagaagauguuuucuucuuuaggaggaaacucuugugaauuuagaaucucauauuaugaacuaaaggugcaaagaguuuacacauaaaauuuugucacaaucuugggcuaucuucugaacacugcagaagauaaucagaauauuaaaaucugaaaaauguaaagauucugaagcacaagucaaaaaaagcauaagguuguuccugaaaugcuccuuacuacucgcuguuaaauccagguagucucguucagcugucaaaauccuagaauugauucguggaacaacauuuggcugauucaugauauacucuaccacaucuugaucauggggcaguucacccugcaagaaaaaaaaaggagguugaggggggaggguaaagcaaauuuuagcaauaauaauucauuaggaaccaaaaaauuauuaacuuuauaaauggcuuccucugugcuaauaauaguuaagacagaaguuacuauguuauuggucccugucacugccgaguauaccugggcacaucaccuacagcaucucuaccucuaucaacaacgugaggcagauauuguugacauucauuguaaagaugaggaagcuaaggcacagaaagguuaaauaacuuacucaaacucacaaagcuaaugcaaagugauuaugaaaugcaaacccaggccaggaaugguggcucaugccuguaaucccagcacuuugggaggcugaggaaggcagaucacuugagguuaugaguucaagaccagccuggccaacaugccaucuuuacuaaaaauacaaaaguagccgggcaugguggcaggugccgguaaucccagcuucucaggaagcugaggcaggagaaucacuugaaccugggaggcagagguugcagugagccaagaucaugccacugcacugggcuacagagugagacucugucccaaggaaaaaaaaaaaauaggaaaaggucuucucucaagcaguuaauauacuuuguaauaaaaaccacucccaucuuuguucaaucucagccauccaaauaaacuuacaucuccagagucagaauuacaaugagaggauaggaaaucauugucauuuauucuucccuuuugcacagcuaauauuacagaaauaguuauacuucuugaaggugaucucagagccaugugucaacaacugugcaaaugugcagauuuaucaaacuuaaaauauuuaacacacagguauacuuuaaagucauuuucuuuuuuuuuccuuugagacaaggucuugcucuuucauccaggcuggaguguaguaguauaaucaaaaccacagcucacugcagccuugaccuccagggcucaagggaucuuccuaccuuaaccucccaaauagcugggacuacaggcaugugccaccacacccagcuaauuuuuguauuuuuguagagaugggguuucaccacauugcccaggcuagucucaaacuccugggcucaagagauccucucucaccgugcccgaccugaagucauuuucaagauaaaagaugugaaucaaauauacacauucaagucuaaauaauuccaauuagacauuauuuguagcuauuuaauaaggagcauaugaaccaaucauacaaaucaaaagacaaagauauuagauggcucacuguacauguuggcccauguauacaacuuuggucaauauuauaaaucuacuugacuccaauuagaagcccaucgaguucaaggaggggaauuuggcaaagucuauaaaaauuuuaaaaguaggguugcagggccuggggaaggcguggcaggcgccaugucugccugugaaggugcugcugaaacagcccaagaagcaggccaaggagauggacgaggaagguaagacuuucaagcagaaacaaaaagaggagcagaagaaacaaaaauaggagcuaaaauagaaggcuauggggaagggaccccuggcugcaggugaaauuaagaaaucugggccgggugcaauggcucaugccuauaaucccagcacuuugggaggcugaggcggguggauaaccugaggucaggaguucaagaccagccuagccaaaauggcaaaacccugucucuacuaaaaauacaaaaauuagccgggcaugguggcgggcgccuguaaucucagcuacucaggagccugaggcaggugaaucaccugaaucugggaugcagaaguugcaguaaaccgagaucacaccacugaacucuagccugggugacaaagcgaggcuccaucucaaaaacagaaaagaaaaaaaaaucuggcaacaaguaagcugugccuugugccugaggagauggugacccuugauuucauucauauuuaaacaucuguauucccugccauagcaucuuuugccaccuauagcuggaaugaaguguuguccugaagccuguuguacauauaagaauaaacauuuguaaaaaaaaaaaaaaaaguuauuaauuaaaaaaaauaaauaauuguaaauguaacaccuucugaccagcccuuguauacacacacaugcacacaugcgugcacacacagacacacacacacacacaugguaguugucuugaggaagaaaucaugaguaguacagcacagggguguauggcuaaaaguuucucuucauuuacauuucuguuuugaauuucauaccacuggcauagcauaucucuuaauucuuuuuaaagaaacaaggucaugcccuguugcucagacuagagugcaguggcaugauuauagcccacuacagccucaauccucaagcaacccuccugccuuagucucccgaaguagcucagacuacaggugcaugccacaaugccuggcuaauuuuuuuuauuuuguagagaugaggucucguuauguuagccaggcuggucucaaucuccugggcucaacuaauccuccagccucagccucucgaaguguuguauuacaggcgucagccaccacaacuggcugauaacacaucuuuuuguagugcauuuaguucaaauuuuccaguacuugguauuuuucaagacaauguacaaagguauauacauauuagaauauucacuguagcacugucuguaacuagugaaaauguagaaguaauguccaauacuagggaaugaaguaaauguuuauuuuauuuuacuuauauauuuuuugagacagaguuucacucuugucgcccaggcuggagugcaaugucacgaucuuggcucacugcaaccucggccuccugcguucaagcgauucuccugccucagccucccgaguagcugggauuacaggcaugagccaccacgcccagcuaauuauuauuauuauuuuuuuuuuuucuugagacggagucuugcucugucacccuggcuggagugcaguggcgcaaucucggcugcacuugguucccagagggaaccucugccucccagguucaagcgauucuccugccucagccuccugaguagcugggacuacaggcgcccgccaccauguccagcuaauuuuuuuuuuuuuuggauuuuuaguagagaugggguuucaccauguuagccagaaugaucuugaucuccugaccucaugauccgcccaccucgguuucccaagugagccaccgcgcccggccuaauuuuuuuuguguguuuuuaguagagacaggguuucaccguguuagccaggauggucucaaucuccugaccucauuauccgcccgccucggccucccaaagugcugggauuacaggcaugagccaucgcgcccggccuauuuuuuauaauggaauacuggccaggcacgauggcucaugccuauaaucccagcacuuugggaggccaagguagacaaauugcuugagcccaagaguuggagaacagccugggcaaccuggcaaaaucccaacucuucaaaacauacaaaaauuagcugcaugugguggcauacaccuauggucccagcuacuuggaaggcuguggcaggaggacugcuugagcccagaaguucaaggcugcagugagcuaugaucacaaucccuacacuccagccugggugacagagagacccugucucaaaaaaaguuuugguaaggaaagugaccuuuguaacaauuaauuugccccacuacuauuuacaucuccccagcugcacaaagccuugaaaaucaauggccccaaaauaaaacaacuaggacacuagagaauucucagggguucucuuuauuugggcugaaccagaccucacucagugccaacagccuuuucccuggggguaucugucaaacacaacugggcaauuguuuaacaucuuagcugccugagguggcagauaacacaugggcuaacacaaagcuggucaaaaaacaaagaaaaaaaaaggcuggggaaugggauguccauaagggacuuugaaaagcucugacaaacuucuuggaauuugagagaccauaagcaccaugcccagggguacgugaaugcccagggaaaaucuuagaaggucuuaaacccuugccucuaaccuuggggcucugugcaagcaaaaauggaagacuaaggcagaguugccaacugccugguugaguguggaaagugugccccaacacaacacagagacccuuggggaaaacugggagacuuuuugaauucaugcaucaaaggaaaucucuguucguucaucagcugaccaguaaguuaaacaagcugaaacuucagaagccacacaugaaaaagaauacagauguuaaggaauugguucagggccgagcaugguggcacaugccuguagucacagcacuuuggaaggccgaggugaguggaucacuugaggacaggaguucgagaccaauguucugaaauuagagccuggccgaugugguaaaaccccaucucuacuaaaaauauaaaaauuaguugggugugguggugugcuccuguaaucccagcuacucgggaggcugaggcaggagaaucacuugaacccaggaggcggagguugcagugagcugagauggcaccacugcacuccagccugggcaauagagcgaaacucugucucaaaaaaaggaaagaaaauaaaagaaagaauugguucaggaaagucacuaaacaaauaacaguuacaacaacaacaaagaacaacauaaacccugguacggugaagaagugucacauuauauuauuucaaauuccuaguugucaaaaacaaaauuauuaaauaugcagaaaugguggcucaugccuguaaucccagcacugugggaggccaaggcggaaagaucacuugggcccaggaguucgcgaccugagaccugccugggcaacauagaaagaucucaucuccacaaaaagauacaaaaauuagccauguaugguggcaugcaccuauagucccagcuacucgagaggcugaguugggaagaucauuuaaguccaggaguuggaggccacagugagcuaagaucaugucacuguacuccaacccgggugacagagcgagacccuguaucagaaacaaaaaaaaaaagacaugcagaaagaaaaaaguaugguguauacucaggaagagaagaggccaagacauacuauucuuacuauuauauaaguaaaauguguaauguauauucuuacauuauguucauauuauucugaguaaguccaaacauuggacuuaauuagaaaaagaauuuaaauaaaugauuucaaauauauucaagaacuaaaagaaaccaugucuaccaaaguaaaguuuaagaccaacaucucaccaaauaauaucuauaaaccaaaggaaauuaucaaaaagaaccaaauagaaaucuggauuuauaauaacugaaaugaagcauucacuagagaggcucaauagcagauuuuaguugacagaagaaagaauaagugaauuugaagauagauaaacugagauuauccagucugaggaacauaaagagaucugugggacaugagagaguaccaccaugugcauauuuccagaaugagaggagggaagagaaaaggacugugugugguaaauaauuuggcuggcccuaguuucugggauguaaacucuaaauccagugauaggagugucuuugucauucauggugagccccuuaggacacacauggugguuuauacuacggguugaugcacaguggggcccgagagucugugcuaaugcaaugacucagguugggggcugguaacacuagaaagaccaaccacaugauuagagaguugggguucugagcaacaagcuaucuguccaauaucauccuguucucugcaaauuugauuuguauacaacguccagaacaagcaaaucuauuaagcagaaaguagguuuguguuugccaauggcaggguggcugggaguaggacaaaaugggcaaaauggagaggaguaauugcuacuggaugugggguuucuuuugggggugaugauaauguucugaaaauuagaggugguaguuacauaacuguguguagagaauaaaaacuacugaauuguaccguucaaaagacugacuuuuauacugucugaauuauaucucaagaacuauauauauuaauauuuauauauaaaugaaaaauaauauugagucucuccaaagccaaaauucccuacaaauagaauaaauguuucuuagaacugccugcaauuuuuaaaauaaacauuuaauccugaaaucaauaauacuaguuauuuaaauuaccauauauagaagauuuaugaauauuuucaucauaggacuugccaagaguuugcaaaccaauuacaagugacuuacagaaaauaguuuuuuguuuuguuuuguuuuuuuuaacgggacagggucucacuccaucacccaggcugggguacagugggguaaucacagcucacugcaaccuuaaacuccugggcucaagcgauccuuccaccuaagcuuccugaguagcuaggacuacaggcgugcaccaccaagccuagcuaauuuuuuaauuucuuuuuuagaaauggggucuugccauauugcccagguuggucucagacuuccuacccucaaaccauccucucgccucagccucccaaauagugauacuaagaauuuuacugccuacuauagaggcaacaaaaaauauaagccaacuguucucuuuaaaaaaucagccuugaaacgugacucaccaaguacaccgcucuuuggaagaaggugguggucuccaggauuuuaugcauugugaugguuucuaacucaucagggucuagcuguucccuuucaaagggcauuccauugaacagcacaacgggcagagguccaacuccagucugcucauaguagccucuugcuuccugaaacacaaguaaccacaaaaacaguauauuuuugccuuuugugagacaaauggaacacagcauauuuuucuuacaugccuguucuaacaacaaucaauagaaauauuguaaagaaaaaauaacucaagauauuucuuuuuaaaaaaaugaaaaaugacaucaaaguuaauauccuacuauguaaaucugagauugaauuacugaguucaaguuuuuacaagaccacaaaagcuugcaaauuaugaagugcguguguguguacguguguuuguguauguguguguguguguguguguguuuguguguguguguagcacaggcugucaaaacugaacuacauauucuacggucagcacuauacaacagaacuuucugcaaugauggaaauauucuaucugugcuugucugugcuguccaaugcaguagucacuaaccucauguaacuacugagcaccugaaaccugccaacuaugaccaaguaacuaaaucuuuaauuaauuuccauuuuaaaaucuacaugugaccaugggcugccaaaaugaggugcacagguuuugcuaccauaaauuauaagcgcucuaugcaaaaagccugagguaaauauuugcacccaauucuaaauaaggguccauaucacuaacaaagaaauuacaccugcagaaaacaaaacaagguuuguggggaaacagugcucaacaauugcucuaagacacaauacauccaaucuuuucccuucuccaggacaaaagagguucacuggccagaaaauacuggggcaacaaaacggcaaauguaccuaagacagacauuuuuccugacugucaacauaggugcuugucccucagauuaacuuuucagaguaaaaacuguauuaccacccaagauguaaagugggcaacuuuacaaaugucuaucgcacaccuuguaauugccauuuucugaaaauagcagaauuuaauuauuuauaaccauuuuagauagcaccaguagaaaagaacucccauuggguaacuaauccgagucaucgguaacagacugcuuacuuucuaaucagacaagcucaauaacagguaacagcacagaaacugacagccuaaaacauggcacagccuaaaaagccuucuagguugguucaagccacuucucuacaucauaguuuaaauguuuuaaauauacacuccuaaaacucuuaccauguuaauucuguucuuugacaucucgacuauuucauagauauccauuaaaacucaauuuucaucuaacuuuaguuuugaaaaucaucccugucaaccaauuaaaacaagaccagaaaacuuacauuauaauuccaagauacaauaagauaaauaacauugguuuugucugcaaacaguaacugaguggaagucaggagugacagggagguguuuggacuauguagcuuccuuuuucaccacucagaaauaguuuacaagaccaaauaacagaaugcagcacaauuaucaaacagccaaacugaaaauucauauggacaaauuuucuaucaacagcuaacuaaaaauauuaaauaaugauaaauaauuaacaaacauuaauuuuugguaguuuuauacugagccacucacaaacaacugagauuaguaaggacucgaagauaauaugcuaaagguaaaguguuugcccacguagguuagaacuuuuccuaauaucauuaucuuacuggcuuugaaagauauaaauauauaccuaucagacuauauauucucaucaguuuaaaauuucuacuuuaauugcauugccuacuuuuuaaaauaauuacuucuuucagacacagaagauaucauagcuucacuauaacaaaaggaacagauuuacaagugcaaugacauuuauuagaagcagccauuuuuccuaaaauuaaccauuucaaaagaauccauuccauuggacuuuuuguauagggguaaagcugcuguaguuaaaaaaaaaaaaaaucucauuagucauuagauuguuaggacuucugggauacucuccacaucccugccuuaagaguacuucuauucaaaaagcuagacaauuaaauggaugaaauauaaauaauaugaccuguuuguauacagaagagccucuaaucaguacagauggccaagucuaggaaacuaaggagcauggugugugauacucucauucaauuuuucagcacaaucaagauuucgacacauguaaagauauaaaaauacuccuuuccccaguuuguccacucuacucaucauuuuucaaguaaauacuuuugauaucauaaucauccacaauaaaaagcuacugguacuuucucuucaacaggauaagagaaaaugagacuuaaacaguuccauuaaaaguuaauaagcaaguuaaaaaucagucauaucuucacaagacugaaauaaaaacuuuuucaaacacugaaaagugaucugguuucuaaacuuuuaaaugcuaaguacugaaacacuuuaaccaccaucgccauuauuaaccaaagcccccaaacacgggguuaaggacaguacaauguugcaaucaaauaagaaacacaaagaaauuuuuuaccuuccgauuccgaucauaagcagaaucaauccccaaaaugcuauucacuucuacauacggauauuucuucuccaggacacugaccacauguucaacuuucacuuuuucuccaguccucaccuuguuauagaucugaagaaagaaaaaacaguugguuaacuacacuuuuaaguucaaauuucaaaguguuuauuccacauuuuucugaauuuagaggaaaauauacuuauuuuucuuuuuuuuuuuuugagacggaguuuugcugucacccagguuggagugcaauggcacaaucucggcucacugaaccuccgccuuccggauucgugugaaucuccugucucagccuccagaauagcugggauuagacaccugccaccacgcccagcuaauuuuuuguauuuuuaguagagacagguuucaccauguuggccaggcuggucuugaaacccugaccucaggugauccacccgccucagucucccaaagugcugggauuacaggcaugagccacugcgccuggccaauuacuuuucuugaaaggucaaauugggacauguuagcaauucuuccuuuuccauauaccuuacuaagauggcuuccuagguuggaaauuaaauauucuuuuuuuuuuuuuuuuugagauggagucucacucugucacccagguuggagugcaguggcacaaucuuggcucacuacaaccucuaccucccagguucaagcgcuucuccugccucagccuccugaguagcugggacuacaggcacacgccuccacgcccagcuaauuuuuguauuuuuuaguagagacgggguuucaccauacuggcuaggcuggucuugaacuccugaccucgugauucgcccgccucggccucccaaagugcugggauuacaggcaugagccaccacaccuggccggaaucagcucagucuuguuaagugucaaaugaaaaaauauauuaguuaagaaaaaucuaaauaggccaggcaggcaugguggcucacaccuguaaucccagcacuuugggagggugaggcggguggaucacuugaggucaggaguucgagaacagccuggccaacaugcugaaacccuacuaaaaacacaaaaauuagccugccgugguagugcacaccuguaauuccagcuacucaggaggcugcagcaggcgaaucccuuaaacccaggaggcagagguugcugugggccaagaucacacaacugcacucuagcuuggaugauggagugagacugucucaaaaaaaagagaaaaaucucaacacuuauaaguaguccuugaaauaaaaacuacauccacgauguuuaggagggaugaggaaagggagaggggagagauagagaaaucuaaauugacuccaguauuauuuauuugauuuuuuuuuuuuuuugagauggaguuuccacucaucacccaggcuggagugcaauggcaccaucuuggcucacugcuaccuccgccuccuggguucaagagacucuccagccucagccucccaauuagcugggcgugguggcaggcgucuaaucccagcuauucuggaggcugagacauggugccugccacuaugucugguuaauuuuuguuuuguuuuuugagauggagucucgcuucgucacccaggcuggagugcaguggcucgaucuuggcucauugcaagcucugccugccagguucaugccauucuccugccucagccucccgaguagcugggaccacaggcgccugccaccacgcccauuuaauuuuuuuuaauuuuuaauagagacagguuucacuguguuaaagccaggauggucuugaucucuugaucuccugaucucgugauccaccugccucggccuccccaaaguacuaggauugcaggcaugagccaccgugcccggcccaauuuuuguauuuuuaguagagaugagguuuccccauguuggccaggcuggucucgaauuccugaccucaaaugauccacccaccucggccacccaaagugcuggaauuacaggcaugagccaccacacauggccaauuuuuguauuuuuaguagaaacgggguuucaccauguuggccaggcuggucucaaacuccugaccucaggugaucucccucccuuggccucccaaagugcuggaauuauaggugugagccacugcgccuggccucaaguguuuuuacagugagcaguauuacuucacuucugaaauaaaaaacagcagccaagccccaguggcucacacguaaaaucccagcacuuugggaggccaaggcaguaagauuguuuaagcucaguaguucgagaccagccugggaaacauagugagacaucaucucuaccaaaaauuaaaaacaacaacaaaauuagcuggguauggugaugcaugccuguagucucagcuauuccaggaagcugaggcaggaggaucacuuagggccaggaguucaaggcuguaguaaacccugacugcgcugcugcaauccagccugggcaacagugagauccugucucuaaaaaaaauuuuuuaauaaaauaaaauaaacagugggugguggguguagcugguccuguugugcuguggcucugcacagccugcagucucaggccgcagagcccaagagacauggagccuggcuucaauggucacgcugccauuuaggagggcugguuccaugagaucugcagccugagcccagggaagccuuguugcuacagauggagcagcugcuccacugccagcgcucacgcucccaggauauccuuguuuuccacaguaagacccacagcagugugcugguguuggauggcaucauccccugcauggacagggacaaguucuccuacuagaugagaaucaaccugccauucagcaaccaccccaucccacaaaaggugcugaucgucggggacaaagacggcauccugcacaagguggugaagcaccccucuguggagucugugguccgaugauagacugaaaaggauggcacucaggucucuaagaaauuccugccggguauggccauuggcuucucuagcucuaagcugacccugcauaugggugacgauuuugauuucgugaagcagaaccaggaugccuucaauauuaugaucacugacuccugggauccgcugagagccucuucaaggaauccuauuaccacucaugaagauggcccucaacgaggacagcauucucugcugccagggcgaguaccaguggcugcaccuggaccucaucaagcagacacgguaguucugccagucacucuucuccaugguggcacacgccuacugcacuguccccaccuaucccaguggccagauugccuucaugcucugcagcaaaaacccgagcaccaacuuccagaagcccaugcaacaagugacacggcagcagguggagcaggugcagcugcucagauguguacagugcugccuucguacugcccaaguuugccugcaagucccugaaugaugugagcugaacccaggcgccacagcaggugccacccgggaucucagaucugggagccuccaggaugccugcgccccuucagcccuaggccagauccccugcugacugucaccugccaaccaaguguuacaagccucagaauacugcccagcuuucccugcugagugcuggacuguuucugugucugucucugugugacauucggccuccaagccuauaccagcuguguacaguaccaucucucuaucuucuuuggcccccucgaucaaacauguguacuuauaacaauaaaaaauaaaugaauaaauaaauaaauaaaaacuuuaaaaagcagaguuaaaauauucucugggcaugguggugcacggccguaaucccagcuauuugggacugacaugggaggaucccuuaagccuaggaguuugagaccagcuugagcaacacaacaagaucuggucucaaaaaguacauaaauaaauaaaauuuuaagguagccguuguggaagauauauucaaacaaacaaacaaaagcaaaccuuuagcagagauaaagugaauaaaauaacaaaguauaaaauacuuacuauucugagugacuucuuuugaaccuauuucauucuccgcagcccugcuuaacuaccuuccccauuacuucucauggagaucacugcaacagcucaucaacuggcaucccugccacuuugcuuugcccuuccucagauccaucucuauacacugcagcagacaugacuuuuaaauucaggacccaccccugagcucuauacaccccagcugccuagcauacaaugaccacacauuguuauuaagaguaaguuagaucugaaaaaauuauuugccauucugaacaaaaacguacaugugucagagucuggaaggcaugauaaucauccacuucuugggcaacauaauuauaugcucuaagaacagccacuccagcaucuugcaucccaucaacaucuucagagucauuaaccacaaagauaaaaccaauucuggagggaaagggaaaagaaaaaaagaaacaugucaaagaaugcaaaugguuaaaaagaaugacauccuuguacccuucucauacauuauagcuaacagaggaaaacucuuugagugaaaagcacaguucacagccuacucuacucuaacaugauuggcaaagguauacauacaccacuuacaaagguuuuuuuuuuuuuuagacagaguuucacucuuguugcccaggguggagugcaauggugcaaucucggcucacugcaaccuccgucucccagguucaagcgauucuccugccucagccucccaaguagcugcgauuauacgccacuaccccuggcuaauuuuuuguauuuuuaguagagaugggguuucaccauguuggccaggcuggugucgaacuccugaccucaggugauccaucagccucggccucccaaagugcugggauuacaggcaugagccaccaugcccggccacuuacaaaguauuaauaaaaaagcaggcucucaaacguggcuuaggccuuucuacuguuaaagcaagccauuuccacgucaugaaaagauuccuuuacugacaugaagagcguugcuauaguuuuaagagauuuuuuuuuucugauuuuaaacaaaaacuagaauaaaaauuuucacacuuucaaaguaaacagaaagggggggauugugacauuuagcacaugcaguaugagaauuauugguaaaagaaaagccaaaaaagguuuacaacugucccacgacaaaaagcaauaaccaagguuaaaguuuaucagauuuuaaauuuuaaaauaaaggaauuaaccacagagauacuauuauguaucuauagaugggcuggcaaaaaagacuuugcacugaacauacuggggcaaaggcauuucaauggacaaagaaucaucuuuucaauaaauggugcugaacaacuggacaugcacaugcauauuaaucagucuagaccagacuuuauaucuuucacaaaaauucauucaaaguggaucacaggucuaaauguaaaacacaaaaacaaaaauucccagacgauagcagagaagaaaauuuagguggucucgagcuuggcaaugauguuagauccaaaagcacaauccaugaaagacaacacuugguuaauuuggacuucacuaaaauuaaaaaugucugcccugugaaagauacuauuaacagaaugaaaggacaagccauagaguggcagaaaaucuuugcaaaacaaccaucugauaaaggacagguaaacaaaauaugcaacucuucuuguuuguuuuucaacagggccuugcucuguugccgaggccagagugcaguggcacaaucagcucauugcagccucaaaccucugggcucaaacaauccuccacuucagccucccaaguagcugggacuacaggugugugccaccacgccuggcuacucuuuuuuaguucucuguagagauggaggucuucucauguugcccauggugaucucaaauccuggccucaagcgauccucccaccuuggccucccaaaguccugggauuauaggcaugagccauugcaccuggcuuacaaagaacucuuaaaacucaacaauaagaaaacaaccaaaguuuuaaaaauggagacaaaagggcagggggaaaaaaagaagaaaaaagaaaaggacaaaaaaucugaacagacacuucaccaaacaagauauacagauaggugauaaauauaaguagauccugaacaucauaugucauuagggaacggcaaauuaaacaacaaugacauaccaccacacaccuaucagaaugaccaaaauccuaaauacugguaaaaccaaaugcuggcaaggcuguggagcaacaggaucucucauucauugcugguggaaaugcaaaaugguaccgcuacuuuagaacaaaacuaagcauacucuuacaaaacuaagcauacuauuaacacacgaugcagcaaucacgcuccucgguauuuacccgaagaagcuguagacauguccacacaaauaccugcacccagauguuuauagcagguuuauucauaacugccaaaacuuguaggcaaccaagguaucuuucaauuaagugaauggauaaauaaauggggggacauccacauaaugacuauuauccagugauaagaagaaaugagcuaucaagccacuagaagacacagaggaagcuuaaaugcacauugcucagugaaagacaccaaucugaauaggcacacgccguaugacugcaaccuaguucuggaaaaugcaaaacuaugaagacaguaaaaagaucaguaguugccaaagauuuaggggaagggaggaagagauaaacaagugaagcacaggagauuuuuagggcagugaaacuaaucuguauuaaacuguauuguaaugugaauacuuuacaucauacauuugugucaucaacacaaauaacaaaucuuaauguaaacuauggaguuuaguuaauaauaauguaucaauauuuagcagccaacaugcaggaccacaugagcuccuacaaagaaggaaagagcagccuguaugccuggcucucuccaacuauucacaaucucucaguugccuaggaguucaagugccuucuucucaccugccuuugcaaucagaagaccacaugcccucuucucgucccucaauucaagaaauauuguauuagugccaacuguguaccacgacccaacuucuucuguguccuuauauuucucuuuugaucaaaacauagcucugguugugauccaguaauagguucuuccaucuaaccagauguauucaugcuuuauaugaaaaaugucaugaaacucaaaaucucugcauuuccaacuaucagaacccucuguuuuccucaaagccuauuugaaauccaacuucuccaaaaaccuuuggcuucccaaauaucucaaugauuuuuuuuguuucccugaaauccuaacgcacuuauaacuaaccaguaggacauaaccuagcaguugaucauauaucucccuaaaggguuugaaaguauacagaggaucuuuuccaagaagguagaauaaggcauacauguuuacagcauuuagcccaguaguaaucauggaacacacaguaauauuuauugaauaaagaguuauuuucuucuuuauuuucacauuuucuaagaauuaaaauuucaccaacauguaaaauuaccagaauuauuuagaauguaggugaaaauaucuuagcauuuauauguaaaaccuuuaaaaaauaaaaaaaacuguucuuaaaaagacaguggaaauccagccacucaguacccuguaggcagguuuggcaacacaagugaaguaacuguuacuguuugcaucuacaaaaggcuguguauauguuuaguccuugacaggcuaacaaguuauuggcaaugcucuauaucucugcugaaaguggaaauagguuuugugauguggacacucaccuaggaaaauucccuuccauugggaagcaagcugcagccagaaacuauuuuuacaugggcuauuuauugauaauucauuggugguaagcuucuauucauugagaagcaaauucucagucccaaaagacacuggcuucauacugaccagaagauaaaauugccauuagugaugugcacuauuaauuauccuacaacucaguagcaccagacuugcauuuaaaaaugacaaauaaaaccucagcuaaauuagauacaucaucaaaucaauaccaguguuaccuuagugguauaugauuacuaaggaacaucucagcuguguucaucaacucugcuguggucucaugugcaggaucaacuaugaaaaccuguugaagaaagggaaaagaacacaugaaaugacauuuauucaaguaucugugggccgagaaaaauguuaugagucacuguacaugaagccaaccuuuuucgagcuacgcuugaaccacauaaaagaugaauuacacacauagcagcuaccucccucuauguucaaaaaaccugguacugaagggcuaggugauuuucucauggacuuacgcugauaacaagggaacuguacuccaaagugaugaugccgcuuuuucuacuacaccaaaugaaaaccaaguuuagcaacucucucaccuuaaaaaauggagccugccuuuuuguauauucauuucugaggaucucugaauuaagaauucacuuagaaccuaauucuuagaccacagccacagcugucaggcaagcauauaaacacguauuacguguuaagcaacuuagacguauucucucgcuuaauaaaguucagacaugugguaaaacagaaugagauuuaaauucugacuagaaaggaaagaagugguuucaagagacagaaaaguggccaggcaugguggcucacaccuguaaucccagcacuuugggaggccaaggcagguggaucaccugaguucaggaguuugaaaccagcccagccaauguagugaaaccccgucucuacuaaaaauacaaaaaucagccaggugugguggcaugcaccuguaauucccacuacugggaggugaggcaggagaaucacuugaaccccagggggcagagguugcagugagccgagauccugccacugcacuccagccugggcaacagagcaagacucuuucugcgggaguggggggaagaaaagagacagacaagaagaaaaguagagaggguaaucuucccugcaaguucugaggaggccaaccuuggcacuaacccuaccacuaucucuuucccggcugugugagggaagggaaagaaaugagagggaaaaagugggccaaugaagaacccucucucucucucucucuaaagcagugcaagaaggaauaacaaguaggaguuggcaaacaaccauauuuaagggaauaaauuaaacugcugaauuuuagggauuaagauauuaaagaaaaacaguagcaauaugcuguaauauacuguaaaaaaagagcuaucuuaaaacuaguaaaacaauauugcuaugaaacuaaaacugcccuaaaaaauauaaagucuuaaaauaaaaacaaacacaucacugaauggugugaagaguaugaaaaggaaacuuauucaaucuggaaaagcugauuagaaaaaauaaaaauuaaaaaauuaaaaauguuuuaaaauuaaaaacaaauuaaaagacuaaaacaauagucuaaaccuucguguuaaaaaugagcauuuccccacacucugaggggggcuguaaugcuccuguuacaucccacagccccacaaguggucaguacacuacaaagccuuuccagugugaacagggaagaguauuuggugaagggugggggaggaagcagcuaguaaaggugagaagugaccauucuacaugacaaaaaaagagggacuaggcaagggagaaacagaguucacagccagacaauaaguuuuacuuaccauauuauguaaguuuuuccugaucugccgaauaacaccaggaaaggugggucgaagcaacucuuguaaacuagaaggccacgaauuauaucugcuaucaaccuccagguuguugacccacuacaaaaaauaacacaacaggauacaugcacauuaggaaccaguuaguaaaaccugcaauaauaucaauaagacuuuaaaauauuuuaagaagaaucaugugagacaagaccauuuucaaagauaaaaagauuggcugcagugaguggcucacaucuguaauccuagcacuuuggaaggacaaggcaggaggaucacuugagcccaggaguucaagaccagccugggcaauauuaugagacccccaucucugcaaaaaaauauaaaaauuagccaggcaugguggcugcugucccagccacucaggaggcugaggcgggaugaucaccugagcccaagggguucgaggcugcaaugagccaugauugugccacugcacuccagccugaacaacagagcaagacccuaucucaaaaaaacaaacaaaaaagauacaaagaucgaguggaaaaaugagugacuaaaagauaagccacagaauagaugaagacauuuguaaccuacaaacccaauaaaggacuagcgucaagaaugaagaagacauaaaaauaaaagaaagaagcgaaauuuuuuuuguuuguuuguuuuuguuuuugagaugaagucucucuauugacgaggcugaagugcaguggagcaaucucggcucacugaaaccucugccuccuggguucaaacgauucucgugccucagccccccgaguagcuggaauuacaggcacccaccaacacgcccagugaauuuuuguacuuuuaguagaggugggguuucgccauguuggccaggcuggucuugaacuccugaccucaagugauccgcccaccucggccucccaaagugcugggauuacaggugugagccacagcacccagcccuaaacuuuuuaagaacaaaggaaaaaagaaaauguaaaaaaaaaucggaaaaaaaaaaagaauaugaaaaauaaacagcggaaacccaaaugggcaauaaacauaagaaauguguacacccucaauuguaaucuaggaacuaugagcuaagaccucaaugaaauuucauacucgcuagacagaaaaagugaaaguuugucaagaccaagaauaggaaaagauauagagcaaagagaacucucaugcaaugcugguauguggacaaacacuuuagagaacuggaucuaauaaaguugaagacuauauuaguacuaauuuuucuaaaauaaaugcaguacugccgggugugguggcucacgccuguaaucccagcacuuugggaggccaaagugggcagaucaugagaucaagagauugagaccauccuggccaacauggugaaagccccaucucuauuaaaaauacaaaaauuagcugggcaugguggugugcgccuguagucccagcuacucgggaggcugaggcaggagaaucguuugaaccugggaggcggaaguugcagugagcugagaucacaccacugcacuucagccuggcaagagagcgagacugcaaugcaacacaacgcaaugcaacacaaugcaacacaacacaacacaauacaauacucuaguuccagauaucuaccccaaauaaauucacauguauacacaaaaagagaggaaaaaagagccuaauuaaaguaguguuuacaacagcaaaacaucagaaacaacuucauguccacaaagagcaauuguucaggaggcugaggcaggaggaccucucaaacacaggaguuuaaggcuguggugagcuaugauugcauuccugcauuccagcaggguuucaccauguuggccaggcaggucuccaacuccugagcuaaagugauccgcccaccacggccucccaaagugcugggauuacuggcgugagccaccgcgccugacuggauuaucccaauuuuuuuuuuuuuuuuuuuuuuuuuugagacaagagucucacucugucgcccaggcuggaguacaguggcuugaucucggcucacugcaaccucugccucccgaauucaagcaauucuccugccucagccucccaaggagcugggauuacagguguguaccaccacgcccagcuaauuuuuguauuuuuaguagagaugggguuucaccauguugcccaggcuggucgcgaacuccucaccucaaaugauccacccaccucggccucccaaagugcugggauuacaggcgugagccacugugccuggccucaaauuuuuagaauauuaaauaggagucagguaagguggugcaugccuaugguuccagcuauucaggaagcugaagcaagaggauugcuugaccgcaggaauuugaguccagccugggcaacauagugagacucaucucuaaaaaaacaaaagaaagaaagaaaaauauauuugauagaaaauaaaaggauaaaauaagggacaagggaaugcacaccaacuugagaaaagauaugaacuucaggaaggagaggggugguugguaagggacaaagaagggcuucaacuaaaacuguuucuucccccaagaaaacaguuaaaucugacacaaaaugauuaaauguuaacauuuaguaagcaugaugauggguccuaugguuguuagucccuuuauguuugcauaaacaugucauguugauguuauuaucuuuuacucuuuauaaguacuuuuaacagaaaagcaaaugacauuaacaaugucuucaucaaaauaaguuauaucaccaaguaugaauucaaguaaugauuaucuacauucuacauuauuucucuuaaauaaaauuuuucuaaaaugaaugcaguacagaaaccaagaaaaaauaagaucagcucuccacucaccuuauuuuuuaccacaacugcccaagauggcacuauuccccacauucucuauuuuuuuuuuuuuuuuugugacggagucuugcucugucacccagacuggagcgcaguggcgugaucucagcuaccuguaaccuccacccccagguugaagcaauucuccugccucagccucccgaauagcuaagauuaggaggugugugccaccacacccggcuaauuuuuguauuuugaguacagacgggguuucaccauguuggccaggcuggucucaaucuccugaccuuaggugauccacccgccuuggccucccaaagugcugggauuacaggcacgagccaccaagcccagcccuauuccccacauucucugacagaugacaagacaaaggcucagaaagaucauauggcaggcaaaagucuauauaaauccuucaaaucucaaauaucaaaauccuacuaaagaagguucuuagcuaaaaagugacauuuucaauaguaguuuuaauuuacagaugucacgacaucacacaagaucuguaugcaauugagaaaauacaaacuaaacgcuuuuucccaagagaugcucagcugaauaccaggggcaugcucaagugaaaaaaaucacugucuuggccaggcgcacugguucacgccuauaaucgcagcacuuugggaggcagagguggguguaucaccugaggucaggaguuugagaccagccugaccaauauugugaaaccccgucuauacuaaaaauacaaaaauuagucaggcgugguggcaggcuccuguaaugccagcuacucgggaggcugaggcaggagaauugcuugaaccugggaggcagagguugcaguaagccaagaucgcgccacugcacuccagccuggacaacagagcaagacucugucuugaaaaaaaaaaaaaaaaaaucacugucuuaaccacauuagcaacaauaacucaacuuuuugaagcauuuaagggccuacuuuauuacauacacaaagucccauauaagcaauuauaaaucuuucacaccaacaaaagagauggugggaguaacuucacccucauaagagacaaaucagaaaccauaaaaaagauuccuggucagaaaguccuuugaucacccuaacaaaauacucacugaaauagcaggacuccggaugucuacggcauagucugccucagagggcuggauguucagcuucaaaacauuaugcagagaaaggccuucuauucccaaucuaugcagacccuccauuacccgagcuucauuccucaacacaucaaacagacuggggggaaaaacaaaaagagauauuuacuaggaaaaaaagcuuuuaaaaaaaauucucaccaugaaaaaaaauguaucaguucaaccucaaugccaaaucaaauuaauugagaaauuuaaaaaagcaauaaacacacaaauugaggauaaaauaacccuaaaucuauacuuuuacaccacaugauuuuaaaaacaguacauuaaucucucuguauucuuucuuauaacugcauauguauuuacaauuaucucaaaauaaagauuaaaaagagauacuacauuauauaugcuuaauauauguuucaaugucaguaccaauucacagaggcaaacauaugaccacagaaaaaagccugaaagaauccacacccaacuuagagguuugcugggagagacagaagagauagagaugaagggcugggcgcgguggcucaugccuguaaucccagcacuuugggaggccaaggcgggcggaucacaaggucaguaguucgagaccagccuggccaacauggugaaaccccaucuccacuaaaaauacaaaaaaaauagcugggcaugguggcaggugccuguaaucccagcuacucagaagggugaggcaggagaaucucuugaacccgggaggcagagguugcagugagccaagaccaugccacuggacuccagccugggcaacagagugagacuccgucuccaaaaaaaaaaaaagauagaaaggaaggagaaauaagaugugauuaaaaaaauuucuuuugagacuccaucucaaaacaacaaaugaauaaagucugaauugugccugucugcuacccaccccaaaaucaugaagacaaucgaaugcaauuuaauacugaaccacauuuuaccaaaaaguggauauucaaauaauauauguagacagaacaccuucugagacacaagagacaguuuuuuuuuguuuuuuguuuuuugagauggauucucacucuguugcccaggcuggagugcaggggugcaaucucagcucacugcaaccuccgccucccagguucaagugauccuccugccucagccuuccaaguaguugguacuacagauacacacuacuaggcauggcuaauuuuuguauuuuuagcagagaugggguuucaccauguuggccaggcuggucuugaacuccugaccucaagugauccgccggccucagccucccaaagugcugggauuucaggcaugagccaccgugccaggcccagaggcaguuauuuuuaauaaaucuacuucacacuguuccaaaagccaaagaaccuguucuuuucuauguucccaugguuaaguggaaaaguauagcuucuaaaaggacagccucagaaaacacucaggccuugaacacacacuguaacacaagauggagauaugucauccugccuacccaucauggcaugugccuacuaccuacguccacccagugggggcugguaagccaucagacuuugcaucaugccauaucaagaaggaacggcaauaugaacauguuacaaggugcuacgcauuacaaaaacuuuucagagaaugaaaaauauuauccauaccugaauauauccuguguaucuaaauccaugugaaguccauugaugaagagggcugaaucuccagguuguaauccuaaaguucccuugaaauacugaaaaauuuuaauaauuauuagggagcugugagagaauguuuuaaaaaaaauuuuauuguuucugggcuucacuaccuguacaaaucuuggcauccuaaggcagggcuaagauuugcuucaagaugcuguugggauucaauggcaaguaagacaggggauaauaccacaguguauacacauuucgaaacauguuguacaccacaaaaauaugcaauuuuuacuucucgauuuuaaaaagaagagaaaaaaauaaggagaucauggaaagguguaucaauugugaacuggaauuucuuccgagagagaggaauucacaucuacucacucgcuggcugagugcacagcaccaucagacgauaaaaaaaggcugauccaggccaggcacagaggcucacaccuguaaucucagcacuuggggaggccaaggcagguggaucacuugaggccaggaguuggagaccagccuggacaacguggcaaaaccccgucucuauuaaaaauacaaaaauuaaccagcuauggugguguacuccuauagucccagcugccuaggaggcugaggcacaagaaccgcucgaacccaggagguagaggcugcagugagccgagauagcaccacugcacuccagcuugaacgacagagcaagacugucucaaaaaaaaaaaaaaaaaagacugacccugagcuggugaauagcauaucuauuucuaggucuggacacugguaauauagauggguucauuuugggaaaguucaucaaacgaaugacugagaauuugugugcuucccucuuuguguuucauauauacauuuugggcagggcacaguggcucaugccuguaaucccagcacuuugagaggccgaggcggguggauuaccugaggucaggaguuugagaccagccugaccaacauggugaaaccccaucucuacuaaaauuacaaaaaauuagcugggcgugguggcagguaccuguaauucuagcuacuuaggaggcugaggcaggauaacugcuuguaccugggaggcagagguugccaugagccuagaucaugccacugcauucagccugggcaacagagcaagacucugucucaaaaaaaaaauacauuuuggucaagcaugaugguucaugccuguaaucccaccacuuugggaggccaaggcaggcagaucaugaggucaggagaucgagaucauccuggccaacauggugaaaccccgucucuacuaaaaauauaaaaaaauuagcugggcgugguggcacgcgccuguagucccagcuacucgggaggcugaggcaggagaaucacuugaaccgggaggcgaagguuacagugagcugagaucaugccacugcacuccagccugggcgacacagcaagacucuaucucaaaaaaaaaaaaaaaaaaguauauauuuaugcuuuaauaaaauguuuuacucaaaaaaaauuaagacuccaugaaacagcaauauaguauaauuuugucuuccuuaguggggaaaaaggcccuaaauuuaagauaauauuugauauuuuuacuuuggaaacuaaaaaguaaauaaaaacucccaauaagguuuuucaauuuaguaaacauuugagaaacauuuauuuaucccucagauguacuuaauucacuaauaucucagauauaaagauuaaggaaauuugggguaaagauagugaauugaacauaagaacauuuuucccuccugaauucuacugaaaugucacuagagcuacuuuuucaguuauaaauccacaaagacaaagagaacaggaaagaaaaaggccaccaaauuuuggaagcuggaagagaggugggugaggagucacugucccaacagcccugagaaagcugaauguuagaccaacaacaggaaaggucaacaagaaaccugugucacccuguggaacucaccaaaggcucaggaacuggcagcacacaggacauguacaaggggugauuauuagcuaaguucugauauaaagcccuuuaagacaaaaccccccagccccccaacugauuucccacagccaggugccugaggucggugcuacccccuacuccagcaaaaugaaggcucauucccuggaaaagaacaaaacagaacaucuguggacaauggcaaaucaagcacaaggaggacagggaccccacacacauaauggggaaucgaaggcaagucaccaaacgcucuucccuacugugcuucuacagcucuagcaaacagauuucacccaccagccagaagacugacggauccuuuucuggagacugacaaggacugaccaacccaaaagaaaaggaacaaagauacuguaacugggguucccuaggaaauggucacaacagaacaccuuacagucacaaagccacaucauuaggacuuccaaccagguccuuagugccucacucugagugugaucaccagacaccuaaggaaggccuccaccacugaaaagaccaaaacccaaaaacgcagcuuaagaggaaacagacuuugcagacagaaaacacaagcaccauuaucuucagagauacacgggaacaccauaaaaagaacaaaaaaaaccccugaaaauuaaauauuugacaacuaaaggaaaaaagauacacacagguuaaaaacucuuaccagaaaguguuuuuuuuuuuugaaaaagagaaaagaauaggaaagaagagacuuuuaaaaggccaaacuagucagaggugcaacauuuaaaaaauaaauaaauacauauuucuaggaaaagaggaaagagaaaccagagagaagaaacacaaacaaagaauuuaagaaaauuucccaaagcuaaaggaaaugauuuucaagauuuuaagggcccacgaaccaccuaacaguacagagauuuuuuuaaaaacacacauaauuaugaaauuucagauagcuagagucaaagaaaagauccuuaagagaucucauacaaaggcuucagauuucucaacagccacaauggaaacuaaaauuccaagaggcgaugccuuguuucaaauuuugaaaugacuuccaaccuaaaauuguauaaccugccaauauuguauaacgagcuaucaauaaaaacaaguagaaaguuggcugggcgcgguggcucaugccuguaaucccagcacuuugggaggccgaggcggguggaucaugaggucaggagaucgagacuauccuggcuaacacggugaaaccccgucucuacuaaaaauacaaaaaaauuagccgggagugguagcaggcgccuguggucccagcuacuugggaggcugaggaagaagaauggcgugaaccuggaaggcggagcuugcagugagcugagaucacgccacugcacuccagccugggugacagagcaaaacuccaucuccaaaacaaaaacaaaaacaaguagaaaguugauuucucagaauuucaaauuugccucccaggcaacuuuucucacaaagaaugaugagcuguaccaaaacaaggaaauaaaccaaaaacacaaaagacauggaaucaagcaacagaggauccaacaaaggagguuaaaggaaggucucaggaugaccggcaugcccugggcauaaagagcaaccaguccaucucagaccacaucaaaaccagguaaaaccacaacauccaauauugagaagauggauagacaggaacagugccaauauagaauaguggugggacacugagggggaggcagugaaagaaaguuaaaccacacuguuuaaauaggaggccaauauauaaugucugaacgugaaaaauaaaguaccaauguaagcuagaauucuggagagaaauaucagaagaaucagcuaaaugucgaaagugaaugucuucaggaacggggugagacauguuaggggugcugcuuuccuaaacaacacgguagcaccacuucaugcuuucaguuaugugcauacugaacuuucauuaaaaacuaaaaaugcaaagaucacagaaaugaaaaaaucaccaucuuagauaaaagaagagugacacuguuaaaugcugcugauuaaacucagauuuccuuaucuuuaaagauagaauacaaaacaggucaguauuuucuaucggugaauaccuucugauucucuuccacuucgguucuaaguucugagcucacagcuguuuuuguuauugcucuaaggaaauaaaaacauuaugagugcuuggcuuaauauuugauauaaagucuucaauuuccauauuuuaaaauaugaaacacauuauucaauaaauuagaaaaaacugaaugggaaaaaccuuaaauuuuuauaauugauaaauauauuucuccuuucucagauguguauauuuuuuguaagauacaaaaucaaagaaauguagcagcuauagcauuauaaaacaggugcaguuguuuccaaguucuuaaaacauaugcaccccauuucuauauaugaucucuacuacucucaggcuaaaaggauaauguugaauacaccaaggcagcagauugcucuucccacuuaagcacuuaugguggagguggaaucauucauguauaccuucaaguagcagcuggacuaaaugagaauucacuacaugaugucuaagucccaaauaaacaaacuuaguuauaaaauaucucacaucagaagucaaaacacuucauucagugacucaagaaaaugacugggaaccauucaagucaauaguuucuaaaaauguggcuuuuaaaacaauuuugccuugcauuuaugagaugugcagcaauauuacagaauugaaggcaaugucagaaaacguacaaacaaaaucuuuuuuuuuuuuuuuagacggaguuucguucuuguugcucaggcuggagugcaauggcaugaucuuggcucacuguaaccuucaccucccggguucaagcgauucuccugcaucagacucccgaguaacugggauuacagaccccugccaccacgcccagcuaauuuuuuguauauucaguagaaaagcgguuucaccauguuggccaggcuggucuggaacuccugaccucaagugauccacccaccuugucgucccaaagugcugguauuacaggugugagccaccaugccuggcccacuucccccuuuugagcaccagacaaggcggguggaucaccugaggucaggaguuccagaccagucugaucaacauggcaaaacccugucucuacuaaaaauacaaaaauuagccaggccuuggccucccaaagugcugggauuacaggcaugagccaccaagcccgguccaaacaaaaucuuauucugucacuaugaacuagucacuuagccucuaugacucaguuucuucaagauucaauaagaugacauauguaaaaccuuucaugaagaaaaccacuauggucugggacagacucuagauuaguuaguuauaugagcaagacucauccaauccugaaaggcagguauuuuaauucucguuccacugcugaggaaacugagguuguuuauuugcaaaggucacacaacuaauaaguggaagugcuaagaacauaaccuaaaucugucacuucaaccacacaaugcauggucuugccaucuucaagacacagagcaccaucugcaauaguaguggugguggucauaaagaaucuuaauuuucgccaggcgugguggcucacgccuguaaucucagcacuuugggaggccaaggcgggcagaucacuugaggucaggcauucaagacuagccuggccaacacagugaaacccugucucuacuaaaaauacaaaaacuuagcugggcauggugacgcacgucuguaguaccagcuacuugggaggcugaggcaggagaaucgcuugaaccugggaggcggagguugugguaagccgagauugcaccacugcacucuagccucggcaacaagagugagacuccaucucaaaaaaaaaaaaaaaaagaaucuuaauuuucuaggaauuuucauauuguuauuaccucauuuggcaagugaacaugacgaugacuggguaugauguuaaggagaagagcauuauucuacauuaccuggcuuugguaggaaaauucugacuaagauccuucaugacaaccaaagccaacucaacaggagaagccaagauucgagcagcagucuggaaacugagaucugcaacaaugucaaauauaauuaaaaguggauuaaucuaaugcaaugagaagcagaaaacaaaauccaaauuuacuucccacucuuuucaugguaauuaagaauaucuucgaaugcaaccauuccagagagugcccaugauuuaauuucagguuuuauucacuucaaagaucucuggaguauucaguugagccguuucugauauaucugcagaaaacacuagggcacacacuaacgcuacacuaacgcauguagcacaggcuaaaucaggcccaaguccuuuucccuuuucuaaauuuacaauacaucacaaaauacagcaugaagacuuuuaguaaaugacguuggggaaaaaaacuugaaaaauaguucuuuggaacagagaaaaacacauacauccugccacaaugacaugucuuaaacacucuauagauaaacaguugaagaaauguauauauauaggaacuuaggacuaugaccugcuucucguauuacaaguuuauguauggucacacagaaagacuugccauuuguuuauauauauuacuucuaccuaguguuaucuguuuacaaaaggacuuccuuucuucccugauuaaucguaauuaaucacucuuaucuuuaaaaucugaggcaccuucagaaucacguacuacauacaauuaaauucaaauuuugcauuuuuuaaagccauaaaacuuagccaaaaaguaggccaaugaccucucccuguuuucauuaccuugcaacugccaaaccuuuaaaggugccauuucauuggugcucucuacaagaugcuuucugaguucuuucaacugucccuccaggucggggugcagaucucuaaaagaaacauaaaaaucaguccuuuucauuauuuuuucuuucccggagcauaagaagaaguaaaccaacuuuaucuucaugguuuuccucucccaacccuaggaaauuuucuacgacauagggggaaaaaaugaaguauaauuauuccucuuuaaaaaaaauagaaaauuagaagcuaguuuaaaacucauaaaauuuauagaaaaauugcuagaauagugauucccuaugagguagauaaggagacugagagugguuaacaaaggagacuuuucaggccaggugugguggcucacgccuguaaucccagccacugaggaggccaaggcaggaggaucacuugagcccaggaguuccaggucagccugugcaacacagcaagaccuugucucuuaaaaaaaaaaagaaaaaaagaaagaaagaaaggaacaaaggagacuucggcuauaccugcaguguuuacugaccuguuuuauuuuuuguuuguuuuccuuuguucuuaaaguaaaaaaaggcuuauacugggaaaaaaagaaagcuuaauaaauaguucuauagaagagaaaagcaaguaugacaacagcaaucuauucuggguuguaaguaugugggaauaaauuuuucucuaugcuuuugugaaucacuguaauuucucaaaguaaaacugaagggaaaaaaacugcugccagucccaaaaugaguuuccuuuagccuacaugcucauaaaucucuuaguaacaugaauacaauuuaggcuaaccauaguuacuggguuuuaucuuuaaauauagcauauuccacuauaguaaagcagaggugaucuggggcagagauauaacauuuacaucagacagacggcuaguacauuacuuuuuucuuuuaaaugccauaaacucaaaauuucuuuuuuuuuuucuuugagacagaguuucacucuuguugcccaggcuggagugcaauggcgugaacuccugaccucgugauccgcccgccucagccucccaaagugcugggauuacaggcgugagcuaccgcgcccggcuaacucaaaauuucuuaauacaacauacagaaauuaaaauucccucagacuguucacuguccaaccaacccacuuccugucaguuacuacagccugagcaucccaaauccgaaauucugaaauccaaaaugcuccaaaauccaaaacucauuaaaugucaacaugacaucaaaguaaauguucauugaagcauuucagguuucagauuuucagacuuggggugcccaacugguaaguaucaugcaaauauuccaaaauugaaaucugacacucuaguucuaguuuaagcauuucagaaaaaagacacucaaccuauacaaacucuuaaauaccaaaaaugaggccaggcgcgguggcucacaccuguaauccuagcacuuugggaggccaaggugggcagaucccuugagcccaggaguucaagaccagccugggcaacauggcaaaaccccaucucuaccacaaauacaaaaacugaagugagaggaucaccugagccucgggagguggaggcugcagcaggccaugauggcgccacugcacuccagccuuggugacagacugagccugucucaaacaaaaaaaaaaggucuaauuacuuuggauagcuaaauaacuauucugaauguccaaaagguaaaacagccucaauauucuugauaauaccuuugugcugugaaugcauaaaaucaucaugcuacccaaaaaauaaacauaaacaccacaaaugugaaaaaagauucugaagcugggagugguagcucacaccuguaauucuaacacuuugggaagccaaggcaggacaaucacuugaacccaaaguucaagaccagccuaggcaauauagcaagacucuaucucuacaaaacauuugaaaauuagccaggcaugguggcacacaacuguagucccagcuauucgagagggugagguaggaggaucccuugagcccaggaagucaaggcugcagugagccgugauugugccacugcucuccagucugagugacagagcaaagcccugucucgaaaaaauuuuuuuagaaaaggauucugaaagccugagucaaauaaaaauagaauaugauuacauucuaacaaggucaaaacugauguuaaacgagaagaaauguauauacauguaggaugaacucaacauguaauucaauguaaacuaagauaucucuucuaaauuguuaaucugguuauuucacuuggccaaaucucaaagcugaaguauauaaaacugagucuagcauauacuauuucuauuugaucacuuucucucucuuucccucucucucucucucucucucucacacacacacacacagacacacacacacacacaaaauguccuaauaaaaacugccagauaaagcagaauucagggcucuaaacaauuaucaagccaugagggaaauaacuucaacuuuuagaauaacagcuaagaagacguuccaggccaggcacgguggcucacaccuguaaucccagcacuuugggaggccaaggcgggcggaccaggaggucaggagaucaagaucauccuggcuaacacagugaaaccccaucucuacuaaaaaaaaaaauacaaaaaauuagccgggugugguggcggaugccuguaguuccaacuacuugggaggcuaaggcaggagaauagcgugaacccaggaggcggagcuugcagugagccaagaucguggcacugcacuccagccuaggcaacagagcaagacuccgucucaaaaaaaaaaaaaaagaauaacaguuaagaagacuuuccagcuauaaaauacuaugaugcuuacauuaacagguuaugaugaugcuuucauuaaaugauuacauaauuauggaauuuuuuaaaauaccauuuccuuucacauaaagcaaauucuaauaaaauguuuuuucugagcugggggccauggcucacgccuguauucccagcacucugggagagcgaagcaggcagaccacuugaggccaggaguucaagaccagccuggccaacauggugaaaccccgucucuacuaaaaauacaaaaguuagccaggcauggugaugggugccuguaauccuagcuacucagggggcugaggcaggagaaucacuugaacccaggagacggagguugcagugaacugagauugcaccacugcacuccagccugggcaaaagagcaagacucugucucaaaaaaaauaaauaaauaaauaaaaaauaauaauaaaauguuuuucccauugagcauguauaaaauuuacuauaucuauuucgcauuuuugcucagacuauguuugaaaaaaacuuuuaaauacauuuuuuccugggaaaauauuaagugaaacaauucaauuucuccucuuauggcaaucaaaaaaugguauguaacuuaaugccaucaacugagaggcaagaaaaacgcacuuaaacugugggcagguagccauacuaucaauuaagaauaaugugcuucaggcuggacgcaguggcucaugccuguaaucccagcacuuugggaggcugaggcgaguggaucacuugaggccaggaguuugagaccagccuagccaacguggcgaaacaccaucucugcuaaagauacaaaaauuagccgggugugguggugcaugccuguaaucccagcuacuugggaggcugagacagaauaaucacuugaacguggaaaguggagguugcagugagucgagaucacgccacugcaccaaccugggcgacacagcgagacccugucuccaaaaaaaaaagaauaaugugaaaucauaaacuguacuauaaacuaagugguugacucuccacguaggauugcauacauaaaguacuguuaggagaugagaaacucagacaguaaugaguaagaugaugcuuaaaaugcaagaaagccuggaggcuuaaagaaaaugagggcguuucccaaaauacacagaacauacauaccuuaauuuuccaaagaggaaccccugaaccucaucaauaggaucauuuucaccaaucacugugguguuuaccucaguuccuaugaaagaauagaaaauacauauuauuaauaauugcucagauuugaaacaaaaacguuacuagucucauaaacuucauaaaauugaauaaugugaaaaaaaucagaaaccccugaaauuauaccauuuaaaaugcugacuaucacaauuacccuuuggcaaugguucuuuaaacaaacaggauaaaugcauuuuaauaucuccuguguuccuggauaaagaaugcauuuuuccuuaaacuuuggaaaauuuuacaugcuaaaaacuucaaaauuaauacauuuaaacauuauggacaauuaugaaauuaauagucaaacacuaugaacaaagaauuuuucaauauuaaaauucugaagaauuuauaauuagucaacuuaauccuaauacaauuauugaagaaaauagaaugagguaguaguuuauuuuccaucugcuuuacuacucaaauugauuuuuuaucuuuaaaauaagcauaaaagaaaugaaaaaauagcauuuaaaacuuguagauaaaauaauaaauucaaaacccuagaguauuacaacagaaaguauccacaguaaacuguuccauguacagaaauaauaaacaacauaaaauuguuuguuaaauauaggauacuuuaagauuucacguuggagucacaaauaaauggcuauuuguaaauccccuauaacaucaacaacaauagcuacuacuugcugaacguuuuugggcaaaccacugugccagguucuuuuuuugaggguuuuuguuuuuuuuuuuuuuuuuuuuuuaguacaugaaaaaauucuuuccuuacacaccuuauuuauuccuccccaauacuggaagagacauguaucauuaccuguacuuuacacaagagaaaacugggaucuagagaaucugcuuaagggucacccacucagguguaacagaaccaggaugcaaacacagguucagcauacaccuaaaucuauuauuuuucauauggaaacaaacuccccuuuaacucauauuugaagaaagcacacuggucccauuuuuacaaauucaccuuucaccugaguaucauccuuggccuuguacucagugcucuuaauggccaauuccacgccauagccagagagguaaacaggcuccuuccugggauucugcaaguaaagcaagaauuccaucauuaccaccuagcucuuucuaugucacaguguacauggcaugaccauguuaauguugcaucuacuagccauuaccucggauuaugcccucaaaauaucuuuaaauuguuuuuuaacgauauuaacuauauggcuaagaaaguucacuaaacaaauuuuuuuaguccaaaaccuaccaaaaacucaagaguaauaaaagcacguaucuaccauuaaaauauugauuauauguuuuaaaaaucaauccagagucuauauucucuccuuauaaaauccuaggcuccuuuacauguuguaggcugccacaacugugggaauggaauuccaagguagaagcaaaaccagaugaauggacagcugaaagugcuauggucccaaccauaagaaauggagaaagagaaaaagaaguuccagaaccuacagagcaggguugaaagcuggugaggucucagucccagagguguuuuuugaggcccaugggaguaugcuuuuuauuaaauuuaaaugccuucgagcggagcuuggagugaccagaugucacaggcucaccagcauccugacugaagauggcccuucagacauuaacauccauccuaacagcaaugaagggggcagagggagaaucaaaaacuggacuucaauaaaacuuucugcuuguacaaauuuucauuuaaaauuuuauggccaagcacagugacucacgccuguaaucccagcacuuugggaggcugaggcggucagaucaccugaggucaggaauuugagaccagccuggccaacauggugaaacccccucucuacuaaaaauacaaaaaauuagccggcaugauggugagugccuguaaucccagcuacucgggaggcugaggcaggagagucacuugaacucaggaggcggagguugcagugagcugaaaucgcgccacugugcuccagccugggcgacagagcgagacucugucucaaaaauaaauaaaucaauaaauaaaauuuuauuuuuuuugcaugaacuuaguacugagcuuauuaugacauagaaacuuuaaagggcuaacaaccuuuacauauaaauauuuuaaaugacuaaauauuacacagagucuuuuuuuuuuuuuuuuugagacggagucucgcucugucgcccaggcuggagugcaguggcgcgaucucggcucacugcaagcuccgccucccggguucacgccauucuccugccucagccucccgcguagcugggacuacaggcgcccgccaccacgcccggcuaauuuuuuguauuuuuuaguagagacgggguuucacuguguuagccaggauggucucgaucuccugaccucgugauccgcccgccucggccucccaaagugcugggauuacaggcgugagccaccgcgcccggccuacacagagucuuaaaagcuuaauauuacaucaagucuaccuaugaaucgccuguuuagaaaauccucccccuuccaccaaauaaaaagguggcaaagagaaaacagaagaaaaaagguuggaaaggaaacugaauucaacaaucaguuccauaguaugaugaccauauuaaaaucagaaaagauuauuuacaugguucauuuugaaauaaaauguaaacuuuaucgagcuacuuuuuuagcauguuuuauauuucuucagaaagccaagcaaagcacaucauaugugcaaauaauagacucaaugaaacuacuggauuugucaaaaaagggauucaaauaacuagauuuuuuuauaaagagggagauuauuagcuuauguucuaaagucaugcuaggcaaauuacauucaaaacagguguaaaauaagucaauacuuacaaauauauaaugucugaauacauaauugauuuugccugcauugcuuuuugauauaagcuggcggugaaaauuggaaaauuccucagagccaaucucagaguagaaaaucaccacagggcuuucaggauuagacgagggauaucugugaucuccuuugaacaauaaagguuugggucugaaaauaaauaauaaaagcucaaaacuuuaaaaauaauugugaaacacuaaaaaugucacaaaauauaaaguacaguuaugaaaauucaaauaaagauuauaagcaucuuaauaugaaggguagcaugaucuuaaauauuuuucacuuacuaagauuacuaucagguaugagucuuauuuauucaugauuaaaaauaacaaaaguacauuauaaaaaauacuaacuauaaaauguaaacacuggcagguccagugcaugaugccuguaaucauaacuaagacaaagccugggcaacauagcaaaaccucgacucuacaauaaauaacgaaaauuagcuggguaugguggcaugcaccuguaguccuagcuacuugggaggcuaaggugagaggaucaccugagccccagaggucgagggugcagugauccaugaucauuccacuggacuccacccugggugacagaacgggacccugucucaaaaaaaaaaaaacgaauaaaauaaaucucaauuaauaacagcuaccaauuccuaaaaggggaggaaaagggccaaaacaggauacauauucaaaugacuacuaaaacuugaguauguauguauguaauauauauauauauauauaacauaguauuuuuugggggguuuuuuuuuuuuuggagauggaguuucauuccuguugcucaggcuggagugcaaugacauggucucagcucacugcaacucucccuccuggguucaagugauucuccugccucagccuccucaguagcugggauuacaggcauccaccaccacacccggcuaauuuuuguauuuuuaguagagacaguguuucaucauguuggccaggcuggucucaaacuccugaccucaggugauccacccaccucagcuucccaaagugcuggcauuacaggcaaaagccaccaggccuggccaauauaauauguuauauuauguuauauuuugagaaguccucagucugucacuuaggcuagagcacagucgcgugaucgcucagcucacugcagccucgaccuccagagcucaaggagggacuacaggugcacgacaucaugcccaacuaaauuuuguauauuuuguagacauggguuuugucauguugcccaggcuggucucaaacuccugacucaagcgauccacccaccucagccucccaaaguucugggauuacaggcguaagccaccacggcuggccaaguauauuuuucuaccauauaaauagaauaugauuagcuuuuuauuuaaaaauauaaguauaggccggucgugguggcucacgccuguaaucccagcacuuugggaggccgaggcgggcggaucacgaggucaggagaucaagacuauccuggcuaacacagugaaaccccgucucuacuaaaaauacaaaaaacuagccgggcaugguggugggugccuguacuugggaggcugaggcaggagaauggcaugaaccugggaggcggagcuugcagugagccaagauggcaccacugcacuccagccugggcgacagagcgagacuccgucucaaaaauaaauaaauaauaaauaaauaaauaaaaauauaaguauaaauaaugcaaaaagcacaggaugacauucagcauauuacuugccaauucuacuaagucuaucuccucuacuauuuuuacuacuaugaucuuccuaauggacguuuuuguuucuguuuuuguuuuggagucagggucucacucuguugcccaagguagagugcaguggcaugaacagggcucacugcagucucuaccuccugggcuaaagugauccucccaccacagccucccgaguagcugggaccaaaggcgugugcgugguuacugccaccacacccagcuacuuuuuggagaaacugggucucacuuuguugcaccgguuggucuggaauuccugggaucaagugauccuccugccucagccugccaaagugcugggacuacaggcuugugcccccaauggacuuaacauuucaguuuuccucauaaacuuuaaaacuucucccaaaaaaacuuaucuaaggauggcaucaagauauuaacagaucuuaaugcacagacuuuaugaccuaccagucucuauuauaauaaacuauacaacucagcagaaaguaaagacaugaauacagaugcuccauauagccuuauuguaacaggaggaaaugacuuaaaaauccaucgguaagagguaaauuaccaauuacgggacagucuuaccuagguuaugcauguguuaaaaauaacgagguauacccacuuguacuaaauugaaagauaccuuuuauaaaaauaaaacuaccuacauguauaaauuuaaaaccauagaaaaaagucugaagguauauaugccaaaccauuaaaagcaguuaccgccucucagagagaggagacaccguuguucuuuucuucauaaaggugugcauuauuguuguagcaaauuaaaguuuuuuaaaagaauuacaaagccaucaauuuuguuucccccaagagacagcacuacuguaucaccaugcagccauuucugaauguccaugccuugacccggagauggcuggaacgcacgcuguuuuuuggucggcacucugaguaagaagcacuaaugccauuuggugggcagaggaugggugcuggggagccaaucucacuaaagaagaccuacaccaccuaacugccauuagcaguacugagagggccggccaaccccacggagagaucacgguucuguuuaugaacagcauuagaggagguacagagggcuugcugcccuagccagucagcaaaaugauacauagcagaguugucuaccacaggaaacccaccuuugggcaaaaagcugguacauuaguuaccaaauuaauauucaaaucaagccugcaauuaucuuucaaauauccuccuuugucugaaacuaauaauauccugagagauauuaucauuaauaucauuauuucaggcauuggcuuuaauacacacaguauuccuuacuaagccaaugacaaaaucuaugucauugcucagaugcagucauuacuaaacaguaacaguuaauacuaaauacuuguaucaucuccauuuugaaaugagauuaggaaagaaaguaauuugccacauuucacaaaacuauuuuaagugacggagcugagauucaaauauagucagucugguuccagaagccauacucuaaaccauuacaccuaaugauacaaaacagaugagaaaaucagaagguagaccaaaugcagaagcagcacuggaaaugcaugacaugaaaauaaagaaacacauaaucuaccuuucagaggcugucaguagaagagccucaaggguaucagauucacaagucuucuuuccaugcacugaaaaaaacgaauuacauccuucugguggagguucaucagcugcuaucugucacauaagacacaacacauacuuuuuaaauuucuaaccaaagacgagauaaagacauguauaaucaaaauaggugauuaaauuaugacaaaacaacauuguugaaacuggcugagugugguagcucgugccuguaaucccagcacuuugggagaccagagugggagcaucacuuaagcccaagccugggcaguuaagccugccacuuaagccugggcagcauagugagaccccaucucuacaaaaaauaaaaaaaauaaaaaauuaggcacaguggcauacgccuguagucccagcuacuaaggaggcugagguaggaggauugcuugagccugaaaaguugaggcugcagugauccguaaucacagaacuacacuccagccugggcaacagaacaagacccugucucaaaaaaacaaaaucaauaaaugcaaaaacaggccagccacaguggcucaugccuguaaucccagcaauuugcggggcagaggcaggcagaucuccuguggucaggagaucgagaccagccuagccaacacggcgaaauccugucucuacuaaaaauacaaaaauuagcugggugugguagcaggcuaccccagcucagguaggagaaucacuuaaacccaggagguggagguugcagugagcugugauugcgccacugcacuccagccugggugacagggcgagacugugucacaaaauaaagaaaaaugaaaaaaaaaaucacuuuauugugugaagauguaccuuugggcaauacaauacaguaacaagcaagugauuccaacagaaauuaacagggugguugguuucaggggugaaagguggccacaaucaggacaaaguacacggagggcuuuccauggugccagacuaaguccugcuucuugacuugggugaaaauuacaaggauguucacauuauaauaguccauuacuauauauuuuuugugaggaguuuuuccauguuuuauuuuauaauaaaaaauaauuuuaaaauuagcauugcuuuuauaucaaauaucaaguuggugaagacaucuuugacugucucuucuuaagucucucuuaacuugagguuccucugucccucuuuuucuuuucaauuacaauagaaauuuccauaauuuauguacugaagaaacuagauuacuuuacuacaacgauuccugaauucuagauuuuccugacugcaucccuguggugaugcuaaacauuucuugccuccuguauuuccugugaacugcuuuuagaacuacaggcuguaauuagaugcuggcucauugguuuaacaagauuacaucucccaggcugcaaugcauaaauaaaauauugcugucuuuuuucuauauagauauucuuuuauuuuuuuaaaucuguggguugaagacuuaacaucaauuuugcuuauuauuuuuuuuaaaaaucauaaauccuagaaaauuucaggcaaaaaagugauaauagcucuguaauucaauuccaggacaacugggguccauccauucaucaugauauacacucuaaaaugcuguucuuuaagagcacuggacccaccugcuggaaggcuuggauuguagcugaguaagaacgaagggacagacaaaauuuaaacaaauucugcuggaggggugacagaaacugaaaugcagccuccaauauugcaugauaguaggaauaaucgguaccugucaaggaagaacauuaaccaaaguaauugcguaugacuagagauaucuaaagaagauaguucaugaagcacaaagcuguguuuacaaagguaugugaaggcaaguuuuaccaguauauugucuugaacucucaacaaaugcuuaaaacucccuggaguacaaaaugcaguugggcucuuccucucuucucaccuuucgaacuauucccuccccuggaccgcuauuuucccacuuaccuggaugacuuacagcuacauacuuccucagaaauaauucagcugugaaauuaccuacuccagaaagucuccacaaucccuaccccaugcuucaauggaccaguuaaaccucuuccucaaucccagaacacgucuuuguuuaccucuuucacuuaucauaucauuuacuaaauuauuuauucacugucuaucuauaccccacuuagacuucugguccccagaggaagaggcuaugaccuauuuauccuuauauccaugaugccuagcauaugguaacuacuccaaaaacuaaacaaaacugagcagugucaugaggaaguuacacaguauuaaagaauacuaaugaaauuguaaaguuugaaaagaagcauuuaaacaaaaaguuggaccaaauuauuuuaaagaaaaaaaaauccaaauacgaaugugaaaaaauccccaggauaaaugaaaagcaaaggcacaaaacaauguacauaguaacuuuuuuuuuaaaccaguagaaagaaugagaaauaagaauacauauguauauauuugcuguaaaaaacacuuaaggcuaaacaaauuaauuuaaaauguuauaaaaagcaggaaagaaacagaaggaacagggucaaggaagaaacaagauuucucuguguauaaccuuuuauacagcuuugacuucggaaucacauauauccaugcaaaaaacuuaaauuuuccauuuuaaaggacaagcacaguggcucuugcuuguaaucccaaaacuuuaggaggccgaggcaggaggauugcuugagcccaggagcucaagagaucagccuugguaacauagugcgucucuuuuuaaaaaaaauagaaauaggcagggcacgguggcucaugccuguaaucccagcacuuuggaaggggcagguggguggaucacccgaggucaggaguucaagaccagccuggccaacauggugaaaccccaucucuauuaaaaauauaaaaauuagccacgggagguggcaugcaccuguaaucccagcugaggcaggaaaaucacuugaauccgggaggcagagguugcagcgagauuacgccacugcacuccagccugagcaagaggagacugucucaaaaaauaaauaaguaaauaaugaaaauaaaauguuccauguaaaaaacaaaauauaaauauuaacauuuuaugagccagaauauaaaagguuuuauacugcaacagcauccucuacguaaaacuagauaagaaauaucucaaaaugaugccagaauguuaauggugucaaucuuuggguggcaggaauauaaauaauauuucaaacaaauaaaauguuuaacaugcuuuuauguuguucauagaauucauacuccuauagcuuuaauuaauauuaucauuuuuacugaaaaaauguuauuuuaaaugucaaaguucaaauuugauuauaaacccacuuugauaaauuuguucuauaaaaucuuaaaaauaaaguauuuuuugauaacuuaauucuaguugccucuaaauuaguaaaaccuacagaugcuuguuuaaaauauuuacauaucuauaucuccaaaaaaaaaaaaaaaaaaagauucaggcugggcaugguggcccacgccuguaaucccaucacuuuaggaggccaaggcgagaggcagggcagggaugucuugaggccaggaguuugagaccagcaugugcaacacagcuagacccaucuuuacaaaauuuaaaaauuagccaggccugguuguacacaccuauaauaccagcuacugaggaagaugaagcaggaacacugcuugagcaggaguucaagauuauagugaacuacaccacugcacuccagccuccagagccagacucuguuucuaaaaucaaaacuaggccgggcuuggugacucacacccauaauccuagcacuuugggaggcugagguggguggauugccugaggucaggaguuugagaccagcguggccagcauggcgaaaccccgucucugcuaaaacuacaaaaauuagcugggcgcgauggugggcaccuguaaucccagcuacucgggaggcugaggcaggagaacagcuugagcucaaguggcagagauugcagugagucgagaucgcgccacugcacuccagccugggcaacagaguaagacucugucucgaaaaaauaaauaaaauaaaauaaaauaaaauaaaauaaaauaaaguaaaaucuagcugggugcagucacucacgccuguaaucccagcacuuuggaaugccaaggcaggaggaucgcuugagcccuaggagucugagaccagccugggcaacacagcgagacccugucuccacaaaaaaaaauuuuuuuaauuagcccaaauaaaaaauaauaauaaauaaaauaaaucuuuggcuagaucacagagugaaaaaagugaaauaaaauaaaaauaaaacaaaaagauucagacaauuuuuaaaauaugaauuauuuuaauaaaaauuaaaaaguuaaaaaaaucaauacaggccaggugcagugguucaugccuguaaucccagaacuuuaggaggccgaggugggaggaucacuugagcccagaaguuugagaccagccugggcaacacagugagaccucaucuccguuguauuaaaaaaauaauaauuaaauaauuuuaaaagaagaaaaaaaaaacaacccauuaacaucagcagcagucacacaauuuugaaacauuuccucuucuguaagaacuuauaucuggccaggcacaguggcucaugccuguaaucccagcacuuugggaggcugaggcggguggaucacuugaggucaaaaguucgagaccagccuggccaacauggggaaaccccaucucuacuaaaaauacaaaaauuagccaggcguaguggcgaaugccuguaaucccagcuacuugcaaggcugagucaggagaaaugauugaaccugggagauggagguugcagugagcccagaucguaccacugcacuccagccuggaaacaaagcaagacuucaucucaaaaaauaaaaauuaaaaaaaaauaauaauaaccuauaucugucaauguaaauuaauauucaagguuuuaacuacucacauaucagcaucuccaacuauuaauguuuacacccuauauagcuuauacgaaguuuaaaaaaugugaaagcacaucauaaaaacugcaaaugagguuuuacaggauaaucauucauuugauaccuuaacacucaaguuguggguggcuggcaggcauaauggaaaacacucuggaugauacuaacuuaaugauaaugaacuuaacagauaauagcucaguuguguaguucauaacaaaaauagugaaucagauuagaugguuauuaauacugaaugauuuaaaaugaaauguacuuccacaaaauauucacauagcacuuuaauaaaggaucacgauagaacaaaaacaagaggggaaaaaaacaaagguaccacuuauagccaaagguauacauugcuucaaaaauaauaauuuguguuguguuggcucuuccugaccaccaucauaacuccagucauuaaagacaacaauguuuuccauuaacugccaugccacacauacuauaaagagacaauuuuuuccuaauauuuucccagacaccaaagucaaagaagcauuugcuucaauuuuaccgucaugaucugaugauccaauauuuugacuggcuucuacaaaauuccaaaauuucucuugacugucuucugcuaaaaacucacugggagaaaagaucagaaauaaaacaacuuaauaaaauuuucuaauauaaacuauauuacuaaagagaguaaaaauaaguuuugaaguuuccaaauguccauaguuugacuuuuaaucuauaauauauaauacucuuuuauguauaauauauauauuuuuaaugauaaucaaguccuaucuuauuaguuauuaauaacuuagccuaugaauuuuuucacuuaauagcuauuucuuaagaaaccuggaauaauaaaaacauaaaagggaagucucaauauaaagaaagcuuaugaaaccccauugacaaaaauacuaugaguaguggaagaagaauuaggaacugaugauucuaguacuaguucugcuuacuuauuuucugaaaggccuuacaaagaacaaaaaauauguuuugccuaaaguucucccacaguaaaauaugaaccguagaaaaauuucugagaauaaaggcagcauguuguaaucuuuuaacacucuuaaauccaaauuuucaagaucaccaaacuuaguuuaaaauuagcacugaucuaacaaaaucagauccaagaacuuaaugccaucuuaauuuuuuucgacuuuauccuacuaaaauaauggccagucuaaauuucccuucauucaagagucuaaaaccccuacgaggaaaugcauguaguaauugaaugauucaugucaauugcuuaucuucuccucugagccauaauacuaaugcaguggugaucuuucacugucuuaaagcaaacuacagaucuggaucucagcuuaccuagccaaaggaagacuuucccauuacuugugaacacugggguguacaaucucacucuacuccacagcuagacacagaaauaugggaaaaauaagaaacauuuccugguaaugcacagcuucucuaaaaauagguuucugaaaauacccauuaucauaauauauuaaauuucucaaugccuccuugaaaguaguauuuuucuaggcuuucuaguaacugacauagacaccacaccaagcuuggcauagcuuauagucuaagaaaacaaguccuaagacagauacaucaggaugugcaaauaaacacuaaauuaauuaauuaaaggcacauucacaagauaagcagagaggggcaaggugacacacucaccaguguggugagaacuaagauucaaucagacuaagacucucccaguaaaggccacacacgaauaaauacaugcuuuucauacaauuacagggaaacuucuugaaacauacauucuuuucaccccacugcauacauaaggucuuacaaggucuaaacuuggaacaguccuaauauuacuuacuagauccacugaaacaacccagaggagagaauaacaauacaagauauuauuaaagaaaugcugccuuuuuuuacagcauauuuuuguugcuuuuuguuuuuuuagcuucuuauauaauacuuauuccacugagcauaaauuaugauuuuacaggccaggcgccguggcucacgccuguaaucccagcacuuugggaggcugagguggguggaccaccugaggucaggaguuccagaccagccuggccaacauggugaaaccccaucucuacuaaaaauacaaaaaauuagucgagggugguggcgggcgccuguagucucagcuacucaggaggcugaggcaggagaaucgcuugaacccaggagguggagguugcagugagccaagaucgugccauugcacuccagccugggcaacaagagugaaacuccaucccaaaaaaaaaaaaaauuaugauuuuacaaacuauaugaugucugggauuugcuuuaaaauauucuagugcgggaggagagaaggggguggugauggugguuauuguacuuaaauugauaauuguuaaaacaggaugauggguacagagagaguacauuauaccauucucuccauauauaaauguuuugaaaugccauaauccaggacaaguuuuuaaucuacaacacaaaaaaaacuacaaacaaccagaaugaaugcccacaagauaguacaaaucaggugacaacuuguuuucuuagauuuccaaagcuauugcgggagaucagcauuggucuuccuucuauguggaacuaggagggaagaaacuaauauuuaaggaggcucuacgauguuacagucacuaagcuuggcauauuuacucguguccgcaaacccacacagccacccucagauauaaccguuuuucaaauaaagaagcugccauucagagaugcuacugacuuucuuagggacauagaguuagucaauggaaaagcuggaauauaaauucaugucuauuuaauuuauaccucuaacaugcuacauucuugggucauuacaaaauuuagcacucaguaaaugauuauugguuuugauuuuaauaauaccuccuuauauaauauuucuguagcuacagcugcagaaaacauauuuaguguuuuacuucaauuaaagauaaauaucacuucauagacaaucacaaagcuacaacuccuucacaaacaucagguccaaucuaaaaauacacaacaggaauauuuuuagucccuaagggauagaugcaaggaaggcaaaagaucuguggugguggcaugccauaaaguguaguaaaauauuuugacccuucauccuuaaccagauggacauaguaccuugauccaacaucagggucucccacagacauaagaaggaagaauggugggcucugcuagcucuggaggugaauacuaaguggauucuaauaagcauagcucauuucuaugaguugccuacaugucguauuaccuugggaaacuguauacaaauagccacaggagaaggggccuaaaaauaguaaaccaaaagggcaaauguagcucuuacuucacaugccaaggaaaaaaauuaauaaaaauaaaacaaaauggcaaaugaccagggauaucaugaaagggggagaugucugugauaaggaaguuggugaagaaaacaguauacccuguccacuucacagugaucaaagaaacugaaaauauugagcaauuagggcuggcaauuuuagcauucuuucucaaaaguccauaguuuuaugcuguaagaaucuucuaggacaaugaucaagaauguacaacuaucaagaaauuaguguaaauaaaagugaaaguaacaaaauguaauucaggguaagaauguuaaacagaggccuggcgcgguggcucacaccuguaaucccagcacuuugggaggccgagauggguggaucaccugagguggggaguuccagaccagccugaccaacauagagaaacuccaucgcuacuaaaaaaaaaaaaaaaaaaaaauacaaaauuagccggacuugguggugcaugccuguaaucccagcuacucaggaggcugaggcaagagaaucgcuugaaccugggaggcagagguugcggugagccgagaucacgccauugcacuccagccugggcaacaagagcgaaacuccaucucaaaaaaagaauguuaaacagaauaucacaaaaacaccuguuacaguuaauuguacaaaaugauucagaaagugauaguaaaucuuggccaggcccgguggcucacgccuguaaucccagcacuuugggaggccaaggagggcagaucaccugaggucaggaguucagaccagccuggcggccaacaugguaaaaccccaucucuacugaaaauauaaaaauuagccaggcaugcuggcacacgccgguaaucccagcuacuugggaggcuaaggcaggagaaugagaaugggcuugaaccugggaggcagagguugcagugagccaagauggcgccacugaacuccagucugggugacaaaaugaaacucugucucaaaaaaaauaaguaggguggggggggggguuguaaaucucaaugacagauuuuauaccaaacaaaucauccaaaauaagauuagcaaaaaggaaaagaaaaacuuuaguuuuuagaguccagcucaggcaguccagcucaggcagucucaaaauaucuucagucacugcuuuuuuguuuguuauuugcuuuguugggcuuuuuucccccauaauaagaacucuuaaaaaagagccacuucacuuuuacaacuaugcuguaucaaauaaaguucugacauuugacaagcuugacccauuuaucaaguuaguuaucaccaugaaauacauacaaugguuuugucuuuguuuugccacuucuaugcugagaaagaaaggcagagagaggcgauggaaggaagucuauuuagcagaaagucugcuaggcuccugagcuagccaagaccggcugccacaugcccccucccacugguccuuuuagcaguaucaaaugaggcuuuuuccuuaagaggugcaaccauucguucacacaaucaacauggcaaaauucuucauccacauuuuucuaggaauuaaggggaaaauguuagaauacaaaauucuagaggccaggcaugguggcucacaccuguaauuccaccacuuugggaggccaaggcagguagaucacuugagcucaggaguuccagaccagccuggccaagauggugaaagcccaucucuauaaaacauacaaaaauaagccagggguaguggcucacaccuguagucccagcuacuagggaggccuaggugggaggauggcuugaguccaggaggcagagguuacagggagcugagaucacaccacuacacucuagccugaacaacagagacaggccuugucucaaaaacucucaaaaaaauauauauauauaaauugaagaugaagaagacagaccacaaggcugauuggagugaugugacaguccaaauuucuagcacguucaaacacuaagacuuaccaagugcuugcugcucaaucuacccacauuuauccuuuggaaagucucugcuaguuccaccucuacaucacuugagauacaaucaaauaaccuuccauccauaagcauuuaagcccuaccuauacagacagguaucucauuauauuuauuuacaaacacuagcuaaaaagcacacuuggaauacaaaauuucucaugaaauuacuauguuucacuaauuuuaagacaacuauuguuuuaugaaaaauucuacccauuuuaaucguaagauaacuucuuucccuuuuuuuuuuuuuuugagacggagucuugcucugcugcccaggcuggacugcaauggcgugaucugggcucacugcaaccuccgccuccugggcucaagugauccucccggucagccucccaaguagcugggacuauaggcacgaaccaccacacucagcuauuuuuuucuggagagacgggguuuccccauguugcccaggcuggucucaaauuccuggacucaagcaauccacccaccucagccucccaaagagcugggauuuacaggcaugagccaccguaccuagccaccguuuuaucauuuaaaaagaaagauugagcugcaugggcauaaucuccuaaucugaugcucaggcacaugccagcacgcucagcuaauuguugccaggcuggucucgaacuccugaccucaggugauccacccaccuuguccacccaaaguguugggauuauaggcgugagccaccgugcccagccuucuuccacguucuuaagggaaaaauguccucuuucccccacguugcuaagcccucuucucuuccuuuuaucaaucaccucuuaaaacuuccuucaaauaaggagaaaauuugaauacaacuggccaggcacaguggcucacaucuguaaucccagcacuuugggaggccaagguaggcagaucacaugaggcuaaggaguuugagaccagccuggccaacauggcgaaaccccuucucuacuaaaaauacaaagauuagcagggugugguggggcacuuccgugaucccagcuacucaggaggcagaggcaugagaaucccuugaacccaggaggcggaggucacagugagccaagaucucaccacugcacuccagccugggcaacagagcgagacccugucuccaaaaauaaauaaauaaauaaacauaacccucucuuuccuuguuaugcuuuuuggaaaguaacauacuaacuuauccaacacaguuauuuguccaaaguuccuacauagcucuauaaacccacauagcccuuguccuacugaaugaugcuauguccuaacagccuuuguacaauacauccuacaguauacacugaaagaggcucuucauaaaugcauuugaugauaaucucacuccuuaaaaagcuccugaauguucacugucagagccuauauuuauacucaaauacacgaagggaaaaaaaauguucucuuaccuggcuucuaacaacaauggaguggaaaaccauuuuguuguaagagagguuguaauggcuuuugagucggccuuuacugaggagaacagccacagaacagugaguacaaccagaacucccauuuuauagcaaacuccuaaaaggaaaaaaagaaaagaaguuuugcuacaaggaaauuuuuuuuuuuuuugagacgcagucucgcccugucgcccaggcuggagugcaguggugcaaucucggcucaugcaaccucugccucccagguucaagcgauucuccugccucagccuccccaguagcugggauuacaggcacgcaccaccacacccugcuaauuuuguguaucuuuaguagagacaggguuucacaauguuggccaggcuggucucaaacuccugaccucgugaucugcccgccucagccucccaaaguguugggauuacaggcaugagccaccaugccuggccugcuacaagguaauuuuaaccucauacuuggagacacaaaauaacaauccuaauaauacuuggagacacaaaauaacauaaguuagcgaaacagaaaugcuucugacauauaauagcacuuaauaucuagcuaguccaacagauauuugcugagugacugauauguaacugaaggcacuuagguuauuacauucuuuccuacaaaggcucugcuucauuucccaagcaaucuacaccauacagggguauaaaaaucaguugguggcacaccagguugcacacaaccauauuuuauaaaggaugaaagcaaauaaagcugagauagaugaaaauauaaaugauagguauuaaggguugaacugugucccccaaaaaagauauggaaauccuaucccccgguaccucguaaugucaacuuauuuguaaauacagucuuuacagaggucaucaguuaaaacaagguuauuaggugggcacuaacccaaugacugauguuauaaagaggagaaaucuggacagagaaagacagcacagagggaaaacuauguagagacacaggagaccaccaggugaagacagaggcacacacuaaaauuauacuguaagcuaaggaaugccugaaacuaccagaagcugaagagucaaagaaagauucuuccuccaaagauuucagcgggaacgugguccugugaaacccugaguaaggauuucuagcacugugagacaguaaauaucuauuguucuaagccacccaguuugugauacuuuguugugguagcccuaggaaacuaacauaaugggucccaaauguaaacucagacagguucugaaauaaagaaauguaaaauuuuaguggcuucccaagccaacugucccaucuacaaaaugagggaucuagggucacuggcaaaguggauggccacagaaugcaggccucuugacacccuccgcagccgcuccaagccugucaagauccucucagacagcauccagacaguuucagaaaaaggucuccagcugcagauuucucugauuuucaucuccaaaguccaccuaacagaacccuaaucggaccuccccugagcucuacccauuugaaugagaacuaaaagggggugugaauaugugggaagcacuaagcuauccuugggcuucagaauguuagcucugguaaggcucacuucggucucaucccaguucuuuaauauugguuacaaaaucuaucacugagggaggcuguccacauuggggacuagucaauagcugcuuuuuauaaaaagcaucauuuguguuaacauccugcuucauagaacauacaguaucucugaagaacgauggucaaaagcaaaauaaauuauaacaaauagaaaaguggcuuucagaagcauuuuaaguucaggcacugccagcuucuuuggaaaccaaaaaaaauuaauaaaucagccaggcaugguggcaugcaccuauggucccagcuacuugggaggcuaaggugggaagauagcuugggccuaggagguccaugcugcaucugggcaacagagcgggacaggaggaguuacgggacaggaggagagcaggacaggaggagagugggggaggaggaggaggaagaggaggaggaggaagaggaaagaaagaagaaagaaggaggaagagaaggaggaggggaaggggaagguaaaggggaaggggaaggagaaggggaaggggaaggggaagaggaagaagaagaggaaggagaagaagaagaacaucccacuuauaaauaaaaacacucagaaguguuuuucaaaaucaacguuuguaaaaacugcuauagaggcugcagaaaugaaagaauacacacacaaaaaugaaaccuacugaaauuagagauaaccaaacuagauuuuacacaaugaaaccugauagcagugauuccuggcugguugagugaagaggauauaggccuuuucuggaaucuaguaaaguuacugacauuucccacagaggagcaaacaaggacccaaauuuuauguacaacuuaagaauucucuugggacuggcccagcgcaguggcucacgccuguaaucccagcacuuuaggaggcugagguggguggaucaccugaggucaggaguucaagaccagucuguccaauguggugaaaccccgucucuacuaaaaauacaaaaauuagccaggcauaguggcaggugccuguaaucccagcuacucaggaggcugaggcaggagaaucgcuugaacccgggagguggagguuucaguaagucgagaucgcaccacugcacuccagccugggcgacagagagagacuccgucucaaaaaaaaaaaaaaaaaaaaaaaaaaaaaagcauucucuuaggacuaaccauagacacccuuucccacaggcccacagacugcagccucagaaaccugcucuacaggacacaauagacacgguuuguaaaaaaagggaaccuuuuagcaucagggcagcugugaucaauuccugaguuugcuacguacuagcaguuuaaccacauauauguuaccuaacuucccaggcccuuagucucgaagacuaucaaaguaggaauaauaguaucugccucacagggucaaugugaaaaugaagaggcaauaaaaaaaucacuuuguaaagugccaaguacuauaccagaauugauuguuguaguaaaacauuuuaucguaagaaaaaacuaucuucuaaauuacagaauaguacaucaucguuauuaaauagccucaaaaauacacauuggaaauauauccucuguggcugagagaaaaaauucuccccaaaaguuacagaguuuuucuuuuuuuuuuaaucuggccugagucaaugaguuuauaaacuggagacagcgcaucauaugaacugucuagcaguauuacgcuauuagcuauguuuacaauuuguccugaaggggucuagauguguacaccccagaaaguggugauuccugaugacgaauuggacgccacugcacuguaaccccagguggauggcauguagaguggggaggaaauuggggguaugacaaaguccccugaggaaaccccagcauuuaacaagcaaugacucugagcuaaacauuguauuaggugcuuuacauacacaguguuaucuaauccuuacauacaacaacccagggcacuaacguucucugaggggagcaaccaugucuacuucguuuaccaaagugcacagcaugaugccuggcacucagaagacaguccaugaauaugcugcaugcaucuccacuuuaaaaauaagugaaagcucgaagaugcugaguaccuugccuaacuaauaaauagcagugcuuagaacccacaccuuccugcuuuuaaaguucuacaauaccgugcucucuucucugguucucuggcuuuacaaaaggguaaaaagccauacucugugcagacucagacugagaaaagugcuugugagaaccaaggcaaguccaaggauuuucaguggccacaguucuugggagacagguggcugagaaaggaauaguuuuaaccugaaaccaagggaggaggccugaagcugggaccgaagcaauccaaccaaccaaucugacagauccacacuuacgcuggcuuuggggaccgaugggagcuccucaagagcaggguguuuugucuaucauggucuccacgccuagcauuaugccugaaacauagaaggcucucaaaaugaaauaaacacaggccucauucauuaaggcaugaauggaaacaacaggaaaggaguguggcaccaagagugaagaugcuauaaaaugccuaggacugcaagauagguaaaaugaaaauccuaugaaccuguggccugccucgagaucccccuacacuguuuucaaaaaggagagagaguacguguucuuggggagagaugcagcaccauuugagaugaaaaaaggaggaaagcuauacauuaaaaaagagcuuugccacucugaccccacauucuuaacucuacagguaaaaccagaggaaaagacuguccagagaagcagacguaagaaucucacugaaguggucucugcuuugaguaugucuucauuuuauaggaucccuuaucauucugacccuagggguucuuaaauguugcuuauaaagacaaacagucugagauaauggccaacagaaugugccauguggcuuugcaugauaagcauuauacuugcggcaugaugaauaaacagaaaacacucuuuaacaaguucuaggcccaacuaucaacaaccauccguaggaggcugagguaggaggaccaccugagcccaggagguggaggcugcagcuagcaagaucaugucacuauucucuaaccugggcaacagagcaagacucugccucaccaacaaaaaauaaaaaaauaaauuaaaacacuaucucuugcaccauugcacuccagccuggguaacaagagugaaacuccaucucaaaaaaaaaaaaaaaaagaaagaaagaaagaaaauuaucacaucaucuuguauuguuacagggaaacuuagauaaaaaaagaaaaugcucacagacagcugcaggaaaguucuaagcaaauuuucuucuuacuuucauauauuccccugaaguucaaugugcauuauaaaugugcuaugcuacuguacaaaguauuauggucacuuccuuuaauaaguuucauguggccaggaguucaagaucagacugguagguaacaagaccucaucucuacaaaauaaauaaauaaauaaauaaauaagaauuuuuuuaaaauaagcuucagcuaaguuuaucaaaagcaagucaaguguugcuaaauucgacuggcuuaaaaaaaaaaaaagcaaagugaaaaggcuacaauuauuccaaguuuuguggugcuguuaaauagcuauuuaaaaugucuucaaacgccugcaaguguaagauucuugaaggaaagagggcacuuuacacuaaaauuggcuggcaaguacaucaaugaauguuuccaaaacaguuaguguagcacaauaaggcaaaagaccccaggacuucaaacgaacaaaauugcuccuucucaaaucuggcaagaaaugcaaaacaacugcagauucuggccaaggaacaaaaacaguucacaucuauaaguuauuggcgacggacgcagaucucauucuggcaggucccacgcuaaaagugaaaccauaucauccaauuuccagccaacagaucacaguguuaaaagaaaacaguaaccaauacgcaucaacccgaauucauuuuaggaaaaauugaaaucuauuuuaaaaagcacgucguucugcaaucaggguccugcaaagugcugcuucucaacucacugaggaucaagcuuggucuaaauccaugguaggauaccucccccauuuccuucugcacuuggcacaaggaucuaaagcucuucaaagaagguucaagaccgcugaacagagcccgccgccacccccgcggaagcgauaccuugccaagaagaccacugagggcaacucggggcgcucgcgaauaggggaagggauaggacaccagaggguaaacugagucacgguagaggcggaagcucaaugugacaggggcacagggucgccuugugccccaaacccucucuuuguccacgaggccuccucacgccaccccuggguaccugucaccggcagcgcacccgcggcacacgcaccgcucgcgucucccuugcagcccaugcccgggccguggucaguccgccacagugccagagacaacgccagggcagggcggggcgaggcggcagcggcagugcaggcugcgccagugagaggccgacacgcgccuuucccgcggcucgacucaacacccagccucgcaaagcaauugcccagcugccggccgcccuuuuacuuc

SEQ ID NO: 191102 - RNA, 239554 nt, Homo sapiens
cuccgcuccgacugcuuguaggcgaugcccaggcaaagaccgugacugacacucucgcucacacgcacgcacggacccaggcccacgcucggagaucgagccccgggcucgcaaccguugucgcucccggcgccgcggccagagcccggaccacggcuuccgcgccgccgccgccucgccgagaagggccgcgccggaccucgagcgcggcggcccccggccggcagggauggggaagcgggcgggaggaggagcaaccggagccaccaccgccgccgucuccacguccgccggggccgggcuggaaccugcggccgcccguagcgggggcccgcggagcgcggccgccggccuccuaggcgcgcugcaccuggugaugacccucguaguggcugcggcgcgggccgagaaggaaggugggugucccccggcggcgucccugcggcggggcugucaccccgcucucgcggaggccgggagggcugggccgggaggaagggccgcggccggggcuccggcgcaaaguugggcggucggguaccgucccgagccgggaccucgcggcgcccgccgcacggaguggccuucgcucuccgugauuccuucccgugccuucccccgucuccugucacugccauuucaaaacuuccugacuucucguacguucuugccacuuggcccgcuagguaggaggggcauauuuuuuggcuuuauugcggcgaauagguacauuuuaggacacuucuguuuucuugguugcgguugguugcaugcagacagagcuuacuuuaaaaugugguaaaaauagcgagacacagcuuaaaaaauuucacuuugaauuuguucagacauuucuucgaggggaaaucuugguccuguagcuuccuccuuuagugucucugcguuauugauaacuuuauuauuagaccuaaauacaauuccauuuaacucuuuaguaagcuguugaaagccuguuuacauuucuuauuuuaaaauacgugauucggugccuuuaucuuugaugugaaagccuuuaaaaauaaacgugaaguugccagcuugcaagcauuuaucuauaauuuacaguuaagggcuggccccuauuuuaaaaaucucauuaguauuguacugcugcaaaacggguacuuggacagggucaaaaauuauuuuguaaucuugaagaccaaaucaguguaauuucaucuacacuaccucuuuuugagccaagggacaugugaauggucacagagccuucaugaagaauugacuaagugaauaguuuaaaaaaaaaacaaaccacgcaaaacuuguuaguuuagcauugcacaugaaacugccuguacaagaaaacaauuucuugccacgguaauuuuagaguuaacauucuacuuuaugacuaaagucacuugcuuuuuauuguugcugaaggugaaagcaaauacaaaccaaauuaguauuaaagugcaaaugugcuucaguauacuguuucuuuuauuuuuguccacauuacauucccuuaucuaacucucuaagcaaccuuagucugaguuaacauugguggaaauuauucaaagaauugucgucuauagaaaggauuaauugauggaagcaaaauuauuuccagaauaaaauauugccgcuuuaggacuagucgguccugggguugucauaauacaucauuggccacagaucugcaguuaguugaguguucuuucuuaugugugaucguggcaccuagcauuuuggccuguaguggguguucagugaacccaaaauagugcaguaauuuaauggacauuuuuugggugggacuucaaguagaccuugguggguauuguguccuuguuuuucuguuccuuugcuuaccuugcacagugccagacacacuggcgcuuagccuuugagugaaugacugucuucaugcgcccuuagcacagggaauugaaauaaugguugaaucuaguaaagcauuaaguuuguauuuuccuucuacugcugcugauuuuuccaacagccauuuuauaugcuaauaaaaacuuuacucuggguaaaguuaaguaaacaaaccuuuuguuugagaacugucagccuaaaauauauuugcuaauuucucauuugcauaguuuauacauguuagugcaccucucuaauacccauaaauguguguaaggauuggaugaggagaauacuugccaggguguuaaguauguauuaaaggggugguugaaucagccaguggccugggugaaucagauauccuuuguggcccaugcuuuucuguaugaacaauuugugugugcgguuauccaagauauuaauggagaugaugcugauauagaacauaggccucuacccaucauaaacagaucugguucuaaucaaauauucugugaagguaucuccagaaauggcuucuccuuuaaaacugaucauauuccaguauuguuucugaguaaguaggggaaaagcaauuuauuuucuuacgugauugugacacugugagucuggcaucugaugaggcacaaauacaguauuuguccuaaaagguacuguugaguuuuucagcaaguuugggcagauuucugaagauggcugaguucaguuugaucauucacacccggaggaauuuugugucuauugaaguagcauaaacuaguuuaaaauuucaaaguuaagauuuaccugcaguuuuaaugaugauucugcagguauuuuguauguuuguauuucuuuuccuucauuacuguauaauuucacugcaaaaucuuuaaaagacaauaaaacucauugucuccugaagaaaagcugcagaaauaaauuaccuaauguaguuuuucauguuuggacuugauguugauuuucuugagucagaagcauggaccauuccuugucuuaacauccuauaugacuuaacugagcuaugggagugugcuaucacuaguccagaggaaagguaccuuugagaugguuuuggcugugauguaaaguuuguaaggacuuugaaagaguuuccagagauagaaguuguuauaaucacuacaaauaacuaguucuagauugguggcaagauuuugucuugaggcuaacaucuagauacugagaauagcaaaaaugugugugaguugugaaaauauauuuuuaaaauauauagugaaaauacauguguauguguauauauuaaauguauacuuuuaguagucuuuugaauuauaaagcagcccauuaugacuggcaaauaagaccuuuuuuaaaaaagcauuauauaucauguaauauaauuucauugugaaguggguuuuuggaaggcauuuauuauaaaugagaagcuauaguuuauguaucuaguaaauauaaauucgaauaaguuuucaagaauguuucaauuuaugacaauuuaaauuucauugucacauguuuuauuaauuggcaauuaaauggcaggguaacguuugacagccuuuauuaggacuuuaaaaauuuuuugccaguguacuauaguuucaugcacaaauuuuuguuuuaagcuguauuugugacauaggugcaaaacacaguacaaaaguauuuacaaagcauaugagaaaagugcauaggacuaaagaccacaagaaaacagauaagaaucuaauaguuuucuaaggguagccaaauugacuaggaguguuauuuacuuuuucuuaaccaaacuauuuuuaaccuacuuauuacucgauaauguuaaaauguuuuugaaagugauuuucuuaagagugagauguguuaacccuuuguaugggguagaguggguaccuuuuaauuuagggccuuguaaauagaauguuauuuaauaagugcuucacuaaugaacguuuguagccugcuuuuacuaaaggcuguugccugauggagcauuggaguuuuguaguuggaaaaaguguguccuuuuuuccucuugcuaaugaccauuuuccuccuccuucuaauucuuacaguggacccucauagacaucugccaacaagauugcuuugggaguagauguaaacucaucuaauuguuacuauccagaguagcaauaagccaaauuacucuuggaggaaaauaaaaucuuugcuaggugcuugauauuuuagguguucucucucuugccuauaugugacucaagcgcucugauuggccuugccagaccaagaggcccuuuuccuacagcugaauuuuccccuacggucucuuguaagcagcaucuggcauuguuucggugacucuguacuucucgguucugguugugcccuagcugacaguugcugcucuccaauugccuguugguugucuuccucccugugugugucuagcugcuggugcacacugcauguguccagggcagaauuaucuugcgccaccuccaguuuucaguuuuuuauuaaugcuaugauuauucugccugccccacuggauucaguuuugacccuucaccaaguggcaucagugccuguuacauccucuuuugaucacucucccacugccuucaccauggggcacugcagcagccucucuccuaccgccuuucgccauuucuguucaguccugcaugcucccucugaauuuguggucuuuguuaaucauucaucauucauuuugacaccuaauuguguacugccuuguuagcuacuuaaaugauuucaggggugucauucuucaccuaggcuggaauuucuguagggcagaaccuuugucaacaucuguaguacauaaauagcaggcauucaguuuugauugaaaguuugccuaaacuuucauuguaauauaauuucauugugaaguggguuuuuggaaggcauuuaauuuauuauaaaugagaagcuauaguuuauguaucuaguaaauauaaauucgaauaaauuuucaagaguguuucaaccuaugacaauuuaaauuucauagucacauguucuaucaauuggcaauuaaauggcagaguaacguuugacagccuuuauuaggacuuuuaaaauuuuuugccaguguacuauaguuucaugcacaaauuuuuguuuuaagcuguauuugugacguaggugcaaaacacaguacaaaacuauuuacaaagcauaugaaaaaagugcauaggacuuuuuauaccugagaaccugagagucagaaguacagguaaaauucaguucuggugcagaugucaugaggaagucugcuauaguaggacauugaguaacaccaguuuuuucuuccccacauguugcuuuuccuuguaacuaaaaggaguuguauacacuuaucuaaaccaucacuuuuauaacuuuuugauuuuaagauuuucagauucucauaaaacccuaaucuagagaucaugaaacugaggcuuagagagguuaaguaauauacccagcgugauagggcugguaaauaguggagccaggauuccgcccuaagacaucugucccuugagccaaacuauguaaccccaaaugagcacuucaggaauuagauuuuguuauauuguaccaacugcaaaaagaacagacuugacaguucaugcaaaacccauguauuaguauucaaguaaaauguacuuuuuuuuuuuuucaaucagccacaagcuuucauaucacuuucuguugacuuguuaacaguuuaaguaaucacaggccauucuggaucaugaagguucuuaaaaggaaaccagugaguggauaauacagggaaaugaauauuugguauucgaagcuacugucucuuuguucuugaugacuuagauaccugguuguauugcuaagguuaagcaauauugccuucuguagauacugcuuagcuccagauuggugugaugaguuagucuagacuuguggaauauucucagaagcuggcccuggacuaacaggagcuggagauaaugcaagggcugguaguggcauuugccucggcaggcagaaaucucucgcagacuuccauuagagguccaagggcuccagaagaaguucaaaggugcuuuguucuuauuagggcauuuuggaauuagguggucauuaguucucaucuguaguuccaaaucuguuuuguuguuguuguuuuuuaauucccaugugauuacuuuuaaaaccacagauggaggguuucuagaaagccuuugccauuugccugauugauuuuguugcauacaacucugccguuuuagggcagagguuugauguuuaagaggaucuuuuagauggucagucaugauagaguaugaaaccuacguuuuuauuuauuuucauuuauuuauuuucuagaaacuuggugaaaaaaacacauaacaaaauacuuaaccauuuuuauauguacaguucagugguguuaaguguauucacguuguuguguagcagaucuucagaacuucuucauguaaagcuggaagucuauacccauuaaacaacuuccuauuucucucccuacccuuaauccccacccccaggcuccugguaaccaccauucuacuuucuguguuuaugaauuugacuacuuuagauacuucauauaaguagaauaaugcaggauuugugaccugcuuauuuuacuuagcauaauaucuguaagguuaauccauguuguaggaugugacaguuccuuccuuuuuuuuuuuuuuguuuuguuuuuugaaaugauguuuugagaauuuauuuacaaccauugaacacggaugauuuuguaaaacugacaauuacaggcuccuuaaacucacaacauacauauauuucaauauuuaaauagccuguuuucuucaaaaguaauuuucugcuuuuucauaaaaauauaaaaaagacaacauuuauaguuccuuccuuuuuaagguugaauuauauuccauuguauggauauaccacauuuuguuuauccauucauccauccguggacacuaggcuugcuccuaccucuuggcucuugugacuaaugcugugaaguugaguaugcaaauaucucuucaagacccugguuucaacuauuuugcauaucuacccagaagagagauuucuggaucaugugauaguucuauauuuaauuccuuaagcaaccaccacauuuccauagugguugcauaaucucagaaucccgugaauaaugcacaaggauuccaauuucuccaugcccuugccaacaguuguuuuuguuuuguuuuguuuugauaguggugugaggugcuaucucauugugguauugauuugcauuuuucuaaugauuaaugauauugagcgucuuuucauauccuucuugggcauuuguauaucuccuuuggagaaaugucuauucacguccuuugcccacguuauauucagguuuuguuguuguuguugaguuauaggaguuccuuauauauucuggauauuaccccuuaucagaugauuugcaacuauguucucccauuuggcagguugccuuuucacucuguugaucauauucuuugaacaaaaguuuuuguuugauauaguuacuuuugcuuuuggugucauauccaagauaucauugccaaauccaaugucaugaacuuuuucccuaugcuuucuccuaggcauuuuauaguuuugggucuuauguuucggucuuuaacccauuuugaguuaacuuuuauuuaugguguaagauaaaggguauaacucuauucuuuugcauguggauauccaguuucuccaguuccauuuguugaagaggcuguccuuucuucacugaguagucuuuguguccuuguaugaaaauuaauuggcuauauaugcaaggguuuauuucuggacacuuuauucuguuuaacugcucugugugucugucuuuaugccaguaccagacuauuuugaauacuauagcuuuguaauauguuuugaaauaaggaaaugugagaccucuaacugucuucuuccuuuucaagauuauuuuggcuauuuggggucccuugagauucuguaugaauuuuaggaugcacuuuucuacuugccuugggauuuugggauuuugauagugauuguguugaaccuauagaucacauuggguaguauugauaucuuaacaguauuuuaacccauaaacuugggaugucuuuccauuuauuugugucuaauuuuuucagcaguguuuuguaguuuucaguguacaaaucuuucacuuccuugguuagguuuauuccuaaguauuuuauucuuuuugaugucauuguaaauaaaacaugcauuuuugaacuaaugauuuuaaucaguguaucauuaauaguuguaaauacauaguuuuuaguaaacacuccauauuugaaacaagaaaaaaugcugcguacuuaagguauuucguuaauuaccugccuauaaaaugaaagacauuuaagcccucguuaguucuaacaguuugugacuuuuuuuuguuuuuguuuuuuuguuuuuuugagacagagacucacucuguugccaggcuggaguacaguggugcgaucucagcuuacugcagccucugucucccggguucaagcgauucuccugccucagccuccugaguagcugggacuacaggugugugccaccacgcucagcuaauuuuuguauuuuuaguagaugagguuucacggccaggauggucucgaucucuugaccucaugauccaccugacuuggccucccaaagugcugggauuacaggcaugagccacugugccuggccaauuugugacuauuuuuuaaaucaguuauaaugauugcaaagugauauggcaguuugguucuugaaagcugauuuuuucuguauaguucuaguauuacauuuggaucaaaggaugugcuaguuaaaaacugucuuggcagugaaguuugagaaauagcauagccaacuuuauggauucagguuaauuagugguuuguauucaugguauggcaagggcccuacauggauuuucuuuuuagagcaugauuaaacugggagcagaagauuuucuaggcaauuauucaugguacaaaggugcucugugaaaccuaacuguauuuauaaagaucuuugagauaguuuauguuugucauuccaaaaguuauuagguagagcaguguacaagagaggguagugugcuuucaaaccuuugggcgaaauuggaccaccuuuagaaaugcuucuauggauuggugacaugggcucaucugaaguauugcuucuugauuagcaaaugggaaaugaaguaguggucagcacuaccaagagguaaugucucuuucagaaugggugcagcagugguuauguuucagauauaggggaguucuuagguauuuagggguccaccucauuauucuggguggcuucuguugaguuauggcugggcaugaaaauagguuacugagaauuguuuugaagagagauguaggaaggaaaaaacaggcaaggaauuagguccaguuuuauuggaauccuagaaauucuuguuuaaauugauuguaagaauaaaacagauuauaaaaugcagauuaauaaauggugaaaaacuguaaccagucaagaacuaacaugagucauccauguuuuggucucuguuccuuccucaucucucuucccucuccucacucuuuuccugccccuauuccccauuuaaaaaaauagauacugccaauaguuuucuucaaaggcaaucaauucacaucucaaccauacuguaugcaugugcuuacuuccccacacuggcuguuacucuuuucuuaccagucuaccaauaaaguugucacguuguuuuaauuuauuuuaaaacaauuacuacuaagacugaauacuuuuauacauuugcgaccauuuguauuuguguuugaucagucuuuugucaguuuucccauugauguuugaauuuuucuuuuugacuuagucuuuugacuuuaaggauuuaauauuuuucugaguuucuauuugcauuugaauuuuuuauuuucuauuauuuuuauaccugucaggcaacucucuuuuuuuuuuuuaaaugguuucugccuuucugauaccuuaacaccccuaaagauuauauauucaccaauauuuuauguccgugcuuccaucuuuaaaugcaaaucucuauuucuucaguccguuggcaucagguagagaaucuguuuguccucaaaucauuagucaguugccuuaacaccacuuauugaauuauauacaguauuuccuuucauucaaauucuguuauguacugggaucuauuucuugauuuuuuuuuucccaggguauuuuuuuuucucauguauaugucuaugcauuuguacauuucuguuuuaacuuuauuuuagguaauauagcuuauuuauacauuucauuagcuggcuuggcaggucauccccucucccuaaaugauuauucuucaaaaagcaguuucuuaucuaucuuguuuuuauucccuaugaauccucaaaucauuuuguaaagaaaauuuaaaguugcuauuugcuuuuugguuacaauuacauuaaaacguuagauaaauuuggaauuugacaucuuuauaggguuuuccauuuuguuugucuuucuccuaagucuguguguguguguguauauauauauauguauuaaguaaaacuguaugaaauuauaauuuuugucaguccaacauaauuaacaacuuauucaaucuaauauuaauauguauguuuuuaugcauuauugcuuuggcuagagcuucagaacauuguuaaauaagagugaugaaaaagcaggcauccuuauguuuuucuguuuuuuuaagagaaaaauaccuuaaguguuucauuguguaguaugauugggguaguugguugaaguuagauguucuuaauaauaggaaauuucuuauauuuuuaaagaguuuuaguuuuaagaguuauuagggacagcuacuacauuuuaucccauggaguuauuuuaugaccuuuuuaccuuaagcuguaggagcaguccucuuagcugcacugaacucucuuggugaauuuauacccaugucuguuuucccucuaguaaacucguccagggauacccauuggacuugggcugccugcagcugccaggcuauacucacacacuuccacauuugcuccauuuaguuaaugugcauauuuuuauauugugguuuuguuuuuaacuaaaacucuuuuuaaaaagcuauuauaucgauaugaucccucaugaguauugauguaucaauauauaguaauuauuauaguaauauaucauuauauauaauauauauuaauaaucccucaugaauagauuaaugcccuccccagggggauggggaacuaaguucucacauuuaauuuccaagagaguucaccugagaccugguauuaaaaugagccugucaccaccccccuugccgccaugugaucugcacacuccuuugccuucuaggaguggaagcagccugaggcccucagcagaagcagauguugguaccacacuuccuguacagccugcagaaccaugagucaaguaaaccucuuuucuuuauaaauuacccagccuccaguacuccuuuaaagcaacucaaauggacugagacaucaguuugcugucaauuaauuugauauuuaaaaaaaaaauaccaagaaaacuucuuauggaauuaggaaaguugcuguuaaauuuucuaugaaaaaaugaaaauguagaaauacugggaaaauucuggaaaaguuaugaggaaugacuagcacaagcaguuauuaaaacuugcucuuaaacuauuauguaauugguauaauuagaauaaguacugguauauaaauagacaaauuaauggaauagaauagaaauucuaguaauagaccuaaguauauaugguuuauguuaaccuacuuuucuucugggagucuggaacuuugguauguguuaggcagagggguaccguguggcuagccccaaguaaaaaccuugggacucuguguuaguuuccuauugugccuguagcuaauuaucacaaguugaguggguuaaaacacaagucuauucucuuaucauuccaaagggcagaagucuaaagucaggguguguggcugacugccacaguuaugguuugagacaaucauuacagcaguuaacuccuguuauugcuugagacugucauuacugcaguuacuacuggagaccaucauuacaagacugaacgaagggacgaacauagaaaugaaaaaagacaaaagaaacuguuuuaaggaaaggcaacauggggagaagaggagagcucccugcuucuagugaucaaaggcagcccccuugagcuucuacaguccuuucguauuuauuggguaaagagcaaggaggaggagguaaccauuggucagcugcuuaauugaucacagguucauguuguuacugacaggcuucaguuaugccuaaucaugagaaacauuugugcagccuccaucuccuuuuuguuuuuaaauuaauugagcaagacaauugcagauuaugcagcccuuaguggcgccuagacaggaacuugaagggacuaucagggacaaaaagggaccugaagagaacugaagagacccgaagagaccugaaaaacuaguucaggccaugaugggaagagggggucggacaugucucauuauacccuccucccuuuggaauucaggcaccacuuguagcugacugucacugcuacuacuugagacugucacuacagcaguuucuacuguuacugucugagaccgucauuaugagacugaacgaaggcacaaacguagaaaugauaacaaaaaacaaaaguaauuuuuaaggaaaggcuagcauggggaagaagaagagagaagaaaagaaugaaagggcucccugcuucuagugagcaaaggcaaccccugagcuucuacagcccuuuuguauuuauuggguaacaagagcauggaggaggagguaacgauugguuggcugcuuaauugaucacagguucauauuauuacuaacaggcuucaguuguaccuaauuacaagaaacauuuguguggccuccaacaaggguguuggggcugugcucuuucuguaggcuucaggggagaaucuuuuucugucuuuuuuagcuucuagaggcuuccugaauuccuugguucauggccucugacaucacccuuuuccuaauccaaacaucuugcauaucacauucuguuccucugagugugauuauuaauauauuuggcccaucugacuaaucugggauaaucuccccaucucaaaauccuuaauuuaaucacaucuacaaaauuccuuuugccauguaagguaacauucacagcuuccugggauuaggacauggacauuuuggggagucauuauucagccuaccacagacauugaguuucuaaugagcuuucuugauagaugugacaccaaaagcacaaacaacaaaaggggagaaaauagauaaaguagacaucaaaauuugaaaguuuugugcuuuaaaaagcccuauaaagaaagcagaaaacccacagaauggaagaaaaauuuucgcaaaucauguaucugauaaagggauauguaucuagaauguauaaagaacucauaaccucaguuacaacagacagugcaauuaaaaaaugggcaggggaucugaauaggcauuucuccuaauaaagauauauaauaaacguaugaaaagaugcucuacaucauuagcuaucagagaaauacaaaugaaaaccaaaaugagauuccauuucacacccaccaauauggcuacgaucaaacagauggauaauaaauguuggcaagggugcggagacauuggaaugucuuguugcuuuauggguaacauaagauggugcagcugcuuuggaaaacaguuugguagguccugaaaauacggaguuacuguaugacccacaguuaugcuccuuaguauauacuccaaagaaacgaaaacacaaaaacuugcacauaaaaacuugugcaggaacauucauagcagcauuauuuauaguagccaaaaaguggaaacaacugaaauguuugaagaauagaucaaauggaauauuauucagccauagaaaugagugaaguauuauuaugaaugcuuguuacaacacaggugaaccuugaaaacauugugauaagugaacaaagccacucacaaaagaccauauaagaccauagaagccauuuauaugaaauguccagaauaggcaaauccacagagacaaaauagauaacaugguugucuagaacuauggagagcaguguagggagugacugaugauggguacaaggguuuuucuuugggauggugguugaacaacucugaauacacugaaaacuaugcauuauauacuuaaaaugggagcuguuauuaaacaaguuuuauuaaaaauugauaggcuuuucaucuaagggggaaaaaaccuaaaugagauaccauuucucacuuauuuggguggcaaaguucuaaaagcuucacaacacuuucgaugagacugcaggaaagcacguguucucacaccuuguuaguuggaaugcaaaaaagauacaaccuuaauggaaagaaguuuggcacagugucuaacaaaauuacauauauguuacgguuuucaccuagcaaucucauuuuuaggaauuggcuguuuuaacaauacaaauacauauauauaagguuauucauagcaugaugauuugugaaugaaaacuauuggaaaugaccuaaaugccccuauauaguugaauaaauuguuacauccacauaauggaucauuaugcaccuuaaaaaagaaugaggaaaaccucuagaauaugcuuuuuagugauuuccaaaguauauugauaaaugaaagcagcaagguuauaaagaguguauguguguggauagcuaccuuaacagauuuuuaaacuuuuuuuuuuuuuuuuuuuuuuuuuuuuuuuuuuuuuuugguguguaguucugugaguuucagcacauguauagauuugaauaaccacuaccauagucaggauacagaacauuuucauuacccuccaaaaccugugcuaucuccauauaguccacuucugacucuugucaaccacugaucuguuaugugucacuguaauuuucucuuuuugagaaugucauauaaaugaaauuaguguguauaauuugagauuguaugguuuuaagacugguuuauuuuacucagcacaagacacuugagauucuuccaacuugugugucuugauaguuagucucuaauguugaguaguauucuguuguaugaauauaccaugauuuauuuguucaucuguugaaauuuuggguuguuugcaguuuggggcuguuauaaauaaagccgcuuugaacauucauguguaagucuuuguaugcacauguauuuuauuuucucucagguaaguacauaugaguggaaugucuggauccuaugguagcuguauguuuaagaaacugcuaaccuguuuuccaaagcggcuguaccauuuuauauucccauaagaaguguaugagaguuccauuuccuccauaugcuugccagugcuugguauggucaguccuuuaauuuuagccaucuuaacagguguguagugguacaggcauuucucauuuuauugcacuuugccuccuucacagccaauaugcuguuuacaaauggaagguuuguggcaauccugccugacacaaaucuauuagcaccauuuuuccaauagcauaugcucacuucuauuuuuaugucacauuuugguaagucucacaauauuucaggcuuuuucaguauuaaaucuguaaugguaaucugcaaucagugaucuuugaugugauuguguaauuguuuugggaugcccacaaaccacacccauaugacacugcaggcuuaacugauaaaugccuguguucugacugcuccaacuggcuguucccccacuucucgccccuccucaggcugucguuuucucugagacaacaauauugaaauuaggacaauuaguaguacuaaauagcaucuaaguguucaagugaaaggaagagucacaccucucccuuauaaaucaaaagcuagauaugauuaagcuuagcgaggagagcaugucaaagcugagaaaggccaaaagcuaggccucucguaccaaacagccaaguugugaaugcaaaggagaaguucuuuaaggaaguuaaaagugcuacucuggugaacaaaugaaugauaagaaagcaaaacagccuuauugcugauaggaguaagcuuuaguguucaggauagaagaucagaccagccacaagcauucuauuaggucagaguuuaauccagagcaaggccccucucuucucuucaguucuaugaagacugagagaggggaagaagcugcagaagaacaguuggcagccaggagagguugguucaugaggcuuaaggaaagaagacaguuucaucacauaaagugcaaggugaagugguuaagugccgauguacaaguugcagcaaguuuuccagaagaucuggcuaagaucauugauaaacguggccacgcuaaacaacagauuuuccauguagaugaaacagccuucuuuuggaagaugccaucuuggucucucauagcuagagaggagaagucagugccuagcgucaaagcuucgaaggacaggcugacucucuuguuaggaacuaaugaagcugguaacuuuaaguugaagccaaugcucaucugucaugcugaaaaaauucuagggaccuuaagaauuaugcuaaaucuacucugccugugcuuuauaacuggaacaagaaagccugaaugacagcacaucuguuuauaaugugguuuacugaauauuuuaagcccacuguugagaccuacugcucggaaaaaauauuacuuuccaaauauuacugcuuguuaaaaaggcaacuggucacccaggagcacugauggagauguacaaggagcugcauguuguuuucgugccugcuaacacagcauccauucugcagccaaggaucaagaaguaauuucaaguuucaugucuuauuuuaaaaauacauuuuuuaaggcuauagcugccacagagacugaguccucaguuggaucugggcaaaguccauugaaaaccuccuggaaaggauuugccauucuagaugccauuaagaauauuugugauucauaggaggaggucagaauaucaacaagaguuuggaagaaguugcuuccaaccuucauggaugacuuugaggaguucaagaugucaguagaggaagugacugcagauacaguggaaauagcaagagaacuaggauuagaagugaagcuugggcuggguaugguagcccuuucagaggccuaggcgggaggaauauggagcccaggaguucaaggaccuccugagcacuguggcaaaacccugucucuacaaaaacuacaaaaauuagcuaggugugguggcucucaccuguugucccagcuacucaggaggcuguggugggaggauuguuagagcccaggaagucaaggcugcaguaagcacuccagccugggcaacagaguggcuggcauccugaagauguaacugaauugcugcaguguuacgauaaaacuugaacaaaugaagaguugcuucuuauagaugaagugauuucuugagaugaaaucugcuccuggugaagaugcugugaacauuguugaaauggcagcaaaggauucaggguauuaucaacuuagucgauaaaguaguagcaggguuagagaagauugacuccaguuuugaaauaaguucuucuguggguaaaaugcugucaaacagcauugcaugcuacagagaaaucuuucaugaaauggcagcaaacuucauugcuguuuuuuauuauuauuauuuauuauuauuuuuuuccccaagaccgagucuugcucugucacccaggcuggagugcaguggcgcagucucggcucacugcaaccuccaccucccggguucaagcaguucuucugccaugaccucccgaguagcugggauugcaggcgccccccaccacaccuggcuaauuuuuguauuuuuaauagagacggggguuucacuauguuggccagguuggucucgaacuccugaccucaugauccgccugccucugccucccaaagugcugggauuauaggcaugagccaccacgccuggcccauugcuguuucaagaaauugccacagccaccccacccuucagcaaccauuauccugauccugaucaaccuugaggcaagacucuccacuagccaaaagauuaugacuugcugaagguucagauaauuguuaggauuuuuuagcaauaaaguauuuuuaaguuaagauauauacuuucuuagauacaaugcuauugcgcucuuaauagauuacaauacaguguaaauguagcuuuuauaagcacugggaaaucaagaaaacuuaccugacuugcuuuauugugugauauagguuuuauugugguggucuggaaccaaaccuggcaauaucucugaggcauuccugcauuucauuguaauuuuaauuguauuucucuggugaauaaugauguugagcaucuuuucaugugcuuauuugccauccauauaucucauuugguaaagugucuuuucacaucuuuugcccauguuuuauuaggcuauuuucuuauuuuugagauuugagaguucuuuauauguucuggguaccaguauucuggagauacauauuuacaaggauuccuuccaagucugagguuuguguuuuuauucucauaacagucuuuugaagagcagaaguuuuuaauugauugaaucaacuuuaccaauuugcucuuuuauagaucauguuuuugguaucguaucuaagaaaucucugccuaaugcaaggucacaaagauuuucuccuguauucuuuucuggaaguuuuauagugguaggucuuucauuuagaucugugauugauuuugaguucauuuuacauaugauaugaguuuuguacccaaguucuuuuuuuuuuuuuuuuuugcauauaaauaaccaguucuucuagugucuauuaaaaagucaauuaaaaagacuacuacccuuuucccacuguauugugcuuguacuuguugaaaagcaauugcauguacaugugugaguuuauuucugguugucugucucucuuuuguucuguuaaucuauuuuucugccuugaugccaguaccacacugucuugacugcagcuguauuauaguuaccgaaacagugucaguucaccaacuuuguucuguuucagaguuuugccuauucaagauccuucacauuucauuaugaauuuuagaaucagcuuaucaauuuguacaacagagccuucuuggguauugauugggacuguguugaaucuauagaugaauuuguggggggaacugacuucuuaacaguauuuaguuuucugacacaugaacagggauauuuucaccauuuauuuaggucuuuaauguaguuuucaguauaaaauuuuuaaaguaucuuuugucauauuuaucucuaaguauuucauauuuuugauacuaguuuauuaauaaaugauauuuuuuuaaaaucucaauuucugguucauugcuaguauauagaaguaaauuuuauguugaucuuguauucuguaaucuugcuaaacugacuuaauaguucuaauagcuuuucuguagauugcauuggacuuuuuacguagaugaucaugucugcaaauacguuuuuuuccagucuggauaccuucuguuuugcuuaccugauuguacugcuuaugaccuccagugcaauguugaauagaaguaguaaaaguggacaucucugucuuguucauaaucuuaggggggaagcauucagucuuccaccauuaaguaugcuguuagccauagguuuuucauagaugcccuuucccagguugaggagguucuuuuaugucuuguuugaagagaguuuuuaacaggaauggauauuuaucaaaugccuugucuguaucauggauuuuuuugguuaacaugaugaaugacuaaccuugcauuuuuuucuuggucaugauagguauuaugcaauuuauuuuaaaguuuuguuuguuuguuuguuugcuaagacuuagaauuuuuguaucuuuggucauuaggaauauuggucuuuuuuuuuuuuuuucuuguaauaccuucccuuucaguauuagaguaaugcuggucucauaaaaucaguugagauguguuuuuccuuuuuaauuuuuuggaagaaucuguauaaaacugguguuauuucuuccauaaauaugugguaagaauuaccauugaagccaucuaggcuuggaguuuacuuuauggggauuuuuuuaaccacaauuucaauuuuuaagaagcagggcucuucagguuaucuauuucuuccugagugaacuuugguaauuaauaucuuucaaagaauuuguucauuucaucuaaguugucaaauuaauuggcaaaguuguucauaauguucccuuacuaucuuuugaauauuuguagcaacuguaaugaugacacuucucuuauuccugaaacuuauaauuuguguuuucugucguuuuuuucuugaucagacuggcuacaaguuuauuaauuuuaaucucacaaaaagcaucuuuuggcuuuauuauucucuguauauguuuguauuugucucacuuuuucuguuucauugacuuuuucacuugaauuuuauuucucuuuuuuuuuucuuugcuuacuuagaguguaauuuuuccuuuauuuucuaguuucuuaagguggauacugagguuuuugauuugaggucuuuggguauuuaucaaagaucuuuuuguuauugauacauaauuuaauuccauucuggccagagaccauacuugguaugacauuaguucuuuugagacuuguuuugugacuuugaauauaggcuaucuuggugaaugugugcauuugagaagaauaugucuucugcuguuguuggaguacucugucaaugucagucagguugguuguagugcuguucaaguucaccauuuucuugcugauuuuuugccugcuuuauucaucaauuauugagaaacacauaucuguauuccaccugguaucauuuccuucugccugaaggauuuuuuuguaguguggaucugcuaguaaugaauucuuucagguuuuauaucucugaaaaugucuucauuuugccuuuguucucagauacuuuuauuugcuauagaauuacaggucgacauguuuuuuuuuuucuuuuucuuuuagucuuuaaagagauacugucuucccacuugcauuguuuuccagaagaaauuugaugucauccuuaucuuuguuccucuguauauaacaugucuuuuuuuuucucuugauacuuuuaagauuuuuuuuguaaaucugguuugaaauaauuugauuaucucuugguguaguuuuuuucauguuuguugagcucaggguuuguugagcuucuuggaucucuggauuuauaguuuucauuaaguuugggacauuuuugcuuacuauuucuuuaaacauuuuuccuguccuccuccuccuccuccuccucccaaccccauuuugaggauuccaguucugcaggcauuagacagcuugaaguugaucccacagcacauugcacuguuuagguuuuuuagaucuuuuccugcguguuccauuuuggaugggucuacugcuaugccuucaaguucccuaauuuuuucuuuugcaugucuaauccacccuuaaucccauccaucacauuuuuuucaucucacaaauugugguuucaucucuggaaguauaauuugucuuuguaucuuccaucucucuacuuaacuuuuugaacauauggaacacauuuauaauaccuguuuuauugucuugucugcuaacuucugugccaguucuagguugguuucaauggauuauucucguauugggucauguuuuucugucucuugugugugccugauaaucuuugauuggaugccagauauugcaaauuuuacguuguugggugcugcuauuuuuguauucccauaaauauucuugagcuuuguuuuaagaugcaguuaaguuacuugacaguuugauauucugggaugucuugcuuuuaagauguguuaagugggucuggaacauuguucaguuuuggacugauuauuccccacagcugagguaaggcccuccugagcacucuguccaguaugucaugaguucuggauuuuuuuccaguugguauaaauagguacuguuucugacccuguuugaauggugggcauuguuccucuaauccuuuuggaugguuccuuccccagcguuggggaguuaccucacacaaaugcacugaucaguacuucaccgaggacucaauggggacccucuguaguucuccaggguucucuaugcagcucacuccauuuugguauucuuuucuaugaacucuaauugccuugguuuccucggacucucagcuuugucucaucaauuuggaaaauccaccaagcucuaccacuguuuccccucccugcacuguggccuaguaacucccuugaggcaguaagcugggccaaucauagggcuuaccuuguuuguuucccauguccuucguugacugauguuuagggucugaaaaugaucauuuaauuaaugcaguucgugugaguuucugguugcuucaggaugggaggguacaucaugcccagaaguagaaguucauaugucugcaucaguuauuauucuacaguguaacuggcauuguuauuuucagauguuauuccuaaaccucuugguacagaaaauuuuugguaauuaaugugagauaguaugguguauuaguuucccuuugcuguuacuguaacaaauaaccacaaauuuaguggcuuaaaaacaacacaacuuuauuauuuuaugguucuggagaucagaaguccguauguagugagucucacaggcuaaaaucaagauguuuguaggccccuacucuauacccacaaaauuaaaaaagauuuuuuuuaauauguguuuguaggacuguauuucuuucugaaggcccuaggggagaauuuguuggcuugaguuuuccagcuucuagaggccaccuacauuccuuggcuuguagccccuuccccugccuucaaagccagcagcauugggccgaguccuccuuaugugccuucucucugggucacccucuucugccucccucuuccacuuuuaaggacauugggcccaccuagguaacccagaauaaccucccuauuuuaacaucagcugauuagagccuuaauugcaucugggagcuuaauuccccuuugccaugugauuuggcauauucacaagaucccgagguuaggaugugggcgucuuggagugggcugaugacuauuauuuugcccaccacagauugaugguuuuuagaauggucucugccuaagacugccugccugccugccugccugcccgccugccugcccgccuucccucccucccgcccgccuucccucccuccccucccucccucccuccccuuucuuuccuuucuuuccuuuuucuuuucuuucuuuuuuaacaggggaucucauucugucacccaggugggaguagugcaguuucuggggggucuugcuuuuaagauguguuaggugggccuggaacauuguucaguuuuggacugauuauuccccacagcugagguaaggcccuccugagcagucucucugguaugucaugaguucuggauuuuuccaguuggcagaaauaggcacuguuucugaccuuguguuucuguuucugaaauggcagaucucggcucacugcagccuucaccucccagguucaagggauucuccugccucagccucccgaguagcugggauuacaggcauguggcaccacucccggcuaauuuuuguaguuuuaguagagaugggguuucaccauguuggccaugcuggucucaaacuccugaccucaagugauccacccagcuuggccucucaaagugcugggauuauaggugugagccacugugcccgcuccuuucuuuugaugacagugaagaauugucuauauaggauuuuauuuuauuuugcuuauuuuuuuaagacagggucuugcucugucacccaggcuggaauguaguggugugauggcagcucacugcagccucgaccucuggggcucaagcaauccuccugccucagcccccugaguagcugggacuauaggcaugcaccaccaugcccagcuaauuaggauuuucuuuuuaaccuacacacaguaagacauuauuagaaacaaugagacuacaaaccuauacuuuaaaaauguguugguuauauauagccugucugucauacauagcauuuagaaguagcuuauuuuaauuucagguaugauucagaaaacuuuauggauuauuucacaaaguuuugauuugagaauuucucagcccauugcauuuggcaacguauagaaacuuucaagcuugggaaauugauugauagccacaaauguaauuuuagaucaguaucaacugucuuauauuucaguauuuuuuuucuuuuaaaauugaagaaugguauauuuuccccccuuccuccacuuaucacagcuaaugccuuauguucuuuguugcuuuugucacguggaacaccuccuugugugcuauuuuccugucaggacuucagugugucaucccccacauugucagcaauuucagugaucucugaaaaagcccaggauuuucucccugaccuuuacccagugcccuuuguaaaggguuauguauaccugauuugauggaauaauuuauguauagcagcucugagcugaaguuagcacuuuugcuuccauaacugucuucauauuguauuugacucccaucuucuucauauguuuaaauaauuauugauagaauucuaaaguaguaguuuauuuaagccagaaguuaaugugcaaggugaauaauaauuuuaaucauucuuuauacuccccccaccauaggcuacauuaaaaacaaacccggcuuuuauuuguccaagaaugguugagugucaguaggucaguagagccaguuccagagcacauagucaagccagcagguauuuguaauaccuucucuucugcugcguucugcuugcuucuacuugcacacuccuggguaaaagugaaugagauauguccagcauggcagaccaccagaaguuggccauagcacucagcacuuuguccuugcuucaggaauaggcccagaugguuacucuucucuggccacaauccugggaccagaagcccagucagcagagcaccugcucuuccaccaggcugguuugugccuggagugaguggugaauagaugaggucaaggcuuugcaaauggauggcuuuucuucacguauugguuuaucauuuacuuguuguguguguccuugggcaaauuauuuguggaccuuucucaacuguacagugggcauaaacaugcuuaauagaguugcuaggcacuuugccauaggucuugaaauguuaguuuucagauauguuugcagauuaggcgugcuaucuuuugucuccucucucuguacuguuucuuuuggccuaugucucuauuuaccuccucccgcaccuugccuccagugaaagaaaccaggcauggagcauuugucucuuggaucagccuugauacccuuaugcucccuacugagcaguuccuuggggccaaggggagucuaaggccauccccaaaagagguagccauuucuuuaagguacuguguuuuauuuauucaaauuuugcauuccguuucaguauccaugcugguuccaguagaaaaacagauuuucccaaguggauacaccuuaagaugugucucaugcuuuguacuuagggcucacaauagcacguuucuggaaacauuucuguguuucagcaguacuauaacagucauucuucaucaacaaggagaauggaauggaauggaauguugccagggucuugguucacagagguagacuaacuuugaccuuccugggacccugaacaacuccacaucagacagaucguugugaaaggcacugaguaacauuuagauaaguggaugauuuugcauuuuuuacaguaacaucagaaaguccaguguuguaugaaacacugcuuauuaauaaaguaagagcaugugguuagauaucagcuacuuguaggagaauaugcguggcuuucaguuucauaguucuauuccugcagauuuuuauugcaucaacuuguuuuauuugagcaguuuguguacagugauguauggaauaaucuucaccaaauaguguguagauauguuuuugacucauagcagaauaaguacucuaaggccuuagaauaguagccugggaagacaaauguuagcacagaaagauacaucauucuuagauagccaagaagaccugcaggugucauuaauuagcaucugaaaaggaaauauuuuggaaaacauaaauaauacaggcaguuaggugucugcagccagagaguuagagaaggaaagaaguaacagacuaauggaggggaguugucagggaaggagguguuggggcagaagggcccaaacauggggagcuugguggagggccuggaagaaacuggugauuaaagcaacaauugucugucuaagcacacacacccuuacccugccccuaucauuaggcggcuggccuuaugauauguacuguguacaggguaacuucucuuuuguacaauugaagauaaaaggcuuaauuuauacaugucuaguggucauaauacaucaacaaauugcucuuaaaugaguuaguuugucagcugaauuaacuaacauaaauguugucauauccuuuuccuuuuuuuuuuuuugaaacagagucugucucugucacccauacucaagugcagugaguggcacaauuauggcucacugcagccucgaucuccuaggcucaugugauccucccaucuuagccucccaaguagcuaagacuagaggugcgccuccaggcccagcuaauuuuuuuuuuucuuuaguagagaugagguuucacucuguugcccaggcuggucucgaacuccagaccucuaaccauccucccacuuuggccucccaaggugcugggauuacaggcaagaaccagugcgccugcccgauauccuuauucugaugggaaggaugugccuuagcaaacugguucaaaugagaaguuggggaaggaguauaaucuucuggauaaugggagccaggaaacuugccaggucucgucuucacuacgcacagaugagugggagauguugggagucacucuugcuuugugcaggcuucccuacaaacaugucagcacugcuuggcauacuuccugaaacuuauguuuuugucugaacauugccccuccaaagggagaacucauuuuccgagacccuacugcagggagauaggagugcccacuguguugucugaaaugugugugguacacagcaagugcucaguaagucucaauucaguugaaaguugaauuacacacugacaggcagguucaugacuauucccauguuuacguccgaaguucauguuggugucucaaaguguuaacacuuaaaauauuaaaacaccacauugagauauacauaauauauaauauauauauaauaaaggaaacauagacccucugcgcccuuaucugguagucacuccucgguucuuaucuggucacuaggcuagacagaacaccagcaaauuaauucguuaauuuuuauucaguaggugccaugucuuaggcuggguguagaaagauaaugacacaauucuggcuuugcaagagcuuucagugugguggagugaacaggccuacagauggaugcugaguuauaagugguugccaggauaggucgggugcuggggacaggacuuaguguacuagggcauuacuuagaauaaguaacucauuuugaggucuuaggcaguaagacauuauagccuuguuaugugucugugucucagaguucugagauuuuucuucugugccucccaccuuaaaaaaccucuccaaaaaaaaaaacaaccuaaaaaaaguggcguaagacaucccaacaggauguguuacaugggaagacaacaugguaugauaagaagagcaucgaggcucuagugcuuacuagcucugugaccuuguacaaguuacuuaucccugagagucuguuuccucuuagacuaagugggaauaaaaguauucuguggaauguugaagagguuaaacuuuugguuugaggaugcuuaaucuauuuagcuucaucuucucuccccccacuaucaacccucuugaaaaauuuuccauugcaccguucgaauuaguugaguauacaguuuuuuauuauaagcaguuuguuacuuauuaaauuucuuauuuccaugugaucuuuauacucuuuuuuuuuucucuuuccuuucugacaauuugucuguacccagggaauuuaaauaaauaaacauuucauuuuguagucacauaugaauaaauuuacacacuguacuguuuuauguuacacuuccuguuuucugucagugugcaucuuucaugcaaccaguauauuuuucaguacacugcuggguccuuggauauguuuaugaguaagauaguaauuagcuuccaagaauuuuuuuguuagagacaggcauaaacaauuacaguguaagauuaaagguacauauuaauaugugugugccacaggagagagcuagguugacuguauacacagaccuguguaucagucagcuuaugaaauuagagaggacaguucuaauggggcauuaggucuggaucugaguaacucccuuuuauggugagucaaaacaauacuccauaaguuccaucugacucaccgcccccaucuaagaagugugccguuuguuuguuuguuuguuuguuuguuuuagguggugggcaggugugguugaauucacaccugugaacaccccuggaacaaguuuggucaaagcaagggcuugucuucguaagugauuagucuugucaucuuauaugagggaccugccuggcuaccuuucucagugguguagagaguaaacagacugcugacuuggaauaugggcuugacugugaccuugagcaaguuaacuaguccucaugugucagcuuccuaauuuguuuaauggggauaauaggaauaccugucuucuaggguuggugugaguauugaaucaucuguagggcuugguauguaguaagugcuggauuagugcuagcucuuguugcauauucauguuauguuugacucuggacuacuuguguaaucccaggugagccaacuugaagcuauuuucaguuggaccagaccaacuccuuagucugaagguaauccauguagucagcucaacaaacauuuauugagggccacugugucagacacuggauuggucguuggaaccuaagagaugaagaaggggugauuccuggccucaaguaguuuauaccuuuuauuuauuguguucucuuuaguuucucaaaauacuuuuaagaucaagacauucaaagaauuaagauuugaagaguggaagaaauuuuaaaaaauuaggaaaggguucuuuuaaaguaauguauuagguaauuuagggagaaauugucccuuccagacucuguuaaccacccggaaagauuuugucugagucgaaugccagacaccuugcugguuuaacuacugcuaaguuauguugcagugagcagagaacagccgauuuacccugugaggcuuacauguucaguguaugcauugucagcucuaguaauuauucuaacauacuagauauucaugauagaaauuuguuuuaugacaagggaaaaauauaccccugucaaaaugauagcaaauaaauuugauaauuuugcaauuuaaguuuuuuuuuaaaaaauugcuuuuguucaauuuuuuuguuucuaggcuuugcuuacuuucucuuuuacugaauuauccuugcauuacuguucuuuuucuacucaaauuuuuagcucuagcaggaaaagccacccuaggaaaauugacuaaugccaucuaguucuaccuuuaugugaauuucaggguuacauuuaaaucacuucuccaugggcaggcaaaagaaagguagaaaauagcuuuugaaguuagccugucuaggaguagguaauuuuacacaaucuaaauucacaggagaauuucuucagauuuuuaggagcaguaauuuucauuacacauucccuaauuucauuaggaaauuuuuaaguaaucugugcuguuugugagauuagaugaauuggugcccagccauggggcuugucacagccauccagauucaucauuccugguguccacuuggugcuuagcagcguggcccuugguaguaagugguagcuauuaugugccagguaaucuaugcaguagugccuguuuuaaaaauguuggagaaaccagccccacaccaccuggcggguaccccgaguccagcggagacaaaggaguuagaaagagacagaauaagaguuuaaaagguggguccaggggaccagagugucagaggcuugcucacagcccggaacucucagccuccacccaauuuauugguuuacaagcucuuuguucuuaggguagaugggagggguacgaagcgaugaggaaaagaauuaaucggugaaggagaacucgucagucauucaauaagauauauagcaguggcgguuucugugaauuuccccaagcaaaggcgugugucuaaacggcuuaagaucuuuaacuuaccgggacugaaaugggugggaguggguuucaagaggaaccaagauguuugauuauacuccacuguuucaagggaguguuauuuccccgagcaaccuguggcaugccgcggagcucuuacgcucuuggggcauaaagacaugaaggcaauaaggagacuuuucuccucagaggccgcccauggcucccagugggugucucacacaggggagaccaacucaucuggcacccuagaaacucucuuucccacaaaaaagaauuguaucuauauuuuauagaugaagagacugagguuguaaagaccaagagucaguguuuucccaaaguuugcugauaauaguguguauuaauuuacugcuugguaacuuauuucuguuuuauagauuaguaucuuccuucccaggauuuguuggaauuaaauaagaauagugcaugcagauugcauaguacagugucaggauguagaaagcauuuaggagauaugguuagacauuuuacuuggguuauuucuguuucgauguguuuuucugucugggaguaaacaggugguuuaaggaaaaaucuugauugcaguagaauugacuuagucaaggacguauauuucaaauguguguuuaacaagcuugauaugauaaaaauagauccaauucuuaguugcaugugauuuuugcuuuccucuguaauauuuauuugacuguuuuaaagaaauuauggaaaacauugacuucuuucccaacuguauuucccugcaauuuguuugcaguggaacugaauuuacucuaaagaggagguauguggcuugcauaucauuuucaguaauaggaagugacaugagcaaaauugcaaggaaacagagauuagagaccagccuugaauaaauccaguauaaaaguagaaugccuuaacauuucuccuaauuuccuaaauuguauuacagcaguauuuuugaccuuguaggugguggucuccuuuauuauuauuauuuugucuggggacauaggagauuucuugagaaagaccuuuaacugcagcuguaugugguaauaaguguguagggauugcugucauucuauuaguagaacauucaggaaugugaaugcuugauuugccaguuuccuuggaagucgguuggaguauuagaauauuacuguacacuauaccugugccacuuuuauguaagccuguuagaacuggauucuggaaaacauuuauauuugagaaguuaacuuauucuuccaaauauuaauucauucuguaucuagauauuucagacuuuuagcaaaaauuuaccacuaugcauuugcauagaagaaaaacuuuuaaaaauaugugauguaguauaaacaucugauuuauaagugaagauaaaauuauucuagcuuauauauaacaacaacaacaaagggaaauuauucuagcaaucucaaaaauucuuauuguauuuauuuauuuuuugagauggaguuuucacucuugucacccaggcuggaaugcaguggcgcgaucuccgcuuacugcaaccuccgucucccugguucaagcgguucuccugccucagccuccugaguagcugggauuacaggugcccaccacuaagcacagcuaauuuuuguaauuuuaguagagacaggguuuagccauguuggccaggcuggucacaaacuucugaccuccagugaucugcucaccucagccucccaaaauucugggauuacaggcaugagccaccauaccuggccugcaaucucaaaaauucuuaaagcugacugguuccugagaccuuaaggaaacaaaaaagcuaucaaaaauuaguaaagcuccuuuucucccacuuuuaacauacaagaaauuaauaaaagacagaaaugaggugacaucuaugugccuucaggguauuaagagcccaggguaauaaccuacuuuaaaacaaugcuguaagguugaacaugacuaaacuugugccagcuuucuuuuucuuuccuuuauguuuuagccaacucuauugagguauaauuugcauacaguaauauucacuaguuugaagugugcauuuugauuaguuucauaaacauacaguugugaaaauggcaccaucuuaauguaggacauuuccaucaucucagaaaguuccccugugccuguuagcaaucagugccuuuuccucaucacuggucucaggcaacaacuauugcucugcuuuuugucacuuucuguagcugcugcguggucuagaauuguaaauaaauggaaucauacuacaugcagucuuuuguuuugacuuguuucaguuugcauaaugcuuuugaaauucacguuacauuuaucauguuuguuucuuuuuauugcuaaguaaacuacaauuuaguuuuuuaccuguuaauagauuucuggguuguuucaaguuuagggcuauuaugauuaaagcuuuuaugaagguuuaaguaaaaguuuuuuuguggacaaauauuuucauuucucgcaaguaauaccugggaguagauugaugaguuguaugguaagauuauguuuaacuucagaagaaacugucaaaccauuaccagcaggaugugagaguuccaguugauuuuacaguaugucuuuccccaacacuugauguugucagucauuucaguggguacuuagugguauuucauuauaguuuuuuuuugagacggagucucacucuguugcccaggcuggagugcaguggcgcuaucucagcucacugcaagcuccaccucccggguucacaccauucuccugccucagccucccaaguagcugggacuacagacacccgccaccacgcccggcuaauuuuuuuguauuuuuaguagagauggaguuucacccuguuggccaggauggucucaaucuccugaccuugugauccaccugccucggccucccaaagugcugggauuacaggcgugagccacugcgccaggcagccuuuucauuuuuuaagcagcguuuuuugagaguaaauauuuuaaauuuuaaugaaguacaguuuuucaauuuuuucauuuacaggucuguguauauucuguauccuguaagaauuuuugccuaccacaagaucacaaaaauuuucuccuguguguuucucuagaacauuauaguuuuagcuguuuauuuaggucuguaauccauucugagcuaauuuuuauauaugguaggaggugggagucaauauucauuauuugcguauucaaauaaugggaauauguaaauaaugcauauugcaauagggaauagaacacaaaagcaugcuuuuuguuguuguugacuuuuaaaauauugaccuacaauuucccguaaguucacuuuuuaaagugcauuugcauauucagcuguugcagcacaauuuaugaaaagacuuucauuuuccuccauugaguugcuuuggcaccuuuauugaaacucaguugaccauguauuugcgugucuguuuuucgauuuucaauucuguucuguugauuuacauaucauuuugucaguucuguauuagcuugguuacggcagucuuuuaguaagucuuuaaagggaggcaguaugaauacugcaacugcuuuggcuguuuuaguuacuuccauuuccauguaaauuucagacuugucaauuucgaaaacaacaacaaccugagauuuugauugagagcacauuaacucuaaucaaacuggugagaauugauauaacaacauggaguuuuuaaucccaaacaagauucaucucuuuauuuagaucuuuuuuaauuucuuuaaacaguauuuaucucucauguuuuuggaggcuguuguauagggaauuguauuuuuuccauauacaacaauuguauauuguauacaaguauacaaacaauuggauauuuguucuguauacaaccgauuguauuuuuuccaaauacaaugaaauuauauuuuauuuuauuuuucaauuguucagugcuuguauauagaaauguaauugauauuuguuauuaacuuuacgugcuauaaccuuacuuguucuaauagcaccuuuuuuuuuuuuagauaguguuuacagcuuccuuuccuuguucccaauuuuggggggaaacauucagucuuugaccaucaaguacgaugucaguuguaaguuuuuaauaaguguucauaaucgcugaggaaguucuuucuauuggcuuacugguaauuuucaucaugaauuggugaauuuuaucaaauucuuuuucucuauauuaagauggugaaguaacuaguuuuucuuuuuuuagaauguuaauaugguaaaauacauuacuuuuuaaaaauguaaaccauccuugcuuuucugguauuaacucuguuuggauguuauauauuacucauuuuuacauauugcuggacucaauuugguaaaacaccuuuaagcauuuuuuaugucugcauuaaugaagucuguugguuuuaguuuuuguaugcuauuuuuauuucugguguuggauuaaugcuggucucaucaaaugaguugggaaggauuuuucuuacaauguugaaucauuuuuauagaauuagucuuauuucuuuuaagccguuuuagcaucauuuguuagaauuaaccagugaaaccaucuaaggcucagacaggaaaacugcaaaaugauacuggaucauuuugugucguaaagcaaacaugugcuccaggacuaauggaaacaaguuagaacaacacaaaaacuggcuugaagggauucucauuggccaaauuuggaacauuuugaacaucaaaaaaaaaaguaaucaguuauauuggaagaaaauaugaguccauagugauacuuaaacaugaagaagguggauggaaauaaaaaugacauuaccaaagaaugccuucuaguaaauguacaaggaaugauugaauuagaaaguuaccguuuuacaacugccacuguaaucauugacucaggcaggaauugucaauggaugcuaaaaauuauugguaaagauuauuggguauauguguacuaucucaaaauucuuuuuaugaauuaucuauuacaaagggaaaaauacaucuuugugaugcaaagaucugguggauacuacauuaagcaagugauccaauuuaauaucaccaguagugacaaauugaaauaucagucucuuguuaggguugcaugucauuucuauauuauucuuaccaaaaauauuugcccugaaucuaaucaugaggaaacaauaaagcaaaucaagauugugggauauucuguaaaacacuaggucuugauucuccaaaaauuaugucaugaaagacaaaaacuuuugagggggacuguuguaauuuaaaggagacuaaagugacaaccaaauauaaugcuguaaugcaugauccuugauuggaugcuggacugaaaaaaaagguuauaaaggacauuuugggguggaaacuuaaauaccgacuguauuuuuuaaauguuauaugucaguauuaaaaugguuggcugugguaauaaaauugugauuauguaggagaaugucuuuguucuuaagggaucugugcugaaaguauuuacugggaaguguuguggugucuguagccugcuuucaaaugguuugaccauauauagauacacacacacacacacacgcagacauauauauauuuuuuucucauauauaugagagagagagaaagggagaaugugcugaaacaaaucugauaaauacaguuguuuuaacuauucuguagguuaaccuuuucuacaguaaaaggugcgccaagaaaauacuucccuguuugagagucaggaccacaguggcucuuccaggccuugaccauggggcugaagcaguugguucuucaaaccuguccagcucuuccccaccuccccagagacacagaugaccuuguaucuuagcucauugaaacagacccuccagcgucagcuccuucuauuucucccuucuuguaaccucaguuugugucuccccccacguuucuuuacuucagucuucagauagagcuuuucuucuccuuucucuucuccuguuuucuugacuuuccaaggcaucuacuuuagagucuggcuucucucugccacucagaaaccugucucaagacuuaccaguggcuuccaauuggccaacucugguggcuuauuuucaagucucugccccucuguccucuucuuuucucugugggauagucuuugacacuguugagcccuuucuuggcuuccaugacacaugcccucuucuguuccucuugcucauaaaccuccacugucagugcuccacugcugcuggagggagguucugcccguaauaaguugcagagcucagcccucuaccauuucuuccuugauuuuugaaagcugagagcuucaguuucgucccucuguuggugucccuuuccccaaguucaaguacugucuuggaacugccugcuucagcauuuuuccuugcauagcucauuguuaacucagaucccauuuaucugaaguugaauuaagccuuuccuuucuucauaugccccuucaaaucuggucacuugcccuaggcguaacaggcauuuaaaucaccagccuucaaagcuuguggguaucauaaaaugcagacucccaggcucagucucagagaaugcgauucaguaugucugaauguaggcccagaaucuaccuuuugcugaguaccaaggcauuuuaaugcagugguccaagaacuccacuuugagaacagcuacuuuaaugauugguuucaggguuuguuacuguucuacuucaccaugggcuuucucugucuucaggaagcugcaccuguugggagauuauucuaaguauuggaaggucguugagagacagccugagcuugagcuuuguagagaugcagaccugaucuguccucucaucucugccacuugccagaaguuugaccuugggcaaauuacuggaaaaugggaaaaauagcacacaacuuccaggguuugguguggaugguggcucagcuucugccccccucuccagccucuucuuaauucucuucaaugcuccccagauuucagaccuaugaaaugacuuaucuucuuaaagaaccaugauuuuucauaccucaaauuccuuugcacuguugugcuuucugguaggaaugcccuaccuuaaccuccguguucaccugacucuuccuucagacguaaccacuccauaaacccuuguggcugaauuuggugguuucagugcaccuggagcacccaguacuugauuuauucgucugugucucaucucaguguaugaguuccuugaggagguccagccuuagccguuagcacugugguuaugugcaguagcuuuuaguuaaaaguuaucuuuuuuuuuuuggaauaaucaaggcaccuacuaugacauuagcuaauuguauuucagaggccuaguuuugaaacuuucauuauuugucaacauacuuggcagccaugccagcagguauaagcuuucccgcauguuuucaaaacaggaaacuuuuguccuuuggaauagaaguucuaacacuugagcacauuuuuuuuuuuaaacuaaugucuugaagagguaacuuguuucuuuuuuuaaguuuagguuugccucaucccacaaugagaucaugaaauaaccuugccucuccccauccuaugaguuagcugguacuuucuguuuauagucaguggucagcaccaaaauaguaucccuugaauuucaaagcaagccaggacagacuagaaguacauuaaaauuugugccugguuacuagagggggaaaaauaaaauauauaauguuguuucauauguauguagucaaaaguaaaacaugugacuaaauaaauuuuaaaaauaauaaacuaaaauucauaguaaugcuaaaauuuaguuuauguaaaucauuaaguaccaggcacaacaaaauuuuuguuucuuugcuuuuuguuuuuauguaaacauuauugugcuuagaaguugccaaauuuggugucuuucaauuuuuuuccuuuuggaauaaaugugaacaaagucucacauuuauucaaacauuuaacuucauuuuaaaaauuauugcuguaggauaacuuuuuuuuuuuuuuuugagacggagucucacgcugucgcccagccuggagugcaguggcgcgaucucggcuuacugcaaccuccgccucccggguucaagcuauucuccugccucugccuccugaauagcugggacuacaggcacaugccaccacaccggcuaauuuuuguauuuuuaguacagaugggguuucaccauguuggccaggcuggucucaaacuccugaccucaggugauugccugccucggccucccaaacugcugggauuacagccgugagccaccgugcccagccgcuguuggauaauuuuuuaacuuaaaauuuaugucagagauggagaauaaacuauuaaagacuaauagagaauaaaauuuuuggaccauguauuuacaaaagucauguuuaguaguaaaaaaaaaaucuaguuuacacuacuuaaugaaaaaagagaaauauuuuuaaauauauauaacacauucucacuuugacauaaauuuuucucuuuuuaccccaguuacuacuaugcccaagaaaauuuuccaaacuuuaagucuuuuuuuucuuuuaccacuuuggaguaugaccuguuauuuauaaacuuuccuugaaaaaaaaucgaaauuuuaauuuguacccugaaacuuugaucaaaguaauaggagaucaauaccacaugaguuaaagaauggaguaaaaauauaauuguucucuguauaaucaagaaauuaucugaugggccauuguaacuauuucacauuuccauuuagcaaguugguuccgagauacaaaaauauuuggcacuuuuuggcuuguggauguccaguugcucuagcaccauuuauugaaaauugaaaaaauuccuccaguggauuauuuucauacuuguaucaaaaucaauugggcauauuuguguggcucucuuucugggucaucuguucuauuccauuagucugugcaugucauuuuggcaaugucacacucucucagguacucuauuacuagaauaauacuacccuuacucuuacucuaccuuaauauuggggaaaguaauuucugucacuuuuuccuuauuucucaagauuguuuugacuauuuuaggguguguaccuuugcaugcaaauuuuagaauaagcuaguuuguguguaugaaauauguugcugagauauugauaggaauugcauuaaaccuguauauuaauuuggggagaauugacauuuuuccuguguuaaguacucuauuauauauguucauuuauuuagguuuucuuuuuuuaaucagcauuuaaaauuuuuuaguauauagauccuguacauagcuuucacuuuccggagugauugcaaguauuucacuuuccagagugauuguaaaugguguuuuguuuuuuauuuuuugguuuccauauguucauuguuaguauauagugucuuguuuuuaacuuuuugguuuccauauguucauuguuaguauauagaaauguuauugauuuuuguguguuaaucuuauauccugcuuccuugcugaacuuacuuauucuagaaguuuuagaugauuuucacagguuccuuuggauuuuccauguaaacgaucguaucauuugccaauacggacaauuuuauucuuccuuccugaucuguaugcauuuuauuuuccuugccuuauugcaguaucuuagaauuucuaguacugugcugaaaaaaaguuguggaucaccuuuucccagucuuaggggaaaaccauucuuucaccauuaagguauagauuuuugcagaugcucuuugucaaguaaaggaaguuccaguuuguuccuauuuuagugagaauuuguaucaugaugagauguuggauuuugucaaaugauuuuuuuugcaucaauugacaugaucauaugauuuuguuauuuauuaguauauuugauuccauuaauuuuuuuucaaauguugauucagucuugcauauuucggauaaauucugcuuaugguguguaguccuuuuucuauauuacuagauucaguuugcugguauuuguuugaggguuuuugcaucuaacuuaauaaggaauaguggucuauaguuuuaaaaaaauuuugcaaugguuuugucuagcuuugaugucaagaguaauacacuagcuucauuagaugaguugggaaauguucuuuguuuuuuuaaacuagauuauguaaaauuggcccuaauucuuuuuaaaauguuugguaaaauuuuccaguaaagccauuuuggccugggaauuucuuuuuuggagaucuuucucuuuuuuaguuuuuuuuuuuuuuuuuuuuuuugagauggaguuucacucuugucucccaggcugaagugcaaugccgugaucucagcugacugcaaccucugccucccggguucaagcaauucuccuaccucagccuccugaguagcuggaacuacaggcgcacgccaccacgcccagcuaauuuuuuguauuuuuaguagagauggguuuucaccauguugguaaggcuggucucgaacuccugaccucaggugauccacccgccuuggccucccaaagugcugggauuacaggcgugagccacugcgcccggcugagaucuuucucuucacaaauucacugucuuuaaugguuauggguauaugcaggccauuuccuucaucuugguugagcuuugguaguuugugguuuuugaggaauugguccguauuuucaaaguugucaaauuuaugagcauaaaguuauucauucuaugcccuuaguaaucuucuaauggcuauaguaugaagcuaucccuuguuucauuccugaugguugugcuuugugucuucaccuuuuugucagucuugcuagagccuuuucaguuuugauuauuuuucagagaaccaguauuugauuucauugauuuuuguuguuguuauuuuccuguuuucaauuucauugguuucugcucuuguuuuuauaauuuucauucuacuugcuuugaauuuauuuugcucuacuuuuucuaguuucuuaaaguaggggacagagauuauuaaugugagaccauuuccucuuuucuaauauaagcgucacugugacauaaguguuucggucagaacuguuuuuugauauuuugcguuuuuauuuuuauuuacguauauguauuuuuugcuguucuauugcuuuuuggccaaugauuuguuuagacaugugguauacagaaguguuugaagauuuuuguguuauguuucuguuacugauuucuagucugauuacauugugauuggaaaucauaugaacuuaagguucaccagcauuauaguuggaaaauggaauaauuuuaauuauuuuaaaauaguugggguuuguuuuaugacccaggguauggucuguccuggugcaugguccacgguagcuuaaagggaaugaauauucuguuguaggguggaguguucuggagaugucuuuuagauccuguugguugauuguuguucaguucuuuucugucuuugcuaauuuucuuuuaguucuaccaguugcugacagugaaguguugaaaucuccaccuguaauuuagcuuuaucaguuuuuguuuuauuauuuugcaacucuguuguuuggugcauuuacuuuuaggagcaguauuuuuuuauugauggauugauuuuuaaaguaucguuauguaaugucuuugucucuaguaauuuucuuuccucugaaaucuaccuuaucuguguuaacauagccauaccuguuuuuaaaaaauaauguuagcaugauauaucuuuuaacgaccuuuuauguaaaacugauguguuugaaauaaguuuuauuagacgguauguaguuggguuuugucugacuuucauuaaggucucuuugccuucucuguuuuuuaaaaugcacuuuucugaaguuauuucauuuccauacauugagcacagcagauguuaaguuuguuuuaaccgucaguaugauuuaagaaacuugauggaaaaggauggucucuuauauuuaccccuuccuuugcucuuguuuccuuuaugaaauuccaagcugccuuuuauuauuuucuuucuuuuugaagauacuccuuuagaccuucuuuaagcguaggcuugguagugacaaaauuuuuaauuugcuaauaccuuuauguuaccuucuuuuuugaaggauagcuuugcugguuauagcauucauaauuaacaguuuucuguuguuuuuuguuuguuuuguuuuuguuuuaaugagacaggguuucacucugucacccagguaggaguacagugaguggcacaaucauggcucacugcagcuugaccuccugggcucaagcaauccucccaccucagccuccugaguagcuggaacuacauaugcacagcaccaugcccagcuaauuuuuaaaauuuuuuuguagugauguagucucacuguguugcccaggcuggucucgagcuccugggcucaaguggcccucccgccucggccucccaaagugcugggguuguaggcaugagcuaccgugcugggcccacacaauugacaguacuuauguuucaguucuuauauuucagcauuuaagaaauaugccacuccuuuugcacuuucaugguuucagacugaacaccaauucgaauugguguucuaguauagguaaugugucauuuuucuugguuccuuuuaagacuuuuugucuuuaguuuucagaaguuugugaugugucuugauaugaauuucuuuggguuuauccuaucuggaauucgcucuguaaguuuaugucuuucaccaaauuugggaaguuuuccuguauuaauuuuucaaauccucccucagcgucacauuuuuucuccucuccuaauguuagauuuuucauuauugcccuggaggucccugaggcuuuguucauuuuuuuguuucagccuacuuuuucugcagcuguucagacugaacaauucuuuuuuuuuuuuuuggagauggagucucgcucugucacccaggcuggagugcaguggcgugaucuuggcucacugcacccuccgccucccggguucaagcgauucuccugccucagucucccaaguagcugggauuacaggcgugcgccaccacaccuggcuaauuuuuguauuuuuaguagagaugggguuucaccauguuggucaggcuggucuugaacuccugaucucgugaucugcccgccuuggccucccauaaugcugggauuacaggugugagccacugcgccuggccgaaauugaacacuucuuuagaucugucuucaaguucacugauccuguaugguauuaaaggacucuaaaagguggaaagcggguggacuggcuaggggacguuaggacuugaaacacacuggacuggaguaauuuccaugcauguguguuggggcggugugguguguaugcguguuuguguuuuucccccguguaucccagacuggaguggaguacaacuugaaauugccaacaggcauaaacagcaacaaaaacaaaaaacagaaaacccuguccucucuggccaaaggaucaggaaaagggaagcccaggagggacuugccaaugagacauuuuacccaguggcaguagcaggccuagucugcccacaacaguggcccagcagagauagagugagaagcuuaccagugaggugacuguagaacaagccacgggaaaugcucuuauucaccccucaggucuggcaguccccuacccacuggccuaaucauacugugcagccugaggaugugccuuccaccccgcuguguggcaccagaagcuauccagugggagcuccagcagagcuagaagaaugaagcagacacauauuaccaucacaggggcuuacaaaacucaauugucuuuggaacuacagacuacaaaaguagaccagaaccuacacaccaaaccuaacugacuccauguuuuucuaacuuccuuaaauccuuauuuucacuuaaagggauuuuuuuuuuccuguuacaauaugucugguugugcugaaugugagucugcaccaucagugaacuguugacuuauucugcucucugcuucuguucucugguucuaucauuuuaacuuuaaaaugugcaacucugguaaaucccuaaaauuaacagugcauguguucuguaggaaaugaguuccucuugguuuguuggcuauuuccagcuuauuguacuuucuuuacugcaaauuuaggcuauuaaaaggauauuaguaccuggaaacuaagcucguuuuccuccuuuuaauccuuauuggcuaaaauauuagucaucuuugguuacaaguugauggcugagcaguuuuucauuccacaguguugagaaacuagacuggaaucuugagcugauaaaccagaaugcagaugugguagauauuggagucuuggaaucagcagacccaugcccuaguucuggcucugaacucauucaacuucuacaugauuucugagaaacccguaauuaaaaaaaaaaaauuauuucuaagucagugauguuaacugcucucccagucuguugcugccugaaggggaauauccgguaaagagacccuguccugaugcucuuugccacagaguguagagcugcuagcagggggagaagcaaguguagggacauuaggaucauggcauacuggagagaggacuagggcuacagaagccacaaggacagucagggagaggaaagguggaauguccaugaaacacagcacugcuaucuucaaacuuugacuguuuuuaaauugaaacauagcuuauaaucaguagagcacacacaucuuagguacguagcuuuuuaaaucuuuauauauguauguauuugauuauaguuaaugauuuuaacuaucauacagacgaaaauguagacuauaaagccuugcgaacacuuuucauggggaaauacuuuuuuccauucacugcuuuaaugaagugguuaaauauuggcuugauaagguaucuauauguauagauguauuuuuauuuuuugucuugugcugaaauuuuggauauucuguaagaaagacacguaaugagauugguagccaucauccucacaaaacauagugauguguuucucagaaggaggauuuaguaaugauaggccuuuggguuugcagguacaagaaauaaggcaaggaaaaugguugcaauuuuggaguaaggccuucauguaguugaugugagaugaugauuuggaauccuucagaagcuauuguauaaaaguaaccaaaagaagcaagcccugugugggguguaaaaauaaauacugacuuuuuuuuuuuuuuuuuuuuuugagacagucucacucugucgcccaggcuggagugcgguggcauggucucggcucacugcaagcgcugccucccagguucaugccauucuucugccucacccucccgaguagcugggauuacaggugcccgccaccacgcccagcuaauuuuuuuguauuuuuuuuuucaguagagacgagguuucaccauguuagccaggauggcucgaucuccugaccuugugauccacccgccucggccucccaaagugcugggauuacaggcgugagccaccacgccuggccuugacuuuuaauaaacagauuuauugagguauaauuaauguacaauaaacugcacacauuuaaaguguacaguuugaguuauggcccaugugaaacuauuaccauagugaagauugugugaacgugugcacucucuauuuccuugugacccuuuguagaauuuucuuaccucccuuccuaaucccaggcgacaguucuucugcuuucugucacuuagauuaguuugcauauuauacaacuuuguauaagcagaaucauacaguauuuacucuucuguugucucccuucuuucacucagcaugauuauuuuuagauuugucuguaauguugcauguuugacuguuuuaguacugcauaguauuccacuguguugcuguaucacaauuuguuuauccacccacccguugaugggaaugugaguuguuuccucuuuugaacuauuacaaauaaagcuucccuaaauauucauguacaagucuuucauuuucauucacacauacguuucauuucaguugggcaaauaccuagaaauggaaugucugguggguuauguguucaacuuuuucagaaacuacuggccuggcacgguggcucacgccuguaaucccagcacuuugggaggccgagacgggcagaucacgaggucaggagaucgagaccauccuggcuaacauggugaaaccccaucucuacuaaaaauacaaaaaauuagccgggcgugguggcgggugccuguagucccagcuacuuaggaggcugaggcaggagaauggcuuggaccuggaaggcggagcuugcagugagccgagaucacaccacugcacuccagccugggcgacagcgcgaggcuccgucucaaaaaaaauaaauaaaaaaaaaagaaacuacugacauguuauccaaagugguugcaccauuuuauauucccguuagcaggguauuacaguuccacuuccugcacauccuugccaacaccugauaugguaagaaguuuucaucuuaaucauuuuauugguuauguaguggugucuccugguguuuuaauuuuuauuuuccuaaugacuaaggauuuugagcaucuuuucaugugcccucuuauuucaugugcuauucauguugucuuugcuuaaaugucuguucacaucuuuuuugcauuuuuuuaaauugagcuguuuguuuucuuauuuaguuguaacaguuauuuacauauucuggauacaaguccuuugucagauaagcauuuugcaaauauuauuuccagucuguggcuuguauuuuuacuuuuguaacagugucuuuugaggaguaaaagcuaaaaaaaaaauuuuuaauccaccucucaauucaucuuuuuuucuuuuauaguucaagauuuuuuucuuuuuuguauccuacuuaagaauaucuuugccaaacucaagaucacuaaaauuuucccguguugauuucuaggaacuuuagaauuuuagcucuuacauaaauucuguuauucauuucaaguugauuuuuguaaauuuuggagcauccagauucucuuuuguuuuucuuucccauguggcuauucauuuguaccagcaugacuuauugaaaagauuacuuuuccccaauugaauugccuuggcacccuguugcaaucaguugaccauauaugugggggucuacuuuuggagucucuguucuauuucacacaucuguuaucugugucaguuuuauaccaucuugauuacuaugauuuuaagucuuaaaucaggcaauguugaguccuccaaucuuguucuucuuuuucaaaauucuuuuuacuauuuuggguccuuugcuuuucuguauaacuuuuagaaucaucuuguaaauuuuuacaacaaaaaacuugauuggaauuguauugacugucuagaucaauuuggggaaaauugcuguaacaauauugguucuuuugaugcaugaacaugguauaucuuucuuuuuauuuagguguucuuuaauuucuuccagcuguauuuugucaaauauuuaucuuaguauuuugaugcaauuguaaaugguuuugauuuuuauuuuccaguuguuccuugcuguuauuagaaauaugauugauuuuuauauguuggccuugcauuuuccuacuuuccuaaucuuacuacuuuccuauauccuguaucaccuguaaaaauuguaccagaaucaaaaaaauucuaguagaauuuuuauagguguuauaggagauaucaugucugugucuaaagacaguuuuauuuucucuuuuccagucuacauacuuuuuuuuucuuugcguuuuauuggcacgaagauugcccucuuaccuucauuuauucuuucacuaugauguuaaauaggaguggugagaaggaacaaucuuaccuuguucuaaucuuaaauggaaaguauuuagucuuucaccauuaaguaugaugauagcuguauaucuuuuguacaugucuuuuaucagcuuaaggaaguucuuuuugugcccauuuugccaagaucuuuuaccaugaauggaugaugaauuuuguccaauguuuuuugucuguuuuuugaaaugauuaauuuuguuuuuuaagucuuauauguugaaguuuuuuuuuugaauauuuaaacaguauuucauuccugggauaaaucccacuuggucaugauguuuuuaucuuuuuuauacauuaauggauuacauuugcugaaauuuugacaagaauuuuugcaucuguaauaagaugugaaauuggucuguaguuuuuuuguuuuaauacccuuauuuguuuuggggaucagagugaugcuggcuuuguaaaaugaguuuggagaguuucuccuguuucugggagaguuugcguaugauuuuuuuuuuccccuuaaauauuugggagaacucaucguuaaauacaucuaauccuggaguuaucuuugugagaagauuuuaacuacaaaauaaguuucuuaaguacauauaagccuauucaaguuagcuaguuuuuugugagugaccuuugguauuuugagucuuugaaggaauuuguccguaucauaaacugagaguuguuaauuauauuugcugauuagucuucuaauguuuauagaaaguauagucguauucagucucucauuucuuauguucacaauaccuggcuucucuuuuuucaaacugacuagcuagauguuuaucaauuuuguuaaucuucccaaacagaaaacuuuuguuuccuucgauuuuucucuauuuucugcuuucuacuuuauugauuuauauucuuuauuauuucuuuucuuuuuuuauuaaaaaacaagauauggauuacuuaucuaauauuuagaaugugaucuuauagauuauauaugaguaugcaauauagauaacuguauggauauaccauauuuccaaucauaaauauuauauuacaagauguaaugcaagauaaaaucccugcacaauagcuguguuggcauaagcaucauuuuaacugaguguuuuaagaugguuguaauaccacugaguguuuuaagauggcuauaauaccacuguagucacagacaugucagcagcauguucuuggcacauuuaaucuguggcuacaguaaggauaccaaccuccucuguaaucaguauuuccaacuuagcauaauuuaagugaauuuacaauugcuugauguauaucuuuuuaaaagagugaauguguucaaacguugagauuuuuagaagucuuacaguagugguuuucuuuuuucaaauuuuuggcauauauucaaacuuucagaaaauuuuuaagaaugaaaauagucaaaaacauucauauucuuuacccagauucaccugcuguugacaguuugacccauuugcuuuaucauuugcuguuuucuccuccccgugcacaaucuaaugaaugaauuuguauccaugaaagaacuauaagcuuaaagcucuugagcagagauuacauuuuguccucugguuacacaauauuuaaaauaccauuuagauaaacauuuuagaaaagauuuagggaauagaacacaaaagcaugcuuuuugcuguuguugacuuuuaaaauauugagauacaauuucucauaucauacuucaccuuuuaaaguguauaauucaguggguuuuugaaguauacucauagacuuguacaaccaucacaacugucucauuccaaaauauuuccaucaccccaaaagaaauccuuuauacaauaggagucacacccuauuccuucccagccccugacaacugcuaaucuagguucuuuuugccuauucuggacguuuccuauaaauggaauacuaaaauauauggccuuuuguaucuggcugcuuucacuuagcauuaguccucaagauucaucugugagcuuugugucaguacuucauuccuuuuuguuguggcugaaaaauacuccauuaaauggauuuaccacauuuuguuaacugcucauuagucaguggacauuuagguuguuuucauuuuugacuaucaugaauuugaacaaugcuauuaugaacacugguauauaaguuuuuguuugcacaaguauuuucgguuuucuuauguauauacauaagaguauaauugguauauuguaugguaacuuuauauuuaguuuuuuuaauaacuacccaacuguuuuccaguguggcugcuccauuuuauguuaccaccagcgacuuaggcguuuucgaugucuccacauccucaucaaugcuuauuguugucuuuuuuauuacagccauccuuuuguuuuugaagcaguauguuguuuugcuuuugauuaacaucugucuaaggacugguuuugagcgucuuuucguguauguauguauuauuguccguuuauguaucuuuggagaaaugucuagucaguuuccuuguccauuuuuugauugggagguuugucuuuuauucauugcaagaguucuuuuuauauucucuguauguaucucuuaucagauacaucauuugcagaaauuuucucccauccuguggguugucuuuucacuuuauugauagugcccuuugaagcacaaacuguuuuaauuuugauaaagucuaauuuaucuguguugucuuugcuuaccuauucuaguuaagaaaccauugccucaucagagguuaugaagauuuacaucuauguuaucuucaaaaguuuuauagcuuuaucucuuacacugaggucuuuguuccuucuggauuuaauuuuugcauauguuguuaggcaggguccguccucauucuuuuccaagcagauaccuaguuauuccagugccaguuguugagaagauuguucuuuucuccucugaguuaucuuggcauucaucaauugagugccgaaaucaauuggccauaaaugcgaggguuuguuucuggacugucaguucuauucuguuugaucuauuugauuagguuuaucuuuuauuuauuuauuuauuuuuauuuuuagucugagucuugcucugucgccaggcuggagugcaguggcgcaaucuuggcucacugccaccucugccucccagguucaagcaauucuccugccucagccucccagguagcugcgacuacaggcgcgcaccaccaugcccagcuaauuuuuguauuuuuaguagagaugggguuucagcauguuggccaggauggucuugaucucuugaccucaugaucugccugccucggccucccaaagugcuggaauuacagacgugagccacugugcccaaccuugauaagguuuaucuuuauuccaguacuguucugucuugauuaauauaccuuuguaguuaaguuuugaaaucgggaaguuuugaguccuccauugugucuuucuuuuucaaaacuguuuuggcuauucuugaauauucuuaugaacuucaggagccacuugucgauuugcaaaagagcaaggugagauuuugacaagauugcguuggaucugaauauuaccauuuuaacauuauuaaguauucuagcuuaugaauaccagauaucuuucuauuuaggucuuuuaaaauuuuuuucagugaugcuuuguaguucacaguguacaagucuuguacuuguucgagauguauaauccuuuguauauguuucuagauaugauuugcuuguauuuuguugagaauuuuuauauccacauucauaagaacaucuguaguuuucuuuucuugugaugaccgugucugauuuauguaucaggguaugaauugcuucauauaauaauuuggaacgugauguuuucucuugaguuuuaaaauuuuuguuacuuaaauuuuuuuagagacagggucuugccuuguugcccaggcuggaaugcagugguacagucauagcucgcugucacuucagacuucuggguuuaagcaaucuuucugccucagccuccugaguagugggaauacaggcaugcaccaccacacccagcucuuucuuucuuucuuucuuucuuucuuucuuucuuucuuucuuucuuucuuucuuucuuucuuuucuuuucuuuucuuuucuuuucuuuucuuucuuuucuuucuuuucuuucuuuucuuucuuucuuucuuucuuuuuuuuuguagccaugguauguugcuauguugcccaggcugguguugaacuccuaggcucaaaugauccuucagccucagccuccuaaagugcugggauuacagccguuccccaugcccagccuguuuuuuguccuucuuuaugcuuuuuaaaaaaagcuugugaaggauauguuuuaauucuucuuuaaauguuuaguagaauucaucagugaagccaccugucccuaggcuauucuuugcggggaaacuuugauggcuaauuagguuuguuaagauuuucuguuuauuuuggaguuaauuucaauaauuugugcuuucuaguuauuuguucauuucauguaggcugucuaauuuguuuguguauaguuguuucuuguguucucuuuuaaucccuuuuacuguaagauuggaaaguucauuucuuuuuguagcauuaguaaugcucccuguuucuuucuuuucuuuuuuuuuguauuuuuuuuuuuuaaauuauacuuuaaguucuaggguacaugugcacaacgugcagguuuguuacauauguauacaugugccauguugguguguuguacccguuaacucgucauuuacauuagguauuucuccuaaugcuaucccuccccccuccccccaccccauugacaggacccggugugugauguuccccacccuguguccaaguguucucauuguucaguucccaccuaugaaugagaacaugugguguuugguuuucuguccuugugauaguuugcucagaacgaugguuuccagcuucauccaugucccuacaaaggacaugaacucauccuuuuuaauggcugcauaguauuccaugguguauaugugccacauuuucuuaauccagucuaucacugauggacauuuggguugguuccaagucuuugcucuugugaauagugccacaauaaacauaugugugcaugugucuuuauagcagcaugauuuauaauccuuuggguauauacccgguaaugggauggcugggucaaaugguauuucuaguucuggauccuugaggaaucgccccacugucuuccacaaugguugaacuaguuuacagucccaccaacaguguggaaguguuccuauuucuccacauccucuccagcaccuauuguuuccugacuuuugaauaaucaccauucuaacuggugugagaugguauugcauugugguuuugauuugcauuucucugauggccagugaugaugaguauuuuuucauguaucuguuggcugcauaagugucuucuuuugagaagugccuguucauauccuucgcccacuuuuugaugggguuguuugauuuuuccuuguaaauucguuuaaguucuuugucgauucuggauauuagcccuuugucagauagguagaugguaaaaauuuucucccauucuguagguugccuguucacucugaugguaguuucuuuugcugugcagaagcucuuucauuuaauuagaucccaucugucaauuuuggcuuuuguugccauugcuuuugguguuuuagucaugaagucguugcccaugccuauguccugaaugguauugccuagguuuucuucuaggguuuuuaugguuuuaggucuaacauguaagucuuuaauccaucuugaauuaauuuuuguauaagguguaaggaagggauccaguuucagcuuucuacauauggcuagccaguuuucccagcaccauuuauuaaauagggaauccuuuccccauuucuuguuuuugucagguuugucaaagaucagaugguuguagauguguuguauuauuucugagggcucuguucuguuucauugaucuauaucucuguuuugguaccaguaccaugcuguuuugguuacuguagccuuguaguauaguuugaagucagguagugugaugccuccagcuuuguucuuuuggcuuaggauugucuuggcaauguggguucuuuuuugguuccauaugaacuuuaaaguaguauuuuccaauccugugaagaaagucauugguagcuugauggggauggcauugaaucuguaaauuacuuugggcaguauggccauuuucaugauacugauucuuccuauccaugagcauggaauguucuuccauuuguuuuugucuuuuuuuuuuuuuuuugagauggagucuggcucugucgcccaggcuggagugcagugccacgaucuuggcucacugcaagcuccgccuccuagguucacgcaauucuccugccucagccucccaaguagcugguacuaacaggcgccugccaccacacccggcuaaguuuuuguauuuuuaguagagacgggguuucaccacguuagccaggauagucucgaucuccugaccucgugauccgcccgucuuggccucccaaagugcugggauuacaggugugagccaccacgccaggccguuuguguccucuuuuauuucacugagcagugguuuguaguucuccuugaagagguccuucacaucccuuguaaguuggauuucuagguauuuuauucucuuugaagcaauagugaaugggaguucacucaugauuuggcucucugucucuuauugguguauaggagugcuugugauuuuugcacauugauuuuguauccugagacuuugcugaaguugcuuaucagcuugagauuuggggcugagaugaugggguuuucuaaauacacaaucaugucaucugcaaacagggacaauuugacuuccucuuuuccuaauugaauaccccuuuauuucuuucuccugccugauugcuuggccagaacuuccaacacuauguagaauaggaguggugagagagggcaucccugucuugugccaguuuucaaagggaaugcuuccaauuuuugucuauucgguaugauacuggcuguggguuugucauaaauggcucuuauuauuuugagauaugucccaucaauaccuaguuuauugagaguuuuuagcaugaagggauguugaauuuugucaaaggccuuuucugcaucuauugagauagucauguaguuuuugucuuugguucuguuuauaugauggauuacguuuauugauuugcguauguugaaccagccuuacaucucagggaugaagccaacuugaucuucguggauaagcuuuuugaugugcuacuggauucaguuugccaguauuuuauugaagauuuugcaucgauguucaucagggauauuggucuaaaauucuuuuuuuccugugucucugccaggcuuugguauuaggauguugcuggccucauaagaugaguuagggaggauucccucuuuuucuguugauugcaauaguuucagaaggaaugguaccagcuccucuuuauaccucugguagaauucggcugugaaucugucugguccuggacuucuuuugguuuguaggcuauuaauuauugccucaguuucagagccuguuauuggucuauucagggauucaacuucuuucugguuuagucuugggagggaguauguguccaggaauuuauccauuucuucuagauuuucuaguuuauuugcauagagguguuuauaguauucucugaugguaguuuauuucugugggaucgguggugauaucuccuuuaucauuuuuuauugcgucuauuugauucuucucuuuucuucuuuauuagucuugcuagaggucuaucaauuuuguugaucuuuucaaaaaaccagcuccuggauucauugauuuuuugaaggguuuuuuuugucuguaucuccuucaguucugcucugaucuuaguuauuucuugccuucugcuagcuuuugaauguguuugcucuugcuuuucuaguucuuuuaauugugauguuagugugucaauuuuagaucuuuccugcuuucucuugugggcauuuggugguauaaauuucccucuacacacugcuuuaaaugugucccagagauucugguauguugugucuuuguucucauugguuucaaagaacaucuuuauuucugccuucauuucguuauguacccaguagucauucaggagcagguuguucaguuuccauguaguugagcgguuuugagugaguuucuuaauccugaguucuaguuugauugcaccauggucugagagacaguuuguuauaauuucuauucuuuuacauuugccgaggagugcuuuacuuccaacuauguggucaauuuuggaauaagugcgauguggugcugagaagaacauauauucuguugauuugggguggagaguucuguagaugucuauuaggucugcuuggugcagaccugaguucaauuccuggauauccuuguuaacuuucugucucauugaucugucuaauguugacagugggguguugaagucucccauuauuauugugugggagucuaagucucuuuguaggugucuaagggcuuguuuugugaaucugggugcuccuguauuggugcauauauauuuaggauaguuaguucuucuuguugaauugaucccuuuaccauuauguaauggccuucuuugucucuuuugauuuuuguugguuuaaagucuguuuuaucagagacuaggauugcaaccccugcuuuuuuuugauuuccauuugcuuggcagauuuuccuccaccccuuuauuuugagccuaugugugucucugcaggugagauggguuuccugaauacagcacacugaugggucuugacucuuuauccaauuugccagucugugucuuuuaauuggagcauuuagcucauuuacauuuaagguuaauauuguuauaugugaauuugauccugucauuaugauguuagcugguuauuuugcucguuaguugauacaguuucuuccuagccuugauggucuuuacaauuuggcaugauuuugcagguggcugguaccgguuguuccuuuccauguuuagugcuucuuucaggagcucuuguaaggcaggccugguggugacagaaucucucaguauuuguuugucuguaaaggauuuuauuucucuuucacuuacgaaguuuaguuuggguggauaugaaauucuggguugaaaauucuuuuaagaauguugaauauuggcccccacucucuucuggcuugcagaguuucugcagagagauccgcuguuagucugaugaccuucucucuaguuguucuacccauguuugaaagugggauauugaauucuccaaauauuuuuauugaauuucuucuuuaucccuucauccugcauguuuuuauuuccuguguuuuggagcucucuuguuagguucacguauguuuauaauuaugucaucuuaauggagugaucccuuuauuauuauuaaaugucuuuuuuccucuuguagcaauuuuuaucuuaaagucugaauuuuuaaaauuuauuuuuuaauaguugcugugagaauuacaauuaacaucaacuuguaauaguuuaguuuggacuaaugucaccuauucuucaaauauucuucaugccuuuuuuucucuccucuucugagacuccuguuguacagaugguguuuuguagucacucaggcucuuuucauuuuucuucauuuuuauuucuguuucccagacuggauaaucuuaaccaaccuauuuuugaguuugcugauucuuuccuuugccugccaaaauaugcuauugagccccucugaugaauuauuuuaguuauuguacuuuuauguccagaauuucaauuugcuuguuuuuuccaguuucuuucucuuuauugauauuuucuguuuggugaagcguuguucucauacuuuaguuuugcacgugguuuccuuuuuuccuuugaacauauuuaaaauagcuuauuuaaagucuucuaguaaguccuguccucagggaccauuacuguugauugcauuuuuuccuauguaugagccauacuuucuuguuucuuuaaauuuauuugaaaacugggcagugggaggggcucauuucaguuacugugcuuuucuauuugguuauuuuaauaauuucuuucucuucuuaauauucuccauuuggugugacuuuuaguucuuuggacauuauuuccuuuaguucuuugaauauauuuaauauagcugaauuaaauuauucaguaauucuaaaaccugggcuuucucaagggcaguuucuauuaaauacuuuuugucccuuuauacuuuuuuguuucuuuguaugucucucaauuuuuuguugaaaacuggacaacuaacauauaagguggcaacucuggaaauuagauuuuccccucccuaagguuuguuguuguuuuuguugcuguuuguuuaguggcuuucugaacaaguuauuuuaaaucuauauuauuuguggugcauggcuacugaagucuccguguggugagcuucauagucaucuaaugauugaacagagauuuccuuaaaaaccuggaaccaguaauucuccccaucuuuguugagaggccuguguauuugcguacauauguguguguuggggcacaucaaaacacucagccgggcaguugacagcuguuccuuagccuuccccuccuguuuacacaaagccuggggucagccccaggugugagagcuuagggaugucucagguuucuucugagcacaggcagagccagagcccgaugcguacacaggaccuucuagauuggcaggaaggugucaacacuuuuuacagccccuguggacaucuuauucccaacuuuuccuuuuaaacuuuugggucugcuuauuguuuggcccaacugucaucuaccacauuguucugcagccaaauuuuuaaaaauuuccccuaaagguuuuugacaacuguuaccagggucgaggcuuuucacagugggaaagcucugagucaggucaaauaaaaguagccuuccagguggggccucacugggacucaccacacagaucagauaaagacaguucucuggaaaucaggcuuucgaggagcugcagcauuguucugccacccuuauugccugucaggcugcugauuuucacugugauugggcuguugguuauagugcugucacagagcuggagagaagagaaugagaauagaaaaguuaaaugccacauauuucacuguucuuguugagauucagcuuuuuaaaaauguauuaacauuccauggauugcugcaagcuuuuggagauugcugcaagcuuuugguuaauugccagaguucuuagaaaguuuauucugaugcugccaauuuucuuguucuuguuagaauuuucaaaugucccuaacuuugccauuuucacugacaguaccucuguugcuuuuuuuucuucuucugugcuauuuuguuucuucaaacuauucucaacuuuugcugucaaaaccaguugauugaauuaacauugauaauggcauguagguccugaaauuaaauuucauuaucuuaauauuauaaauauuaacccauuuaagaaucacuauuacaaaaacauuuugaagauaaacuauugagcagguagaacuaauuaccagaauuuaucauuagcuauuucauuuuuuaauacagauucuuauugagaucauuuuagaaucauacacuguuauaagaaguuauacagagagauccuguguagccuguaccugguuccucccaauggcaauaucuugacaaagaauacuacaaagucacaaccaggauguugaucuuuugauaggaauggguauuucauuuucaccauccugauauuguggcuuucauuaccauuucccugaugguuaaugauguugaacaucuuuucacuugcuuauuggauuguucuuuucuguuuguuuuugaguucuuuauauagccuagaucuuuagacuuuuguuaaauauguaguuugcaaauauuuuauaccuuuucguaguuuguccuguccuacucuuaacagggucaugugaagggcaaaguuuuuaauuuugaaugagguacaacaauuuaucauuuuuuuuuucuggauugugcuuuuggugucaacucuaggaacacugccaaaccuuagauccugaagaucuucucuauccuuuuuaaaaaguuuuauaguuuuacauuuuaaauuuagagcagugauguauuuugaguuaauuuuuguauaaguuguaaggauuaggucaggguucuuuaagaaaaauauuguuuuggucuauagaugucucauugcuucugugcuauuuguuggaaaagcuguucuuccaaugaauugcuuuugcaauuuugucaaaaccagugaggcauauaugguucuguuucuagguguucuacucucugcaagugauuuaugugucuaucccucugccaauaucacacugccuugguuacugaaguuaugcaguaagacauaaugucugguggagugauuccucucacuuuauucuuguuuuugaagauuguuuuuagcaauucuaggguuuguuccuaucuaauuuuuuguauaagcuugucaacaaaaaauuauccugggauuuuuacaggguuuacauuaaacccacagauuaauuugggaagaauuaacaucuuuacauuuugagucuuuuaauccaugaauauagugugucuucuuguuuauguagaucuucuuugauuuauuucaucagcauuuuguauauuucaguacauauguccugugcaugcuuucuuagauuuauaucugagguacuucauuuuauuuggagucguaaauggcguuguaaauggcauuuuaauguugauuuuugcauauucauuguuaguauauagaaauguacuggauuuuaggauuuagaccuuguauucugcaacuuugcuauauguacuuauuaccuuuaagaaggacuuuucuuuuugaguccuugggguuuuuacauagacaaguauguagccugcaauuagggaguuuuauuuccuuuccaguguguucgucuuuuuuuuuuccuugccuuguuaaaguggccagaacuucuagcacauguugaauagagugagagccacauccuugacauguucccagucucagggccuauauauucagucuuuuacugguaagaaggauauuaccuagagguugagauugagguaguucuacauuucuccuaucuucuugagaguuuuuaucaugaagagguguucgguuuugucaaauacuuuuucugugucaguugauaugaucauguguuuuuccucuuuagccuguugauggggugaauuacaaugaucaguuuuugaauuuugggugagucuugcauaccuugaguaaaagucacuuggucgugaugcauaauuuuauacauugcuggguucaauuuguaauuuuuuuuuugucuaaguuaaugaguuuuguaguuuuuaaaauaacauguauguagcauaaaauucagcauuuauaacuauuuuaaguguacaauucaguagcauuaaucacaauguuauacaaacaccaccauucuuuuuucauuacccuagagacucaguaaccauuaagccacaacuccucacuucccccuacccuguugcccaguaaccucuaaucuacuuucuguccccgugaauuugcuuauucuacauuuuucaugugaguagaagcacaguauuugcccuuuuuugucuagcuuauuucacuuacuauaauauuuucaagguccauccauguuguagcauauaucagaauuucauucuuuuuuguggcugaauaauauuucauuauguaacugccauguugauccauucaucugugauggacacuugguguuucuguuuggagacuuuggguacuauggucacgcaucacucaacguggaaaacauccuaagugguguuaggccauuuaaucauugugcuaacauagaguguaccuacacaaaccuaggugguauagccuacuacauaccuaagguauaugauacagccuauugcuccuagacugcaagccuguacaacauguuacuauacugaauacuguaggcaguuguaacacaauggcaaguuuucguguaucuaaacauagaaaaggguacaguaaauacaguauuauaaucuuauggagccaccaucaucuaugcaguccaucguugaccaaaacauuacaugguacaugacugcauuuaaauacuuuguuuuaacagucagccuauuuagguuuaucauauagguccugacuagggccugcuguuuugggcuauaguuccaguaauagcuuaguuuuuagagcauuugcagugcgagcuucagaguuuuagugauuuucugauacugaagcugcuaagaguaguuggugguucuugagcauuaguucuacauuuuauaacugaaguuuacagaucuuuuuagaugacuuagauucuuuaggauaaggugaaaauuaauuaugguauuuugucuuuagcuauaaaauuaauuuugaaaaaccuuucuggcucaucuuuuuagauguaugguauauauccugcacaucugaauuacauaggauuauauuuugaguuuuaguaaacaacaugggcauuagcuucuuuaggaaguugaugauauugaguggucuugauaaaauuaaaauaugguuuauaugaguucccuuguacuucuaauguggcaagaagacaaguauauguuacauuuuucagauaauaaaacuaaugagggaagaaacaaagcuuugaucauaaaaugucuuuaagcucgaagggacccauguggaccuaguccaggauguuuuaaaauugcuauugagcccuuuguugaaacaaaauauugagcaaguguaacuguaaaagagauauugauguauuuaacaauguugaauucuaaaauagcagugucuuuuuuuuuuuuuuuuuuaagacagggucuuguucugucacccaagcuggagugcauuggcacuaucucagcccacugcaaccucugcccccugggcucaagcacaaugucauuauccuaaccagaauuucuuaucuuauguuuuucagacuugcuucuaggcacagauuauugacaagcaaaccaggaacuuuuacagauugugauaagaauuaagauagggaauauaauagaggauaacugggcugcucugagaagccaaggagggccacacugugaguggggucaaggcugagacuugaaggaggagaagaugccagccauaacaacagcaugcuaggcaaggugacucuguaacacagcuuuggggacccuccugaggccugccuguguggcccuuucuucuguuccuaguuuuuguagaagaaaguuuaaaaaucgcugauuugacuaguccagccuucuccuuuugugggugaggagauugugaaggcuagaagguaaagauaugcaaugacaaccuagguuccuaaugccugauaccaccccccacaauauggcauaaauuuuucuacuaguuauuuacagcauuuguuuuuuucaugaguuauuuuagauguauuaaaauugcaaauuauauuuauucaucaguuguaauauucagaaaaauaccuucaccuaaaagaaaaacaaaaacuuaguagacaaagauuugucuuuaaagugaaagauauuuuuaaucuuaacuaaaugaaauagggaaguaaacaguuugugaacuucuguuuugaaagcaaguguuccuauuuugaaacaacugacacauugacauuuuuacacugauuauaaauggcuuuguuacucacagacagcuuagagaugugggucggugugaggagcuuaaaguagaucuuacugagcccagcuucagaguaaauaugaguagaaucguaaaagccagaaauguaaauccuuuucuuuccuuuguaaaucuuccuuuccucacuuauugucagaaauauaugcccaauuaaaaaaauuugguugcuaaaaggugcuguuagucaugagcauucuguaaaguuuauuuugaaaauaaauagggauggguuuagaagcacagauucacauugccagaauucauacuuuucucuagccacuuucuugcuaaguauaucucucuguguguauuucuuuaccuuaaaauggaucauaaugucugugucauaggguuaguuugaauauuaacaacagugaucaguaauuauuaguuuauuuuuauuucaauuacaguuguuugaugcuugaacuagggaacaucaggaaaguuugggauucauuaacagcauaaaauuaggggaaauauuuuugggagaggaagcuguuacuaguucugguuuugaaucuggagaugugauaacuugacugacuuuuguuacauuuuauauuuuauagcuuaauaacugcaugugaaaugauuaagucuguaucuaguguucuguuuuuugaggcauauaauugaaagguauuauaauuggcuguuuaaagcaaaauacguuaauuuguuuuaugccagaguugaauccuauuuaucucuacaucuuuuaaggaaagccagugauguguaacauaguauuuuccuuuugagacuuuauaaucagcugcuguuauuaauuuuuuuaacuaacauucauauuuuuaacauaacucauacuuuuuaaaauaugaauucauaauucauaauagaauuuuuauauauuuuuaaagcuucugauuuaaaaagcaguauacccaaacuacugccuuuauguaguucucuucaguuagaucagcauuucuucuggcucaauggugggaacucauucaguggucguucuauuggaacucuuaauagcagccaccuauagcucguuuccaguuguuucuuguugguuuccucugccaauuagacauaaagcuucuaauuagaggccuugacuuuaugucuuuuacauugugaacaucuggcuguucaguuauuucuuguuaguucauuguguucuuauguuaauaaauuugucuucaguagggaauaaccaaaaaauucucuggauccugugaaauuucaguuuguguuaaaaaguggggggaacaggugaggaaugggaugggugagcugagcagagccuuuuauauucauaguccuuuauuguaaugaguuuaucacuuuacuuagagacauucuaaguauacugugucaguaauucuguuggagccauuagcucugaucuugauauugaaauuccacuauaagccaggacuagagauaacauaaccagaaaaaggucauuugcaucaguaaguacaaaugccagugcuuauuguaccugagcaaaaaggugggacaucauucaugcuuucaguauuuauugaauauucucuauaugccacagacugguuaggggaugaauagaaguggagcagguuggcacugucauugaagagaaacacaggaaauggaggacaggaguuuucccaaaauaaaaucaggaugugacugcuagacuaaggagaaaaggaugcuuggcaggcagaaaaaacauccaacgagguaauguaaucuaauuaacuaguaucuuauucugcugcuugacuguccacuuuugucauaccggaacagccagguacauaugugggacagugagugucuucccugauuuccaaaagaccaacaaaugggagucagugaauuccauauuaagccaaaugaaauaucacauaguugaaauucugcaugugaaaguugucccuuuucucccauuuauucagcaauuuauagcaauauggguuuauggauauuuauuuuauacuuugggcuacaucuaguacuucuucauuuuguugcucagauuguuucagcuuuggucauuugggagcucuuucuguugauucuuaccuuccuuucucuauccccaucaguguaggauuugggugguuuucucuauuuuuuacuuuccggcacuauaggaugcuccauucucaucucguguauuuccugccccuguccucaaaucggccauugcuccaggaagcccugguuucuuuuauuggaaaauaauauuagaacacaagaucugaguuccagguguguucuuugcuauuggcaugucauugcuuuaggcucuuagagcugacagagcaaggaaauacauguauguauacuaaccuaugaauauacacaucuauaaauauucuuauauguauguaauaauguauauguuucacuaaacaugaauucuuacugauaucacugacucuuaaccauuaccaccuggaucauuuuggccucccccgccuuguuucuguauaaauugcucuuccaacagugagacaccuggcucccaguauccaccaucuguguacuuaauuguucgauuucaguguacauguauaguggcaucagaaugguuaacccaaacucccaugggaaaaagcauuauuaacuagaauacauugcguguguaugguuucuuuugccuuuagucuuacagauucuauucauuuccagaauuacuuaggugagcacucuccccucuccccccacuucaguaagguugauucauucauuuguaauacaguuaaauuguuuugucauuuuaugcauuccauccuggagucucccagucuucuaaauaaauuuuuaaaauuugcauacauuuagauucacuuuuugugcugugaaguucuguuuugacaaaugcaucauguccuguauccaccauuacaauuugauaaagaaugguuuuaccacccuaaaauauauuugugcuucacuuauucaaccuuucccaucucccccugaucuccuagcaaccacugaucuuuuuacuaucuccauaauugucccuuuuccagaaugucauguacuuggaagcauacaguauguagccuuuucuuuuaguaauauuccauuguauagauauaccacaguuugucuguucaccuuugauggccaucuugacuaugcccagauuuuggugauuaugaauaaagcugcuuuaaggaauuguauguagauuuuuguauguaagguuucaaaucaguucagucaauaccagaagcacgaucgccagauuguaugguauaacuauguuagcuuuuaaauauauuaccuuugcauugcuguuucuuggaucagaauaaucuuuugcuauuuucccugcccacuuccucaccaaaucccuuugacuguggaucccaggucauaucaucacuacaaaaaagcagaugauaccgaauuucagcugaucauuucuugggggaaauauaauacuguagugaucuuuucuauaugcuuuugauauuuucaauuaaucuaucagggaaaauaauuaguugcaucuuguugaauuugacuauuuugugcuuucucauaauauaacaguaauggauauuuugaaguugaugcauauagccuguagguuguugaaguuacuuuauuauuuguuuuauuuuaaaguauuucuuaguuuguaaaauucugaaguauuagucauauuuuucuuuucaaccaucaccauuaagcaguccauuuuuagauauaaaauuauauuaauuaacuuuaaagucaaagauguuaugaaaaucaaauuuauguuccuguaagugaugguauguuuuguuuucuucacagcauucguucagucagagagcauaauagaaguacugcguuuugaugauggagggcuacuacagguaauuuuuuuuuaaguagacaaguuauuguuaagccuugaauaauaucugguuauuauuuuucuuuuaaaaauguaauugguuuaucugaaauauauuuauauuuuaugagcuuugaagauaggucaguagagucuuuaguaauauaaaaaccucuguaguuacgugaguuuucuuuuagauuaaauauuucuuuaaaaugcaaacucauugugguauuaaaaccuuguaaauaaguacauuaucauucuuaucuuuacguaagagguguugagaaauguaauagagagugguugcauaguauuugccuagagucagcuuuguauguuuuaaaacugaauaaaaacugaacauaaugagcucuaauuuuauaaagccuuccuacuaaaaaaugaucuuaagucucuuuuuucuaguucuuuaaucuguuucaaggugagaacuuggagaaccuaugggaacaaauguuuuaaauaucucccuuuaggugguuguuuauaggaucuggauggcagacaaaucaggacugaauuucuggaaaauucccuaaguguguuugcucuguauugauugaggaaggauuugugucuguuaggaacuggacaucuagguugcagguugauaauccauucuaaaaauucuggagcaugauuuguauuuuugcugagggaggcugcuaauuuguaucuagauggaguuggcuauggaaaagcuugugaacugggaugugauucacuaauagucuuuggaucugcucagaugcuuggacaggagcuugggugagaucucagaauucuguggcaaagguaauuuuggucuagaaaaauguugagggcaaguaguaucaauugguuacuuaagccacaaaaaaaccuaagacuccuacagaaugucuaauauugagaugcuauauaauguaguauauggccccuaaauagcugaauagaagacccuuuugaauagauguaaaauuguucauuuuaauguugaagaguguuucucagaaacaauuuuuauuuugacauaauguuaucuuuuucugacuguaauuuaccaauagguuuaacgauuuuaaauaacuccugguuucuuaugcuaugauuagaacagaaaaauguacauguagcauuucuauggcagaauauauauccuuucucuaauuuaaauuuaagcuaaagcagggagagugucaaagcaacaaccuuguuuuacauuauuuaaaaugugaauuuugcccaagaacauuccuucuuagaucugcaauucauguacauucauguggcuuggccauaguaauuuuuuuuuuuuuuuuugagacagggucucgcacugucacccaggccuggagugcaguggcgcgaucucggcucaccacaagcucugccucccggguucacaccauucuccugccuaggccucccaaguagcugggacuacuggcgccugccaccaugcccagcuaauuuuuuuuguauuuuuaguacagacgggguuucaccauguuagccaggauggucucaaucuccugaccucaugauccgcccgccucggccucccaaagugcuaggauuacaggugugagccaccgcgcccggccaacucauaguaauuuuuuuaauccucaaaaaucaacugauaagaaaucaguaaaaaaauaaauuuuaaaaauugccaaaaagauuagacuuguuuucuuuauuuuuagauaaggaaaauuagguuuauggaaguuaaauaauuuauucuguaguacucaauugcuagagcaggaauucaguguccaguaaguaccauacucaccaugucuaauuucaaaacucuccacggcacgaugcaugugcagugcucucagauauuccauggguuugcacuuguuaugaauauaaauuauaacccccauagauuauguuuucuauaguugaugcuuuggccauugucauuccuguuuggcuggacuaagauuuagcauccagaauacguaaagaucagaccguuccuaagaugacacggacucugaggaaucugcaucucaacagaagaaauccacauuaaggccauaaccacaggaugcccuggucagguaucucaaaccaucauucccauccuaacugaucagaaugguuggcucuucuaaccuguuccuuugaaagauuauaaaauggaauaacaaaagauucuuucauuuacaagcauaauuuaauaaaccugaaucugcuuccuaaucuaacuuucuuuuuaaaaaaaauagaggcagggguggacacagugguucacgccuguaaucccaacaccuugggaggcugagacgggucagucgcuugaguccaggaguucaagaccagccugggaaauguagggaaaccuugucucuacaaaaaauuagccagguguguuggcacacaccuguggucccagcuacucuggugucugaggcaggaggaucgcuugagccugggaggucgagacuucagugagcugugauugugccacuguacuccagccugggcagcagagugagauccuguaucaacaacuacaaaaaaguguucccugaguucaagucccuuaaauuuauuuugcaccucauuuuaaagggggguugagaguccugagcuaaaguggugagcaaagcccccauuauugcccagccauuccuccucuaagagguucacgcccuuggccaaaguccucaaaaccuggagcaucucagccccagcuccgcauuggaaucaccuugagagcuuuaaaaauuucuggugacagguacuuuccuaagggcauuacaggaacgaacucaccugggccucaccagcaacugauggcaugguacccaagggucccauuguacagguggugggaugugguggggacaggggccagguguaccacaggcagggagaugguggcugagcugggguaaaaaaugcaugccuguccccacagggccaguggacccccauguccugaccuuggagguccagagagcacaucagaacuuggccagcauacggagcuccacagcugacugaccacacaguucauagagacagggucucacucuauugcccaggcugguuugcaguggcgcaaugacagcucacugcaaccuugaccucccgggcccaagugaaccucucgccucagacuccagaguagcugggacuacaggcacaugccaccauacccauccaauuuuuuguauuuuuuauagagacagaggucuauguugcccaggcuggccuugaauuccuagccucaagccaucuucucgccuuggucucccaaagugcugggauuacagaugugagucaccaugcucggccucuaaucuaacuuuuuuuuuuuugagauggggucucgcucugucacccaggcuggagcgcgguggcgcagucucggcucacugcaagcucugccuccuggguucacgccauucuccugccucagccucuugaguagcugggacuacaggcacccgcuaccaagcccgacuaauuuuuuguauuuuuaguagagacgggguuucaccguguuagccaggauggucucaaucuccugaccucgugauccacccgccucagccuccccaagugcggggauuaggccacugcgcccggccuaaucuaacuuuuuuauaugaagauaaaggucaggaaaaaagcuagcucuguauuuuuuucacuauccugccagaauaauaaauagaauuuuaaaauuuuggaaagcaagcucuagaauguuugugaguugaaaacacaaacagaauuuugucuuuuuuuuuuuuuuuuuuuuuuuuuaaaaaaaaagacagugucuugcucuguuacccaugcuggaggccaguggcacaaucauggcucacuguugucucaaccucccaggcucaagugacccuccucccucagccucucaaguagcggggacuacaggcacaugccaccacaucuggcuaauuauucauuuuuuauagagguagguucucacuauguugcccaggcuggucucaaacuccugggcucaagcaguccucccaucucagccucccaaaaugcuaggauuauagaccugagccacuaugccuggcagaauuuugucuuuuaaaacuuaaaguccuguuuuauuuuauuuuuauuuauuuacuuuuuuugagauggagucucgcucugucacccaggcuggagugcagugagcaaucucagcucauugcagccucugccuccuggguuccagcaguucucuugccucagccaccaggauuacaggcgugugccacaacacccagcuaacuuuuguaguuuuaguagagacagaguuucaccauguuggccagguuggucucgaacuccugaccccaagugauccaccugcuuuggccucccaaaaugcugggauuacaggugugagccacugugccuggcaaaagccauguuuuauaaauggaauucuaaccacuuaauuagagaaccuauauugagccuucuugcaaagaguauacgauuuugauucauuuauuuuuuuucuuuaaaguguuuauugugagauauaauuuacauauagaugcuuaaauuuggggagggaaugcaaggcaaauaccuguguaaccaccacccagauuaaaaacuaaaaacaggccauuacccuccaaaguuuccccucaagcucucuccuaguuacuacccauaaaguuagccauuuuccagaauuuuauaauaauugccuuucccuguaauuuuaacaucugaguguauaucucuaaauacuacagggucacauauuuuuugaaguucauacaguuuguauuuuuuuuuucuggcuccuuuuucucagcauuauguuucuaagauucacagcauuauguguugaguguaacuguaguuacuucaguuucauugcugaauaguguugcauuguauggauaugccccaauuuauguauuauuucugcuguuuauguguauuuugguugcuucuuguuuuuugcuguuaagaauaaugcugucucuuggugaacauaauauauguguucaaaugauuuuuuucugagggauuagaaugcaguuguugggucauagaguagggauccccaacccccaugccauggaccaguaccggucuguggccuguuaggaacagggcugcacagcagguggugggugaagaagugaacauuaccuccugagcucagccuccugucagaucagugguggcauuagauucucauaggagugcaaacccuauugugaacugcacaugagagaucuagguugugcgcgugccuuaggagaaucuaacuagugccugaugauuucagguggaacaguauuauucugaaaccaucccgcuaaccccccauccauggaaaaauugucuuccaugaaaccagucccuggugccagaaauguuggggaccacugucauagaguauguguaucuuccauuuuaauagauaaugcauauaguuuuccaaagugguuguuuuaguuugcaaaccugucaucaggaauuccucugcaacaacuuuguaaaguguuuucuuccuucccuccuucuguucuggagaauggcuaaugaucuguaauuuccauuuuauuuucguuucccugauuucucauaaagcugagcaacuuuucauguuuacuugaccauuuggauaucuuccuuugugacauccguuaagucuuuuacccauuuugcuguugguuugcaugucuuuuuucccauuguuuuguagagguucuuuauaaguucugaauacaagaucuuuccuggagccguaaccucacagcaguaacaaaaaucaguuccauuacaugaguucuuuauugguuacauauauugaaaauagcuucucucacuggauggauugcccuuuuggcuuauguaauggugacuuuuagugaacaggaauucuuaauuuuaaugaaguucagucugucaguauuuuccauuaugguuaauacuuuuuuauuuugugucuuguucaauguuuuucuaucccaaggucgugaagauauucucccguauucuagaauuuuacuguuuugccuuucacaguuagcucaaauucugucuggaauaaauuuuuguuauugaugugagaucaagauuuuauuucuuguauuugauugucucagcauccuuuauugacuauuucccaauguuuucuuucccuaguauuugucagugacaccuuauucauaaaucaaguguccauauaugugugagccuguuucugggcacuguauuggauuucuuuggcuuauuugucuauccuaauaccagggucaccguuuuaaugacuauaguuuuuaaaguuuugauauuugguagaacaaauccugacacuuuguuauucuucucaguaaugucuugguuauucucaguucuuugccuuccauauguaucuuuucaauuagcuuuacacacacacacacacacacacacacacacacacacucgggauuuuuuauuagcgucacucagaaucugaagaucaauuuggcaagaauuaaaaaucuuucagaauuuucaguauucagucugacagucugagacaguauauuuuucaacuuauuuaggucuucuuuaucucauaauuuuauauucugcauaaagaucuugaacaucuuucgauagauuuauuucuggggcuuugguauuuuuuaauacuacuguaagugacauuuuuucaaaauguucgcuuuuugucauuauuagguugaagcauauugcugaugcccggccuuuauugaucuauaaaaguggcaauuucauacgacucaacauaaaauguagaaaugugguugcuuuuaauauauuugcuguguauccugaaaacuugcuaaauuacuuauugauucuaauaacuuagcuguagaugcuuuugaacaaccuccauaaacuaucaucugagcuugaugacauuucuucaguuuggcacucaaaaucaacugucacacauucuaccuuuucuuuuucuuaccuuaacuuuacuagcuacagccaguaugauguuaauacagugcuauuuaguaguccucuuugacacuuuccucaucucagaaauacaacauucaauauuucacgguuagauacgauuuuuucuucacugcccccuuugccacccccacccaagauagccuuuaucacaugucaguuugaguucucaacaagauccugagacagaauuaggagugcaagagauugagggcuacugccugugaaaaauaagcuaaagaaagcaggauugggcaaggagagucucagacugugaugcagaaucucggccaacccaguggggagcucuggagcaaagauugcccauuggaagcauccugcacuggguagaguuggccaggcccuaguauaccugcugugcucauucauugucugggaggagcccaagaagaacguggccuuaccucaaaugccacaguugaucccagaguacauagguggaggcugguagccaacaguguuuuucacaacugaaugccaaguucuuccuuguagggagaucugagcuguucauagaaaaaauauuggaaaucaaagccaggcugggcgcaguaguucaugccuguaaucccaguacuuugggaggcugaggcagguggaucacuugaggucaggaguucgagacaagccugaccgauauggugaaacccugucucuacuaaaaauaccaaaguagccaggcaugguggcacaugccuguaaucccagcuacucaggaggcuaaggcaggaguaucgcuugaacccgggagacggagguugcagugagcugagaucgugccauugcacuccggccugggcaacaaaggugaaacuccaucucaaaaaaagaaaagucaaagccaaagagauacauucuaaaagcaacuagagaaaaagagagaccuucaaagaagguagaauuagccugacagcugacuuauagacugaaacaaugagaggcaaaaauaauauauaauaaaauuuacugaaaaaauuugccaaacuagaauucuauacccaaugaaaauauccuuuacaaaugaaagugaaaucgacauuuuaaaauagauaagaauggagagaauuugucaccagaaaauuugugccaaaggaaauaauacagucuuuaggcugaagguaaaugauuuuagaagcucagaaacgcaaaggaauaaagaacauuaaaaauguuuaaguguguggauaacuaaaugaauguauacuuuguagaacaauaauaauaauguuuugacuaaugcauuguggcagaacauuuugguaccacuaaggcuaaaucuuaugaagcuugacaacuucuaccugggucugucaguuuuggaacguuucuuuugggaagugaaucaccgugaugugagaaacuuaagccacauggaaaggccacauguagucuucuggucagcagucccagcugagcucccagcugacagccagcaucacuuucccaucacgugaaugagccaucuuagacaaccaacacauuugaacuuucagacaaaugcugccugaaaucacauguaacugcaauacaaaagagacuuuaagugagaauaaauuguuuuaagccgcuaaaccuuagacugcuuuauuaugcagcaguagauaaccagaaugcuugauauaucauaucagacuugguuggucuguguucaguuuucuuccacugcuucagaaaugccuuuuugcauuugguuuguccaaaacaggaucgagacaaggucuacacauugcauuugguugcuaugucuccuaagucuccuuuaugcuauuucccccacccgccuuuuuguuguuguuuuuguuguuguuguuguuaaugaaauuggcucauuugucugugggauuuccuacauucucaguuugguuauuuucauccucuuggugucauuuaacauucacuuauggugugaauuuucuguaaacuguuagcuaaaucuagagucuugauuagguuuaaauucauuuguuuuucuuggcaagaagauuuuauagcuaguugugcaguaaucuggucuuugucucugguccugaagaugcucuaaaucuuggaauuuucuuaauaauaagagugucuuuguuauucaugagucccuuggaucacaucugaguuuauaccuaaugagaauacucaagauggggguuggucaucagaaaaaccaaccauguuggccgggcgcaguggaucacaccuguaaucccaacacuuugggaggcugaggccgguggaucgccuguggucaggaguucgagaccagcgugaccaacauggugaaaacccgucucuacuaaaaauacaaaaauuagccaggcaugguggcaugcgccuguagucccagcuacucgggaggcugacacagaauugcuugaacccgggaggcggagguuguagugagccgagaucgugccacugcacuccagccucagugacagagcaagauucugucucaagaaaaaaaaaaaaaagagagaaaaaaaccaaucaugugauuagaggguugggcuuugagccaacccacccuccucuagggaagccgaaaugugaguugggucacaugguggucagugauugaaucagccauaccuuaccuaccugaugaaacuggauacugaagcuugcuagaaccugcugggagguaauugaaucauggcggcgguuacucccaugcuguucuugugauugugaguucucaugagaucuggugguuuuauaaggggcuuuucccccuuugcucagcacuucuugcugcugccaugugaagaagaauauguuugcuuccccuuccgccaugauuguuaguuuucugaggcgucccaagcccugcagaacugugagucaguuaaaccucuuuucuuuaugaauuaauuacccagucuuggguaugucuuuauuagcagugugagaacagacuaaugcagaugguuagcaucagaauuguacugcaguucacuagugggacuguacauugucuguauuuuucuugaggacaugcuaugccagauugccuuagauuuuuaggucacagauuuucuuauguagggacuuaaugauucuggaaauaagauauuguggcauuauuucuguugaucuaagccagauguuggcaaacuuuuucgguaaaggaccagauauuaacuacuucaggguuugugucccgaauggucucuaucacaacuauucaacuuuggucaucguagugugaaagcugccguaacaguaugugagaaaugggcauaaaacuuuauuugcaaaagcuggcagaagacuggauuuggcucaugggcuaauagauuaccaacuucuuuucuaaauugucuuggaaaugggcuuuaauguucucccaggagaaaaggaaauggagaaggagcugugauuuugacuuguaaggaggccuagaaguacucaucuuuuguuuuaaauuaaaggacuucuauuauaaaagaaauauaagcuuguagaaaauuugaaaaaugugaaaaaauaauaaauauaagucauauuuauuggguguugacaagucagguacucuucuaaauucuuaaauacaugagaugguauucauuuuaugaucauuuuacaggugagcauauuaaagugcagggaguuuaaccuaaccaaauaaaugauuauuaagugauaaagcuagaauugaaaaccaagcauuugacucugaggccuaaguuuuuaaccgcucugcaauaacaggggucauuacccuuguaucccacugccuaaauguacuacaagguagugcuuuuuguuuuuucaguuauuuuucucucugcaaacaaagcuagauuuucucacucuacauuaucaguuuuacaauauuacaacuaauuuuguacucaaaacagccacuucaugucaugucaaguugauuaccuguggcugaagagagaagugggugggacacuagaaagccgucaucagaggccaacagcucugcagcuccuuguaguuggcagaaugcugcuuuuacagacuuuccccaaggguauuuggcuagugagggcagagcugguguuugcacacagguuuuuauuuucuacuuuaaauuuugagucuucucagaaauaccugcuccccacuucauccucauuuugauucucccuuuacuacuauuuccugcccucuauuguaguacaauaagugguacaaaagaagaauaaauagcggguucagaaacagccuuaaggcugggugccguggcccacgccuauaaucccaguacuuugggaggcugaggcggguggaucauuugaggucaggaguuugagaccagccugaccaacauggugaaacuccaucucuacuaaaaauuaaaaaaaauuagcugggcgugcuggcacaugccuguagucccagcuacuugggaggcugaggcaggagaauugcuugaucucgugaggcagagguugcagugaguugagaucacuccacugcauuccagccugggcaacaggcaaaauuuuauuuuauuaaaauaaaauaagaaacagccuuaaaaacuaggaauaaagaauaccacagaauacuaaaaugguaugcaaagucugaauauagaaagaucucacaccuuaaacaaaaacuaacucaaaauggaucauggacuuaauguaaaacuauaauaaaaccuuuagggagaauaaaacuaagaggaaagcuucagcuuacagggcuaggcaaagaguucuugacaccaaagaauuaauaccagaugugcaauguauaaaggaaagaucgaugaauuuaaaacuugcucugggccagacgcaguaccucaugccuguaauucuagcacuuugggaggccaagggaagaggagccauugagcccaggaguuuaauuaagaccagcuuaggcaacauagugagaccuugucucuaguaaaauaaaaaguaaguaaauaaaauaaauaaaaaauuguccaggugugguggugugcaccuguagucccagcuacucaggagucagaagcagagaaucuuuugagccugggacaucaagccugcagugagccaugaucacacugcugcacuccagccugggcaacagagccagacuggucucacaaaaacaaacaaacaaaaccuuucucugcaaaagaccaugugaagauguaaagauaaauauagacuaggagaaaauauuugcaagucacacaccugacaauggaccuaguuucuggaauauagaaagaacucucgaaacucaauaguauaaaaauaaaggaaacagggaaaagagaugagcacacauuucccugaaggggaaauacagaugguaaaaacgacaugaaaaccuguucaacauuguuagccaccaggcaaugcaaauuaaaacccaaaacacaaaacagugacaacaccaaauacuggcaaggauguggagaaacuggaucacgcaugcauuacuagaggguaugugagugauacagcuacucuggaaaaaacaguuuggcaguuucguauaaaucuaaacaugugguuacuauaauugaccuacuaauugcucucuuggggauucucccaaagaaaugaaaauuuauauuugcauuaaaacauguauauaaauguucauagcagcucuguuuauaauagccccaaacuggaaacaacccagauguauuucaguagauguacuguuaaacagugauacguucauaccauggaauacaacucagcaauaaaaaggaauaaaguguuggcacacacaacaaccuggguaagucuccagagaauuaggcugagugaaaaaagccaacuccaaaagguuacaugugcaugauuucauuuauaugaccuuuuuaaaaugaaaaaauuuuagucaugaauaauagaggaaugguugccagggcuuggggggaagggcaggaggaagaugagugugauuauaaaagcgacacacuggauucucagggugcugacacuguucugugucuugacugguguucaugaaccuacacagcagagaaaauuguguagaacuaaauacaugaacaaacacaaaugaggacauacaaaacugagaccuucugaacaaggcagguggaucguaccagugucgcugugcugcuugugauguuaugccauaguguuugcagaaugauacaguggggaaacugaguuaaaauauagcucuuuuuacuauuucuugcaacugcaugugaaucuacaguuaucucagugaaaauucauguuaaaaauacauacacacagagaagcacaggaagcaaaacaauuagaaagucaggaaagaccccuuuugugaguuaaaaauucuuaaaacucccucacagaugucauccauuuucacuaugagaugauuugcagagaacuuugugggggagauuggguugauaagaaguaggauuacauguugagaucuucauaaucaaaagcagaccucauccucuaccuucccccaacccaguccuggaggaaguauguaauuuugucucuaaaggugacagagaagcauagucucaucgccugcaaggaaacuggcucccagguauaucccuggggaaagcugcccaguauguaaguaauacucaaauggcgccugguguggcuuccugguaccacggguuugugugcaugugcugccuguaccaucaagaagcuuaaauucuagggugugcagaccuugucuuauuucuaagcauccaugccgugugcacaacugccacguaccucauucugaagugaauuucauuuuauuuuucuaacaagauuaaaucuucuguuuaacaauaaugcaguauaaaaguauggccaucuuaaaauuuguuagcaauaauauagccaacuucagcucauguaagcuaaaaguugguuuuaggcauaugcaguucugucaaggauagguuauuguaugaaugcaguacuagaccagaucgaaggauuugaauucuaacucuuaccauuugcuaauuuagaacauuuagaggcuuaguuucuuuaucuguaaaaugaauucuguauuuaucuccaguguguuaagaacugcaaggaccacuggaaauacaaacacaguuaagacaguaacgcacuuugaauuaaaaggcaaggagauguuauuacaaaugaacaucuaaauuauugauaucucuauaaaauugagguuguaguacgauguucagucuuggccuguguacguuuuggaccagauaauugguuguaggguagaagaaagagcguccugugcauuaccggguguuuagcagcaggccggacucuacacacuuaauguuaguggcccccugauuugcgacaaacaaaaaugccucuuaguuuuuuaacucuuuuagaauuuguccagcauguuuuuugguguuaauaaaaacccgcacacagagaaaugcuucuggacguugccaaauucccccagggaaacaaaauugcccucgguugagaaccacugaguuacagggauaaaauuaucagauguguucguuuuauaaaagaauuuaauaauauuuuaaagcauaucacauauauuuuugccgaggcuggucuauuugauuggaagaagaguccauuuuccucccgcauauccccuuuuggaguugggagugcauucugagagaagcugugcucagauuauuuggaaucugcacccuagugaggagcgagguugaagcugaaguccuuaaguaugacagaagcaugggugggaagguaccgaaagaccaaagaauuuggggauggggagguaggaaaggugucuccaaacucacaugcauauacauauuuuccuuaacaccugaggugaaagaacaccccuguuauaucuugucuguucuaaagagauguggugaagagaauuugcagugaguuaagaaucacuaaaguuucugugauucagugaaauugccuuugaaacauuguaggagugucuuauauuugauagaagauuaaaaaaaugcauggcaugggcauuuucuagggcucugaguacucuuaauagacccuuaucucuggaugugaauucaugagguucaaaggucccugccagucaaauggcaaacuauggaauuucccuguccucuagagauugcuuuacugucuacugagguugaucaucuuuuucauaugguuauuggccauuuauuuuucuuuagugaauugucuucuugcccuuugcuuacauuucagucacaacauugguuuucccauuuccuuuuuuccuuuucacugucgaauuauaacaguuuuuauguaucuuuacauuguaaaguuauuaauguuguaauccuuauuugccuguuuuuauccuuauucaguguuuauuuuugcccauucucugaccuuugacauuucugcauuuuguauuaaauuguuauaguuagguuccaguuguuugaugcaauccuuuugucuuuauauaaacaguugaguuuaucuuauuuagucucacuguagauguguuuaaucuuuuccaucugcuuuuuaugcauucauauuggcuuuuguuuuguuuuuaaucucuugauaauggggcucaauuuucagauauacuuuuaagauauguuuaugccuuuauuucucaaauugcuucagaaacaaaauagugucuauugugaucuuccuuauucucauaacacuuaaggauguguuggcauguucugagauuuuuauucuuguuuauuacaguuaaaugauuauuuuucuguuuuguggcauauacuucaaaaacaauauuuauuuucugauuuucuaacuuuauuuccacagauccuuugcauugaguaucugcuuaucuuucacaagacagcuuccucauuugugagucuucguaugaguaauuucaguggucagauucugucuucaugauaauuuuuuucuccucaagaaagugcacaugagugauacacguccugaguuccuuuucuguagacuucaugugagaccauagcuucucaugcucuagaauucugucauaaccauuauugauguauaaaugacauacaauaaacugcauguguuuaaauuauguaauuuaaaaaguuggcauaauuauguaccugugaaauuauuacuacaaucaagauaauggacauacgugucacccuuaaaagucuacuugugccccuugguaaucccuuuacgcuccuuaucuuuaggcaaccaccagucugcuuucugucacugucaggaaguuuacauuuuaaaacacuuuauauaaauggagucauacagaauguacuuuuuugagggucuggguuguuccacucagcauaauuauuuugagauuaaucuguguuguuuuguauaucaauagcuuauucuuuuuauugcugagucguauuccauuguacggauauaacacaacucaugugucuguucaccuggauacguggaaguuugggcugguggaaauuugggcuguuccaauacugagcuguaacaaagcugcuacgaacauuuauguacaagccauucauuguacggacaaaugcuuuuguuucucuugggcauauaucuaggaguggagugauuuggucauaugguagguguauguuuaacuuuguaagaaauuggcuucaaacuauacuacaaggcuauaguaaccaaaacaacaugguacugguaccaaaacagguauguagaccaauggaacagaacaaaggccucagaaauaaugacauuuaugcagccaacaaacauaagaaaaaaaaacucaucaucacuggucauuagagaaaugcaaaucaaaaccacaaugagauaccaucucacaccgguuagaauggcaaucauuaaaaagucaggaaacgacagaugcuggggaggauguggagaaauaggaacgcuuuuacauuguuguggcaugugucagaauuuucuuccucuuuaagacuggaucguauucccuuguauguauaaaucacauuuuguuuaucuguucaccugucaaugggcauuuggguugcuucuaccccuuaaugguugugaauaauacugcugugaauguggguucaugcaguaucuuuuugagccccuguuuucaguucuuuaggguauauacacagaagugggauugcgggucguaugguaauucuauguuuaauuuuuuugggaaccacaauacuguuuuccauaguggcuacaccauuuuaauauucacacuaacagugcacaaagguuccaguuucaccacauccuugccaaagauccuuauuuucuuuuuaaaauuuuaaauaguagucauccaaacagguaugaagugguaucauugugguuuugauuugcauuucccuaaugguuagugauguugagcaucuuuuaaagugccuacuggccauuuguguauuuucuuuggagaaauguuugaguccuuugcccaccuuuuaguuugguuguucuucuguuauugaguugcaggaguucuugauauauucuagauauuaaucucaucagauauuugauuuauaaauauuuucucccacugcauggggaauagauguaauuuucauaauaaaaaguuaaagaaauuuuucuuuacagaaaauagaagagcucaaccaauaccaacucauuuaccacccagacucaacgguuauuaccauuuugcuguguuugcuuuauccauacaccuccccacacacacaaauuauuuugccaagacaucucaaagaaaauuaaggacacccuuacacuuuaccuaguacgcaucuugaaaaaauuaggacaguuuucuacaucugccacauuuucugcauaaacagucuccaaaauacuauuucaaaauaauauauauuauugggaaaaaauaaugcuguuuuuucucauuuugauguagcagauaaccuuuugggauaaguucacugaugguauuccuuauagcauuggcauuuucucguacaucaauaagaacuuccauuucuucaucaccugaacuacagcuguugccuccaacuuccuacuuuuucucaucuuccuuaucuuuaaaaccuaaaguagaccaaacuucuucccaugacuuccuuacaaggcagagcauuaucuggccucugcuuagcccuccagucucauuuucuccuucucucccagcuccagcagagagaccugccaucuguuucuugaacauaccaaccucugcucucuaugagggccuucacaugugcuguuuucucuaccaccauccaucccacugccacacugcuuuuuuuaauccuucagguuuuuauguaaauauugucucuucagacaggccuuccuucaugauguguuuaaguauggcaacuauuuauuccuguucacagcaccuuuucaauauuuugauaauccuauuucaguauauaaauauguauuuuuaaaugacuaucucccucacacacaccacccacuguaccuugaguuccaugacagugggaaucauuaccaccagcaccuggcaagcaguuagugagcagggaacaguccgaggcacagcagccucacaaagugauugucaaaggggcuguucucaggaugugucgguuuggcacacuuuuaaaaauccaucgcauuacuuucuguuacuucauguguguuuacaauuugaucuagucauuguaugugauuuggagaccagguuuaaccuuaaaauccaaauggguauaaaaugaauguugaaacuaaaauagaauauuuuggauauuccauaugucuguaauauaaauauuuggcuucaguuuuuuaaucauuauuuuauuccuuuuacagaccgagacaacacuuggacucaguucauaucagcagaaaagguaaguauauuuaauaagauaauuaacauacuuucgguuccuucugggggauuccugugguucucccuccucuuuccccuugcucauuuuggugaagaaggaauagcaaauuguaaaucacauuauaugauuauuucuaaguguugugugugggaaaccagguuuaaguuugaaugugcacaucaugcaauuguguagcaugccuccccugucguguacgaagggcuguuacucagcugaaacuccccuugcuuugugagaugaucagcuguguaacuccuuagaggcuucucuuguggcuaucccugcuuuugauguacugaccacugcugcccccaguuaccaggggucugcccgcaggcccccagagaaggaucucagaccugcgaaacccagucuugugacuuggagagaccgcuuuuaaauacagcuucccugugauaacagggggaugguuuuaccucagguguuaaggaaaauagguacaugcaugugaauuuggagacacuuuuccugccuccucacaaccaaauuauuuggucuuuugauaccuucucacaucuguaaagagacauacugugcugauucucuuucuauaugcggugaaagucuguucuggugccuaaaggugagagagagcuuucuuugaguuggauaaaacagucccuccagcagcuauuuuguguucacucccagcccuuaaugauugcuccccggaggaccauagauguaaaggaaguuagcuuagaagauucagcguaaugguauaguugcucuuccuguuugccagaaacaacuagucaggcaccaguaccuguucuagugagcgcccuuuaguaacaauugaacggcuggcaguggugucaauagggcuuucagguaaggagcccacaucauggauuuaagaacccaguuauuuuacaguguguguuuuuagaaguauguuuuauucugucaguauauuuauuccuuaaaugacagcaaggcaaauuuauccuuaaaaauuauuacuauccacugaaaucagacacuuagcuaccaaaguggcuauggcaacagaagguguccccacccuugcugucaucacugcaguuuccauucugauguagcaggaacagggaagcauuuguuccuccuaggccuucauguuuaaaguacaucuaugaaugucuccagacuagcgaaaugcagacugcaucaacaaagaauuuugcuuugagagagaaauauaaaauauucagacuauuaggaggacaauuaaaacuucuuaccucauaaauaaugaaaauucuuuaguauucacuauuuuuucucuuuuuacucuuucaucucugcaguaacauggcccuuuucccccauuguucugucauucucucuaauauuauaugcccuguugggaccugcccugucugugaaucuugcccaaauauuuaacacuggcauggguugucuccaaaccacugcauguuuagccugauuccuccuuggcuggaccaucuaagaacccuagaacucucuaaccacaucuagagccaaaauaauggugagaaaaacauauauguuaucuugugauucuuccuugauucuuuauuccagcaauuaggaaauuagcuguggaauuagacugcacuacauuuacgaagaugaggauguucauucgugaucaaaauuugggcuuuaaguauuuuccuaguauaaugaagaauugacaucaguacauaauuauauucucaucucaugcucuacuuaucuauuaucuacuucuaucuaaaaguuaguggcauaaaauaaccauuuuaugaugcucucaaacucugucagaaauucaggcaggggacagcaaagacagcuugucucuucuccaugaucuggggacucagcuggggagauuucagaguuggaaaugacuugauggcugggagcuggaggcauguucauuacauguugaugcuaguuucuagcugggaccucagcugagcucucaacuagaaugccuauauguaggccucuuuguguggccuucacaugggcuaguuugggcuuccuccuaguaugauggcuggacuccaagagugaaugucccagaggaaacuagugaaagcuguaucaccuuaaucugcccuuggaagucauaauauuacuucugcugccauaugcuauuagucagcaagucacuuagauuggccuagauucaagauaaggguggggagaaagagcuccguaccuacugaugacaggaauauuagguuuguagacagaauuuacaacugucacauuuuacauuuugugugugugugaccaggaucaugaguuggguaaauauuuaauucaaauuaguaugcagauuggguaugggacuggguuaagcccuaaaacaugucuuagugaguccaggaugcuauaacaaaauaccauagacugaguggcuuaaacaacagacauuuauuucucacaguucuagaggcucagaagucuaggaucaagggcuugcagacuugggccuggcagacuguuuugaugcugaugaaagacugauaaccauauggaccacuaacauauaccuuaggugucuugauaccccuuacaacuaaacccugagaggcuuacagcauccguuuauaagacccucuucaaaagcacagcuuucuuuuagaguagauugcauuuugucauuucaucaacacauaugcuuuauaaccucaucagaaguggugucuccaauauccuccagagguauuuggguguguuuaacggccagaggauauuggcagaucucauuuucuacaggcuuugugcuacagaggcuuaucuugaggagggccgguggcauccaggugaugccuguuccucuacagagaauuuaauacaucaauuuuauguguucagcaauuuaaaggaagacaugaacauaaugagggaaaauggacaguaugaaaaagaaacaaaugaagccucuagaguugaaaaauguuguuucugaaaugaguauuucacuggauaggauuaagaacaaccuagacauugcaaaagaaaagcuuagugaguuugaagacagugacagcaguaauuuaaacugaagcacagggagaaaaaugacuaaaaaacaaauaaacccuuggugaccucugguacaguaguagcaagcagucuaacacaugucuaagugaguuccuaggaauugggagagggaggagcugucaaagaacuuuaauaaaccugaagcaagaguaacacagaaagucacaccaagccagauaauauucaaguugucgaaaaucagucauaaauagagaaacagccagggaagaaaacuaaauauaguaguucaaaagauaggaaugacugcugguuguucaucaaggacaaaugccaccccaaaaccaaugaaaugacauuuuuaaaguaccaaaagaaaaaaucgcuaaucuaaaacacugcuuccagcaggaauauccuucaaaaaaaaugaagacauuuucagacaaaacugagaaaauuugcaguagacuggcacuuuuaagaaauguuacaggcuaaagguaguuaaccauuugaggugaaaacacggauccuacgaagaacaaagaccaccaaaaaggcaaaaauauguggaaaaauauaaaaaauguuuucugguuaacaaaauguuaauuucuaacauuuuaaaaacaaaaaugauuguuuauaacauguauacauugcauaugugauaacagcacaaaggacaggaggguugcauggaagaauugaguuguaagguucuuagauguuauguaaaguaguacaauauuauuugaaguuaaacugugguaauaugaaauaagccccacacgaaacauuaaaaucaaaaaaaaaaaaagaacuauagccaauaaacuagucacgaagauagaaugaaauacuaaaugaauacucaguugaucuaaaagaaggcauaaacagaacaagaggaauaaaaagcagaugggaaaaauagaaaacaaauggcaauauggcagacuuaaacccaaacauaucagaaaccguaguaaaugaauaauuucaacaccaauugucagauuauauuuaaaaagcaagacccaagcauauuuugucuacaagaacuuuauuuuaauuuuguauuuaauauuuuaccuuuuguuuugaaauaauuuuagagaaaagauggaaaaauaguacaaauaauucuuauaucuucuugacccaaauuccucauuuguuaauguuuuuucauauuugcuuuaucacuccuaaucucucuuuuuuaacucucuccuuuuccuucccuccccauagcuaccuuuuuauacauacauguacauguauuuauaauuuuucugaagcauuugaaaaucauuuguagacaugaugcuauuuuaccccuaaauauuucaguguauauuucuuauaaacaugaacauuguuuuagagaucaucauauacucaucaaauucaggaaauuaagacugucucauacugcuguuuaaucuagaggccucauuggaauuuuguaaauugucccauuaacgucuuuuauuuuaaaaaauuugggguccaggguucagacccucauauuuaauuuucacuucucuuuagucucuaauguagaacuauugauuugucuuucuuacucucuuagaacuuugacauuuuugaagaguagaugcuguuuauuuuauagaauaacccagaugggccugggcacgguggcucacagccuguaauccuagcacuuugagaagcugaggcgguggauugccugaguuuaggaguucgagaccagcuugggcaacacggugaaaccccaucucuacuaaaauacaaaaugcgccuguaaucccagcuacucaggaggcugugacaggagaauugcuugaacccgggaggcggaaguugcauugagccgagauugcgccauugcacuccagccugggcaagacucccucucaaaauaaauaaauaaauaaauaaacaaacaaacccagcuagaguuuucugauauuuacucauuauuugauucagaauuugcauuuuugguggaauauuacugaaguuugugucucucccaaugcauccuaucaggaagcacuuggcgucucuuuguuccauuuuucucuuauaauucauaagugucuugcagagaaguacuuugagacuaugcaaguacuguguuuuacaugaaacucugacuaguuuuagaaucuacugaugauucuugccuggaacaguuauugcgcuggcuggguuuucuaaaaauucuaucacacuuaaucuauguuucuuaguugacauucugauugaaguuaagauugaggucacaguucauuuuuauccagguauuucaccaucauuugcgcugucauaaaaaaaucgcacgugcuuaguuaggucuauucugugucauuuacguguccccagcaaucauugagcacuucuuacuuucugguauguuaggauguuccaggcuuguuuuguaauuuccuugccacagcccuggaacaaccuauuucuugaaagacuccugcuucauuuuaguggaagauaauauugaaaaauuaaucuuuaugugccauguguacucauugcuacuguaauguauuaggauucucuuagagggacagaacuguuaggauaaauauauaaaggggaauuuauuaaguauuaauuuacacgaucacaaggucccacaauaggccgucugcaagcugaggagcaaggagagccagucugagucccaaacugaagaacuugggaguccagcguucaagggcgagaaccauccagcacaggagaaagauguaggcuuggaggcuaggcccaucucucuuuucauguuuuccugccugcuuuauauuugcuggaagcugauuagauugugcccaccagauuaaggguggaucugccuuccccagcccacugacucagauguuaaucucuuuuuggcaacacccacacagacacacccaggauuaauacuuuguaucauauccuucaaucuaaucaaguuaacacucaguauuaaccaucacaaguggugucauuauuagugaggugucauuaucucuagacucuuaguaaaaggaagaaaauguuuauguuuauguguauaaauauguacaguauacacaaacauauuccuauucuuguaucuguguauauuaaaaaccgugaguuacugaugccuccaauuuugauacaaaaccaguguucugucuauucuguuucuguccauucuccaacaaugagaaaucuggcuccaguuaucugucuacaguaaguguauugauuuguucaauccuagaauacagauaaauuaguuucaaaauuguuaacuguuacagccauaaaaaaagaguacgguguuuagaguucauguuuuuucuuuagucugaguguauauugucaaaauacuguauucuaaauuuacauggguuauaauguucuucaucuuucucuucauccuucucccacccccacacccaucuguguuguacauuuuaaaugaaguuuaguuuauuuguuucucucuguaucccauuuaggauuuuuacucuacuuuaaaauuuuuuuuuauuauugcauaauacauauugaugggguacaugugauaguuugauacaugcauagacuguguaaugaucaaaucaggguguuuaggauaugcaucaccuugaacauuuaucauuucuuuguguuaggaacauuuccaaucuucucuucuagugacuuugaaauaugcaauauaugguugcuaacuauagucacucugcccugcuguuaaaaacuagggcuuauuccuucugucuguuaauaacuguauacuugagcccaguagccuaccucucuucauccucccucucacaccaaaaagcaaaugcuucccagccucuggugacugucauucuacucuuuaccuucacaagauaaacuuuuuuagcucccuucuauaagucagaacaugcaauauuugcuuuucagugccuugccuguuucacuuaacauaaacuccaguuccaucuauguugcugaaaauaacaggauuuuauuguuuuuuauggcugaauaauauuccauuguguuuaauauauaccuauuuucuuuguucauccauugauggacacuuagguugauuucauaucuuugcuacugugaauagugcuacgguaaaccugggguugcagguguaucuuugaaauacugauuucuuucccuuuggauaaauagccaguaguggaauugcugggucaacucuuaucucucaccauauacaaaaaucaacucaaaauggauuaaagacuuauaucuaagacccgaaacuauaaaacuacuugaagaaaacguagaggaaauguuccaagacauugauguaggcuaagauuuuagggcuaagaucucaaaagcauaagcaacaaaaauauccccauuuaaaaaauuuacuuuugugccauuauuuuuuuacccacuguccuauauaugagcauuucauuuguuucccguauuuugcaauugcaaacagugcuucaaagaauaaucucuuguguauguauuuucauauuuuugaagguuauauucaggguaaauuccuacaacuugaauugcucaaucaaaagauaaguguagcuguaauuuguauuguugaauguauauguuuagaaaugacuaacgguuauaugaagaaaugcucugcauggccagucaucaggaaugcuaaucaaaacaaagaugcauuaucaucucacaccuguuagaaaggcugucaucaaaaagacaaaagauaacaaauauugaccaagaauguguagaaaagggaacccugguucacuguuggugggaauguaaauuaguauagguauuauggaaaacaguguggcaguugcuaaaaaaaauuaaaaauagaacugcuaugugauccagcaaauucauaacuagguauauauacaagagaaaugaaauaauuaugucaaagagauagcugcauucucauguucauugaagcauuauucacaauagccaagacagggaggaaucaaccuaaguguucaucaguggacacguggauaaugaaaauguggggguguaugugugugugucuguguggauucuuaauaguauuccacacauauauaguggaauacuguuaagccuuaaaaaauaaggaaauccugucauuuaugacaacauggaugaacuuggaggacauuauguuaaaugugauaagccaaguacagaaagaugaauaaugcaugaucucacuuaaauggagaauauagaagcagagaguagaauggugguuaccagagcuugaggguggggaccagggagauuugagagauguuagucaaaagacacaaaauuucaguuagaagguguaaguucagcuuagcaguuuuuggacuuuaugauggugccaaagcacaguauauguucaguagaaacaguauuucacauuuugaauuuugaucuuuccugggcuagcuguacaauacucuugcagcuuucagucagccacacaauucagagaguaaacgacugauacucuaccuguaccauguuaccagaugacuuugcccaacaguagucuaauguaaguguucugagcauguuuaaggggagacuaggcuaccuuaaaaguaaguugguguauuaaauacauuuuugacuugugauuuucaacuuaugauggauuuauugguaugucaccucaucauaagucaagaagcauccguauuguguacuugaaaauugcugagagaguagauuuuguguucuuaccauaaaagacaacuaugugagguaaugcaugcauuagcucaauguagccauucuacaauguguacauauuuuaaaauauguuguacaucauaaauauauacaguuuucacuugucaaauagggaaagggauagauauaaaguuuauguguaggauaaauuccuggaagugggguuggugagucaaaaguaaaugcugacauuguuucauuaagcauugacagauucuccuucaaggucugugccaccuugcauucccucauuggugaaaaaaagugccuguuucccacauccuuuccaacagaauguguuacauuuuuuauuuuugcugaucugauaggucagaaauuuuaucacaguguaguuuuaguuugucuuuaauuaugugugagguuaaccaucuccugguauuuaagagccaugcuuauauuugucucuugauguugucucuucauaacuguucuacccauuuuucuauagugcuuuuaauuuuuucugauucaguuaagaguucuuuauauauuggagauauuaguccuauuuugcaagugucuucuccuguucaucaguagucuugauuuugaagaaauacacuucuucguaaguaugcaaguagguuaaauguaaaaagaccuaggaaaacaaguaaacacuaaucuuuaaaaugcugggaugguuauguuacucucagacaaaguagacuuuaggacagggaauauuaucagagauaaagaaggacauuuuacaauuaugaaggagacaguuccccagguagauacaacaaucccagauucuaauauuggagcuuuaaaguacgugaaggaaaaaaaugaauaaaacuaagggaagauuucaacauucaucuguuaguaacugauaaaauagauggaaaaucagcaaggguguagauuugaagaacacuauuaaguaacuugaccuaauagguauuuauuaaacacuacauccaccaagagcagauuauauagauuauacucucugauuauagcaaaauuaaauuagaaaucaguaacaaugaaaauccagauauuuuauaauuagaaauuaaaccagaagcuuuucaauacucauggguuaagaaagaaaucauaagggauauuagaaaaugcuuugaaaacaaaaguacaacauaucuuagucugcuugggcuagacugccauaacaaaauaccauaaacuggguggcuuaaacaauagacauuuauuuucucacaguuuggaaucuggaagucugaaaucaggugucagcguagucacuuuacacugagaccuguuuuccuagcuuguagguggcagccauuccacuguguaacucacaugcccucuuugugcacaugugugcaugggggcuuucuggugucucuuuuuguaaggauacuaaucccauuauauuagggcccccaccauuauaaccucauuuaaccuuaauugccugcuuauagacccugucuccacauaauagucauaguggggauuagggcuucaauaugugaauuuuggagguagcggguggggugggggagaauucaauucauagaacaacauaccaaguuuucuggaauuuagccaaagcaguauuuaaauagacauuuauagcuuuaaaaguuuauaucagauagaagaaaaauuuuauaaugaacaauuuacauuuccaguuuaagacauagagcaucagcuuuaaauagaagaaaauaaaggauauacuagaaaucaauuaaauagaaagugaaaaaaaaucaauguaaacuaaaacugauucuuugaauguagcuagauugguuaagaaaggcagacaaaaaaaaucaguaaugaaauaggggauaucacuacagaucuuauaaacauucaaagaauaagagaaauuaugaaucccuucauucucaaauucagcaauuuagaugaaguggucaaauacuugaaagauacaaauuauuaaaacuaaccaagagagaauuagaaaauuaguuuuuaaauaucuguuaaagacauagaauuuacaguuuuaaaccuuuccacaaagaaaacugcaggcucauaugacuaaacugguaaauucgaucagacaccuagugaaaaauuacuagucuuacauaaacgcuuuuagaaaagaggaauagaauguccuuccuuacacguuuuaugaggugauuauugcaggcauuaaagaaagcuagaagcgacaucucuucaaacauauauucagaaaucucuaacagaauauuagcaaaucaaauccagaaacgugauaacaggguaaugcaucauggccaacaggguuuuauccuaggaaugcaagauuauuauuugaaaacaauauaauuuuucuuguuaacaaaauuuuaaacgccuuuguaauuauuugaauagauguagaaaaagccugugacaacauucagcaucuguucagcacauuaagaauagagaagaaugucuuuaaccugauaaagaguaucuauggaaaaguaacaguuaacaugguauuaaugguaaaagauugaaugcuuucuuucuaagauugggaaaguggcaaggauguccacuuucaucacuuacauuaaacauuguacuggaugugguagucauuacauuaagacaagaaacagaaauaagagccaucagauuggaaaggaaaaacaaaaaggauuuugucuacaaaccaugugauugugugcauagaaaguccuaaggaauauaccaaaaaguaauacagucaguaaucagaaguaacugauuucuucauaacaaauacaaaaauaaaauguuguagaaaaaugugauuuacaauggcauaaaucacugcauacuuugggauaaauuuaacaaaaaaaauguugagaccuguacacugaaaacuguaauauagaguaauuaaagaacuccuagauauauugagaaagauuccgcguucauggauuagaagacugugaagaugauaauucuccccagaucaguuuuagauuaagcaauuccaauagaaauuucaacagacaauuuuuuuuuuuagaaauugauaagcugcuuuucaagauuagauggaaaacguuaagcaucuagaauagaccaaacaaguuuuaaaaagaaaaacaucagaagauuuaaacuacauguuuugaagaucaaguuuaaaacuucuuguccagaugugucaagguaauucaauggcacaagaauacuccuuuucagcagggguuacaauccuagucucugaugaaacagacuugaaaccaacaaagaucaaaagagacaaagaagggcauuacauaaugguaaagggaucaaugcaacaagaagagcuaacuauccuaaauauauaugcacccaauacaggagcacccagauucauaaagcaaguucuuagagaccuacaaagagacuuaaacucccacacaauaauagugggagacuuuaacauccacugccaauauucgacagaucaacgagacagaaaauuaacaaggauauucaggaccugaacucagcucuggaccaagcaaaccuaauagacaucugcagaacucuccaccccuaaucaacagaauauacauucuucucagcaccagaucacacuuauucuaaaauugaccacauaauuggaaggaaaacacuccucaacauaugcaaaauaacagaaaucauaacaguuucucagaucacagugcaaucaaauucgaacucaggauuaagaaacucacuuaaaacugcacaacuacagggaaguugaacaaccugcuccugaaugacuacuggguaaauaaugaaaugaaggcagaaaaaagauguucuuugaaaccaaugagaacgaagacacaauguaccagaaucuccgggacacauuuaaagcaaugugcagagggaaauuuauagcacuaaaugcucacaagagaaagcaggaaagaucuagaaucgacaccauaacaucaaaauuaaaagaacuagagaagcaaaagcaaacaaauucaaaaucuagcagaagauaagaaauaacuaagaucagagcagaacugaaggagauagagacacaaaaaacccuucaaaaaaucaaugaauccaggagcuguguuuuugaaaagaccaacaaaauaaaucacuagccagacuaauaaagaagaaaagagagaagaaucaaaucgaugcaauaaaaaaugauaaaggggauaucaccauuuaucugacagaaauaaaaaacuaccaucagagaauacuauaaacaccucuacgcaaauaaacuagaaaaccuagaagaaauggauaaauucuuggacacauacacccuccuaagucuaaaucaggaaggagucgaaucccugaauagaccaauaacaaguucugaaauugaggcagugauuaauagccuaccaaccaaaaaaaguccaagaccagacagauucacaaccaaauucaaccagagguacaaagaggagcugguaccauuccuucugaaacuauuccaaucaauagaaaaagagagaauccuccuuaacucauuuuaugaggccaacaucgucugauccaaaaccuggcagagacacaucaaaaaaagaaaauuucaggcaaauaucccuaaugaacaucgaugcgagaagccucaauaaaaucuggcaaaccaaauccagcaccacaccaaaaggcuuaucuaccacgaucaaguuggcuucaucccuaggauguaaggcugguucaacguaugcaaaucaauaaacguaauccaucacauaaacagaaccaacgacaaaaaccacaugacuaucucaauagaugcagaaaaggccuucgacaaaauucaacaccccuucaugcuaaaaacugucaauaaauuagguauugauggaacauaucucaaacuaauaagagcuauuuaugacaaaccaacagcgacuaucaagcugaaugggcaaaaacuggaagcauucccuuugaaaacuggcacaagacaaggaugccuugucucaccaccccuauucaacacaguauuggaaguucuggccagggcagucaggcaagagaaagaaauaaagaguauucaaauaggaaaggaggaagucaaguugucucuguucgcagaugaaaugaugguauauuuacaaaaccccaucaucucagcucaaaauauccuuaagcugauaagcaacuucagcaaagucucaggauacuucacugugcaaaaaucacaagcguuccuauacgcuaauaacagacagccaaaucaugaguaacucccauucacaauugcuacaaagagaacaaaauaccuaggaauccaacuuacaagggauaugaaggacgucuucaagaagaacuacaaaccacugcucaaggaaauuaagagaggacacaaacaaauggaaaaacuuuccaugcuuauggauaggaagaaucaauaucgugaaaauggccauacugcccaaaguaauuuauagauucaaugcuguccccaucaagcuacuauugacuuuucuucacagaauugaaaaaaacuacuuuaaacuucauauggaacgaaaaaagaacccacguagccaagacaacucuaagcaaaaagaacaaggcuagaggcaucaugcuaccugacuucaaauuauucugcaaggcugcaguaaccacaacagcaugguacugguaccaaaacagauacauaaaccaauagaacagaagugaggccucagaaauaacaccacacaucuacagccaucugaucuuuugacaaaccugacaaaaacaagcaaugcagaaaggauucccuauuuaauaaaugauguugggaaaacuggcuagccauaugcagaaaacugaaacuggacccuuucguuauaccuuauacaaaaauuaucucaagauggauuaaagacuuaaaacguaaaaccuaaaaccauaaaaauccuagaagaaaaccuaggcaauaccauucaggacguaggcaugggcaaagacuucauaucuaaaacaccagaagcaauggcagcaaaagccaaaauugacacaugggaucuaauuaaacuaaagaguuucugcacagcaaaaggcacuaucaucagagugaacaggcagccuacagaaugggagaaaauucuugcaaucuaucugacaaagagcuaauauccagaaucuacaaagaacuuaaauuuacaagaaaaaaaaaccaucaaaaagugggugaaggauaugaacagacacuucucaaaagaagacauuuaugcggccaacaaacauauuuaaaaaagcucaucaucacuggucauuagagaaaugcaaaucaaaacuacagugagauaccaucucacgccaguuagaauggcgaucauuaaaaagucaggaaaugacagaugcuggagaggauguggagaaauaggaacgcuuuuacgcuguuggugggaguguaaauuaguucaaccauuguggaagacaguguggugauuccucagggaccuagaacuagagauaccauuugacccagcaaucccauuacuggguauauacccaaaggacuauaaaucauucugcuauaaagacacaugcacacauguguuuauuacagcacuacucacuauagcaaagacuuggaaccaacccaaauguccaucaaagauagaguggauaaagaaaauguggcacauauacaccauggaauacuaugcagccauuaaaaagggugaguucaugcccuuugcagggacauggaugaagcuggaaaccaucauucucagcaaacuaacacaagaacagaaaaccaaacaccucauguucucacucauaagugggaguugaacaaugagaacacauggacgcagggaggggaacaucacacgccugucggggguugggcggcuaggggagggauagcauuaggagaaguaccuaauacaggugauggguugaugggugcagcaaaccaccauggcacauguauaccuguguaacaaaacuucacguucugcacauguaccccagaauuuaaaguauauuaaaaaaaagucuuuuucaacaaaugauaguaggccuacuggauauuuacagagaaagaaaaagugaacuuuaaucuuuaacucacaccaucgccacaauuaacuuaaaacagacaauaauaaauaggcucaugucuaaaaguuaaagguuuaaaauuuuuaggauaaaaccaagcuuuucauagaaauauuugcaaacuggacaaagcuuuaaaauaccaaaaacacauaccauaaaagaaaaaaugaggccaggcacaguggcucacgccuauaauucuaacacuuugggaggcugcagugagaggaucacuugagacuaggaguuugaaacuagccuggggaacauagugacacccuguaucuacaaaaaauaauaauaaauuagcuaguugugguggugugugucuguagucccagcugcuugggaggaugaagcaagaggguggcuugagcccaggaggucaaggcugcagugacccaugauuggaccacuaacuacacuccagcaugggcgacagagugagacccuaucucaaaaaagaaaaaaugaucaucauuucgaccucaucagaauuuaaaacuuaggcucuucaaaagacaccauuaauaaaaggaaaagguaaaccaggaccaggguaaaaauauuugcagcacguaacagagaacucuuacaacugaauaauaagacagacauuccaguuaaaaaacuuuccacagacguuuacaaaagauaccuaauuguacaccaaguaaauggaaagauggucaacauuauucaucauuagggaagugcaaauuaaaaauguguuuaugggagaauauauaucauauaggagaagucuuauucauuuaaaucacuguuuauuuagcuggcucuuuaauaaaaaucauauuugaaaucaauuuaaacugcuggugacuuugauaguuuuacugguuaaggcacuuccuuccccaccucuuauuuguggcuguaauguuuguggaucaagaugcaaaauaguggcuccuaaaugugagggugcuuaaaaaugcagguuucugggguccauucugcuuacaaggaauuagauucuggagguggggccccagaaucugcauuuccacaaacauuguagguguuuaugaugcaaauacaucacaaacaauuguuuuaaaaaugcugggccaaagaguaucuuuuguuuagguaguaguugauccuaggaaaacauuuuaaacucccagagacccaagaagcccauauguuugauuugggaguuuccugcucaacuuugaccugacaguucaacaagcaguaugaccauuucccacaagauuucuuguaucucuucaguuguuuccuagcuugaaaucagaaaauagucuucauucaucuccauauaaauaagauuuuagugaaaauuuauaaaaccaauuguauugacacuucagaacauguguaaucauugcagaaagcauaaaauaaugcaauaugcuaucauaaugucucagauuuuguugcuuugaaauugucaaagggugagcccagcacacuggcaugcugcaucuguagucccagcuacucaggaggcucuaacacaggaguuugagaccagcuugggcaacauaacgagaccccugucucucaaaaauaguaauaauaauaauuuuaaaaaucagggaaaaaacugcaaugauauuagcaaaggccaccacucuuuauauugcaucuucccuaguuuguuuuucaauauuacauauuugcagacauuugcuuucuguuaauaaagcacuaaacagugccauguuaaauaaacguggauaggaaccauuugaaucagcuguggagacagcuguguuacugcauuuuugguuugguuaacauaggauuguaccugugucaacuuguaucguacucacucggauauuaaacuguuccuuagauauagaucugguaugguuuugaaaauaugcuuuuauuuaugagggaaucauauuugauguacuguuucuucuauaucauucugugagcacuuuguaaauaucacaguaacaguugcuggacaucacaucuuugaagcauuuuacaggagaucuuagcacaagacauaaaaaauaaaacuuaucuaaggauuugaaaggaagaaucaaauuguuacuugcagaugauuugucuacagugaucauccaagauagugcucauuuuggcagcacauauagcagcaguggaaaaucaugagagaaucuagacagacuguuggaauuaaacucaccaaggugacuagguauaagaucaguacgugaaaauuaguaacuuuuuaauaugaacaguauccauguauaguuacuuuaugacaucuccaucuagauaagacaucuaaauuuaaaugucuaaaacaaugcucuugaaaaucuaccucuucccacuuccaacccacuccucccaugucaugacuguguauccagugaaaaucuuagaaugaguuauccuugaucccucaaaaucaauccaucagcacaaccuguuuucucaagcuuccaaauauauucagaaaccagccacugcucgcuacucucccuugcagccacccuagauuguaucugccgucaccaguugccuggagcacuccaggacuucccugcuucccacuguugggcuccuacaggaacuuccuugguacuucacaaaguagccagaauuaaccuuaugauaugugucagaucaugcuacuccuugcucaaaaacacuguaguuuguuacacuuugaauaaucuauacuccuacaaggagaccuggcucuuguaccucugagcucagcuccuaccuccuacuccucccucacugcacaguggucacuucagccuccuuguucaacucgccaaauacauuacuacuuucuuccccuagaucucugucguucaggucuuggcagcagugucccuccucagagaggcauuuucgguucuaaacacagccccgccguguuugauuuuucuuuauacacacauuuucaccuaacauauucaacuuuuguucccccuacuaggagguuagugccaugagagcaggugcuuuucuuuauuccccacuguagccccagccaauagacgguaacuggcauauaguaaacauucauacauuuguauugaauggaugggguauauacuuuuuuaccccaccuggccacuuuagacauuuccauuuguaauuugcagaacagccucuuggcucugugagagaaaaacacuguaucuuaauuuccuuuuucuccaacaucuaaacaguccauggaauuaauauauaggaauuauauauuauauauaggaauauauauuacauuauaggaauauauauuauauauaggaauauaauauuauauaggaauuaaugacauacaguuaugccuuauacuuuauuuuuccuugauuugauuaagauuuauguaaauuugaguuucauacuaaugaaacuaaugagcugaggagcaucucuuguuuuaaaggcgccaaagaauguuuuuguuacauaacaucuaagaaacagacagggcagaaagcaggaaggaauagaugccaacacuguguugcaaggaauugugccuucaugucccggugucuuuaguuucaugcuuuaguaaaauauaaucuuacuuuuggugcuugcuuucuuuuuuuguuugucaucuuuucuguucaacauaugcagagggauucuuaagcuacacaaaagaauguucuaaauugguagggcuaaaaacauguuuggauuuuauuaccuucagcuaaauuauuccacuacucagauuauuuaaucuuuauagaauugaauuaaagccaaauuuccuccauauuaugaauguccuugucuauuucuaauuauuucuuguaucuccuaaauccuggauauuuccucugacuccuuaauccugaaugaaauuacuauaucauuucaaagcuuacguuacuaugaauuucagugaugauggaaauaaaguagucucacaaaauggguuuugcucugacaucauuuccuagaacaaaaacaucaaaaucuacuauuuugaaacuuagugccugacugaauuucugacuuucugacugaauuucugacacuuuaggcaugugaaccaccaccacuacucccccuaccccaccaaaagucauuuauguuuuauaucagcguuaggcccugauguugucugagguuugcuauucagaaaucuguucuauugagaaguucugguaucagguggguuaguuagaagaugcuacuguaauauggaggccaggacaucagagaucaguucuaguguauuccaaacucucagaugaaauagauauuucaauucuuggaaguuuguaucccaaauucauuuuuguuuaguccuuugccacucuaguuacaaucugauugugauuuuugucuucauauauugucugcuaaauguauguaaguuguauuaacucuuuauucaucauacauguaucagaaaauccaagcgaccuauuaaaguauaucguuaccaauuauaccaaccaaauaaauuucaacauucagucugccugagcauuuucuauuugcauauaccuuugaagaagaaaaauaaucccacuuuuucauuuucuaaaacgcaaucuuuauugguuucugcuaauuuaaaaagugacgcacauuucugauagauuguuagacccaauuuuucuuaaaauggcauuguuaugacaaaagucagcugucugaauagaguuuggggaaacauauauuuugaagaauugcuucuuauguuguuuucuuuuuauuuacaguauaucucucuaccgggggaauugcaggcccauacgauuugagccaccaaugcuggauuuccaugaacaguaaguuuaaaauuuuuggacuguacuuucccauuaaacuauuaaauguauuuuacaugcauuugucuugucuuuugccuguguuacaucuaugugggaaaguuacauguucuagucaucaggaaaacaaaugauacugaaugcaguuugaaaaugggaaguaaguaucuauuaggagucuaacauguaauauuaacuuuuaaagcuugaaaaauacucgcuuguuguagucucugguucagagacucuuuggaaacagcaaagaacuuauaguuagcuguuuugauuagcacuucauuuuuauuuuuacuauuuaaaaaucuucuuaugaauaaaauauauucuauuuguuuaauauaugugcuuuuaauagacaagcucuuauauaucaccaaauaguauuaucaccaacccauaauggcagguaaaagcaaacgcacagacagacaugguucauucacagaacucugccuugaugagcuaagcaaaccacugcacacccucccccaagcaggagagacccccgggccucuaagcagcuaauauacccaagggccagcaaagcagcuacauaccugcacucagcaccuaagaaagagccccacagugcacccccaagauauuuccuuggccugcccaauggcccugcaccugaaaucagggccugaaaaacagcccugugggcaaccaccggcagacacaccuccagaccagcugagcaucucugugccugugucaggccuaagaaauagcccugugggucgccacuagcaaacauguccccaggcuagccaagcagcuuugugcucacaucauggaccugagaagcagcuguauaggcugccccuggcagacacauccucgggccagcugagcagacuugcaacugugucuuggaccugagaaacagccccauagggcagacacacuucaaggccaacuaaacacccaugugucugcacccccacccugagaaacagccccaugggucaccccaagccaacagacacccaagccaucugagaagccaugagacugcaucccacgccugaaaaacagcccugcgggccaucccuggcaaacauaacucccaguucagcugagcagccucagcgggcuccuauaugucccuucucagauucuccaaaaagaguuuuuucaucuugcugagucaaaagaaaguuuuaacucugugacauaaauccacacgucacaaagcaguuucacagauagcuaggccugagaaacagcccuuugggcuacuccuggcaggcauacacccacaccauccaacuaaacacgugcuugugcugcuguccagaguaacagcccugcguuuuagagccagacccuaaguuggccagauuccaagcugccugacccacuguguggaugcacacaucccugaccugagaaacagccuugugagcccacccucaacaaagcugcaccacuaccaccacagacucucucagccuaggcuacugagauacuugcagacgucaagugugacugacagcugaggaaaguacccagagacuacacuacagugcccaccuagacacagaugcaccaaagccaaugcaccccaccaaucugacacuccaagacccauuuauaagaauaagucuuucccugugaaauguacuccauaaaauuggaagaaaugacuuuucuaccagauguauagaaaucaacauggggacacaucaaacacaaaaaagcaaggaaacaugacgccuccaaaggaaaacaauaauucuucaguaacagaccccaaucauaagaaaauauacuaaaugcuagagaaagaauucaaaauaaucuuaaagaaucucagugagauacaggaaaacuuacaguucagcaaaaucaagaaaacaauucaugauuugaauaagaaauucaacaaagagacagguaacauaacaaagaaccaaacagaaauccuagagcugaagaauucaaugagugaaauaaaaaauacagucaagagcuucaacaauagacuaaaccaagcagaagaaagaauuucugaacuugaagacagaucuuuugaaaugacacaggcagacaaaaaaagaaaaaagggugaagaaagccuacaggauguauuguauaccaugaagugaacaaauauauuauggucauuccagaaggagaagagaaaggagaaaggcuuagaaaacauacuuaaugaaauaguagcugaaaacuucccaagucuugaaauuugagauggacauccagguccaguaaacucaaagaauuccaauuagagucagcccaaacagguuaucucugaggcacauuauagucaaauuaucagauguuaaaggcaaagaauucuaaaaguagcaagagaaaagugucaagucacauauaagggaauucccauuaaacuaacagcagauuucucagcagaaaacuuacaggccaggaaagaaugaaaugauauauuaaaaauacucaaagugggggugggggaccugugagccaagaacacuauauacccugcaaagcuacauuucagaaauaaaaaagaauuaaaaucuuucacaaacggccgggcgcgguggcucacgccuguaaucccagcacuuugggaggcgggcggaucacaaggucaggagaucaagaccauccuggcuaacauggugaaaccccgucucuacuaaaaauacaaaaaaaaauuagcugggcgugguggcgggcgccuguagucccagcuacucgggaggcugaggcaggagaauggaccgggaagcggagcuugcagugagcggagaucgcgccacugcccuccaggcugggugacagagcgagacuccgucucaaaaaaaaaaaucuuucacaaacaaggagaaaugaagggaauucaucacugcuagacuggccuuacaagaaaugcuuaagggacucuuauaucuggaaaugaaaacauaaccaccauuaugaaaacaugugaaacuauaaaauucacugguagagcccaaauacaaagaaaggaaaaagaaucaaaccguaucaauguggaaaaccacccaagcacagaaaaaccauaagaaaagaaguacagaacaaaagauaaaacauccagagaacaauaugacaggaacaagucuuuaccuaucaauaaccuugaauguaaauggguucaguucccccaucuaaaagauauaaacuggcugaauggauaaaccccaacuauauacugccuguaagaaacucaccucaucuguaaagucauacagacugagagugaagggaaagaaaaagauacuucauccaaauggaaaccaaaagccagcaggaguagcauuacuuacauaaggccaaacagacaucaaguaaaaagcuauaaaaagcaacaaagaaggacauuaugagauaaagggaucaguuaagcaagaaaauauaacaguuggaaauauauaugcaccuagcacuagagcacccagauauaaaaagcaacuauuagaucuaaagggagagauagaccccaguacaauaauagaguuggggauuucagcaguccacucucagcauuggacaggucaucuagacagaaaaucaacaaagaagcauuggauuuaaacuacaccaucaacuaaauggaccuaacagacauuuacagaacauuucaccaaaaagcugcagaauaccauuucuuucgucaacacaugaagcauucuucaggauugaucguauguuaggacacaaaaugaaucucaaaaaaauuuuuuuaaauuaauuuuaucaacuaucuuaucugaccacaauggaauuuaaaacuagaaaucgauaacaagaggaacauucaaaacuacaaauacgugaaaaucaaacaacauguuccugaaugaccaaugggugaaggaagaaauuaaaugguaaacuaaaauauuucuugagacaaaugaaaauagaaauacaauauaccaaaaccuauggggcacagcaaaagcaauauuaagaggcaaauuuauauaacaauaaauccuacaucaaaaaacuagaaagauuucaaauaaacaaccuaaugaugcaucuuaaagaacuagaaaagaacaaaucaaagccucaaaauuaguggaaggaaauaaguaagaucaaaaucaaaaugaaugaaauugagacuaaaaauaccuacaaaaaguggggaacaucuguauuuauuuguugaguuacaaaaaucuaaccauauuaucucaauauaccauuuuuauaacaauauauugugcauacuucaaaaaauuccauugaauuuucuguuauuuuauaauaaagaacaucaaaauuuauggguauauuauauuuguuaaauucacuuauuuuuaauuguuuuaaacuuuuuauuuugugaucagugcugaaacugaugauuuaaacacaaccaugacuauuuccuuuccucaagagagaguccuaauggaaggauauacagaauauuaaagauuuuaauuaaccuuuagccuagagaacaguucggugucaugaacaaggagcaacuuaaagaaauaaaagaaucagucuaugacaagugaggaaauaaaugggauuucucauagagacuguuacuagucauagagaaccugaaaucucaugagcugagagaaauuguggaagauuuguggaagaagugugaauggguagaugaacuccaguacaagcaagggucaguugacacaguaaagaaaauuuauuugaagcauagcaaaggaguauaguuauauaagacuguuccccaaagcagcggauuuacaugcugcuccaaaauaguggaaacagacaaacaaacuucgcuauagucugaauguguccucccaaaauucauacauugaaaccuaaucucugaugugauuguguucagagguggagcuuuaggagguguuuaggucaggagcgcagaccuaaucucacaaaugggauuagugaccuuacaagagaggccccauagagcuacuguccccuuucugccaugugaggacccagcuagaaggugucaccugugacccagaaagaaggcuccacaccagaacccaaccaugccgacaccccgaucucagauuucccagccucuagaucuaugaaaaauaaauuugucauuuauugugcuauagcaguccaaaaggacugagccaccauucuacuauuauuuaaaacuuucuggaucaagucagagaacacugagcggaguuuguuauaucucgcaaguguagaaguggaucuguagaaguagggguugcaggcaggugugaaccaacauguguaaggguucaaucagaggcagaaccagucagauuuuaaaugaauguauauguauauauacacgcacauggguuuauaauaaggaauuggcuuaugcauuugagagagcugguuaagcaagcucaaagcccacagggccagggagucaguaagggaggauagcgggcuggaaccccaagggcacagacugaaguuucuuguccacagauaaguauccagggaagauccugaggagaggagagaaauugcaggucuagcugcuguuugaagccucuuggcucagacagggccuaagcuuucuuugaaagugcuucccagugacaaagucacagacucaccuagaauaaucguuuuuauuaacuugaaaucagccuauuagggacuuuaauuauguuggcaaaaucucucccagcagcacuuagguuaguguuugaauaacugggaaaagguauauuaugcuacaaaauagcugcugucucacuuuucucuucugucucuaaggagauaauauuacuuuuaacucacccuaaccagaaacauacuagaaagggaguucuggggacuuuaguucaagucaaguugauaucacaaagcuaccccauagauacaaacaaagagguuccuaaauuuugaacuucugacucuagaaaaugaagagagauaugguugaaagaauuugcuuaguaauuuuaagguaagguucuuuuugugaaacuugaaaguagucuugggacaaagaaaaugaaauuuguacauuuucacugcagaaaguaaauuaucaaugucuucagaaagugacugcuaaaggaaaacagauauuuuagaauagauccucuuuuaaaguuauuguauguuuuuuccacucucagaagcauacaacuuguugauucaaguuuuuuccugcauuaacugcauuuauuuuugcccccacaaaucacugcucuuuuuaacaugaauguuauuaagugaaaaaagauuagaauacuguaauacagaauggccccucuuaauaccuguuagcuaccuauucaacaucuaccucccccgccccccccccuuuuuuuuuuuuuuuugcaguuauccagccuuuaggccuggcacccugucccuagcucagggguaaaucuugauaagucaguuguaauaauuccauuauuauugcuuguggucuguucaagggugagugugacccaguuuuacucuguaacaggagggcaggucaacugagguguuucuggggaaggauuguuuuuuuuacucuaaaaagagucacagccagaugcuguggcucacgccuguaaucgcaacccuaugggaggccgaggugggaggauugcuugagcucaagaguuugagaccagccugggcaacauagugaaacccaaucccuacaaaaaauuuuaaaaaguagcugggcaugguggugugcaccuguagucccagcuauucaggaggcagagguugcagugagcugagaucacaacagugcacuccagccugggcaacagagccagacccugucucaaaaaaaaaaaaaagagucgcaagaaagaaacgcccaucuucuaugccagauacugucugcaugcagugccuaggauacugcggcaaucaucuugcaaucagugagggguucuagccggaggacugaugccaugcagucaugaaaggcaacuggucuaacagaguggaaagauggaaagaaccugcgucuuucauaauguugucgaacugcuaaauuaacccuggaacugcccuacuuuaggucuuuuuguuuggugacacuuugaucuguuggagagugcauggcaccuggcaccacugacuucuuccucccucucagaucuuucccugccuauacccuugugaaccauuguccauguuuuccuccugugccugaggcuauuuuuaaaauuaucuuucaaggguuuauguuccucuguguauccccaaauugugguugugugcggcugcauuucuuucuucaccucauuucaaccaacucugcgcuuucuuacugggugggcucuuccaugccuuugacauaugccuguaaucucccaaucucugucauccccccucacuuaccaugugucuccaacaccacacuaaacucaccaugucuugcucuucuguaucuccaguccaugaacgguaccacagucaccaaagccagaauauucaggcuuccuggauuccucccuuucccucacagcacuccauccccuuccugucaaauccauuccaggaaggaauccuaugaauuuuucaugucuguucugcucuaauccucacuacuuaccccucuccucuuaacucagguccacaucauuucucaucuggacuguuaccauaugccugccacuuucuagucaggauucaugcugucaacagggaaauguuuuucacaucaaaaucugaucaugucguuuuucccacuuccccucccccaaaauuccuuuaaugguuuccuauuugccuucaggauaaaugcuaaauucauuauaaaaccugccuuuuuaccuuccuuauauguccuccacaccuggggagaacuacaugucauuuccugaaagcacugaucuucauaagggcugggcguguuauucauaccuugagucuccccucuaaagauaguuuuuuauggaaguuuucauacauauaggaaaguagaaagaacaaauaaugaauguacuuuuaacauaaacucagggauuauugccauuuuugcauauuuauacuucuguuuuugaaucauuugaaagcagcagaccucaugaccuuucauuccuaauucuugagcacacacugccauacaguugauccuuuaacaacauggcagguuaggggcacggacuccccaccacacugcguaguugaaaauucacauguaacuuuugacuccccaaaaacuuaacuacuaauagccuacuuuugaccagaagccuuacugauaauauaagcagucaguuaacauguauuuuguauguaauaggcauuauauguacuguauuuuuaccauaaaggaagcuaaaaaaaaauguuaagaagacaguaaggaaauucucauucauuaaguggagguggaucaucguaaaggucuucaccucaucuucacauugaguaggcugaggaggaagugauagucuugcugucacagguggcagaggcggaagaaaauccguguggacccucauaguucaaacccauauuguucaagagucaacuguauaaggacauucugcauaacuacaguaccauuauugacauugugagaaaauuaauaguaauuauggagugcuuuuaaucucccucuguuuuggucaaggcuguaguuauuugguuguaagugacagaaaccugaaauuaacugaggcaaaaaugauaauauauuggaauacugaggaccauaauauaucugcaggaaagucagagaugcagcuggcaccugggaacaacagcauucacuugcucuaacaccaccaggagucuucugucucuuauuucugccugucuauguauuggcuuauucucucucacugccgguauccuuucccuacagcagugggaagaaauucgcugacugcucuucagccuugcauucugugucuucacuccacugggaagcucuguuguaaagcaagccuuuccccagucuaacuagcagggguggaaacugccuucucucugcuuccagggugguguuaauccugcugagaugagauggagccccacccaaaauuugguucagauaucaagacuguugaugucacauaugcacagacaccagcagaaugaaaaaguuuauuguacucaccgaaugaagauucuaggggaugaccaugguaggcagaugugagaaagggcuggagagagcagagaaggacuagauugguuuuuuuguuuguuugcucauuauuauuauuuuuuaauuauuauacuuuaaguucugggguauaugugcagaacgugcaguuuuguuacauagguacacaugugccaugguaguuugcugcaugcaucaacccaucaccuacguuagguacuucuccuaauguuaucccuccucuagccccccagccccugacaggcccugguguaugauguuccccccucuauguccauguguucucauuguucaacucccacuuacgaguaagaacaugcaguguuugguuuucugcucuugugguaguuugcugagaaugaugauuuccagcuucauccaugucccugcaaagggcaugaacucauccuuuuuuauggcugcauaguauuccauguuguaugugugccacauuuucuuuauccagccuauugauggacauaugaguugcuuccaagucuuugcuauugugaauagugccacaguaaacauacgugugcaugugucuuuauaguagaaugauuuauaguccuuuggguauauacccaguaaugagauugcugggucaaaugguauuucuaguucuagauccuugaggaaucaccacacuguauucuacaaugguugaacuaauuuaccugcccaccaacaguguaaaagcguuccuguuucuccacauccuguccagcaucuguuguuuccugacuuuuuaaugaucgccauucuaacuggugugagaugguaucucauugugguuuugauuugcauuucucuaaugaccagugaugaugagcauuuuuucauauguuuguuggcugcauaaaugucuucucuugaagugucuguuccuauccuuugcccacuuuuuaaugggaucuuauuuucuuguaaauuuguuuaaguuccuuguagauucuggauguuagcccuuugucagauggauagauugcaaaacuuuucucccauucuguaggcugccuguucacucugaugauaguuucuuuugcugugcagaagcucuuugguuuaauuagaucccaugugucaauuuuggcuuuuguugccauugcuuuugguguuuuagucaugaagucuuugcccaugccuauguccugauugguauuccccagguuuucuucuaggauuuuuaugguccuaggucauauguuuaagucuuugauccaucuugaguuuauuuuuguauaagguacaaggaagcgguccaguuucaguuuucugcauauggcuagccaguuuucccaacaccauuuauuaaauagggaaucuuuucugcauugcuuguuugugucagguuugucaaacaucagaugguuguagaugugugguguuguuucugaggccuuucuucuguuccguuggucuauauaucuguuuugguaccaguaccauacuguuuucguuacuguagccuuguagcauaguuugaagucacauagugugaugccuuuagcuuuguucuucuugcccaggauugucuuggcaauacggguucuuuuuugguuccauaugaaguuuaaaguaguuuuuuccaauucuaugaagaaaguuagugguagcuuguuggggauagcagugaaucuauaaauuacuuugggcaguauggccauuuucaugauauugauucuuccuauccaugagcauggaauguuuuuccauuuguuuguguccucucuuaauuuccuugagcagugguuuguaguucuccuugaagagguccuucacaucccuuguuaguuggauuccuagguauuuuguucucuucguagcaauugugaaugggaguuacucaugauuuggcucucuguuugucuguuagugguguauaggaaugcuucugaguuuugcacauugauuuuguauccugagacuuugcugaaguugcuuaucagcagcuuaaggagauuuugggcugagucgaugggguuuucuaaacguaucaucauuucaucugcaaacagauacaauuugacuuccuccuuuucuauuugaauacccguuauuucuuucucuugccugauugcccuggccagaacuuccaauacuauguugaauaggggugaugagacagggcauccuugucuggugccaguuuucaaagggaaugcuuccaguuuuugcccacucaguaugguauuggcuauggguuugucauaaauagcuuuuauuauuuugagauauguuccaucaauaccuaguuuauugacaguuuuuagcaugaaggaguguugaauuuuguugaaggccuuuucugcaucuauugagauaauccuguggcuuuugucauugguucuguuuaugugauggauuaccuuuauugguuugcuuauguugaaccagccuuuccaccccagggauaaagacaacuugaucgugguggauaagcuuuuugaugugcuauucaguuugccgguauuuuauugaggauuuuugcaccaguguucaucagggauauuggccugaaauuuucuuuuuuuguuaugucucugccagguuuuggaucaggaugaugcuggccuuauaaaaugaguuagggaggauucccucuuuuucuguuguuuggaauaguuucagaaggaaugguaccagcuccucuuuguaccucugauagaauuuggcugugaaucugucugguccuggacuuuuucgguugguaggcuauuaauuacugccucaauuucagaacuuguuauuggucuauucagggauucgacuuuuuccugguuuagucuugagaggguguauguguccaggaauuuauccauuucuucuagauuuuguaguuuauuugcauagagguguuuauaguauucucugaugguagcuuguauuucuguuggauaaguggugauauccccuauaucauuuuuuauugcaucuauuugauucuucucuauuagucuggcuaguggucuaucuauuuuguugaccuuuucaaaaacacagcuccuggauucauugauuuuuuugaaggguuuuuugugucucuaucuccuucaguucugcccugaucuuaguuauuucuugucuucugcuagauuuugaauuuuuuugcuguugcuucucuaguucuucuaauuuugaaguuauguuuucgauuuuagaucuuuccugcuuucucugaugagcauuuagugguguaaacuucccucuacacagugcuuugaaugugucccagagauucugguacauugugucuucauucucauugguuucaaagaacaucuuuuuucugccuucauuucauuauuuacccaguagccauucaggagcagguuguucaacuuccauguaguugugcaguuuuaagugaguuucuuaauccugaguucgaauuugauugcacugugaucugagaaacuguuuguuaugauuucuguuaucuugcauauguugaggaguguuuuccuuccaauuauguggucaauuuuagaauaagugugauguggugcugagaagaauauauauucuguugauuagggguggagaguucuguagaugucuauuagguuugcuugguccagagcugaguucagguccugaauauccuuguuaauuuucugucuuguugaucugucuaauacggacaauaggguguuaaaaucucccacuauuagauugugugggaguuuaagucucuuuguaggucucuaagaacuugcuuuaugaaucugggugcuucuguauugggugcauauauauuuaggauaguuagcucuucuuguugcauugaucccuuuaccauuauauaaugcccuucuuugucucuuuugaucuuuguugguuuaaagucuguuuuaucagagauuaggauugcaacuccugcuuuuuuucauuuccauuugcuugguaaauauuccuccauccauuuauuuugagccugugugccuugcaugugagaugagucuccugaguacagcacacugaugggucuugacucuuuuuucaguuugccagucugugucuuuaauuggggcauuuagcccauuuacauuuaaguuuaauauuguuauguguaaauuugauccuguuauuaugaugcuagcugguuguuugccuguuaguugcaguuucuucauaguguugauguucuuuacaauuuaguauauuuuuacaguggaugcuacugguuguuccuguccauauuuagugcuuccuucaggagcucuuguaaggcaggccugguggugacagaauaucucagcauuugcuugucuguaaaggauuuuauuucuccuucacuuaugaagcuuaguuuggcuggauaugaaauucuggguugaaaauucuuuucuuuaaggauguugaauauugggccucacucucuucuggcuaguagaguuucugcagagagauccgcuguuagucugaugggcuucccuuuguggguaacccaaccuuucucucuggcugcgcuuaacauuuuuuccuucauuucaaccuuggugaaucugacgauuaugugucuuaggguugcucuucucgaggaguguuguugugcuguucucuguauuuccugaauuugaauguuggccugucuugcuagauuggagaaguucuccuggauaauauccugaagaguguuuucuagcuugguuccauucuccuugucacuuucagguacaccaaucaaacguagauuuggucuuuucacauagucccauauuucuuggaggcuuuguucauuccuuuuuauuccuuuuucucuaaucuugucuuugcucuuuauuucauuaaguugaucuucaaucacugauauccuuucuuccacuugaccaauucggcuguugaaacuuguguaugcuucacaaaguucucgugcuguauuuuucagcuccaucgggucauuuauguucuucucuacacugguuauucuaguuaacaauuugucuaaccuuuuuuucaaaguucuuggcuuccuugcauuggauuagaacauacuucuuuagcuuggaggaguuuguuauuacccaccuucugaaaccuacuucugucaguucgucaaacucauucuccauccaguuuuguucccuugcuggcgaggaguugugaucuuuggaggagaagagaccuucugauuuuuggaauuuucagccuuuuugugcugguuuauccccaucuuuggauuuaucuaccuuuggucuuugauguuggugaccuuuggauggcaucuuugaguggacgugcuauuccuuucuguuaguuuuccuucugacaggcuccucugcugcuggucugcuggaguuugcuggagguccacucccgacgcuguuugccuugguaucagcagcggaggcugcagaacagcaaagauugcugccugaucauuccucuggaagcuucuucccagaggggcaccugccaaaugccagcuagagcucuccuguaugaggugucuguuggccccuacugggaguuuucucccagugaggauacacggcggucagggacccacuugaggaggcagucugaccuucagcagagcucgaacgcugugcugggagguccacugcucucuucagagcugccaggcagggauguuuaagucugcugaagcuucggccacagcugccccuuuccccaggugcucugucccagggagcuggggauuuaucuauaagucccugacuggggcugcugccuuuuuuucagagaugcccugcccagagaagagaaaucuggcagucuggccacagcggccgugcugagcugcagugggcucugcccaguucgaacuuccccgugacuugugacuuuguuuacacugugauuguaaaaccaccuacucaagccuuagcaauggcggacgccccuccccccaccaagcuccauugucacagguugaccucagacugcuucugugcuggcagcgagaacuucaagccagugaaucuuaguuugcugggcuccaugggggugggacccacugagccaggccacuugggucccuggcuucagcaccccuuuccaggggagugaaugguucugucuugcugguguuccaggugccaaugggguauggaaaaaaaagaacucaugaaguuaguucggugacugcccaaacggccgcccaguuuugugcuugaaacccagggcccuggugggguaggcaccggagggaaucuccugguuugcagcuugcagagaccaugggacaagcgcaguaucugugccagaguuccucagguucagucccugacagcuuccuuuggguagaagagaaaauucccugaccccuugugcuucacagaugaggugaugccccacccugcuucggcucgcccuccgugggcuguacccacugucuaaccagucccaguuggaaauguagaagucacccgccuucugcauccaucucgcugggagccgcagacuggagcuguuccuguucggccaucuugccagcaauugguuuuuauugcgguuggggagcaaggcuggaguggguuugcaugauuggaacuucucacuagcuccgagagagaagggcuuuuugauuggcuugcccagguuuggggcuaaagguaaaggggcaucauuggggcuugaaaacuaucaacaguugaauaucaaaaauggaguuagagucuuucuaacucauggcaucuucuaaaaaguaucaggcccuucaggaagggugcaucuagaauuucccuugcuucuuucuugaccccagugcugacuccugucauuacccugaucauuccuacucuccuguagaauuuguuucacaauaaacagaucaaauuagcuuucuuuguuuucagacuuuuuguuuaaauuuauucuuuaagccuaccuguauucucucugcccuuccucccuuucccucccccucuuuucuuuucccccuuucucuccucuucucuccuuguaacaaucccauggggcaaucuagacaccacuggcuccccucccauucuccacuccccccccgaccccauuuuuaugccagugcuguuaaauguuuuucuguuuccauagcaacuccuauaauuaccugauggauucuuccugccugcuauacagacaaaaccaguucacugagaccaugguauugcaauaaagaguuuuacuaacaugaggccagccacacaggagauagaguuauuacucaaaucagucucccugaaggcuuggagauuaggguuuuacaaggauaguuuugugggcagggggcuagggaaugaggaauguugauugguugaggauggaaucauagggauguggaauaugguccuccugcucugagucagccuuugggugggggccacaggaccgguugagucagccaguugucagaaaugcaaacaucugaaaggaucucucaaaagaccaaccuuagguucuguaguaguaaugcuuccuacaggagugauugggaaauuuagaaaccuuaugaucucccagacaauguccgguuaucucaggccccucugauaacccuaaccucauggcuuuucauuaguuuucagaagcaguuucguuuugggaaagguuauuaucauccuugcuuuaauguuaaacuauaaacuaaauuccucccaaaguuagcuuugccuguucccagaaaugacaaaggacagcuuggaggucagaagcaagauggcgucaacuaugucagauuucucuuacuguucuaauuuugcaaaggcaguuucacuccagacauucauugcaggcuguaaaagaugcuuuggguagaaacuugguuuacuaaaaucuuuggcuuauauaauuauuacauucagaaaaucuugauuucagaucugaagguuaaaguagguacuucauggcuauaaaaaaaauggacguugaauagacuauugcuaaaaauagaugucuuuauugucaagauaaauuuaguuuaugaaaggcauuuuucucugaugacuuuuugguauuccaagaaaaucaaauaggcccccuaaagggauacuuggugccucuuagcuuuucaauuccuaccuacccaaucuuuccauaaaagauuuuacaucaacuccccagcucagccuucaaucuaaaauguuuuugaaaggaggauaguaguauuuugcgguaauugagugguacaaaguacugcauauugauuugacccgacuuccugcccaaaacuaugcuuaacagagugcugugucacugucauucauaaggucugccucagggcaguugcuaagccauuucuucagcuguuuccuggcacugcagugucaucuuucugugguguaggaaacuugcccuugaccacaaaauugcaguuuacuuuccaagcuagucucuaauucauagcugcugcuuucuaauucuuuugagccucagacuauucgaaaauauggacaguucguaguucugcugcagcagcacagagaacagcuguaugccugcuucagcuugguuuauaaauaccucacacugucccuuuuggcccuacuucugucuuuggacagccaguaauggaaacaaacaggaccagcacuggcaggcauuuggaaaucuuuguuuuauuuuuaaauuuuaccuguucagccaaguagucauauauccugcuuaugauaggcagaauucuaagauagaccagaauucuaaaaauuucuggccucuaauguaccuguacauacauucucccaauuauucaaucaaacaccaaucuagguguugcuauagaggauuuugaaacuguaacuaaggccccaaaucaauugaccuuugagauagauuuuuuuugggugagccugaccuaauccacgaaccuuuaaaaucuggcuuuagcaaucagaaacagaaaugucagguauuugagguaagggagauauuggaugcaagagaguuucuucgugcugcuuuugaaaaugguagggucauauggcaaaagacugaaagcaacccgaauuuuaucaacaaccagaaugaacuuaaaagaacuuugagcuucagaugaggacacaucuugcugacaccugcauuuccuugugagaccucgagcagauaaaccaggcauucuuacagaauuguaagauaaugaacgggcauugcuuuaagccucaaaguuugugguaauuuguuacauaguauagaaaagcaacacauugugaguuuacaaauggucauguacuuuccauggucuagauucugcucaugucaccaaaggaacggaggauggugaggaggaaggcaagcuguucacagaccuaugaggucugugagcaagucuguccaaggagugcccgcucccuuugcuuccugugguguggacugcccagagcuagaggcagccugcccuguuugagcacgcaacgacuaaaauagccugcugauguccuuccugacagcuucccucuguucuuguuacuccaagcuacuuugaacaacauaaguagaugacucaucuccucugagcaaggguucauucauuucuaugggauguggcccaugccuuuccucuuugaucccuggaagaaagggcagggccagccucagaagcauugcagaucaagcauucugauccacuccugcuuccaggcuccuagcacuuccacacuugucucuuuuccccacagcccucuccugcaggaggccaccuccaauccugucuucuugaaggauaccccaaauuaccuguccauuauguauccugucuucuuuaucuuagcugagauugauuguacuaaaguuacacaaggaaaaacauugagaaggaauucacagggaugugcaugaaugguugccaguuagccugaagucuauuugaauuguaaaagcauuuuuuuucuuaagaaagcauacaguuggugaacuuucaggaugcaaggaggauguuuuuauuucugugcgcuguuguuuucuacguaaaugucuauaugaagcuugaggaagaagacuuuuaucuucuauauuguaucgauugagcuuccugcaguaucguggcuguaguuugaggccccuugugguuuguacccauuucccuaauuguuucauggugucguaaccccaccugggauugaugagccugucauuuaaaggaucugagucuccacggaggcaagaggaauucaacaauuugagugcuucuugguuugaggaguucuacugucuaacuccaaauauguucuuacagaccuuuucuggauaccuaucuaucacugccucaggacccaaacccuguucccacuuuuuguuguuguuguuguucugaacuguuaggccacagaaugauuguggaccucauaaugugcaaucuacagaacgucagccacagaaugauuuuuggccaggauuuugcuucccuggguaaagcagagaaacucuccugugggauccuaccucuccagugcagucugugggcacggcuuuccuaguuaguaaaaaaaauaaaguaacuagcaugaugauagacuuuaacucuaucaauaauugcauuaaauauacauaaucuaaacacaucaauuaagagaccaagauugucacauugaauaaaaaagcgagacacaacuagcagaaaaccuacauauauguguguguguguauauauauaaagacauagacaauauuuuauauauagauagauagauagauagacauagacaaguuaaaaauaaaaggauggaaaagauauuaccauguaaacacuaaccaaaagaaccgugaaagggcuguguuaauuuggacaaaguaaacuucagaacaagcacuauuacugggaauaaagggggauauuacauaaauauagagggguuaauuuagauacacaaaaauaacaacucgaaauaugcaugcaucuaacaauggagcuuccgaauacuugaagcaaauauacccuuagggcaugggauuuuaagaauggaguaaggagcucaauggaccaccucaacagacaguacuuuaacuaaugagaauuauuuuuuaaaaaguuauuaaaguugcaggaaauuauucauucaaaaaaauguuguaaaucuucauaagaacaguggcagucucuggcauuugggcuacaaccuauucuauuaugcuccccaccacauaccccucaagccccagcuccuuguuauagaagcucccucuaaccccaguuuauacucugggacugcaguuucacccugagaagggagggcugcuagcauuucucaucaucuccaacuuuauguugcagaaguucuauuucaggcacauuucagaaaggacugggucucucuucacccaccccacucuaggacagaugcuguaucccagaugcagcaggccugaaaccuggggaacccaaucuugcucaccucacuaguaggauaaguuccacacuaggaagagcaagcugagaagaccagggucuaccaccccuuccccagugaccacuacuuguacagcagggcaucacuaggggaaaagcauaucagacaacacagacuuuaaaaccaaaaaguuacuacaaauaaagauggacauuuuaugauuacaaaagggucaauccagggagauauaacaauuauaaacauauauauauauaacuaauaacagagacucacccaaaauauaugaagcaaaacugccagaacugaagggagaaauacacaaugcgacaguaauaaugacagucuucaguauccccauuuucaauaauggcuauaccaucuaggcagaagauaaagauauagaagacuuggaaaaaguauaaaccaacuugacuuguagacaucuguagaacaccaugcucaacaacagaauacuuauucagcucaggcauauguagaauguucuccaagauagaccauaugcuaauccauaauacaaacacuaguaauuuuaaauggauuuaaacaauacaggcugaacauuccuaaucugaaaauccaaaaugcuccaaaaucugaauuuuuuugugugccaacaugaugcucaaaggaaaugcuuauugaagaauugcagauucucagauuaggguugcuuaacugauaaguguaaugcagauauuucaaaaucugaaaaaaucugaaauucaaaacacucaugguuccaagcauuucagguaagagggauacucguccuguacaaaguauguucucugucuuaauuuucuacugaaauaaauuggaaaucaaaaaagucuugggauaauaaacauacuccuuaauaaucagugaaucgaauaaaucaaaagggaaauuagaaaauacuucgagaugaacaaaaacaaaacauaucaaaacuuacgggaugcagcaaaaacauugcugggaaggaaacauauacacaccaaaauaucucaaaucagaaacuuaaccuucucccuaaaaaaacuagcaaaagagccaacuaaagcaaacagaaauaauaaaaacuagaggaaauaaauaaaauacagaauagaaaaacauaacaaaaucaacaaaaccaaaaguugguucuuugaaaagaucgaauugucaaaccuuuagcuauacugaccagggaauaaacagaaaagacucaaauuacuaaaaucaggaauguaggaggugacauuacugucaacuuuauagaaagaagauuacagggcaauuuuaugaacaacuguaugcuaauucauuaacuuaguugaaauggacagauuuccggaaagacccaaaauacacaaacugacucacggagaaauagaaaaucugaauagacuuauaacaagugaaauguuugcauuagucauuuaaaaacuugccagaaaguggcugggcacggcggcucacgccuguaaucccugcacuuugggaggcgaggcaggcggaucacgaggucaggagaucgagaccauccuggcuaacggugaaaccccacgucuacuaaagauacaacaaaaauuagccaggcguguuagugggcaccuguagucccagcuacucgggaggcugaggcaggagaauggcgugaacccaggaggcggagcuugcagugagccgagaucgugccacuucauuccagccugggugacagagcgagacuccaucucaaaacaaaacaaaacaaaaacuugccagaaagcaagcccugcuccacauagcuuuacuuaaggauucuaugaaacaaucaaagaagaauuaauaccaauuauucccaaacucuuccaaacaauagaaagggaaacaauucccagcuuagucuguuagaucuguauuacccuaauaccaaaaccagacaaagacacuacaagaaaauauagacaaauacuucugcugaauauagacgcaaaaauccuccacaaaaugcuaauagauuauaaaaagaaucuaguguacaccaugaccaagugacauuuaucucaagaaugcaggguugguuuaacauugaaaaaaucaauacagggaaaaccaauaaucaagucaauaaacacagaaaaaacauuugagauaauaacauccuuucaugauaauaaugccuaacaaacuaggauagacgggauuuucuucaaccuaauaaagagcaucuaugauaaccugaaggcugacaucguacuuaauggugaaagaaugaaaaaauucccccuacaucaagaacaacacaaggagaucuauuccugucacuucucuucaacauucuguuccaaguuugaccauggcaauagaccacauuacaaucuaucacaacauuguguguguuauccaauuaauuuacuccaaacauaucauguuacuugggugugugaacuuaugagcuacugucugguaaugcguauugagaagggcagaaggccaagcccuggucuuugucucuucuugugaauuuaaaaggagagauaauccccaaaauggagagccccaguuccauacauacacauaaaaacuauugauugccccauauuugucaccacucuuaacugacaaugcuuaggcagaagcaucgugggacaaaggugucuuccuaaaucauaguucaguagcccuaggacuguggaggaccagagagagauguuagaggagagcauuucaagggcagcugcucaucaacuccuuacccuggcaagcuuuucuauucuagguugaaggaucuggcucuaucucaaggcagacagggaagaaaguggagaauaauaaaguucggaagccuucucauagccuagccucucguugucagcucaggcugcccauugacacucacuuuccuuugccugccacuuuaaggcagccuucaguucucccaagggcuucucacuguuuuuugguuauuucuuggagucaguaccucccucuaacuucuaaauuuuuucagcauuauuguuguggggaaggaagauggcaggaagagccagcauguacuaaaucacuaucuuuaaggaaccuaaauuagccccugauuaauuuguugcuuuuuuuuaaaauuauuuuaaauuuuuguggguacauaguagauauauauauuuauggauuaccuaagauauuuugauacagguaugcaaugcauaaaaaucacaucaagguaaaugggauagucaucaccucagucauuuaucuuuuguguuaccaacaauccauuuauauuauuguaguuauuuaaaagguacaguuaauuuuuuuuuuaacuguagucaccguguugugcuaggaaaugcuaggucuuauccauacuuucaguuucuuuauacguauuaaucauccccauuucuacccauccccgcugcuauccuucccagccucugguaaccauccuccuacucucuaucuccaugaguucaauuguuuugauuuuuagcucccacaaauagugagaacauggaaaguuugucuuucugggucuggcuuauuuuacuuaacauaauguucucuagcuccauccagguuguugcaaaugacaggaucucauuauuuuucaugguugaauaguacuccaucguguauauguaccacauuuuuuuuauccauucaucugguaauaaacacuuagguggcuuccaaaucucggcuauugugaauagugcuguaauaaacaugggaguacauaaaacgcuacaauauacugauuuccuuuauuuuggguguauacucaugacugggauugcuggauuguaugguagcucuacuucuaguuuuuugaggaaccuccaaacuguuguuccuaguguuuguacuaauacauucccaccaacauucccuuuucuccauauccuugccaguauuuguuguugccuuuuggauaaagccauuuuaauuggaaucagauaucucauugugguuuugauuugcacuucccugauagucauauugagcauuuuuuauauaccucuuugucauuuguaugucuucuuuugagaaauaccuauucagauacuuugcccauguuuuaaccagguuauuagauuuuuuccuuuagagucauuugaguuccucauauauucuaguuauuauuaaucccuugucaaauagguaguuugcaaauauuuccucccauucugugagcugucucuuaacuuuguugauuguuuccuuugcugugcagaagcuuuuuaaguugauaugaucccauuuguccauuuuugcuuugguuacuggugcuugcggaguauuacucaagaaaucugugcccacuccaacguccuggagagaugcuaacuaaugucccuuucuuucaguuugaaagaacucccauuagcauuucuuguaagauauaucugauguuagugaaaucccucagcuuuuguuugucugggaacgucuuuauuccucuuucauauuugaaggauauuuucgcuggaaaggauauuuuugccagauauacuauucuaggguaaaaguguggggguuuuuuuuguuguuguugccuucagcacuuuaaguaugucaugccagucucuccuggccuguaagauuucuacugaaaaguuugcugccagguauuggagcuccauuguaccuaauucuguuucuuuucucuuguuaauuuuaggauccuuucuuuauccuugauuuuuuaaaguuugauuauuaaaugccuugagguagucuuugaguuaaaucugcuugguguucuaugaccaucuuguaguucaauauuaauaucuuucuccagauuugggaaguguucuguuauuaucacuuuaaauaaacuuucuaccccuauuuccuucucuaccuccucuuuaaggccauuaacucuuagauuuccccuuuugaggcuauuuucuaggucccguagguaugccuccuuuuuaauucuuuuuuguuuucucuccucugacuguauuuucaaauagccugucuucaagcucacuaauucuuucuucugcuugaucaauucugcuauuaagaaacucugaugcagucuucaguaugucaguugcauuuuucaacucuagaauuucugcuugauuguuuuuaauuauuucagcgucuguauuaaauuugucugauagaauucuuaauuccuucucuauguuaucuugaauuucuuugaauuuccucaaaacagccauuuugaauuguccgucuggaaggucacauaucucuguuucucucggauuggucccuggugccuuauuuaauucauuuaaggaagucauguuuuccuggcuggucuuaaugcuugcagauguucaucagugucugggcauugaagaguuagguauuuauuuuaaucuucacagucugggcuuguuuguaccccuucuucuuggguaggcuuuccagauauucagaaggacuugaguguagugaucuaagccauaucugcauuagggggcaccccaagcccagcaacacugugguucuugcagacuuguagaaguaccaucuugguggucuuggauaagaucaggaagcauucucuggauuaccuggcaaagauuccuguucucuuuccuuacugucucccaaacaaacagucucucucucucugugcugagccaccuggaucugggaguggaaugacaaagcaucccuguggccaccaccacuggaacugcacugggucagaccugaagccaacacagcacugagucucgcccaaggcccacuguaaccacucccuggcuuccagguguguuucuucaaggcccuaggacucuaaaaucagcagauagugaagccagccagguuuguguccuucucuucaggacagugaguucccccaggucccaggugggucuguagguguguccagaccaguccagaccagggacuggagucaaacaccuuagaaaucuaccuaguguucuguuguccugcagcugagcuggccuucaacccauuugaugcaguccuacccacucuucccuccccuuuccacaggcagaagaucccuaccccauggccaccaccaccacaagcccacggagaauaccgccaggcuaccaccaguauucacuuaaagcccaagggcucuucagucagcuugugguaaaugcugccaggucugggacucacccuucagggaauugggcucccuccccaauccacagcagcccuauccugcuguggcugagcugguauccaagaugcaagacaaaguccuuguuucucuucccccuccucuccucugucaagcagaagaaagggaucucuuucagagcugugagcugugcugccugggguuggaggaggaguggugcaagcacucccuugggcaccccagcucaugucucaguagguugcaugccccccaagucuacuggcuccaagcccagcacggcacuaggacucucuuaggaauugcggugcuuguggccuagacugccuuucaaauuuauuuagggccccagaacacuuuagccugagguggcaaggcuaaugggaacucaaguuaggacugcuagaguucaucuaaaugcugucuccuugggcaggcgaccgcugaguucagccagauuuugcuuucugcugugacagggcagcacugaguucauggcaaagucucacagucgcugcacugucccucucccaagugcacagacucucucucugugccacuuggcugcugccggguggagugggguaggugggaaaggguggcaucagcgauucaagauuuucuucccuacccucuucauugccucuuucagugauaugaaguuaaaaccaaaccaaguacugugagugcucaccugauuuuugguucuuaugaaggugauuuuuuuggcauagagaguuguuaaauuuaguauuucuguggggagaagggacaaugaagguggagccuucuauuuggccaucaugcccugcccuuccaccugcauuccauuuucuuaaacuauugaaaauuaucagcuguucacuguuuaucaacuuucccaagucuugaauuagaggugagcaacuaaauugaagaaaagguagagacagaacuucuugaagaacaaaagcaugguggacaguugaacgaaauauaaaaugaaguucuggcucugcguuuucaacugcuugggauuugagguuuauaugcauacuuuaaaugugaauuacaaaauguaaaauuucgaaaaccauggaccaaaaugauugcaugaggagaggaccuugugaaagaaggguguauauuugaauuagaaaugaggguuuggauugguauaggaggauagggaaaaaaaacacagggcaggcagauuagcagagccgugggggacuugcccauggaacuagccuggcucagguggaaggucuggauugaaaacaggguuacuuguuuagguugggucaugugagauuaggaaggaaccuaguaacuaguggguguguauagguaguuagaaaaagcaaggaagcuauagaaguuaggaggccuguaccaauaagauuagcuacagaaguaguaaguggacuauagaauaaaguuucacuucuaaggcaaaccauggcauggaugccaagggagucauuaaaauggauuuguggauuucagaccauugaguguguuuagguuugacaagaggcaguucaguacuggcgguuaaagcgcagacuagacccagaagacuuagauucacauccagguuccaagugugccuuugacaaguuaauuaacuuuucugugccccaguauucucaucuaugaaaugaguauaguaaaagccccuaacucacaagauuuccucacacaacuuugcuacucaguuucugcuccuaaaaugaagagcacguaucuguggaauuugagaagaggacacaauugguaggaggccggguggugguacagaaagaaagaaaaggaacugaccauuuugugccccguccgccgccucacuggguucugagccucagggaugaaacuugcuucacuguaucccagcaccuggcacuguacgugacauaauuggcacucaggaaauauuuauugaaagacuaaaugcauuuuuauguguaauuuuaaauauaaauucagaaagcauuuuaauauauuuagcuauguauuugucuaacaauuuugauuaauuuuuuaacaacuagaaauaaucagaauuaucugugaaauauuugugauaauuuucuuuuuguuuuacagaccaguuggaaugccaaaaauggaaaaagucuacuuacauaauccuaguucugaagaaacgauuacuuuaguaucaauaucugcuacaacaucacauuuucaugcaucauuuuuucaaaauaggguaaguuucucugcuauacaugaucuuuccugaguuugaaguugaaaugucuagauuuuuauugauuaauaacuugcugugauuagaauuggguuugaauauuucaaaucuguuccuagauuuguuucacuuccuaagaaugauuacuucuacccuuaaccauauuguuuuucucaacaugcaacagcuuaacaaaucagcagugaaccuuaaauacucugaaaaagguagcauucuuacauucaguacauuuuauuuuccuuccuaauaauagguaauuccuuugcauuguguuaguuguuucuugcuacauaauaaauuaccacaaacuugagacuuguggcaacagccacuuagcacacaguucuguaaacuguaagcacacuggguuguuuguucaguguaucaggcugaauuaagaugucuuccgggcugaguccuuguccagaggcucugaggggaaaucacuuccaaacucauuaaaguuguugagagaauuagguuccuugugguuguagaacugaaacccuuguuucgcugcuggcucuuggucagugaccccucucagcuccucagggccuccagguuccuucucacgggccauccaucuucaagccagcaacagcgcaucuuuccccuggcacuuuguaccucucugguguccucuucugccuccagugagaaaacucugcuuuaaagggcuccugucagugggucaggacucucuggauagucucccuuuugauuaacugaaaggcaacugguugggagccuuaauuacaucuuagucacagccucagagauuaggguauaaagucuugggcuccaauuuaagguucuccuuaccacaaauauccucuaaaauuuuauuuguaauuuucauaggaaguauguaaacucauuauuaaaaacuuucucugaccaaauaaauaaaaaugguaucuuaaguacauuuuaaauuugagagaauaccuaaaacuuuaauauauagguuuccaaaauaauuaacaaaauaacaaagaucagagggaaguaaaugaauaggaccgaauuucaucuucccagaauuuucacugacuccuuugaagggaugugauugaguaacaaagaagaaaccuuuuuagccauguaagauauugguugcuacauuuuuauaucauuuauuugauguuuacauuucuccucucuaaaauccuguuucaucauauguuguuuacuuuagaguaaaauuaaaaagcauaacuuuuucauuuaaagguauuuuauaaacaagggacugauaaaucagcauauuacuucugguaauaaaaaguuuaauuuuggggggaucuuuguggaaauaucccuuuucuaaauuauuucuuaaaauagcuuucccuugaguuauucuuuguuaucuaaaagauauuuccacacuuuuuauaaaugugcuauuaauaauagccuccaacaauauaauucuaaugcugugagagaccuguguauacacaggccgagcuccagagaggccuguuccagucaugcagugagugacaggugccaaggugaaggugucgguguucuauuaucauccccagugauuuauaucauauuacacuucagugaguggccuguaccuaauagcuucuauagagagauguauuuauguguaaugaaaccauccagcuuucaggcauugucaguaugcagagacagguuagguuaaagggcaaaauugugaaguaaaaauggaaucaguuaaaaaauaguucacaauugcacuauacauuuuauuucuaacuuguuaacuuuuugcuaagucaagcaauauuuuguuguuucugaacacuucaagcuucaccuguguuaaaggccaggguuuuuauuuuuuucauugcuaccguaauacagagacuagaacaagaguugcaaacagauucuuaaacugggcuagguaaacaauauaaaugagggaagcaagccaagugggauguggggguguccuagagaacaugugacccauucgaagagaucagcccccaccgggcuccagcccagugguuaccauguugggagucuaagcccaugugcaguucugcugauucccaagaagagucagaaauaagaaguuucauguaucugccagucuuuacacauugaaaaucaguucaauuuuagaaagacaguaugggccaaacaacauaggcuaaaggcuacuaacuugacguuucugaacuagacucucccagggacuauuucuauauaugaauguuaggcaaagagaauaguuucucuggaaauuuuuuaaaagauaaacuaaauguguagguaaucaaggaacaaguuaaccaaucuguuuugugcugucagaugauggaauuaaacaauaaaaauaauuacaccuaucaaaauccacauuuaaauagucaagauuuagcucaaaggagauagccaaaaucuuuacucucuccucuuauccuuuuuucuucuucuugcuuugcaucuuuuuuucccuacaauaagacacugacuuaagcucgagacguagaggggagagauagaaugaacucuugggggaagaaauaaccuauuuccucuccacuucagcuuuaugccaacaauaagagccuuggggaaagaugaauagaguuucuuaugucgaggagagcaaaaucuuucuguauguuuacucuaauugccuuugucaugcucggaauuccuggucaggucuuauuucuuugacaauaaaacauugucuauaacucagaguuuuuaguuauuaacuguuaucuguacguuaaccaaaaaguaggaaauacagaaaagacuauuuuuuaauuauuguucaaacuaaguuuuacauaauuauauuuuaacacgcacaugcaaguaaucuuguuaagguuuugauuuuaagaccaccugaaaaucaaaaagaauagaaauacuaagagagguacgggguaugguuguaugacaauuuauuucucuguauauaaguuuuuguaauuaucuauaauuaucuguuaauugaauauaauuaucuaauuauaauucaaaauuauguaauagacugcauuuaggccauucaucuuucauggccauauuauauauaggccauaaaauaugcaauauauguuuugcaucagaaaauacagaauuuuauaauaauauucuauacaaguccaauuguggaaauggggugccuuacacacaguaggaaacaaaaauguuuucuuuauugacuagaagcuuuugauuaauuaaauuuucagacaaacugaagauuaggacaaacuuuguuucagucugugacuaaaauuaaaauguuauaguucacuuauuucaguauacuuaaugaucaaucucuucucauggguugaaggguguuaauaaauauuaaugauuauuuuaauuagauauagaaggacauuauucuauugauuccaugcauguuuuugggaauuuaacaaaaugcgauguagcaauaguauggaauuuuaugcagauaauaaagagaaugaaauaggucucugucuauugaucuggaauaauauacaugacaugcuaauauguaagaaaagcauauuguagaguagaauauaaugccuuuuuuuuuuuuuuugagacagggucucucucugucacccaggcuggagugcaguggcaugaucucagcucacugcaaccucugccuccugguucaagcaauucuugugccucagcuuccccaguagcugggacuacaagcaccugcuaccacacccagcuaauuuuuguauuuuuugguagagauggaguuuugccauguuggccaggcuggucucaaacuccuagccucaagcaaucugccugccucagccucccaaagugccgggaugacaggcgugagccaccgugccuugccuauaaugccauuuuuauuaaaagcaaaaaaucuguguauauuuauuuggguauauuaauaagagccggaauaaagcacagauuugccagguugacuggauaaccuaauaauggugagaauggaggaaguuugaguguauuagcuuuuuauucagucaucuuugcacuguaucacuaaguaaaauaagcacuuguuacuuuugcaguuuaaaacauacaagaaaauguaaauuaaaaauaguuuugccaccccaccuauguggaaagaaggaauuaauuuaacaaauauuuaugaagugucuacuuaaagugccaggcacuuuuguuuuuaccagugaaaacagagaugcuuaucauacauacucuggggaguuugggugaagucagcagcagagggaaggcaagcaugauaaauaaguaaauuuuauaagaucuuagaagauguuacaaggucagaagaaaaguauaagaucagagacuuaggugugcacagggaaggcgguaccauuuuaaauaggguggucaggguaggcuuuauucagaaggugacauuugaacaaagacucgaagggcgugagguaggacuguuuggaggaaagugaaauauauggaagaagagcauucuagccggaaggaccaagcaguauaaagucuccauuguugaaagcaggccuguugugcaaagacagccagaccagagugagcaugggugagaggagaaguaagggggcagacuaugaagggucuuacaaacuaugguuugacuugacucuuuuuccugaaugauguggaaagccaucaaaggguuuugaacagaggaaugaaauuguagcuuuagguuuuaauaggaucauuguucaucaaaaauaggacaagggacaccagucacauuggcuguugucauacuccaggguaagaagaugauuagaugauuacucugaccagagugguacguggaagaggugaagaaaggaguuggacuugggauacagggauaccuuggagauauuauggguuccguuccagaccacugcaguaagccagucacagaauuuuuuuguuuccccauauauauaaaaguuauguuuauacuauacuguggccuauuaagugcaguagcauugugucuaaaaaauguacauaccuuaauuucaaaaauacuuuauugcuaaaaacugcugaugaucaugucagccuucugcaagucgucaucuuuuugcugguggagggccuucccucaauguugacagccacugacugaucaggguagugguugcugaagguugggauggccgugacaguugcuuaaaauaagacagcaguaaaguuugccacauucauugauucuucuuuucacaaaagauuucucuguagcgugcaaugcuguuuaauagcacuuuacccacagcagaaauucuuucaaaauuggagucaauccuuucaaacccugccucuaaguuuauguaguauucuaaguucuuugcugucauugucagcauauucacagcaucuucacuaggaguagauuucaucucacgaaaccacuuuuuuugcucaucccuaagaaacaacuccucuuccguucaaguuuuaucaugggauugcacaaauucauucacaucugcagaugccacuucuaauucuuuucucuugcuguuucuaccacaucuacagugacuucuccacugaagucuugaacccuuccuucaaagucauccauaaggguugggauuaacuucuuccagccuccuauuguugacauuuuaaccuucucccaugaaucacaaauguucuuuuuuuuuuuuuuuuuuccaagacggggucucacucugucgcccaggcuggagugcacuggcacaaucuuggcucacugcaaccuccgccucccagguucaagcaauucuccugccucagccuucugaauagcugggauuauaggcccgucccaccacugccagcuacauuuuuuuuuuuuuuuuuuuuuuuaguagagaugggauuucaccauguuggcgaggcuggucucgaacuccugacuucaggugauccacccgccucagccucccaaagugcugggauuacagacuugagccacugugcccagcugcaaauguucuuaauggcauuuagaauggugacucauuuccaggagguuuucaauggacuuugcccagauccaucagaggaaucacccuuuguggcagcuauagccuuaagcaguguauuucuucaauaagaagacuugcaacuugaaauuacuccuugauccuuggcugaagaauggauguuguguuagcagucaugaaaacaacgugcaucuucuuguacauuuucaucagagcuccugggugaccaguugccuugucacugagcaguaauauuuggaaagaaaucuuuuuucugagcauuaggucucaacaguggauuuuaaauauucaguaaaccauguuauaaauagaugugcuguuaucuaggccuuguccauuuauagagcacagguagaauagauuuagcacaguucuuaaggucucuagaauuuucagaauggcagaugagcacuggcuucaacuuaaagccaccagcuguguuagucccuaauaagagagagucagccuguccuuugaagcuuugaagccaggcacugacuucucuuuagaugguaucuuccaacagaaggcugcuugaucuacauggaaaauuuguuguuuaguguggccacguucaucaaugaucuuagcuagaucuucuggauaacuugcugcaacuuguacaucagcauuuaaugcuucaccuugcacuuuuaugugauggagcuggcuucuuuucuuaaaccucaugaaucgaucccuuuuagcuuucagcuauucugcagcuuccuccccucucucagccuucacagaauuaaagagagucagggccuugcucuggauuagacuuuggcuuaagagaaugguauggcaaggccaggcgugguggcucacgccuguagucccagcacuuugggaggcugaggcagguggaucaccuaaggucaggaguucgaaaccaaccuggccaacguggugaaaccccaucucuacuaaaaauacaaaaauugggugugguggugugcaccuauaaucucaguuacucaggaggcugaggcacaagaaucgcuugaaccuggaaggcagagauugcagugagccaagaccacgccauugcacuccagccugggcaucaagcgaaacuccaucucaaaaaaaaaaaaaaaaaaagagaaugccguggcugcuuagcucuuccauccagaccacuaaagcuuuaucccuaucagcaauaaggcuguuuuccuucuuuaccacauguguguucacuggaauagcauuuuuaacuuccuucaacaacuuuuccuuugcauucacagcuuggcuguuuggcacuaaaggccuagcuuugagccucucuuggcuuugagcaugucuuccucacuaaccuuauuuccagauuuuggguuaaagugagagaugugcaacccuuccuuuuacuccaacacuuacaggccauuguagggcuacuaauuggccuaauuguaauauuauuguaucuuaggaauagggaagcuugaggagaggaagggaguugggagaacagcaguugguggagcaaugagaacacacauaacauuuuucgauuuaagcuugccaucuuaugugggcauaauuuguggugcccuaaaacaauuucaguagcaacaucaaagaucacagaucaccaugcagauauaauaauaaugaaaaauuuggaaauauugcaagauugccaaaaugugacacagagauagaaagugaguacaugguguuggaaaaaugacacugauagacuugcuugaugcgugguugcuacaaaccuuuaauuugucaaacaaaaaacugcaguaccugcgaagugcaguaaagcaaagcacaauaaaaugagauaugcuguauguuuugaagauacacccaacaggauuuccugaugugggauuugagagaaagagaagagucaaaauugacucuagaauuuuguccugagcaacuagaaggacagaguugagucagcugaauugaagaaggcagaggguagaacggguuucagagguacaaucaguaguucaauuuggacauguuagauuucagguaucuccuagauauccaagaggagguggcaaauaggcagauaguauucgaguuugguauaugagaacucgacuagaaauagaaauuuaggagucacuaguguauaucugaagccauggaucuggaugagaucaccaaggaaggaaaaagcccagggacugagcuaugguacagugcugacuugggaaaauuacgguuucuuagugguauuacuagaaacucagaucuccuauccaucaucuacauacuagauguccaguuccgauaguggcagaaaacugcacuaaaaauuaaacauuccauggugauuuuucuaacucuuuggaguuuagaugggccuuaaaaggguauuguuugaauauagacauuuuuaaaucaaauuaaguucucauaaaaaccuuaaaggaaaccaguuuuccucuggauacauuuucaguaauaaacauaggccuuaugaaucucuucauugacacuagaacuguucuuggguaggaauaccauaauucuaaaacuuucaccuuuuuuuagagaacauuuuagauuuuuuuuagguggauacacagcauuuauuguacuaauuuugcuacuguuuuuuuucuuucaacuuuuauuuuaaguucagggauacaugugcaggaugugcagguucguuacauagguaaauguuuuuuucacaucuuuuauaucagaaauugagacccauguuacagucaagggcaccuuacagucauggucagccuggauuaaggguguguuuuuccagagaggauggcacugguggucucaacacuaccaaggaaacauuaaauugucugcuugagguuuuuuuagaccacugguauguauucagaccacacaccucuaugaguacugauauauagcgcaaauucuaagaauaaguuaguuuuucucccuuccugcggugcccagaaugacucacauaaguuuucuucacugccccuuucugugggucagguuuguacuugucauccucacuccuuguuuuaucugaagaucuguuaggucugcauuuuugaacauucucuuuuuuuucuuuuucucauucuugguaugguauaaaacaucuguauuacaagcacuggcaucuuagaugggaaaaugauauugucauguuuuguuuuguuuuguuuuuuucauacugccggagaguccucucuaugucucucagugucaguucugugaauccuuauauugucagagggaguuaggaaggugauaaaagggugaccagucauaugauucuguagaauuaaauucacaacaauaaaaaguguggguggacugccugaacucagugauauuaucuacuucauuucaagauuuuguuguuuuaaaguuaauuuggcuuuaaucuugcccaccaagaguuaaaccugaacauucaauuauuuguucuugccccaggggaacaugaacacugagacccuuaugaaaaaagguccaggcuaaaauaugcuugagugaauccgcaacccucguggauucacccaaaacaguaaaaaaaaaaaaaaaaaaaaaaagagagagagagauauacacacacagacacacacauauauauacauagacacacugauguauuuaauauauauuuuauauguauuuguuuuuaaauuauaguauacuugcagugaaauucacccuuuuaguguauaguucugaguuuugacaaacccauaaggucauauaaucaacaauuuggucaacucaaaccacugaguguagccuauuccagaagacuguauuaauggaaccauguagcauauagcauuuuuagucuggcuucuuucuuuuagcauaaugcauuucauauugguugguguaguaggcuguaucaguucuuuguaccacuuuauuauuauggaauaguauuucauuggcuggcggugucacugugugguuuauucauucacuaguugaagacuuuugggguguuuccaguuuggaguuauuauaaauaaacucacuguaaauauuuaccuacagauuuuaacaguuuuuuauaacaacuguuccaguuuguauucccaugagaaacaugagaguuuugguugcuccacauccuuauuagcacucuguauugugagguuuggguuuuuugugaugcgagucacucagcuagguguacaguguuaggccauuuuuaucuuaauuugcauucuccagugaaaauugauuuugagcaucuuuuuauuugccauccauauguuuucuuuggugaagugucuguucaguucuuugccuguuuuuuaaguugaguuguuuguuuucucauugaguucgugagaguuccuuauguguucaggauacaagucuuucuugagauaugugauuugcaagucuuuucuuccaguuugugucauaccuuuucauucuuuuuauauaauauuugaaagagcagaaguuuauaauuuucaugguguccaguuuaucaaauuguucuuuuaugggucaugcuuugggaguuguagcuaggaaaucuuugccuaauccaaagucacaaagauuuucuccuuuuuuuuuccuagaaguacagcuggcccuguguauccaugagcuucucauccauggauucagucaacugcaggucaaaacuauuugagaaaaaaaaaauagugcuucuguacugaacaagacuuuucuugucuguacauguucaaacaaauaauacaguauaaacuacuuacauagcauuuacauuguauuaaguauuacaaguaauguagagauuauuuaaaguauccccaggagauacgugcauagccaggaggauaggcauagguuauaugcaaaugcuacauuguuuuuuagcagagacuucagcaaccacagauguugguaucugcaugaaguccuggagccaaucccacagauacugagggacaaccauaauaguuuuagauuuuauauuuagaucuacaguccauuuuuagcuacuguuuguuuaugguauaagauauggauugaggauuguuuuguuuuguguguggauauucauugguuccuggacuguugguugaaaacaacuauucuuuuucauugaaaucccacuguacuuuuguugaaagucaguugaccuuguaugugugagucugguuuuggacucuucacuauguucuaauacguaucuaauagacucugaaauaccuguccuuucaccagcccauacuguuuugauaacuguggcuuuauauuaauucuuagaauuagauacuaugaauccuccaauuuugauuuucucuuucagaauugcuuuggcuuuccuuauuuccuuucuuuaucaucuaaauuuuagaaucagcgugucaguuucuuuaaaaaaaaauacugcugaguuuuuuuuauaauguucuuuugaauuaacuuuaaagauguacagaaaaguaauacucuccauauauuccucacucuaacauucuucugauguuaacaucuuauauaaucauaguacaauuuucaaaccaggaaacuagcauuaguacgauaccauuaacuaaagaacuuauaugaauuucaucaguuuuucuaucaguguacugcuuuuucuguuuuaggauccuauuuccuauugcauuuaguuguuacuucuccuuagacugaauuuugguuccacuugcauuagauauauaaauccauuucaggagaacuaacaucuaauauugagucuucuaacccaugaacacaauauuuucauuaauuugucuucuucaguuacuuucaguaguguuuuauaguuuucagcuuacagaacuuguauguuauuagauuuauaccucaguauuucuuuguguguguguuauccuaaauaguacguuuuuaaaaauuagaauuccacuuguucauugcuaguauauggagauacaauugaucauuauauguugaccuugauucccaugacuuuguuaaacucuuuuaggaggauuuuuauagauauuuuuagggauuuuucuguguagaaagccauguuaucugaauaaaaacagauuuuucuucuguacuaauguguagugccuuuuaucucuuuuucgcacuucuuugcacuuuauuuuugagaccgaaucucacucugucaccaggcuggagugcaguggcgcaaucucugcucacugcaaccucugucucccggguucaagcgacucuccugccucggcccccccccccccccccaguagcugggacuacaggcacgcgccaucacacccaacuaauuuuuguguuuuuaguagaggugggguuucaccauguuggccaggauggucucaaucuguugaccuugugauccgcccaccucggccucccaaauugcugggauuacaggcgugagccaccgcgccggcccucuuugcacguccaauacaguguuagauagcugucauaagagagggcauccuugccuuguuuuaaauuuuggaggaaaagcauucaaucauucaccauuaaaugcugugguagcuccuagggcaggaguguccaaucuuugcuucccuggggcacauuggaagaagaagaauugucuugggccacacauaaaauacacuaaugauagcuuuaaaauaaaaaggcaccaaaaaacuuaauguuuuaagaaaguuuacaaauuuguguugggcccaauucaagcuauccugggcugcaugcagcccaugggcugcaggauggacaagcuucuuuaggguuuuuguagguguucuuuauaauauugagggaguucucuucuauugacuuaguuuacugagauuuuaaaucaugacuugauauucaauuuugucaaauuauaugcugcuguugagaugaucuugugcuuuuucuuuagucuguuaaguaaauuacauugauuugauuuuugaauguugaacuagaauugcauuucuagguuaaaaacuacuugcucaugauguguugcccguuuuauaucuugccucgauucaguuugccguacuuuguggaaaguuguguuucuauguuuacgaaggauauuggcuuauacuuuucaagucuuuaugugguccugauucaggguaaugcugaauuaggaauguucucuccuguaugucggaaaguuuauguaacguagguauuauuucuuucuuaaaugguugguagagaauucuuuuccacgagugaaaucauuuaagcucgggcuuuucuuugugggaagauuuuaaaccacaaauuaaauuuuaacugugugcacgacuauuucaguuugagugagcuuuggcagauugugucagaucuagccgacugucaaagaauguguccauuucuccuagcuguuaaauuugugggcauggaguugcuuguaauacuccuuuaucauucuuuuuguguguaaaguguaugcaaugauguccacauuuuaguuccuuauauuuuugacuucucccuuuuuaucacagucacucucuguagaguuuuauccauuuuauggacuuuuugaggcaccagcuucgguuuuauugauuuuuuuuuuuuuuugcuacuuucuguuuucuauuucauuaauuuuuacucuuuauuuuccuuccuuuugcuuacucuggguuuaauuuauucuuuuucuagugucucaaaacagaaauguagauuauugaugugaaacauuucuguucaaaauaagcauguaaugcuauaaauuuucuuccaaguauugcuuuaccugcagccuacagauuuuaauauugugcuuucauuuccaaucaauucaaaauauuuuauaauuucucuuguuacuacucauuucacccguggcuuauuuuagaaguauguuguugaauuucagacuuuuugaggguuugccggguaucuuucuguugcuaauuucuggcucaggugugaauagcaccagugucuacagcuuccagggcuuuugugcucccgugcaaguucacacagucaaccucuagcaauguguaaacauguuagcugcauuucuagcugacacuccuguaugauagccucaucuucuucccuucucugccaugggugagccaguauucccauucuaucuguccuuggaggugcuugucuuuucuacgauuucaggcuaguugauaaucucacucugugauggguucaagaaaaguugugaauuauuguaauuauucuuuuguugcacuacauuaccguaauauaaugcaacaaaagaauaauuacaauaauucacaacuuguaaguuacucuuuuguuggugguaauguaggagacauacucucgcuuucuucagacuaaggugaagccagagucuuacuaccauguauuuugagcuaucauuuagguagcauuuuagaguucuagccauagaggcagaaugagagagguugauggcuuuacauauuaaaaugcacuuuaaggcuuuguuucagggcagaaccgcaauuucagucucuugaacaugggaguagcccuauuguuuugugguaauaacauuuuauuuuacuaacuauagugacauucuuaaucugcagaaaguaacaggagugaguuccugcacauacauucaccccugccuucuuuccuauuuaaguugcugggacauuuuguuccuuguguggauggaaggcagauuucauaagguugaggccugggcuuauucuuuggacuaaaacaagucacugcuuaguaguacagcaguauaucuauaugaaaacucagccucaacgcaacuccuaucugauugucucaucguggaacagccuguaauuagguacuucaugccagccuagugauuguuaaaugaacagaauccaggaaaccaucuguuguacaaggcuguggcugguaauugacaaagauaugugacuguagacauucaauauggaagacaucuuuuuaauuauuuuccacugcuaacuuaaagcuuaaacuuuuaaaggaaaaacuaguuuauggaagugauucuaagaaacuuguuuaaggaacuugagcuguauaauuuuuuuucuuguuacaaauuuaacuuuauuuucuguuucagaaaauucuuccaggaggaaauacaucauuugauguaguuuuucuugcaagaguaguaggaaauguagaaaauacuuuauuuauuaauacaucuaaucaugggguauuuacuuaccagguaagaaccagaauuaaaacuuauuuuauacaauauaaucauuaccucugccuuaucauaugacagccuuuuaagaacucaggaacucaaaggauaauagaaaauguaggaguuuagacuuagagcauuuuuauacuuacagugaauaucucuauucaauaucucuauucaaaucagacugaacaggugauuuuaaagcaacagcuaaaguguuaauuuaagauugacaaaagaauagugaaaaaauauuuucaugcugacuuauaaaauuuuguuuaauuuuuacuuuuacacacuuaugaagcauacuugauaauagugucaagauuaaaacauucaugucuacuuuccuuuaguagguauuuuuugauaaacuuauuuuuacauagaauuuugguuuaggucauuaaagaaaguuaauguauauaggagucauauaguaaaucuuuuuguauaucagccauuauucuguuugugaaucaagauuuuuauaugucaggacuaaggcuggguaugguagcucacaccuguaaucccagcacuuugggaggccaaggugggaggaucacuugaagccaggaguucgagaccagccugggcaacaaagcaagaccucaucucuacaaaaaacauuuuuauaaauuaacugggcacaguggugagcacuuguagucucagcuacucgggaggcugaagugggaggaucgcuugagcccaagaguucaaggccacagugaacuaugauuacaccacuguacuccaccuugggugacagaucaagaccacaucucuaaaugaagaaaaacaaagauucuuaacaauaauugcucauauuuguccagcaguguacuauacaugcccuucuaccuauguuauagguacaguuauucuugaaguuuuaaaagguuaaaucauuugcccaagucaugcuauuaguaaguuguugagggggacucaaacucaugucuuuguaaguauaaagaccauaaucuuuaccacugugcugugcugccaguggaacuugaguguuagcucugacacauuacuuuacaguuccugugcuuuuuuuuuuuuuuuuaaacauuuccuccccaguacccauuaacucugacauaucauauaaaauaagggucagucagagucaguguucccuuucaguaaggacugugucuucugcuuauguauggugaguaaaucuuuagcgguugcuuaguaggcauucaguacgcuguugaugguugguucaguaauuuugaagugcuagacagaucuuacccauuuagcauguacguguugaguaaaugaaaagacuaucauaaaaaugaaggucauugccccacgauggcaucccacaacagaccuaggugauggcagccaaucuggacuauugagggucaugaucagguuguucucaaggugaccccaauggccagcugucuucuuucuuuaccucuucacaucuagucuuucaccaaauauaucuccagucuguuuacuucccuccuccucacuaccacugcugucuuccaggccacucucacuggauuacacauuagcugucugaaugcccuccacucucccccaacacugucuguuacucacucucuggcagagggauuuuuuuuuuaaaucuuuuuauugguauccagucugucuccaauacuacgauguaaguuucaugagacccagcacauuaucuguuuuuuuacuguugaauuguucacuauuguauaugugccuagcaccucauagacacuuaauaaauagcaauauauuaauaauaucauuugaauuacugguuuacccugcuuagucaaccuagggccaucccaugugggaaugaccuggggcugggcuugguauuugagagguugucugggccguagauccaucuucugaugguuggggucaggaaaucuuuugacucccuauuuucuucuuuugucuauugcauggcuucuugaaggacuguuauucaauuucuaauauauuaaagaaaucauucuaaauucacauacauagucaaucaaauauguagccaaaucauguacagaaacaacauuuguggggguuuuuuuuaaauaaagggauuguuaauuuuuuauacauaaauuagauuugccagucucccuagaucagucaguuauaacuaaaaauauuaauuauaaaagcaacuaaaauugcauuuuuuuccuccacugaaacagguauuugguguuggaguuccaaauccauaucgauugaggccguuccuuggggccagagucccugugaauagcaguuucucaccuauaauaaacauccacaauccucacagugagccuuuacaggugaguuuaugaugguaauuuugaauaagcuucauuuuggugggaauuaaugcuuagcaugaaaucucaguuuguuacaguuuccaagacuauuuaaaauaauaggguuuuauaguguauugagagggguauuacuuuuaguacagcuugcugcagucugaauuuuggaauacagcagucugaauuuuggaauacagcagucuggauuuugaauuuuuugaaucauuuuuaaaacgacugugucuucucugguguuauaguuuaggcagcucugcauuuaaagaagaguuuuuagcuacacaaggcugcuuuuuuucuugccuguaaacacuuucuggcccaauauccauguuuuuuaaaacaguucaaguuuauuucuggaaauaauaaauuuuuggugauggcaaccuagaaauuaaaauucagggaaaggguaauauagaauuaugcuuaaaagcaagcuuguuuuuuuauuuaaaaaauucaacuuaucuuaccuaaucuucuagcaguaauuguuuucaagugugagauuccuccucacuagcuccuugucucuuucacaguggaaguggcuagugucauuccuucagagauuuucugaaaucucuaccuuacauccuagggacuuagcugugugacaugugcagccucuguggcuucuaguuguguugucuguguuaaaaguagaugugaaugcuuucuagaauaguccagggugccagaguucuuucggaccaacacugcaggacuuaaaagcagcuugaaaaugacagguggaggaaaaauacuauauuuugugguaaguauagggcuuuggcaacuaaaauggcuguugucccagaccacccugguauaacuguucauaaacaauggaagaggaaaugaggaugaaccagggaaauguucagagccugaauagugaaaugcuuagaaaugauaagugaaagcagcacgaaagaaaucucuccccaacacuuggcaacaacugggugaagauagccccaguuuuaauuuuuguagcuggaugucugcaucacagaagaaccuguucuuauguccugcuuuucaggugggaaguauucccucuuauccucaccauccuucuguuguuuacguccuuuugauacuuuagguaaugguguaguuucccuguucuggcuguuauuacaaaucuauguagaaacuucagaaauucuugcugcuuucuuuccuguuuuuacaaaagacagggucucacucugucacucaaacuggagugcaguggcacggucaugguucacugcagccuugaacuccuggccucaagcaauccuccugccuuagcuucccaaagugccgagaugacaggcaugugccacugugccuggccucuuacuccguuagacccgacugcaugaguugccccacugugccguagaagggcuguuaacagggugccccaagggugcugccucauugugguggccagaccacaaggauggagcuugcaggacucagcagauguuggucagucuacaauugccagaguugccuuacagucuguaccuuuucucuucagccuuuggaguuaccaagcccagcacagugaucacuucgaauucaauucaucuagucuuuuuccaguuaaaacauuuuaauucaagauuuacacaagagagcaaauggaacaccaaaguuacucucuuagaaccaaauauagauuguuuaccugggaagacacucuuacccuuguaguccaguguuacugugugucacuagucuugucaauauuacaguaagaaaagauuguaaagcgagaaaauguauaucguuuguugauuauacaacauaaacacaugaguauguucuccucaggaaaaaaauguuaacaauucaaacaugaaugaagcaaaaacgucccuuugaacuuccuacuucccaguccagcuguccagcagaacuuucugugaugauggaauaguuccuuuccugcuuuguccaaaacaguagccgcuagcuacgugugacuguugagcucuuuaauucagcuaggguggccaaaauguuauuucaacuaauuuaaauguaaauaaccacauguagcugauagcuauugcauagacagcauaguugcaguccaagcccuuccucguggacaccacuuuugccaccuuguauguaucauucuagaccuuucucuugugcaugcguguaugugggcacagaaacauuuauugugggaauuuguuuacacauaauauauucuguacauaauguuuggcuuccuuuuuuuccuaaacuauacuaaauuagaacaaauagcacuggacuaaaaauaaagaaugugucagguuccuaguuuuaguguaauuauuuguuugacuuuguaauuuagacuuuuucugucucuauuucuuuauucauuuucucuguuaucaguaggcgacuuuuuaaucuucuggggguuuuuuugguugguugguugguugguugguugguugguugguugguugguugguuuuccagacaccaggcuggagugcaguggugccaucuuggcuuacugcagucuugaccucccaggcucaaccaauccuuuuaccucagucuccugaguaguugggacuacaggugcacgccaccacaccuggcuaauguuuuuuauuuuuuuguagagacagacucucacuauguugccuaggcuggccuacaacuccugggcucaagugauccccgcuaccuuggccucccaaagugccgggauuacaggcaugagccacugagucuggucuaaucuucuguuuucaagcauuguuaugcuuguuugcuugauacuuggaaggauugaugaaauaaugugugauguuuucugguuuuccagaaaaaguucuauagucauccuaucauuuaaggugcuauuauuauuaacacaauaagcacuauagaugagcacuguaacaaaucagcaggcaaguaauaauauacaaagaaaaucuauagcuuaucagucuuugguaaaugcauuacuuuuacagcagcaacuccccggccccugccaaaaaaacaaacaaacaaaaaaaaccuuuaaggguccaggcgcaguggcucaugccuguaaucccagcacuuugggaggccgagauggguggaugacgaggucaggaguucaagaccagccugaccaacauggugaaaccccaucucugcgaaaaauacaaaaauuagcugggcguggaggcaugugccuguaaucccagcuacucaggaggcugaggcaggagaaucacuugaacccaggaggcagagguugcagugagccgagaucacaccauugcacuccagccugagcgacagggcgagacuccgucucaaaaaaaaaaaaaaaaaaaaaaaaaaaaaaaaaaaaguuuaagcuuaagaauugccauuuuucuugcuuuauccuuuuuuauucacuccuggaggacuucuugugaugaaacaagugaacguuuccacccauucucauacuucaccccaaauuuaauugaauuaaauauauuuuuucuuuuuaagaauuaggguuagcuuaccuuuaaaggaaggucuccugccuugugacccauuuuguguauauauauuuacccaaaagaaaggaaagcagaugaccacaccaagacuuguacucaguauccacagcagcuuucucuuuaauggccagacauuggaaacaacucaaaugucccauuaauguguggauugaaaaacugcgguauagucaucaaauagaagugaacuauuaaugcauaaacaaagugguagaccucaaaauaauugcauugagcaaaagaagccagacacaagaguauauguuguauuauuccauuuagauaaaacucuagaaaauaugagcuagucugaggugauagagagcagaucagugguugccuagaaauaggaagggacagagaaggauggauggauugcacaaggcaugaggaagcuuuuggggauaauggauauauuuaauaucuuaauuacagugaugguuuuaugcccaaacacauaggucaggauucaucagguuguauacuuuaaauauguauuauuuauuuuacauaaauaacucaauaaagcuguuuaaaaaaaguaagcuuaggcauaagccacagaaauauuuuugcuaccaguagaaaccacauauuuucauguuccauuagaguuauuuuguauauaucucaaauauuuuuacucuuccccaucucacaauuaugguaguuauuugauccacugcuggcucuuguuauaaauguauggauaaagaagcacuuuguguuacuguaagaaauacaaaauuuauguuuccaaaacuugguaauuuuuguaagugauucccuuuggaaaaaagaaaaauaaguauccuguuacuuucuaaaaucuggucucuggaacaacuaugguacuuacacuguuucuaaguuaaauuuucaaaguuaccuuauuuuaauuaaaaauacaacuauugcuuacacauacagagcacugaauuuagugauauuauacauauccuacguuuauaucuuuaaauguuuugugauaaacaguuaggaugucagaauuauuucuguguaauagcaagucaccugcuuugagaauaugacuuugaacguagccaucaugugcucuuuugccccagguuguagaaauguacucuaguggaggagaccuucaccuagaacucccaacgggucaacaaggagguaccagaaaacugugggugaguuguaaccuaguuuucucuugugugugcucccaugaaaccgauuauucuuaaauuagaaaauauuuaacuccuuaauaggcuuaacaaauauggaugacuucucuuuaaucguugucuuaauguuaauuuaugucaaguauauaugaaaauuggaggaggaaagaauauaaguaguaauuuuuggaaagggcagugaguaaaauuggugggaguucuaccccacuacauggaaagaaaguaacuucagcuauucuuccuccgaauuauauggguaaaguugucucugagucugauaauuuaugaugugcuuuacacauaaaaaaauguaaaugauuaaaaaaauguaggaagcauucauuauguuuuuguuuuguuuuugaagguaaguaauugaauguucagauucaccauugguaaaggagauggcauuugcagagagaaccuagucaagugccugcgauaacuuagaaaaauuuuaauucuugaaggugaucuguguucaccuucaauauuguugaauauuuaacaauauuaaccaaauuaaagaauauguaagagaaccuuauuuauaaagauucuugccauuugugaguuuuaaaaauguuuaccaugcuuuaauucaagagggagaaggcaauuguggucaauucaguuccauauccagcucacucagaucacugcucaucuguaauggaggaacacaaauuuuacaaccaggaguaagguuugaggaucagaguuucuuuauuaacugcuguuacacacacacagccucuugauucugucuucugaccagucuugaccacagaagagauguggagauuauguuuuuagaauguuaauaugaacaucuagaaacaaauuuaucagccaguuauuugguuaauucccagaauauagaaacacaaccagcaaaaagaaauaugcaauggacaguucauuuauauccuuucacaaaaauguuucaccuugaaauugugguguuugagggaaaaaucaucuauaaaacaauccuucagaggauuaaauucagacuauuauaucuguauauauuauucuagacagaacuaagaacuuccugugaaacauaauugguaucuaauaaauaaaccuaagagaauucagauuuuuaaauagucaagagugauaaugauaacagagaauagcauguuuuuauaguccuaguggcugcaaaaaaagauaugguaguucuuauuccuacaaaccuagacugagaaaaaagccaaugggcugugaccucaccuccagccuauuucgguguauaggugaaaaccccagagaccaagucaacucccuagagcuggggaguggaugguccaucccuccaaucuuaggagggucccaaucaccuguuuucuacuuugggacuaaaaaagagaguagggauaagugaaggccacuaagcuguagaacacaagaaucuccuaaaauaugcugaaagguuugugcagagaagaaauucaggcagucccagggagccauauuguucugaaaccaggaaagagauuacuccucaaaauuuuuuuuccaguaagucuuccuuuuaguauauaaauguucucucauuacgggacugaaaauguaugcugucuuacaugaaugcaguugguaaacuguggauuuacuugagaagcuuugcauuguuaaguuuuccaugaaagagcaguguaagcccugcugguuaucauuuaugaagguucuuguggacuucuagaaaaguauuuaccucugauggugacauuucuguugguuaaauuucaagacugaguuauauacccaaacaccacuaacuagcauauuaaaaaauaacugauuuuguagauuaguuuuaccuuuuaauggugauuuuguaacugacaauuuguuuucagaucauuugacuucuuuugcuuugccuaccuuacauaucguauuucaucaauucuaaacagcacauuuuucacauuuuaaaguucuccagaaauggaguguguguuacauauugguuuaauuagcaaugcauuuuuuuuauuaauagguauauagaauacucaucuuucagucagugucauccaguucaauaaaaaauggugguuuugcuacauuacaaaagcugugcuacauuauggucuguuaacuugucaggaaauuccuccuuaugaaaccaagggagugaugagagccaguuuuucaucuagagaagcagauaaucacacagccuucauaagaauaaagacuaaugcuucagacagcacagaguuuaucauucuuccuguugagguugaaguuacaacagguuaguggaaaacugaugaaaucgaaaguuguuuuguuuucaguauagcuuacucuggcaaagugaaaaauaauuguugacuuuucuuuuuuccaagcuccuggaauuuauuccucaacugaaauguuagauuuugguacacuaagaacacaagguaaaaaaaucuuuuaaaagagucuuuauggaguuuuuuuuuuuuuuaaccccuguauucagugcugaauggcucuacuauguaauucagcuuuaaacauuauuucucaguugguugcaugaucuuguacaaaucuccuuuucagacucagcgccuuuacagguuuauaccccauuccgcugagggguggguggcauugcuuaacagguuggaaaacaaggccaugggauaauuuaagucaucuaaauggaagauugaggcagaaaauaguuuucuaguuucuuaauccaguugcucaucaguucaguuacgcugaaucuugauuuuuacuucuggauuuuguuuagauaugaguuauuaaauuacauuuugacaaaauguugaaaguuuguugcagcuguucagaaaacucaaauucugaaauuaaaaacaacuaaguaaagauuuuugcuaaggaaaaacuaagagcacuuguaauuugggauguauauggacuauauauaauaauauguaguuaagauugaagaccauauguuuaaaaauuagauuugcuguuaguauauuuuuacauuguaaauuauuaauuugcuucauuauguuuugcuggaaagcuaaaagauuaguaaugucugacuucacaaaaaaauaauauuuggggggcugggcaugauggcucaugccuauaaucccagcauuuugggagguggaggcaggcagggcacuugaggccaggaguucaagacuagccuggccaacaugacgagaccccaucucuacuaaaaaaauaauacaaaagucugcugggcauggugguacaugccuguaaucccagcuagucaggaggcugagguaggaggaucacuugaacccaggaggcugagguugcagugagccaagaaugccccacuguacuccagccugggugacagagcaagauucugucucauuuaaaaaaaaaaaaaaaaaguauauauuuugggguuuucaaaaaucugguuuaagagggaacaguucuuauaauacacaauguccuuaugaguaaagcaauuaccaccuaauguuucuuuuuauuaaucuuauugucauuguauuucacaaauugauagcuucaauuugauaucuuauaagguaaagauucuaacuuggcuaaaaagcaccuuuuuaagaaauauuucuuuuccucaauuuuaacagaucuaccaaaaguuuuaaaccuucauuuauuaaauucaggaacaaaagauguaccaauaacaguaaguuuuuacuucuuuuuuccccuaauuuguauauucuuuguuuuuaaauguaugacaaaguuaaaaauaauuaaacccuuauucuaaaauaauuauauuuggugaugaccuggugacacuuugguucuaagugugaugugagaaaccuguucugccccagccacccggauuuuaaggaugagagagaaaugggcaaucuuuucaaaguaaguuugaaccaaaguucaugaguuucuuauacaggcacagucauauaaaaggccuguucugauaaauccuaaaaucugugggccauguguauagaaaaacagguuauaaggauuucaucagauuugguuguuggaguuaagguaugggcaggaaagaggaagaagagucagaugaauugggaagaaaauaagcaaaaaaaauguuguagguagugguaaagugcuguuaacacuugucacaggcucccuaacuagcaguuauugaguuaccguaggcagcacauuauaaacuaaggcccucucucccucacacauacauacagaguaaguaacuuuuaggccauauggaauugaggugccguuagauaguuuuaggaaaaaaagggauaucuaaguuuugccuuggcccacaacgucucucccugaugagguccccaagauauauacauguguaaucauuauauaggaaaauaggacauuuuuauuauaauuugugcugaugccagaaacuuaacuucagugaacugacaaaaugaaauauagaucaugugggcuugagauuuaagggaccuuuguccaucgauggccauacccagauuuuaucaccagcugguggaguagaccaaagagagaagaauauacaaaccccagcgaggaagcaagagauggucuucccagguaaccacauucugaugcgcagugaccuuccucacuagugggaccgggaugcaggcauugucuucauaucugaccuagcauuucuccuagaugggaaagugccuuuacuuagcccaagcaaaccagccuaacuuuuuacguacaauaaauggacugaaacaaguaucuuuuucaauaaacauauuauaggaaaaugaaauuggcaauuaacccuaagaaugugaaugaagaacuaguacucaggucacuuaugacauggaauuaaauaggcccauguuuguccuuuuucuuauucacuaaggaguuuuaggauauauuguaagugaacauuuuugcucuuacugggucaggcacuaugcuaguacugcuauguaauaaauguauuacuuaauaccuauauggugcagugguccuaguuuucuagauaggaaagcugaguuagagcugcuuuuuuuuuuuuuuuuuuuuuuggaagugacuuacacaacuauaaaaaaugcaaaaauaggccaggcaugguggccucacgccuguaaucccagcacuuugggaggcugaggcugguggaucacuugaagucaggaauucaagaccagacuggccaacauggcgaaacccugucucuaccaaaaauacaaaaauuagcugggcaugguggcaugugccuguaguaccagcuacucaagcugaagcaggagaauugccugaaccucagagguggaggcugcagugagccaagaucacgccgcugugcuccagccugggcaacagaccgagacugucucaaaaaaaaaaaaaaaaaaaaaaaaagagguaugugaaacaugaaaguauauuauacagugucacuuagcaaucacaucuuuaugaauauaucauuuuaauugcauagucuauuucuguuaaaaaccuauauaucuguuaauauaauacaucuguaccuacaucuguaccuaccuauguguguaucuuuuauaauauccaaagcccaaacucugccaguguuuugguaguuuucucuuauucccgccuucauucacccauucaauaaauauuuaaugaacaucaacuguaugcuagcugcuaugcugacugagaauacagcagugaaucagaccacugggguucccuaccccaucaagcucacuguuuaucagggcucucuggaacucugggagauauuuagauuuuauucuaaguguaaugggaaauuauuacaggauuuuaaacgagagugacaucaucugauuuauguguuguaaaaggucacuguagcuacuuuguggagagugaacuuacagacauggaagggcagaaagcaaaggagaccacuugggaucugauuuagcaaucagccugagaaaugaugguggcuuagauuucccaccuuaucagcuauggggcaagcccaccuaccguggaaacugaguuuucagagcucuucuuaagguuuucccuguguguuucagcauuuucugcauaauucaccaggcuuagagacuauagauauuuagaaagguuccugucuccuuuuguuucacaaacauagaauuuucaggauuugcuaagcagugcuagaagcuggagaucuuuuuuuuaaauuccccuucagggaauucauucucuuucuaaauauaggauuacuaaagcaagcaauuccaaauagaaguuccucaacugcuaacagacaggaugcgcagguccaaacucuccuaauaugucuauaaugcaacuuugagaaaauggcuuuccucagcauuuacaaaacauuagugcuguauaaaugauggaguaaguuugccugagaugccuucagaggaauguuugcaugagguuucccuugguaauuaacaaaucggaaucauaauaucagcuuaacauaugcuuuagugaacucauacacaaauuauuagaaauacaauguuaaaugcugaaagugcuuuuuuccuuauuugcucaagugcuuuuauaagcaguuuuagaauguuccggaccguugaauuucacuugaggguuacugagcauuaguugggucugaauguugugagaaaagccuagaacuauauuuagaacauaugcaagcuugcgaacugccuuuccugggaaacuugcaauaguuuuauacuucuugauuaucuuugaguuagcaauagucacuaacagguuguuguauaaauaugcuuacuacaagguguugauuguguaugaguugucauuuaaagccaccagaaugggccagcuacuuaaguguuuugucuuggguuuguuuguuggcuuuuuguuucccuggaaaauggguuuuaacaauuuggguuugguuuuuuuuuuuuuuuuuuuuuuuuaacugauaaugagugaagaauucagaccauuuguauaaaacaugaguuuucaguugaauauuucuuuguuauuacugcagcguauuuuaagguagcaauacuaauguaaaguuuuuaucugguaaggaaaaucuuaaagugguguguuucacaugaaaaaaauuucaucaacuauuuuaaauucuuacuaauagugacuauauuuuaacaaacauccuugcuuugcuauuucuggcuugguguuguacaggcugauaacacucaaaaaauauugugcuuguuguugaugaacucccacuucuagccuuuaagcauauugaaaaauggucaagccuucauuguguguccagaguugguuccuucugguggguucuuggucucucugacuugaagaaugaagccauagaccuucguugugaguguuacagcucuuaaagguggugcggacccaaagagugaacagcagcaagauuuauuaagagcgaaagaacaaagcuuccacagcguggaaggggacccuaguugccucugcuggcuuggguggcuagcuuuuauuccguuauuuggcuccccgccauguucugcugauucguccauuuuacagagcgcugauugguccauuuuacagagugcugauuguugcauuuacaauccuuuagcuagacacagugcugacuggugcauuuuuacagagugcugauuagugcauuuacaauccuuuagcuagacacagagcgcugauuggugcguuuuuaccgagugcugauuggugcauuuacaauccuuuagcuagauacagagcgcugaugggugcauuuuuacagagugcugauuguugcauuuacaauccuuuagcuaggcacagagcacugauugguguguuuacaguccucuagcuagacagaaaaguucuccaagucuccacucaacccaggaaauccagcuggcuuccccucucaauccccccucuaaauaggacaccccaacugcuguugggaauugggcaaugaucauucuagcuacuuccuacuggauaagggcaaagaagggacccugcagugguaguguccuccagaggggaacugucuaggccagucaaagggccagugggucgauccagggguccuugguagaaguuguuaguugagcuuauuugggguuccauuuguaagaccaucuguagcuugauggccucgaucguagaggaaacaaauuugacaaggagauuaaaaauacagggcccaaaggcgaguaauagcaagauggcugucacaggaccuagaaagggaagaugccauguuccccaacuccagagguugguauaagaguuggaaaggcauugaaagaguuugaaaggcguugucugauuucagaagccuuuuccuguaaacgcuguaguaucccugacugguuaguguaaaaaaacacucuucuccuaagaaggugcaaaguccuccuuucucagcagugaggaggucuaggccucagcaguuuuggagagucacugcugccaaagagucuauuugggauuguagaguaaggauagauuucauuauuucuugcaaacugucugagaaauccuuugagaguuugugguaguaggauaaugauguagauaaaccugcuauucugguuccuguagcaguggccaucucuaacccuauaaguagggguguuaguuguauggcccugugcugagacacuugagcuuugaggggcacagacccuaugucugauuuccauaagauuagaaguuaggauaauauauguuacacuuuuuuuuuuucauaauugagauuucauugguugaggaucguacagacauuucaauuuguacacaaaucuuaacauacauaacgaaauucuaaaaagccauguauuguaauuauuuuuuaaaguuauuccagugacuuuccagcuuaaaauuuggaagcaaauuuuccuuaagaggcuaucaaguaccaguaucuucacauguuggucagcuguuacauacagcccaccaguucacaacucaauagcacguacacuacauauucaaauuuguaaucuuucacagcacaguaacaaaguuauuaggaaaacaggacuaccacaaccaaagauguuacagagugcacacaauucuggcagagagagccaugaucaaagagugguuuucuuuaggaaacaauucuacuaaaaaacaacaugguaauagaaguaauuuaaaauguucaagacauuaaaugcaggacugacuccauauugccauuuaauaugcuuuguauuauaggauauaaaaacuaaccccccaucuauggaauguuaagcugacacccgagacaaucagagccucccauaauucaauaucccacacuauuuucugguuguaccaaaaaauaaacaaccagcaaaugauuucaccucuuaaaaaaaagcauuuacacuuaaaaaaugggaugaggugggauucccuccuucuuaaaaauguuucuagagcuacuaaaaaacuugcauuuacaaaauaguugauaaaaauauuccucuggauuguacaagaagggagacagggaccacugauaagacaugguauaugguuauuaaucagacuuggcuucuuucucuccugcuucaucagaggcuggacucuccucaguuuucguuuccccauuuucugcagguaaaucuucuuuaguuucuugguuagccacuucggccuguuuucccuuugcuccccuuuucccuuuuguuugcacguuuuugucugaagauuuauccuucgcugcugccuuuuucggcuuugcuuccacuuuugcaggagguuuagcugacaaccgcgccgaucuccucuugggcucuuccuuggcagcggcuucagcggagcugaccuuccucuugggcauccuggcggcggggaaggcgcgugccaggugccugcgggccgcggcgcgccaagagccuucacgaaacugggcugccuugccgcugccacuccuccccaacacuguuaacuuuuagcaaacuuuuguugaaaaccuuguaaguuugggauuuuaaaauuuuuuuuuuuuuuuuuuuuuuugcuuaucacuuacugaauacccauugugucuuuuucccuuaauugcuugggaggaaccaucuaucguccuguccugaagggaguuccuccuaggucuggucggaccuuuguauaguaauuaguuaagauuuagauccccuguuaggaaaccugcuggguuaaggauuuuugauaggaaggcuacugguugucagugaccucagugcuuucaggcuauguccuuguuuacucugacagcaaggugguauuggaguguuauaggguuacagagaagaccuucaauuaucaauuauagguuuuaaauuuacccuggcuuuuaaaggacuaggguacacuuuuuucuuuacuacuuccauuucuuuuucuuucucuuugacuucuuuuuugucucucuuuuuuucucuuucugacuuccucuuugucucuuccccucucucacuguuucucuuucucucugacuuccucuuugucucugucucuuccucucucucucugacuuucugucucuuucucucuuuccuuucugcuggucuuucccugccucugccagcugcuuaugcugcuguucucccuucuccuuccccuuuugauggcuucggcggugugagacugccaccucuuuggauuuuuguacugcgugcaauaacuccauaauuuccuugugguauuuaauggggguuccccuagagguuaggaacucccuuucuuuccauauugcagcaugggcauguaggaauagauaagcauacuugcuaucuguauacacacauuuauucuuuuucccuuucucaguuuuaaggcucagguaagugccacuaguucugcuaacugggugcugcucccuaggagaagaggcuuacuuucaaguacgguugcaucauuaacuauggcauaaccugcccuucauaucccauuuuccacaaaugaacuuucaucaguauauagguuaaguucaggauuagcuaaggggacuucuaagagaucaucucagguggcauaaaucuggacuauaauuugucagcagucaugcucgauugguuccccauccucugggagaaaaauggcagggcugagggccacacauguacauauuugaagcaccgguugcucaaggaguagcaucugcuaucuaaguaggcgguugucugauagcuauaaacuuccuuuggcaccuacuaugccauuuacaucaugaguaguccagacagugagauccuuuccuuguauuauuuugauagccucugacacuaagauggccacugccacaaccacucauaaacagugaggccagccuuuugcuacuacaucaguuuucuuacuuagguaugccgcugguugugggguugucccacgagucugaguaaggacuccaagagcuaucccugcucucucucugacguauaaagagaaguguuguccugugagaaggcuuaaagcuggagcuuguaguagggccugcuuuaagguuuugaaggcuguuucugccucugguuccuauucuacuagaugaguaucugcccucugggucuccuugauuagagcauagaguggucuggccaucuugcuguauccggggauccauagucaacaaaagcuggugaugccaaggaacccccguaacuguuuugucuuagggugaggauaagccaguauaggcuguauucauuccuugcugagggcacuggucccucuagcuaagauuaggccuagauauuugaccugcuguaggcaaagcugggccuucgaccuagaugccuuguacccuugauuagcuagaaaguucaagagaucuagaguagccugcuggcaugaggcuuccgaacugauagccaaaaguaagucauccacauacugaaggaccagagugccuggacuugagaaguggccuagaucaugggccagugccugaccaaacagaugagggcuaucccuaaacccuuggcauaagaccguccacauaaguugggacauguggucugugggauccucaaagacaaagagaaacugggagucagagugcaggggaauacagaagaagacauucuugagguccagaacagugaaccauucugcuuucucugguauuugagagagcaggguauagggguuggguacaacuggauauagaggaauuacugccucacugaugagucuaagaucuugcacuagucuaagaucuccacugaccauucgguuuuuguacuccuagaauugggguguugcagggacugcugcauuuccuuacuaagcuuugagcuuuuaaauguuuaacaauauccuguaauccuuuaugagcuucaggccuuaagggauauugccuuugauaaggaaaaguaguggagucuuuuagccugauuugaacugggugggcauuuuuugcccuuccaaauuguccuuccaaugcagagacuucaggguugauucccuccucaaguaggggacaacaaauggguaacuuguuccccauauucauguagguaauagcuccagcuuuggcuaauauaucucucccuaauaagggugugggacuuucaggcauaacgagaaaggcaugugaaaagagcaaagucucccaauuacaacucaggaggugggagaaauaccugguuacaggcugucccaggauuccucggaugguaauggaccuugaggaccgucguccaggacaggagauuaacacugagaaggcugcaccaguguccagguggaagucaauuuccuggccuucaaugguuaaacguacccagagcucagugagggugaugacaugagcuggcacuugccccgggcacccucaguccugcuguuggauuaucugguugggggcuucuggccuagagaaccuuugcccucuggggcagugugccuuccagugauugccucagcauaguggacaugggugaggggguggcuuauuuuucauuggacaaucuuuuuuaaaguguccuuguaaaccacacugauaacaagcccuaccaggugauuggccugcucaauuuucuuuccucucugaaccaccaagguuuguuugagggccuugacuaaggcuguggccuuucucugaucucgcuuuuccuuuugggccuguuccucuuggucccuauuauagaacaccgagguugccaggauuaauaaugccuccagauuuuguucagggcccagggcuugcuuuuggaccuuccuccuguuaucuguggcugauuggguaauaaacucaucuuuuaggaucaguugacccccaagggaguugggugacaggagaguauauuuccuuaagaccucccguagcugcucgaggaaggcagaaggauuuucuuccuuucccugaguuaugguggacaucauugaauaacucaugggcuuuuuccuaauucuucuuaguccuuccagaacacaggucagcagauguuuacaacuccaguccccaugaucuugagucuagaucccagugggcauccauacuggggauggcuugcugaccgguagggaauuugucccuuucuucagcugucauucuaucauuuacuuggcuaagacaccagguaucuccaaauucuugggcugcagcuaaagccgcauuuuuuucauuaaaggccaggguuugaucuaacaauagcaugacaucucuccaagugagaucaaagguuugcccuagaccauguaggacaucuguauaccuaucaggaucauuugaaagcuuccccaggucugccuugaucugcuuuaaaucagagagggagaaggggacagguacccagguugggccaaauuccucucccccuacagcuugaaggggacauaaccgauagcccggggaguuuugugguaccuuggagauuucuuugcuuguuuccuucugggugggggaaauuagaggaggcuuaucauuaauaggaaggugaacuauagggaggcuaggauauggggguaagcugagagguccuccugugggauguaaauugcaagcuuugcauaguuguggauucuccgucaaugaaaagaaagcuuagagauaagguauuucacucuacuugccuucccucuuacagaaaaggucaagcugcaggauaguauuauaauuuauacuucccucagguggccauuuuccccaucagagagagaauauugggaccaggccguagugcagaaaaaaaugagccacaucuuuuucaggguuuaugggucaaauuggucccaauggcuuaggaugcauuucaagggugagccuguugaugccugaguguuucccaucugaaagacaaaacugccugugguuuugguuuguuuguuuccccccagcccaggcacccacaacagucccuggacccugcugaucggaauaguugcacucaccaacgcagcagcagaaacacuaguuuuccuccuagaccacaaggaggaccaaggaagguuggauuuaguggcccuuaccaacacauucucgaaaaccugcacccuugccuguccuccuauaccacaaagaggaccaagaaaaaucagauuuaguggcccuuaccgacgcauucucgaaaaccuguuagaguucuaagcauucuccuguuaguguugggacuuuaccccauccuauaaagauguuaugccccaaaaaugaaguggagggccguacccugagcaagggaagggaucuccaggguuggaagagugacgccuuuuauccucacuucucaucaugugaaaaggaaggauaucguuucugaggcuccccguauccuagcuucaggaauagcuuuuguuaggccugcuagucugaggagggauccuaaaauuccagguagucccccugcccucgaaggggcuuugggcaaaaauuaugucuuugauuggugaguccaggugccuaaaggagggaauagaguccuggaguuuauacuggaaaucauucuuauaggagaaacuagaaaggcaucagagacagagagugguuuuuagaagcggaacuauccuuggagaagagaggcaagaggaaguuugucugacaggcauuaggacccagggggcaagggucaggauagauaggauagauaggcaagucucgcuugggcaacauaacuuugagaauuccgcucauggccacagucaaccaacuuuuugucgggaucccggagcugaauggcuuuccucucuguugacccucagcucagcccagaaguacaggaaaaguggaagaugguuccaggcaaaccaaugcucccaacucugaagaguuggggguuguuagcccuuucccagaaagccugacaccugugucuuuaguccgguggcugugccagucgcuuuuaacuggcugacagguguccgguauuuagcccccgaauucuaaggaaaaauaggacagaauagcaagugaaagggguccaguggugcucacugcuuggcgauagucccuuccuggucaccaaaauguaucccaugugggucgccaaaauguguccggaauuucuuccuuccagugaguucguggucuugcugacuucaggagugaagccgcagaccuucguggugaguguuacagcucauaaagguagugcagacccaaaaagugagcagcagcaagauuuauugugaagagugaaagaacaaagcuuccacagccuagaaagggacccaaacggguugccucuacuggcucggguggccagcuuuuauucccuuauuuggcccugcccgcguccugcugauugguccauuuuacaguguugauuggugcguuuuuacagaaugccgauugaugcauuuacaguccuuuagcuagacacagagcacugauuggugcguuuuuacagagugcugauuggugcauuuacaguccuuuagagacagagugcugauuggugcauuuacaauccuuuagcuagacacagagcacugauugguguguuuacaauccucuagcuagacaaaaaaguucuccaaguccccacucaacccaggaaguccagcugacuucaccucugaauuguugcuggaucauauucaguagagcaaaugaggaacuucaggagccauaucuguggaaguccucugcaaacuacagagcuucaugugaucaccuguaacaaagcuuggccucaagauaaaguggcucauuuguggggggaaaaaaagcaaaauuaacugacucacaaaauguuguagaugaugggaucucagaaaacaacccauuccccuggcugggcugcuuuuuuuuuuuuuuagaaggagucucacucuguugcccaggcuggagugcagugucccaaucuuggcucacuacaaccuccgccucccggauucaaguaguuaucugccucagcuucccgaguagcugggauuauagacacccaccaccacgccuggcuaauuuuuguauuuuuaguagagacgagcuuucaccaucuuguccaggcuggucuugaacuccugaccucaugauccacgugccuuggccucccaacgugcuaggacuacaggcaugagucaccaugcccagccaggauuuuuuuuacaggugggaaaaaugagccccagaguagaugggcagcugacucaagcucacaucucuaguuaaacauccuuuuauugcauaaagugaugccacuggauugucacauauacuucuguacugauuuccucucuuuggaaaaaguauuagcaugguaauauaguauaguauaaccaaauggaacuuuucccaguuugucuuacaguucaaacucuacuuuguuuuauuauuaaaaauacacacacucaccuuucagugaaugaagaaauuuguauuuuaaaugucgcuaauaacagcaaacuuauugauaaguaaaaauauuacaugaacaaaucauucccagccccagcuagagauccaaaagcaauugagaaggaguucuugaagaagaaaaacggaggaaguuaaaaagaguuaaaaugccaagagagccugagguccacagaaccauccuuagggccuucauuucagacccugugaacgaacacuugcugacagcccaggacuaacccaccaauggaaagggagcugcucuagcagugucuuugaucauuaucauauaaucagauccguacccugugaucccacacacaaggcacgaggaucauucucucucuccaugcucuucucaggugcuuaucgcaccuucaagagacugcccuuugauguucuguugaggcagauuucaccuuuauaaacgggcggaaaagagcaggcagggauccagggggaagaacauagugacuugcuggaucugacugugcuccuguuaaggggcuugccugauaagucucacagaaaaggacaauguucuuuucuccgggaaauagcaggcuuugacaaguuuuuaaagcccuucauaauucaacaaauacaacccacgaggguucagaccaagguucagauucaaaguaaucauaaaggaagauuauuuuuuaaucaagaguuguauacaguaccacgauuuugugauacauguuugugcaacaggaugucagaugaaggcccugcaccaacccagggauucuuguuucauuccuaccuguugaugccuagcuauuaaaacaucaauauuggaaauuucauuaguaaaacagagaaggagguuggaaucuuuuacgucccuuccaauugaaagggcuuugugucagugaggaaauaaaaaauaacuguaccuuaaaauguauuuuuaaaaagcaugcucuccaaguacaagguuuuccuguuuguuguuauuuaagcauucuggcuucaagcugaacaucccugugggcugccucagugcucaaucccauagccagcaguauagcccucucucuggauagcagcaugccucacucgcagagccaugucuagagagaaagagaaaaugccauuagaaaugaagugugcagaacuaccuuggcacugacacaccagcuuccaaguucauguuuauucuucaccgucauaugguucagauauuuccucaguauugugaauuucuuuaagagggauccauaagucuuuuucaugucgccuccacuggugugugaauuaggcauucauuuggaaaauaaguaccuuuuuuaaaugcuuuauguacucacaccaaauguaauagauucuuacacuuacaaaucugucaugcuuauucucuggucauuuucuuuuauaaagauauucugaugaaauuaauuugaaguuuuccaguguggccuacuccauuuaaagggacaacauaaguuaaacuuuucaaauuuagaguccacuuuacuuuuccaguauacuuuccaguauaaguauaaggcaacugaaccauuagucugaaauaaugccauguauguauuuuuguucucuuugcagaguguucgaccuacaccacaaaaugaugcuauaacgguacacuuuaaaccaauuacauuaaaagcaucagaaaguaaauacaccaagguugcaagcauuaguuuugauggcaaguauucaccauuuucucucugauagagugauguuauuuugauaaacuagaaagcaucuguauuaacgucuuaauauaaaaauccaaacuguuuuaccaucagaauuuauauuacugcuuagguugauccccccccgcccccccccgcuguaaaccaucaugaacucuuacuugauugauucaugagagaaaauaccacaacuuuauaaagcuaaaucaguauuagcaauagaaaagcacuagcaaauacauuaggauuggaaucauuuccauaaucugggcuagccuuuuuacacauauuauguauuauaauucaucuuaauuaugaaguuacaauauauuugaaguucugaaacauguuugaauuugagagcaaaaauaaaaaguauucuuuguaacauuuucauauauuggcuuuuauaggcaaagcagauccccuacuuaagcuaaaauaauagacuuuaugacagaauuguccaguuagcuauuauuucuaauguguauaguauacauuuugauacuugagguguuaagccagacuauaccauuuuuauagcauguuuuuauuuaguuuugccuacuuuaauuggaacauucauugaauuugcugucacaacauuuuuaaaauaaugacuuaauggcugcuuaaccauacagauaauuaaaugagaauugaaccucugaacagggcuuuuuucauaggcacccaugcaacugaguagcugcuauuaagcuuaaacuuuggcuuuaugauaaagccaucugugcucagaguccacauaguaaagcucagcuccucaucggaugagaauauuugaucaaugaauguaggaggacacuggcacacuucacacaguguuuaugagaguaucuaugccugcugcucacuguggagaguucuagggagggucuggagcagcuacggagguggggcuggccucaggguucauccugugagcucagugaggacucucaaggaauaaaaaucacauaggcagcauacuucaugauacaguugucaagaaauaguauuauagaagacauuaaugccacaguaauuucuacauuugugguaaaguguucucuaugcugcugagagaccacauucaugccuaccagugucaguaucacgagguacauugucuucccuuacagaggaggaggcggcuaauuuuuguauuuuuaguagagacaggguuucaccauguuggccaggcuggucucaaacuccugaccucaggugaucuggcugccucagccuggcaaagugcugggauuaccgacgugaggcacugcacccagccaggauaagagcauuuaggacccacccuucacagaugugccggaaaauucuccacauggucugcaagggugaagagcugcucugcaagggugaagagcuacucuucucuagcuccuguauugaccacccacuuaaucuuucccuucuugagauaaaugcgaugucauuaguguugguucuucugagaucguaggcucuaagauaauuguuucuuaaagaaauauguaaaauuaaauaacaacagcaaagggaaagcaucuuuaagagcaaaugcuacauuucuuaaaaguagguuuuuaauaucaugugaaaauccccccaccauucaccucucccacugccaugcuggauccccacacaaaauaccucugagauugcugugaaaaucagucaggaaguguguguuauuuaacuuuuaauauuguuagaaugcaccuuauauauguauuaacucugcaguguucauuuaucaagcaucuuucucaucaaaaguuauucuucaugauuuucaacagaauuuucuugagcuuuuugaccacuuuauuugcuauguaugauacaaugucaugaaaugcuuaaauguggcccuuguaaucagucuuacgucagaacaaauagugaaaaauugaaagcauccagagauggcuaacuagcaagcagagaaauaagaggcugaaugggaauuuuuaaaauggaaagucugugucugccauagucaaacacuagaugucauaccauuuccuuguucuuuuuugucaugagguuggaugacacacauuugcggaacucacauaugaauucuucacauaaauggaaguguuccuaaaguacucuaagaggauaaacauaaacagcuucuuuauuugcuuugaaaagaaccaucuaauggguaccuagauuggacccaacugaaucaauuucuguaauuccuuauuuauuuauuuauuuuuuaauuuuuguuuuuuugggucagagucucgcuuuguugcccaggcuggagugcaauggcgcaaucucggcucacugcagccuccaccucccaggcucaagcgauucuccugccucagccugccaacuagcugagauuacaggcacgugccaccacaccuggcuaguuuuuguguuuuuaguagagacaggguuucaccauguuggccagguuugucucgaacuccugaccucaggugaucuggcugccucagccuggcaaagugcugggauuaccgaugugaggcacugcacccagccaggauuauucaaaacugcuaugaaaucugaaguuuuuacuucaucuaagaugaggacaauauaauaugaugacaggaggggauuuaucuccucuuauaccaugaguuuuaggguuggcugguuuuugagaagagcucugaauucuugacuuuucuuauaccaugcuacuuuauuggugauagagcaagacuuuggccauacaagaaauguuauuucuuucucaguucaaguguaaaucagcagggcuaagugggggguaauuuugccuccaaggggauaucuggcaaugcagagaggcauuuugguagucacagcugcagggaugcuacugccgucuagcaaguagagguccgggaugcugcuaaacauccuacaguacacacaacagccuccgcaacgaagaauuaaucuggccuaaaauguuaacagugccaaggaugagaaauucugcuguaaguaaagccaaagccuguggcuacagcaaagcagcuuagguacaguguuuuaccuccugaaccaugcucaccagcuaauuccuuaucugcuuaucuuauuacaggaaauauaaaacauuuucccccuuuuguaugaaaaaugugauguuucauuuaaaauguuauaaaaaguguucuguuggccaauuuggaagcucaacuuuuuuuuuuuuuaagauuuugucaauuuacauaaauucacuaauucucuuugguaguaaaagguaacagagauuauuuuuuaugcuuccuuucagcaucgaaggcaaaaaagccaucucaguuuucugggaaaauaacaguuaaagcaaaggaaaagaguuauucuaaacuugaaauaccauaucaagcagaaguuuuagaugggugaguuucuuuuuaaaauaaauucuauuacuuuuuacuaaucaguaaauuauauuuuccugcuaaaugaccugcagaaauacuagccacguucacauaaacuugauggaauuauuuuuugaaagaacagccccaacuauaaaagagaaaaccuccuauauuuuguuuauauuuuacuuuuuuagaagaaaaggguaagugggaugauaggauuugggcuuaaaugaagacuuaaugauucaaaaaucugauuuuuuaaauauuauuuaaaucauuugaaccauuuccuuucugacauuuguuuguaauauguaagugauuguggccuauuauuaaaguauuuugacacucgaaacagaauucuuuauauuccuuuauaaauucauaaacacuucuagaauuacaacuuuuuauaaaugggaagugacauguucauuuucuauuguacuuuaaccaauaguaguuuaauacucaacuuggcaaagauucauuuuagcaaagcuccuuguaauucagugauaagcaugauuuuuuucaaaguaaagcuuuuuuuguugauaugucuuugauucuaauuguaugauucauauaauucauuagagaaugguuguuuguauuaauuucaguauuuugcaagcuaaauuuuguuuuaaaucauauagucaaucacuaaaauauuauaguucuaaaucuuuaauacaaucccuaaugcuaaauguaaauuauuacuuacaacagaagaacuuggauuuuaaauuaacacauggaaauaaaaaugauuuauuuuguucuuguuguuuuuuuuaauaguuauuugggauuugaucaugcugcaacauuauuucacauccgagacagcccugcugauccuguggaaaggccaauuuaccuuacuaacacuuucaguuuugcgauccucauucacgauguguugcuaccagaagaagccaaaacaauguuuaaaguauguccaggagcccucauacuuuuaauuuuccuggucuaccaacuaggugaugcugacacuuuguuuuuuuucucuucugucauuucucagguucacaacuucagcaaaccagucuuaauucuuccuaaugaaucaggauacauuuuuacccugcuuuuuaugccuuccacaucauccaugcacauugauaacaacauuuuacuuauuaccaaugcuucuaaauuucauuuacccgugcggguauacacaggcuuuuuagauguaaguauauuauccaucuuuaacauuuaaacucccugcccaccuuuaauguuuucagaucuuauuaggcagucguguuacauacgguuugccauuauuugugcucugcaaauugaucuaauucuccuagucaguuuuuaccuuuccagguaacuaguuuuuaccuuuucuggcagcucucucuugugauacaguugacuucucuaguuacagucucuacuuagaucuuuuccacauucugcuuucucuuggauaugcuuuuaaacuauuguaauaauggggaauauagaaaagaacuaaauagaaaaaugauagguagaaaaagaauaauacaaggaaggugaagagggauauacguagggaagagaugaucaaaaccaagaaauaucgggacaaagaagagaaucagauaguaaagaagaaaauaagguaguaaagacgcaaaguuggaagauuauauaugacacagaaggaaacaaugaagguacuccugguacagaaaauaagcagggggaaaaauuccaaacaaagcuaucuugagagugaucaaugaaagaagcuuagauaagagagaaaacuguuaggaaagauaaaaagaaagcuaggacaucuagaaauguagcccuuuaaauaguuggcaucgauuagaauuuuagagcuggagggaccuucaguaaugucucgcuccugcuucaguuauuuuguuucagugaucauuggugaugcuugcugagaccacaugcuuuuugcccgauccccuaggguuccacuaaaccucucuuaguaguuuagcuuccugccucuuucaugugcccucagaggaagaauagcaacucagcagaagccauggcuguuuucauuucugauuacucaaaagacuuucgucauacaaagcccucaacuaugucguauaaaugugugguuuuaugcauauauacaaaagcauaggaaagcauagaacuguaauuuuuuuuuuuuuuagauggagucucgcuguguuucccaagcuggagugcaguggugcaaucuuggcuugcggguucaagcgauucuccugccugagcucagccuuccgaguagcugggauuauaggugcacaccaccaugcccagcuaauuuuggggggaacuuuaauacaucuuuaauauaguuacuuucucuucauaauauuguuagaucaaugugacuuuuuuuuaaucugguucuuuuauaucuuuccaguacuuuguauugccccccaaaauagaggaacguuucauagauuuuggaguacugagugcuacagaagcaaguaauauuuuauuugcaauuauaaacagcaauccaauugagguaaaaaccuguuuuuauucuaaaucacauuuaaggauuuuaugcuuguguugugauaaucauuuucauaucuuuuuuuaaaguuggcuauaaaaaguuggcauaucauaggagacgguuuaucaauagaacuuguagcuguggaaagaggcaauagaacuacaauaauuucaagccugccagaguuugaaaaauccucuuuaucagaucaaucaucgguaaguaaacuuucuauugucuccuuaaaguaagauggaugucuaaacugcaaguggaagaucauugcuaugcuacauguaucacuauuauuuuuaugcaguucauaauaguguugguuacuugcuauuaaaaggaccuuauagguaauguaauucaacccccuauuuuuaugaugagggcacugaaacccaaagggguuuaauucugccuugucauaaaaaguucuauaacacacaaauuuuuaauuaucuuuuuguaacacaagugucauuacaggagagauucccauggguacuaaacuaaccuuguguucauugaguuuacugggaaaaagagauggcccugaacauugguagaaaauauuuucaauuaugcaauaauacgucuguccagauacugccucaguaucagugaggcaaacauuguuugaucacugugagucugcccacauauuuuuaccugucuaauaaacauguuacaguugguugucagagagcgcuaaacaagagaaaacaaauuuauuaguuucagcacucaccaguacugaaaggggaacuuggaguuuauaccuacugggaaaagaauuagaaucacaaucugugagaaggagcaucagauaaucucaucugcagguuagaauagaauuucuuggggcaguuuuacaaaaggaaaagcaaguguccuuauacacagagaguguugacaaacacguuuccguggaaugccauaggucugguguuuuguuauaucugaccucagcugcccugaagauaugaauauuaacauuacagagugacauccacagcuugaagcagagccagcuguguauacaauuguggcuccagugugccugaaagguugguggaaggcugugucccucugcuccagccccuuuggccauacagguccauggguaaagagugaggagcuuuauuagcaagaggaccacaccccucccucuuucaggaaccagcuuuuucaguggcccauggaacaaguguaguagagaaauaucaagggauggacacuauuuugagauauuuguacacagugauaugguaauucagugucauacugguauauguuaggauuuguuagucauuuuaucgcuacacccuucauguccauuuuaauaggaaacuucaacuaacaaggcuaaugaaugauaccauuucuacuaucuacagguaacauuagcuucaggcuauuuugcagucuucagagucaaacuuacugcaaaaaaauuagaggggauucaugauggagccauccagaucacaacagacuaugagguaaggacuuuauggggauucauggcagugggguuuuucugaauaagucaguccuuucuugucuuuaugaaaccaaagaauuaaguuuacucagaguuacaguuuaccaguuucauaccuuaaaaacugagcuuucgagaauaguuuauagaauauugauguucauaggcucauaguuuuuugauaaaacccaacccuccuaaccuaaaaagcaacuucagaagaaugccuuuagcacguuuagaauugcuuuguuagaaaccugcuuaaacagaugguuauaucauugcacagaccccagcugaguguccugaguuagauaccucugauuguuccuacaaucauaaauagcagucagggucuaacauuucugaaaaggaagauaaaaucaggagaucauguccuaaucugagugcucacauuuauauuuucaugagucauucaaagucaagggacuaaagguuacuaagcuuuuaauuaaaauauucuguguggagcuuauuuugcauucaguaagauuuugaauggauguauuucugccagaccuaaauguuuuuaauuguauaucuaaaagcucuuaggaaagucaagcacuguuaaauucaacaacuuaccaccuuugcccucauagauguuuucaguggacacaacucccacguggaaaaaaaauguaauuauaaaauaaacagaauuggccauuuaauaauaaaugauuuguugagaguaugucaggugaggaauucaugguuaucacucaugacagaaauaaguacauuucagaauucagauaaauuuuuguuaauaugggugaaaauaagaauuaagaaaaauacccuagagaaguagcuuugagaguuacuaacaguaugggaugggauucuaacucuagaauguucagugcauuuuuaaaaauuagguugaugucuauuucuguaucaaaaaaaaagcuauauaacucuagauaugcuggauuuuacauacauuguuuuaggaguacaguuugacuuucuuuuuuaaaauaaucuauuuuuauagauuauuuguauuuugaaauacaaaaauauuuguauuuuuaaaaaaucugucuucauugcuuccccguuguuuagucuuuuuuacguguuuucaaugaaucacugagaaaucuguggaaauguguuauauuucauuacauuuuauggaguacauuggacagauuaaacaguaucuaugggugauuuuaauauugguauggagcugguuauugucaauauuagucccaaaauuagguuaaccccaaaauauaaugcaauaguuaucaagaucaggcuaagucuuaacuacuuaucuaucaucaucuucuugacuucacagauccugacaaucccugugaaggcugugauugcaguaggcucacugaccugcuucccuaagcacgugguucuuccaccuuccuuuccaguaagaccauuaauacacacauuuuucuauugcucguuuuuugccuuugccuuuagcucuguguuccuagaaucuuagaguaaagucaguuauucuuuauuagucauuuauuuuaaagacauuauaccagguucuuuagaagauguaaagagauacaguccuuuuccucaaaaaguuuucuaucuagaaagggaaauggacccacaauucagagcuauaaagcggaauguagaaguugcccuaagaggagugaaaauaaagugcugugagggaaauacacgucucacugaugcaggggcuaugggagccagcuuagaauuucuuccaacagagauggagaagggguggcagagacgugaaucuagggccagggcgcaagcucaacagggaugcagaggcaguaaagucugaaguugguucaggcaauagugaguuguccaguuuggcaagaauugagaaaaguuuuaagagagaaaauggaauggucugugggggugauaacauggaaaaaacuuaaaugcacuuaaguucaugggaauaugaaguuuuugagugaagacuugacaucaucagagcugagcuuuaaagacuggcucucugcagaaagaaauagaggacacagaugaaaguaacaauagagugccuggaggccaacccgcagacuggccagaguccaugugaaaagugccaaggggaguuugagcgcauggcuguggcugaggcaguaaagucccuucauaccuccaagccuuuguuguuucuuugccucgaaugcccuuccuccuguccuuccuucaaagaacuccugcgugucuuucaagauucaauuccauugucaucuccucucugaagauuucuugacuccucuagacaauacugguuguuucaugugugauccuagaauacuuugaaauuaccccucuugcugcaagccucguauugugcuauaaauauuuccuuauaaguuggccuccccagugagagucugagauccucuaggaaacggaugagagaucguuucuucccaauagcaggcacuuaguacauaauguauggaugaaggaacaaaugauggagagggaacauaggcaagagacauugcaggugaaucauuugaacugugcuuauauccuaaagaggucauacaaacugaaacaaguauggggaggaggguggguagaggaggcaggaauauggcuuagaguuugagccuggagaacaaagacaaaacaaaugagaaaaccaggagaagaugcugccuuuugcaagaagauggugcaguccauucaggaauaccagggcagauguaaaagugucucacauccuagugguaggagacaguaguggguuaagagaaacaagacauugcaaaaucuuaaugcuguaugcaaguugagcaucccuaacccaaaaaucugaaauccaaaauguucccaaaucugaaacauuuugagaccacaaguggaaaauucuacaccugaccucuuguaacagguuccagucaaaacuuugcuucaugcacaaaauuauuuuaaauguuguauaaaauuaccuucaggcuaugcauauaaauguauaugaaacauaaaugaauuucauguuuagacuuggguucuguccccaagauaucucauuauauauauguaaauauuccaaaaaaaaaaucuaaaacacuucuggccccaagcauuuuaaauaagggauacucaacccuuacaguaaaaccugaauucaauauuuaacuccuuaaaaauacaaacuuugaauuacuaguuucaucacauuuaaguuugggucuuaauuaaauccucaucuuccugucauuccacuuuguacugacuauacuaaacucuucguuauuuauccaaaagagccauguuucuuccuuccauuaccuucucaaucaaugauguccuuaaucucugcguaaacucuggcagggaaaaguucaguucagaagacagcagaugacacagugaaaagccccaugaguggaauaaaugagaaagcauguguauaaaaacaagauguuggucuggauccauuuguguugcuauaaaggaaucccugaggcugggugauuuauuuuuaaaaaagagguguauuugguucacaguucuggagacugugcaggaagcauggccccagugucugcauuggugagggccuuaggcugcuuccacucauauuggaaggcaaagaggagcuggcaugugcaaagaucacauggcaagagagaagagagggaggugccaggcucuuuuuuaacaaccagugguugugugaacuaauggcaugagaacucauuacuacgaggucagaacgcaccaagccauucaugagggauccaccccuguggcccagacaccuuccauagggccccaccuccaacacuggggaucacauuucagcaugagauuuagagggguugguuuugaacugcuucagauuaagcuuucagauaucucuaggaggcuuacaggaccagauacuugcuuggaauucuaaauuaccucuauauuaccaaauccugucaaucucuuuaucagauggagaauacuagagcuuacuggaaacaauaccucagaauaaacauuucauguaacucauagcuuaauauuugaauagaauugugagagcagcauuuauaucugugagcucuuuugaucccccacacccccaagagacaaggcacgagggaaguaguuauuucaaguacgccaagugcggugacugcccgagggcuccugucggcauugcagcugcaugcccgcccucugcuggcugucggguguuuuagccucacugggcuguaaaugaggagcgcuggccucagugucacagucauugcgcccuuuuuccugugcacgcucuucacuucuguauuuuuuauuccaaauauuuaaaaaguggguuuaaucauuucagagaccucuucaaaugaguaggaaucuacaaaaaguaaaauuuuguauucagccaaaagaaagauuguaauauucuucuggaggauuacguaaauuauuuaauuuuuuaauuuaaaauuugguacccugucacagacagaagcuugugacugguaagagcaauugcugguuauuuaacaguuuuauuugugugcugggguuuuuguuuguuuguuuguuugagauggagucucacucugucacccaggcuggagugccgugguacgaucucggcucacugcagccuccgcuucccgaguucaagugauucuccugccucagccuccccaguagcugggacuacaggugugugccaccaugccugcuaauuuuucguguguauuuuuagcaggaacaggguuucaccauguuggccuggcuggucucgaacuccuggccucaagugauccacccaccuuagccucccaaagugcugggauuacaggcaugagccacugugcccagcuuguguacuguuuuaauaagauacuugacaacccauaauuucaaaagauguguaauuucucuuugauacaaaugacauauauuuuuccuaaugaagagacuuucuuuuaaaaaaaauugugauuuuguccccuuuggcuuuagauuuuagaauucagugauuucagggcauucuugccuggguguaaacaaaccuugcuuaccaaacugaaaguaaccauucccuuuaucuaaagcuaucucuguuuguaccuuuguuggcauccucaguaucuuaacaugaaagugugaauguuaacgucaaucaguugucacaagauugcaaagauuuguccuccugauuuuucuguaacaugccacagcaagaaaaaaaaguuuuuuggugagguuuuuuggcuguugauuacaauuuaaagauuaucaauugaugaacauucuaagaugucuuuugggcuuugguuuccuagaaguaugcuugucuacucugaaacuugugaucuuaagaaaauuuaaccauauacaaaugaguuuguucuuugcuuucuuccuucaggggaaaauaguucaucaaaguuuaaauauuaugaauuccuucucacagaagguaaaaauacagcaaauacgaucuuugucagaagaugugcgauuuuacuauaaacgauuacggggcaauaaggaagacuuggagccaggaaaaaaaucaaagguuugaagauauuauauuugagaauucccauugguuaacauuuuguuuuaugaccuccuguggauuugggauucaugguucuccugugccucuuuauagauugcaaacauuuauuuugauccuggacuacaguguggggaucauugcuauguuggcuugccuuuucuauccaaauguaagugaccuugcuguucucucucaugucuucacuucccccaaaauacucuuuuaguaagaggccgccacuuuuaaaguacauugcugucuuuuguuacuauagaaauuauuugaaggaaaauugacaagugaguauagaugcagguuaaguauguuuccuuguuuuagcugaacccaaagugcagccugguguagccaugcaggaagauaugugggaugcugacugggauuugcaucaaagccuguucaagggauggacaggaauaaaggaaaauucaggucauaggugagugguuuauguuuauuuauuuuagccaucuuuacaagaugacuauugaaacauaaugcuuucuaaauuauauucuuauguuagauuauuuugcuuuauagcuaagaaagaaugccuaauuuucagaaaguuauuagugaggcaucuuaaauugccauuuuaacuguauguugcuuggaaauauacauacugucauuuuucucuuuucuguggugcuuuagauauuucuuacacuccaagaaaauauuugaaguuguucuuauguaggaugacgacaguauucaccuuagacucauccauuugcauaggaaagaaaguuuuuuaccuaccacugaugucuguuaaaggcaagggaaacauuuucuagguuuacccccaccuaggcacuugguacaagaccagagugucuguuuucuuauugugaaaagaauaccuccuuccuuuuuuuuuuuuuuuuuuuuuugagacggagucucacucugucaccaagcuggagugcaguggcgugauucuccugcaucagccucccaaguagcugggaccacagguacaugccaccaugcuuggcuaauuuuuguauuuuugguagagauaggguuucaccauguuggccaggauggucuccaucucuugaccucgugauccacccaccucagccucccaaagugcugagauuacaggcgugacccacugugcccagcccacccccuuccuuucuaagugcugagcuauucgggagcacacagggcuccauucagacaggccccacaguguuucuuuggcagguaggaaaugugcaucuaaugacaaaucaauacugcacccagauucaaaaacaaaaaauguauugauuugguaguauagaaaucugaucuuuucauguacuucagaaaagaauuugacuagaauaaugauaguauggcagcugauggaaacugcucuucucaagcugcuaauuugaaauauauuuguuaguaucaggauauucccauuuaagaguacuguaaauucucaaaccauuaauaauuggaggguuuguuuaucugaacucucugcuaugaaaaguuuucuuaaggcaaaagaaagucgaauguuuacuuuaaaaagaugguuaaaaugaauacaaaagagacuuccucuaauggacuugcuaagagaacacuaauuaaaacucuccuuuguacccuguauuuccacaguggacauuauaaaggacaagcaagccccaaauguuaauguccaguuaugaacaaauaacuuacaguguuguccuaugcucagcugcuaaggggccucuucaccuccuacccacaaaaagccugcccuccucucuguguccccagcaccccauugcuaagaccuuggcucccugucuaucuugagugcacaguagaugugauauucucccugauccugccuuuguguuacuuuguuauguguguguuacagaggauuucugcuacuagucauauaaacuuguacucuuaccaguauuagaguaucauaacacuacaacaauagaguuagggguuaaaauaugcuucagcguuuagucccaggaaucuuagcuccauuuauaauauugugucuuugggaauguguucugaguucuaagcaacuggcuuauacacacuuauaaguagggagauauucagaugaggucuugaauauugcugaaaacuuuacaugugucugcacaaaacccucguagguuuuaccucuguugucaacugaugucuucauugaaucugaggacucuguuuugucuuuauaucaagggggaaaaaagccauaugccaagcaauguacugccuucucauuaguccuacugaaaauguuuuuagcacccugcuuguagaugucuagaucuuuccucuaggcacauaagauccuuuaggaucugcguaacaucauguauuaucuuuauaugccugccuuuucuaaauagguuaucuacuauaggccagcuuuucuuacugaauuuauacuuggaaagguuuuucgaaacuuacgcgggauuacauuaaugccauugguauuauuccuaagauuuaucauccuuucuauauucaguacagaaacagaggaucugugacagauauuuuggcaacucuuugcaccaauauagagacaucauauagcauuacaagcauaguaaaauauuagaaugaauaaauguguuuuuucagggccagcaaaaaauuucucaaguacauaagccuaauugaauuucuuauguucagaagacucaaauauuucauuuugauacagugacuuacaaauuguuuuucuagauugagugcuauauuugaaguaaauacagaccuucaaaaaaauauaauaucaaaaaucacugcugagcucuccuggccuuccauacuuagcucaccccggcacuugaaauuuccacuuacuaauacaaacugcuccucaguaaguauucaaagugacauugguuuuuggaaauacauacuaggauuauaaaguauuuacucuuagcuuuaacuauagaaaucuuucauuuaauguuucauuauuuuguuuaaggaagaagagauuacuuuagaaaauccugcagauguuccugucuauguucaguuuauuccucuggcuuuauauuccaacccuucaguguuuguagauaaguuaguaucaagguaaguauugcuugggaucaucacaguguuucuauguaguauugaauuaguauuuuauucacuuaaaaagccuuauuugcagcucauacagauuaauagauuugacgagaaguucuggaucuauaagguugagagaagguuuuagggagguuuagguugauacugugcaaagcauccagaaaaacuuucaauauaaggcaagaaaaaguaauauggaacucccuucuaaaaauguguaaagagaaaguagaugaaaccuuucaaauauucuaguuuugaaaagugaacaaaauauuaauuacaaguuguggccuuuaauuuucuuaaggcuauaaaucuggucauauugaucucaaaaccugacagacaauaauuugaaaauaaagcacacaccugauaaucacuccauaacucccuuaacugugauguugcuuaugaauaaauauguguacauuuuuuguuuuagguuuaacuugaguaagguggcaaagauagauuugagaacacuagaauuucaagucuucagaaacaguguaaguauucaaacuucauacuauuccaaagaaauuauuuuauaauaugaucaauauaaauaugaaagaaaauuauuggcuacucuuaaauuuggcugaaggguaaguuacugaagaagucagagcaguccaguaauuauuucagaggcaaaauaaaucaggaagaguaggugggauuuagaucaaggugaggcacauugaguaaaagguucguauuuaugggcauuaaacauuaagcccaugaagguuuguaauaauaauuacagaaauucugagaauauauagaugagguaaauauuaauacaucauugauuuuuauuaagcaucaaaauauugagcucagucauuuacauuuucauucuggauacuuuguaauuaaauuguaagccauccaugaaugcuaaacccaugacuggcuguguuuguauuuagcaugguaauaugcaugauuuucacucaauggauaaucuuuuauuuauaaacauauacauaaacugguuuguucuaggaaccaaacuauuuucuauuauuuaggccaggcugagcaaccacuaaccacacguuauuaaauaagaccuaauguaaggguguguguugggaacuuaacacuuggagcuaaggcucccugcaaacugguccaagccuuuuggccaccaugcccuuguuucugcccaaggccaaauucaaaucugguucucugauuccagaagccuugcccuuaccauuguaucauguggucacugcugaucaggaauugcuaugagccuuuucaaaccagaucccuuguaguucuugaaauacuguauucuuucccauagcuccauguuuuaaucuguaaggcauauauuagcccaauccuuauuagaauaguuuuuauaacucugucuuuaaggcgagcuuacauaagaaaguaauauucaaaguaguauuuuuuucugucaaauaauggcugggacacuagacuaaaguuuagacagucuuguauuccagccucaugcgcggcucugggaaucuuuucgugcuuugcuuuucccaucuguaagaugccaaaguaacaaauguuauuggaaguuaucuagaaggcucaguaaccagaacuuccuuucauucugcuuuucuuuuucuuuuuuuuuuucuucugagacagucuggcucugucacccaggcuggagugcaaugguguaaucucagcucauugcaaccucugcugcccggguuugugcaauucuccugccucagccucccgaguagcgggauuacaggcacgugccaccacaccuggcuaauuuuuuuuuuuuuguauuuuuaguagagccgggguuucaccauguuggccaggcuaguuucaaacuccugaccucaggugauccacccaccuuggccuccuaaaguacugggauuacaggcgugagccacagugcccggcccacucugcuuuuauaauagggagaaauuucacauaaguauuaagugagcuaauauuuaacuuucuuauuuuauuaacuacaagccauauuuacaagauguagaacacugaacuaagcacugugagagauaggaaaauaaguaagaguacucuagacgucagaaauguauucuaaauaagaaauucaggaggagguccuagagugagcuuagaguaaauucuaucucaggcaucucuacagugcuauagaaugugguucucaaaauacuuggucucaggacucccuugcagucuuaaaauuauuaaggaccccagagagguuucugguuuacauccaucaguguuuugccauauuagaaacugaaacugaggccgggcauggaagaucuuuaaaauagugauuuaauuuguuuaaaauaauaauaaaccuauuccauucaacauagguaacaucaaaaaugaaaacuaccuauauuuuaaaaaaucauuuagcaaggagaauggauuuuuuuuaauuuuuacaacucucuuuaauggcuggcucccugacuuaauagacagguagauucucauaucugccucuacauucagucucucuugauauauuguuuugaucgaaguauguaaugaaaaucuaaccugcuacagacauguaauuacaaaaagaaggaguauuuuaguugccuuuuuauuuauaacacuguacaucagucuuuuggaaaauacugguucacggagacaugcagaccuuacaaauguugccacaauucacuaugcacuauccaaaaaugaaucauccucgcuaaucuaaccaccaggcucaucaggaaacucuugaaguauugggaagcugucaugcucacaauggugaauacaaauuauccaaaauccuaaauuuugcucaaaagcuugaauuuuauuagaaacaaauacuucaguaggcucacuuauuucugugaaaauaccugccagaugcccaagucugaauaaccauggacugucugucauucuuucagacauaaacgguguuccaugagaaaagcagcuaguucagcuuccaucucaaacagcuuuucaaaacaacaugguagcuguagaaauacuuuuuacauacuucccauuguaucccacagaauauuaaagacaugcuccaggguugaaguuuuuauggcauaaucgaggacuuuuuuuuuuuuuaaauacaaaugaaugacacugaaaaacacaauggcugcuaggaaaguuugauaccacugcuuugaugcaugcuaaggggucagcaguuuuacccuccauggcuuuugcugaccaucagugcagaugccaacauagugaaaaagacaaauaacgucuaucgguauuauuaugaaaauaguuuugacaucgugguggauacucugacaggaucccugagauccccagggguccaagggucacucuuggagaaccaccacuauaaaauuauuaagguccugaaugguauacgggaggcaucacaacaucuuaaaguuuuccccaaaccaugagaguuuaaauuagcuagugcuugcugggaauauauguauaguacaucauuguguccaucaguuaaucagaguaguugauuuaaaagggaaauuacucaccaaccaucuugaagcaguuggaauauucuucugucuuaguggacuuugacagaaaggaaaaaaauagcaguuaacacuugaacaacacaggcuucgacugugcugacgcacgcauacauuuuuuucaaucaagugcagauggaaaauacaguuuucaggaugcaaaacugcauauauggagagcccuacuuuuuguaggcacauuccacaguggccaacugcuacuugaaaaaucgcagauuugguuaugccaggaauccuggaaccaaucucuggcauguacagagacaaccguauuuaccucagaagcaagaauuaaaaguaaugugcuucauaaagucuguugacucugaguuaauguuuguggaaucaugcugaagcaaguagcuagaucucuaugugugaaacacacaccgaucuaugccagggggaguagaaaacaauacaaaaugcacccuccuuccaugauagcagaagccaugaagaacugguggauguuuauagccaagcguugacaacccuucccucaaaaaaguuuacacuuaauguugcuuaaaaaccagaacgguauauccuuauaugugaccugugacuguuuuuguaauaaaaaagcaaauguuuuucaaccuuaacuauaacuggcugucaaaaagucauauuuugaauauuaaacuaagcuaugcuuuaaacuuuaaaucauuggguguuuaugaaacaguaagcguguguaaccuucaaaauaagauucaaggagaaauguauaggaauuggaaaucuuuuuacauuuaaacauucggugcagccugaagacccuucagcugguccccuucagaggggaggaguggcguggcaguggcaggaggccugagguguuggcccugguccccuucagaggggagcaguggcgggaagcaucaggaggccuggggugcuggcauugguuccacaaguguuugcuuugugcuaaugugucuagcugaucaucuuagguuuguguccuuuucuguguguggaauauuucaaauuuuuagguuaaaaacaaaaaagauauguauccaaaaacaaaugccuugugcaaacauugaggacuuuauuuggugaccuggggaagaaagccccuuuuuggacuuaauguagaauaugaaucucaucguugguuacucugugcugcuuuccagcuaacccauaucuaaacaugacagauaaaauuguuuaugcauuuaaucaguuugagaaacuauacugggcucuagaugggguguaagcgaagaaacauucuuccagagaauauauucaugacuccucucuguuuacccaaugauucaaggcucauccacugcagaguucaacaggauuuauggagggccucucucgacauuuaauuuuaaaccuaauuuuaaaaccuggagaaaagaaaucugucaaaguaaaguuuacuccaguucacaacagaacuguuucuucacuuaucauagucagguagguucugugauauagguguggguucauuuuuacuacuuacuuagaaguccucacuuguuuuaagaugaauuugcaugucuaacuuaugaaauaguuugaauucacuuuguccaaaacaugcacacacuccaugccugaugaaacauaccuuuguuaucaaaugcauaguucaaaaacaugaauggugucuuaaugugugucucuuaaaaauaaaaacuugcucuucucuguguauuuuugaauucuuaaaguauaaauucucaccauuaaauuuaauuucuauguggugcucuguaaaauaacaguagaaauugcaaaucaaaagauugugcagauuuaaugagagaaaaaucuguaauucucauucuugcauagaaauaaccugacugugauggaugcugugaugguccaaggacaaggaacaacugagaacuugaggguggcaggcaagcuuccagguccaggaagcuccuuacgcuuuaaaaucacggaagcauuguuaaaagauuguacagauaguaagucuuccuaacaguuucaaggacacuaauuucagcauuugcuuucaacaguaaauaauuucaaaaacaacauuauuucuguaugugcaccuguguauauuaguuaugaaugcuuaagagcuuaaggaaauuccauguuguguuuagaguuguuugauuuggaucuuaaaagauuuaaaguguuugcacucauugcauaccuuagcugauuuacucucaguaugaaaugugaaguauagucaacuuuugccaucuaaaaugauuuaucaaaguagauuaccucaugaugaaaucugaggaacagcugaucucucugacaugcagggaugguuuauaaccugugacauauaguaauucaugaauaauguauuuaucauuuggacugggagcacaugauggcaagauuuagucuuauuccugauuuuuuauccuuuagguuuaaaacuaagagaaccaaauuucacauugaaaagaacauuuaagguagagaauacaggacaacuucaaauucacauagaaaccauugaaaucaguggauacucaugugaaggauauggcuuuaaaguuguuaauugucaagaguuuacucuaagugccaaugcuucuagagauauaaucauauuguaaguauuuuauuuuaagguguaaugaaucacuaacuuuccucaaacucugugcaaagauauguuuucauauuuaccaaaggucuuuauccacaaaugcauucauuuguuuuuuuuucacuuaaucuuuggcuaagguauuucuucauaucuuaguuuucaaaguuguaaauuuuuuuucacuuaaucuuugguuaaggcauuucuucauaucucaguuuucaaaaguuauaaaacuuuaucuccgaaguggaucagauaaucuuagaaaucaauuucaaaauuauuuucaggguuacguuaaagcaaaagauguugauguaaauucacagucccucagcaacagagauuuguuucauacauguacaguuuuuucacguuuugcaguauacggauauguaauauuuuggucagaagacaguuuuaauaccuaucucaguaauagcugcagcauauuuuaacaauuaauugauaacuuguucuguuauaaaguuuaugcaauaaaaugcaacuucugucccuuaauugaauauuuaauuuagugaucuuuaaugaauauuuacuuaauaaguagcuacauuauugcauauaaggcauaauguuugacaccuaaagaugcaaugaggaauaagacaccuuuccucaagguacauacaauuagcaaaaaauaaaaauagaauaauugcaacaguaauccauacugcaggagaugauggaaaaaucacuaggccccagccaguugguuuguuuuuuuaaaaaagacauuauugggauuguagccugggaaaagagcauggauuuagauaaagaagaaagaaggagagaaggacaugaagcucaggaccauuuucugaauuaauaauuaugagaauuugauuauuguuauuuuuuaguguaauuucucuaauuauucacagaauacaguuguuccuauuacugaccaugggacaauacuuuuuucaucuuaaaauacggaaguugaguaaaaguaucaaacgcaaauucuguguuauauuucaaaggcuuauaggaccaguauuauaugcagacugcuugugagauauuuuuaaaacuuagccuuacuaccaucauucuguuuuagguuuacuccugauuuuacagcuucuagaguuauucgggaacugaaguuuauaacaaccaguggcucugaguuuguauuuauauugaaugcaucccuuccuuaccauauguuagcaaccugugcagaagcccuacccagaccuaacugggaacuggcucuguauaucaucaucucaggaauaaugagguauugugucuuguuucaagguucauauucauucaacauuuaacacuguugaucgagugcccacugugugccagccacuguucugagugcuaggauaugccagcaaacaagacagaacucugccuuuaucaaucucacagacuggugggaacaguuaaaacagagcccuucuuggguggcauauauaauaaacaguguucuuuaccucugaaauuuguuauacaaauuaaguacauuuuaacaucuuuuuaaaaugcucagauaaaguuacuugacuugggcauauauauaauauacuuaacacaauaguaccuaggccacuugaaacugauuagaaauauuuuuuaaauucucagugucuucaucuguucucaauauauuacuuuguguuucaagagucagauaaauucaccucuaaacuaauuuacauauuuauaucacacauccuuuagaggaaacggguuggagaguugaaacuaaaauucuucuuaguaaaagaaaaaucaaauuccaggcauuucuucuaauacacauaauuauugccuccauauaaaaccuccaugugagauggcauucuauaaaaauucaugagcaggccgggcacgguggcucacaccuguauucccagcacuuugggaggccgaggcgggcagaucaccugaggucaggaauucaagaccagccuugccaacauggugaaaccccgucucuacuaaaaauacaaaaaauuagccggauguggugaugcaucccuauaaucccagcuacuggggaggcugagguugcagugagcugagaucgccccauugcacuccagccugggcaauaagagcgaaacuuugucucaggaaaaaaaagaaagaaagagaaaaacugaugugcaaacuuuuauccauaaaacuguggguuuuuuguuuuuuuuuuuuuuuuuuuuuugagacagagucucgcucuguugcccaggcuggagugcaguggcacgaucucggcucacugcaagcuccgccucccggguucaugccauucuccugccucagccucccgacuagcugggacuacaggcgcccgccaccacggccggcuaauuuuuuguauuuuuaguagagacgggguuucaccauguuagccaggauggugucgaucuccugaccucgugauccacccgccucggccucccaaagugcugggauuauaggcaugagcuaccgugcccagccaaaacuguggguuuugucuguuaaaaguugucacagacaacuugguuuucuauuacaucauauuguacuuuaccaagaaacucugccuuuaacaucgaauuuuguugcuugucuacuaacaaaugaauccugauuuuccaauuuuuuuuaccccugcagugcacuguuucuuuuggucauuggaacagccuauuuggaagcucaaggaauaugggagccauuucgaaggcggcuauccuuugaggccucgaacccgcccuucgaugugggaaggccauuugaucucaggagaaucguugguauuucaucugaaggaaaguauguucacaugcuggcaauaaauucccuaguguacauagauuuggcugauaaaauuacaauaaaaaauaaguuucuuuucaucuuugcucaggagaaaaaaaaucuuaauucugauuacuuaauaacacccuguauggaacucugagugacuuagagcucaugcuggauacuguguuuuuauuauauugguaaggguuaaaauacuuuuaguuagaucacugaugguaaauuauaaauguucagauagaacagauguuagagaguuguagaaauuucccuauuucuugcuauuuuuucccuaguguaguuuauauuuaugguggcuguacugaugaaguugaaguuuuuuuuuaauauuagauuuuguagguugcuauuuacugaucugcaguuggucccuuuuucagcuugaacacacucagcugugaccccggucacaguaggggguucuguggagcaggcgguucaucaucccgacccagugccgggagucauaagcaguguggcccaucgguccacccacacagcagucacagcaauagaaacucagcugacguggaaaacgucagagccaaaaacaguucaaguaccucuaguaggacuucugcucaagcagcuucuucacagucugcuaacaaaacaagcccccuugucuuagauucgaacacagugacucaaggucauacagcgggcagaaaguccaaaggggcaaagcagagccagcacggcagccagcaccaugcccacagcccgcuggagcagcacccucagccuccucugccaccgccagugccucagccccaggagccgcagccugaaaggcugucucccgccccccucgcacacccuucccacccagaacgugccagcagcgcgaggcacaguuccgaggacucggacaucaccagucucauagaagccauggacaaagacuucgaccaccaugacuccccagcccuagaaguguuuacagagcagccuccaucgccauugccaaaaagcaaagguaaucaucucccacugccggagauccgugaugugugagggaaaagccagugcgugcuuaaggagcuauuaagauuauaguugugguaaacaacuaauucaguagguuccucuggcucagauuuaucuccaguguuggacuucaacuuuuccauaaaaaugcaauuagagguaucugucauaaaagauauauuuguauuucuuagauuguuuaccaaaaucagaaauucuguggacaucugcuuuucuuuucagcugccugagauuguguuauugugauagauuuagcuuuuguuuuauuguuaaaauaauuuugagcacaggaguaaaauggagaucaucugccuuuuaacuccaaauuaggauuucuuuacuuuagagcagggguuggcagacuacaguuagcgggccaaaucaccaccugguuuuauaaauaaaguuuuauuggaauagaaccaugcucauuuguugguauauccucagcuuucaugcuucuauggcacaguuaaguaauugugaccaaaacaauauggcccacagagcugaaaauauuugcuaucuggcccuuugcaaaaaaagccaacccugcuuuagaguucugcuuacuguauuaauuaccuauuucugaguaacagaugaccucaaaacccaggggcuuaaaagaacguauacucuuaucucacaguuucuguggucagggacaugaguacagcuuagcggggucccauggcccucacaggacacaggacugcagucaagguguuggccaaggcugaugucaucuuaagguucaacugaagguggaccugcuuccacguucacacaggcaguugauggugggauucaguucuucacggacuguuggacggagggcccaagcuccuccuugcuggcuguggccagaggucugucaugguuccucuccacagagcgggucacagcuuggcaguuggcucccccagaaugagcaaacaagagggcaaggaggaagcaggacggaagucacuguuucuuacuaucuaaucugggaaguggcaucccaucaauguuguaguauucugcucauucgaagugugguccagcccacacuccaggagagagaaccgcgcaagggcauaaauaccaagaggugggcaccacugggagcuuggaagucugcaccacacacaaauagguagaccaguuuguaagcuccagaaucaaaagguaaaaaccaguaaauagccucuaguuguauugcaauuucaucccuucacagccugagcuuuuuugcaucuuccuuucugucuuguggcagccaugcuaauauacauuauuccaagccuguaucagucccuuccagaaugguuuaccaaggaguuuugggcuucaauuuauacggaaaacagggaucuuggcagcccuaagaggccagaagaaacuugacaucccagagucaaggaguuuuagauaauuuuuuagucccaggaauacaaaaacuagcucuauugaguucucuuggaauuacacgcauucggauuuguaaaacaguaagaugucuugaauaugauugguuaaccucuucuacagaaauccuuuuuggcuaacccauuauuaacugagcuuacauauuuuaggguaauuuuuagaauaaucuuaagugaauacuuaaaaguucuuuuuuaauuagaucaaguuacauagcguuuuccccacauuuagggcgugaauaaaauaaaucuguauuauccuuucuuaucacaaagaaagaguugggcagucaaauugacuaccucauuccugugucaacacagucuuccaacaccagcgugaugggccaauucuauuuucagggucacucauugagaaccuaaauuuuaaaaugaaaugcuuuuuaauuuucacagugguccuagagucaaccuacuaagagauacucagugagggagcauggaugccacauuauuggugacucuugagccugugaggagacagugguuagaagcuuugcaggcgcggcuacucuacucacuauccuucccacugaugcuguuugggaaaaaggaaggagccuguaucuauauuuuuuuucuucuucaauguuuuuauugaaguauagcaugcauauagacagacagucuuuaaaaugaacuuuaaaaggugggcauugaucuugggguugcaaacuaguaguauguugugaaacuauaggcuuccagcugggcaaaaccuuuauaaucuuucaaaagccuacccccacaccccugcaaauagcagauuuacauuaaauaguaacauucucuuuuuagaggcaacacguucuuuuuuuucucccccugguaucucauacuaaaauuauuucuuauaaugagcuuauguaguuucugguuuuuggaagcugcucaggaugaccucuucaagugaauguguuuaucucccuggaucuugccuucugcgguuggauggcuugcaagccacacagccaugcuaugccaucucuccagucacugcuuccaguggaagaugaugcccagaaaugccgccuguucaugguuggccugagcagggacucuuguugcugaauaaucauuagauucuguacuucuuugguuucuccccccucuaacacuuaaaccccauggacuggacagcagccacugcaggauugagggcuaaaacccaagaaagccgugagccuggcacaguugggucucagugucuguuaaccagagaaaugauggcgucuguggccauucucguuucuggcuuuggcuuuaucaaggguagggagaggcagagagguguggcguccugaggccacguucugccauuaggcaggugcagauuauaucuugacuccgcucccuuacuaacugugugacuugggagaaaaugacuccccugagccuccacuuguuauuuuuaaagugaagagaacaguuacuccccacaucauaggauaucacuacugccaugguuauuauuggggcaggaaguggcacaugccaucuguagccugcugaguugaagguggcuguggagcaucccagcagaagcaucuguuaggaacuuggucucaaggguaagaauugggacaagcagagaauccugagggcaaggccaaacgagaaggcagccagcagauagcaugacagacagcauaacagaaagcaguggaaggugugguuagcacaugccagcaggcagggccaggcaaagcagaggcugaagagugcucgcggagccuggacuugaggacauuauuugugaccuuggaaagaacaguuugugugaagcgccaucaccucugacugagaccaagucacuguggcuuagaguaacuuucacaucagacuguuaguaguggccacuaacuagugaguguuuugggagcuuuuacucuuuaaccuguauuuucccuauuuaauuuuuaacaagaaaaaaguaugcauguauuguaugguagguuuuuaaaaaauauagagaguuacaaccaagaaggcaauauuuuuuaugaaaaaugaauaauacauggaaacauggugcuugaaaauaucucugggccaaggucagaaagccuauagagcugagacaguggugcugauccacacuugccaagguuucagacgugaccacaauuucucgugcacccuggugacuggcacugcuugcuacgguuuuccaguaaggcagcgcugggcagaaugggagcaagacccagucugugugauucuaacuccugcacugugcugccuccucgaagaaaaagagggagggggaagaaaaugaggagauaauuggugaaaccaugugcccaggugguggagugggccgagacccaguuugguagaugauaaaaggauggacaguccgcaggugugcagaugugcgugaguugguagagauggagaggcaggauacggguuuucacuugaacuugaggagucaacuugaggcagcauguggguuuagggaaguuuuuacuugaacuaagucauccucugagacugcugggggaagugguaggguagaaacacaaaauagacaaaguuuggaauagucagauuccacguugcugagaauguuguaggcccagggagucagcaggggcaggaaacuuggaucuguacgcuggccccuucagcaacauuggaggcccagccgagggccacugaggcacugccucagguuugugucacuuucucacuuguacccugcagcccaguggugaagaaugaaaacuggguaguugguggaguaggacagugcuggaguucuguggggcagggacagcaaaaagacagcgagugaggacgucacaggagugcuggcaggagagcgguggggugcugugcuggcagugucgaauuagcaacuuggggaaggaccuuuagccagaaggaaccucacagauagagaacauggaugagucaagggaugggaaauccaacagauugaauuucgaggauggugggagcaaggaauguuaggagacuaagguuuaaaaaggaggugugaguguaagguuucagaggaaaagcaguucugggcaauaccagguucguaggugcagccuuggaaaugggaugucagagugagcuagaggugagguccacaguccuuaugcaacacucugggugccucguguguuugagaauucagaauuuuggaaagguauguagucaugcaccacacgaugcagaagacuguaaaaguaggugaacaucagcagccaccaaaaauauauagucauauuaaguuuuguuucuaaaugaguuuggggaaaaaaaccuuugagaguuuuuuggauuucagauuuacagauaagagauuguccaccuguauaaggccuggggcccagacaaugggagguccaggaaaagaagaaguccguaagugugaugccagcaccccugaagccuggggaaauucuuucuggaggucacaguuggugauucucuggagguuguccagagaugucccucucaggugcugucacugauaugacagggccuaacgugggaccacauauguucagagaacccauuugcuagugauugaaacuucccugaaauaguucuuuuggguggcaauuaaaugaaaugauuuaaagugggagagaggcaacuaacuagcucagacuaacgauucauucagagcaccuagcucagacaaauucauuacacagcauguagugaagauaaagacgaaguaaaugucuaggacaugcuuuuuacauagauaauucauacuuugccuacauuuaaaacagauuagaggcaguuuaaauuaucauagcacauauaaaacaaugaauaaaagucagaaaugguuuuugguguuucaucuguuuuuuaguuacgguacuaucagcagaaaccucgaauaaaguuaguuguuaccauuaaguguuaaguugaacugcaaauuuucuggcaguuaugguugaggaaaaaugucauauaguucugaaggaaaagggggcauaggaguucaucuggaaaaaacaguuugcuggcauuaaauuccugccugaaucugaggacaucgaauaguagaacggauaucguggcucuguuacagagacuauggcaauguucuucacauagauccuuucugucggccccccgucaaacccagcaucuucacauugaaugagagcuccucaccuacaccgugccucucagaugaacacucagucacccccacaugcacagcauuuauggugaccauggguaaguauagcuagugggugguucucuacacuaaacauuuagcagccuaaguguucuuccacacacugagguuagccccaagguaccccacagucagagacaaauguuuuugucaauaaagaguuuuugguuuuugguuuuugggaguuuuguuaagacagagucucacuggcuggagugcaguggugugaucucagcccagugcagccucccagacuuaagggauucuuccaccucagccucccaaguagcuggaacuuguagguaugcaccaccaugccuaauuuuuuuauuuuuauuuuuggagagacaggguaucccuauguuguucaugcugggcucaagcaaucccucugccucagccucccaaagugcugggauuacaagugugagccacaucguaucuggccacuugcuuguuuuuuagcuuuuuauuuugagaugcuuguagauucacgugcaaauaauaaauucagagaucucuuauaccuuuuacccaguuucucccaaugguaacacauugcaaaaccacuguacacuauuacuauacccaggauagugaugcugauacagccaagacacagaacauuuccaagcccacaggaauccucaugggcccuuuucuagccacacucacuucccuccuucuucagccuaccccuuagucuggcaacuaugauuccauuuauguaacauucuugaaaugacaaaauuguagaaauggaggagauuaauaguugccagacuaaggagaacuuuuccccaaaaggaauguaccauuuugguuuuucugagucaguuuaauucucuggagauucaccagugcguuccuuuuuauugcugaauaguaguccaacuuauggauguacuguagguuuuuuagucauuugcucauugaagaacauuuggauuaugucuaauuuggggcuguuauguauaaagaugcuacaaauauuuguguacaaguuuuuguaugaacacagaacuucauuucucuaggauaugugcccaggagugaauuuguugggucuuaugauaguugcauauuucauuuuuuaagaaacugcaaaaacguuuucucuaaugacugugcuguauuacauucccaccagcaacguaggagugauccagguucuccacauccucagcagcaucuucauuuuuuucuguugaauccauucugauaaguguguagugauaccucuuugugguuuuuauuugcaguuauuuucuaauggauaaugauauugaauauauuuucaugugcuuauuugacaucuguauguuuuccuugguaaaauaccuucuucaugucuuuugcccauuguuuuaauuggauuguuuggguuuuucuacuauugauuuugagagucauuuacacauucuaaauacuaguacuuugucagauaugugguuugcaaauaauuuuuacuugccuguagugugucuuuuuauccuuuuauaguccaugauucauuuugaguucaucuuguaugaagugugaaacuuaguuuggaguucacuuugacuuaaaguggggggaagauguuaauuuuuaagucacuuuccuaauaguuacagggcuguucacaucaucuguuucauauucagugaguugugguaguaguguuuuuuaaucaagugguccaucauuucaucuaaguuaccacauuuaugugaauagaguuguuuauaguauucccuuaccaucauguugaugucuguagggucuauaggaauauucuguuuuguuucugauauugguaauuugugucuuuuuuaguuauuuuuguucauuuuuugggguuuuuggucagucuugcuagguuugucaguuuuacugaucuaaucaaagaacagcuuuguguuucauugauuuuucuccguugcuuaucuguuucaaucacagcgccuucuguucuuaucuuuguuauuaucuuuguccugcuuacuuuagauuuauuuuucugcucuuuuuuuaguuauguaaaguggaagcuuuaauuguuaauacaggacuuucccccccguuuuauguaugcuuuuagugcuauaaauuuccuccucaccccugcuuuauugaugucccacaaauuuugauauauggaacuuucaguuucauucccuuccauuuuuuuucuuuugagacuuucugugacccaugaauaauuuagaaguguguugcuuaguuuccagucuuccaagauuggagacuuuuccuaucuuucuguuauugcuuucuacuuugaauccacuuuaguugggagaaugauuucacuucuuuugauuucauuucuuuuaaauguguuaaaugauuucacuucuuuuaaauguguugagguuuguuuuauggcccaguauauggucugucuuggcuuaugacccaugggcacuugaaaagaauguauauucuccuguuuuguguggacuaguuuauaaauguccauuagagucuguugguugauaaugguguuaaguucuuuccugauuuuucugucuaguuguuauacuguugagagaagguuguugacaucuccaaauguaauuguggauuucucuuuuagauguuucugcuuuacauaguuuucagugcuuuuguuugaugcauuuacauuuaacauugcuguaacuucuugguggauugacuguuuuaucauuauaucauguccuucuuuguuucuaguaauuuucuuuccucucaaguucaucuaguauuaauauagccaccugcuuuccuuuaauuaauguuuccaugauuuuuuuuccauccuuuuacuucaaccugccuauaucauuguauuugaaguacguuucuuauagacagcauauaauuugggucaugauuuuuaauccagucugccaaucucugucuuuuuaauuacauaaguagacugucugcuuuuaaugugcuuauugauauguuaggacuuaaaucuaccauuuuauuuuuauuuuguuuucucuauuuucuuuuuccugccuuuuuguggguuacuuguauauuuuuuagaauucuguuuugucuguagcauuuuuuaguguaucucuuuuuuagugguugcucuagguauacauuauauguacauaacuucucaugguccuggggucaucauuuuaccauugcaagugaacuauagaaaccuuaucucccuuuauguuucuuugcuuucccccaguugucuuaaauauuuccucuacauacauuuagaaccaaaucagauaauguuugaauuuuugcaucagucaucaaacauaauuuagaagacuuaagauaugaaggaaaucuuguuuuauuuauauuuuuuuccuaauccuccaagguuccuucuuuuaucauuuccuuucuguuuugguaacuuccuucagccauuuuuuuaggguaggucuguuggauaugaauucucugaguuuuguuucaucugagaaugucugaauauuccugaaggauauuuucauuugaguauaggauucuggaaugacacuuguuuucuuugaguacuugaaaaaugcuuccuuuuagccuccgugguuucuaaugagaaaucugucauucuaauuguauuuuccuuauagauaaugugucauuuucucuggcugauuucaagguuuuuuugucuuuaguuuucacaaguuugauuauaaugcaucuugauguggauucguuucuguuuacccuuuuugagguuugcucuuuuuuuuuuuuuuaagucuauauagguuuagucucaccaaauuuaggaaguuuuuacccauuguuucuuuagguacuucuucagcccuuccuuuuucuccuuuccuucugagacuuugauaacacaaaugucagaucuuuuguuauaauuacacgggucccugaagcucuguucuuuuuuuuuaguccauuuucucucauaauuccuaauugucuguauuuguuuacugauuauuuccugucuccucuguucugcuauugagcccaugcagugagcuuuuuauuucaguuacuauauuuuucaguucugacauuuccauuuuguucuucuuuagcuucuauuucuuugcuguggcuguuuuuucaguuguuucaagcauguucauaauugcucauugaacaagcauuuuuaugauggcuuugucagguaauuucaacaucucucucaucuugguguuggcaucuguuuauuguuuuguuuguguuuucauuugauuugagaaauuucugauucuugguaugaagaguggcuguagauugaaaccuggaccauuuggguauuaauguucugagacuggaucuuaccuaaaccuucuguuuuaacuggcuuucucugacugcucuggcagaggcagaggaagggguugugccaccuuuuuauugccagguggaguuagaagugcugguuuccugcuguccucuguugacucgcaagggcagggaggcuccucauuacugcuggguagggcugggaguucugguucccauguugucuuugcugacaccacugggcagugguagaaguccugacuguccacucggccuccucugucaccaccucaguggcaaagggaggggagaguuggcuccuuagugccuggccaggaagggcguucauuacugacugucuggaaugaaaggcucagcucccugcuuagcccucccugauagcaccaucgccagcaugcugggaugucugguuacagccuugcaaggguggaagucuuggcucccacuuuggccuuuguuggcauggguggauauggcaccccaguucuuaccgugguguuggccuggagccuuugucuugcugggcugccccuuuccugcaccuuuggcaagagauagcuggcuuuugucgaggcuuuauuugugcacauugguguuucugaguggauguguguggcaaaaagaaaacccaggaaucuuacuaucaugccuuuccucagaccccagucucccuccagucugucaccuucucugccuuucagagucaucuucuuuguuuuuguauacugccuagaguuuuuaguuuugcuuggcaggaagaauaaggaaaagaucuacuccaucuucccaaaaguguaagucuccagguguuuuguuuguuuguuuaaaugagauuuauauuucccaauuagggaaaaucuugggcuccacuaaguguagagacugaaaugggaucagaaagucauuuguagaaauuuucacuguaaagccacagauugguacuaaucucacaaaaaccaaacucauuggucauaaccacuaauccuagaagagcauuacagucuacuuauugauaggauaaauuacuuauaaaggauugagaugggauaagcauuuggacuuggguuagugagucucagagcaggucacagcauugguauauuucacuguugagaaggcuaaacacugacuugugcagccuggcagaugcugcugagcacuugccacgugcugggcgcugugcaaggcacuggggcuggagagaucaguaaggccuuaucccugcccuuaggugcuuaggcuguaugacgaauagagccaaggggguccaugccgggagccuggaaaggggcaaucucagggagaaugucgcagaagagcuucauguccagagacagacccgaaugauugcaugaccucaguaggugaggagucuguguggagaucgugggagcaggcaagcagggugaccagccucagggaugcuucauccgggcaguggugugaacccgacgaaccuggcugcucuaccaagauuccuucucugccaccagguucaccuugggcauauuucucacuuggucacuucaagggaaacacacuuccgaguuuuucuaaaccgcuucuccauucagcuuguaccaucuuuauuuagauggguuaauuuuuauuacugauuaugcaccaguuaaguugugguucccguacagcugggagacauccugccuuccccacuguucauugaguucauuaauucaucuuugagaggacagucucccucugaauucuguuuuuuuaauuggcaaauaauaauuauauauguuauacaaugauugccccugauaggucaaggguggagcauauggaagaguuagggauaggcuggagcagacacugguaagguaggugaauccaaauuugaacuuuauccuguagaaaaugagugacaggauaacauuucuaagcuuuaaaaauguuucaaagggaagucagggcuacugacaguguagaaaacggaguggggugggagaguggggcaggaagagaugcucaucagggagacaaggccauuacggguggccaggcaacacuugaggaagcccugggcucagggaguggcaguggaggugcaugagaaaggcauuugagguuuuagaaguagaauccauuccuaccgauugauugaugguaaaauugcauuguuuagaucauuucuuccaggugacucagaauucccccaauucuguucugaaugacagcaccuauccaccagagauucccaggggacagagaaauaggaaaugaggcccugcauuuuugccagcaauuccccaacacaggucucugauaaaccuggauagaauuuauaccuaaaagccaggguauucuuuuguuuuuguuuuuguuuuuuuuuguuuguuuguuuuuuguuuguuuuguuuuuguuuuuuuggagaaaaggucucacucuguaacccaggauggagugcaguggugcaaucauaacucacuauaaccucaaacuccugggcucaagagauccuccugccucagccuucugaguagcuagaacuacaggugugugccaccacacccagcuaguuuuauuuuaaaauuuuuuguagagaugaagucucacuauuuuacccaggcuggucuggaacaccuggccucaagugauccuccugcuuuggcuucccaaaccuuuggggauuacaggccacugcugcgcccagcccugggauuccuaaauugaccauacauuauuacugucaccuggaggucuuguuaaauagauugcugugccuacccgcagaguucugguucuguaggucuggaauggggccauagaauuugcauuucuaacaaggucccaggugaugcggacucuggggcaacaggggacacuuugagaacuacugaccuaacaaaagauuuggaagagucucuccuuucucugaaggccaguuuuucuacuggaacccagcccuaaggaagagacaagacccuuaggaacacgcuugcccugagagucagcuuacugcuucagcccacccaggggcaagcgggaggcagaggccacucccuguggggacagagacugccugcagcuagacgucggccauccagucuuaucagucagguuagggaaggcauccaguauuaucagucagguuagggaaggcacauugucuccccucccacuaacauuugaacuuuuggguauccaaacagcagaagaaaucauacauggcccugaaguagcuccuagccugggugguuggauugauguugauaccauggaccaguggcucucagccugggugcacaguagaaucccuagguucuauccagaacuguugagucagaaucucucugagggguggggccuagacccugaggggucgggcccagacugcaguauuuucuuuuuaacauuccauguguuauucugaagugugucugguuaagaaccauaaucacaaacuugagaauccacacgauguuuuugggauaguuaacucaguuuuggacauuugggacuuggauuguugauguuaaugaaauugagcccuagggagaauguaaaggaaaaagagaaaaagcuccaagggcagaucucuagggaauaccagcaaagauagagucagcaaagaaguugucagaagaagggguucaugguggggccuggcaggagcuacauucuacaguguccaguggaacgggaaggucauguagaaugaggaaugauaggcaucaugggcuucaacagguuagagauucuugucagccuuuccaaaaucacuuuuguuaaggugcuagggacagaagucgaaggacugcauauugaguuaauaaggugaugauuuuaagauaaaaaggguaaauuacucuuccaugcaauaauuuuuuuuuuuuuuugagaugaagucuugcucugucacccaggcuggagugcaguggcacgaucucagcccacugcaaccuccaccuccugaguucaagcgauucuccugccucagccucccaaguaacugggauuacaggcacaugccaccaugcccagcuaauuuuuauauuuuuaguagagaugagguuucaucauauuggccaggcuggucucaaacuccugaccucaagugauccgcccuccucggccucccaaagugcugggauuacaggccugagccgaauuaaucuuuuguuacugaaguuuucaacuuaacuauuguuauguuagguauuuuuugucuacucauagcuucacuuuuugaguuuaguuuuugaaaauucauuuccagccauuucauauuuauuauggaaguuucagguuauuguaaauauagauuauuuauacagauuuacugccccucacccaaugaaccuaagcaugauaaaauuguauaauugcaggugagaaguuuauuauauggggaacugaucuugacuguaugggaaauuuugaaguauucucagccugggcuguugaacucucagaauguaagaaaucccagagcucauggagcaaagcaggacacuccccuuccugucuaccaugauggggagaagcucuggcucuucgauguaggucaggggccuguuuuuuguugguuugguuugguuugguuuggcuugguuuggcuugguuugguuuuuugaggcagggucuugcucuguuguccaagcuggggcacaguggcacgauuauaauuaaacaaacuagucaguccuaugcuugaaacgagaugccccuucaauuuuugagacuuacuauccaaguuaugguuucagaucuaacacuucuuguaaucagugugcaauaaaugaugaaaugacauuccuggaaaucacuaagcgauuuacuuacucuuuuucuagcucaggcucagcagacuuuuucuguaaagggccagguaguaaauguuugaggcuuuaugggccacagacuaucucuguugccucuucuuauuugugucuuuuuuucgaccacuucaaaaauguaaaaaucauucuuagcucacaagccauaaaaaacagacugcaggccagauuuggcccaugggccauaguuugccaacccguuuuaaacacugagguucgagucucccauuaaugguggcauucucugggauaacgccuaaaacauuggaguuuuaauuaaguuguauuaagucaccauuaucgaaaagauguauuagaaauuaugacccguacagacuggguuaaaauguggcuugugugucuucugcagcuugcaccugccugcccgcccaggugauuuugcaggcacaaucugaggugcuagaaccuggggcuuucucugccucugucuaguccugcuggauuguaagcuccaugagggcaggagcuugcuuguuguuugcuacuauguucccagcacacagaacacugcugggaaauauguucggggcugguucucauuugucuugauagcauccagauuuuuccaaguaguuggcuuuccguauguccauuuuacucucuguccauauauauacacaacauuacauaguacucaugcaccaguuaccauucccagggauuauguaauuccucaguacagcccuguguggucuugugucuccaucuuacagaugagaggccaugaucaggcagcuaguuuguagaaagcugccaggguuugcacccagccauuauggcuacacugcugggacucuuagcgccccuaaagggaagcacuugaguggcucguuguuuaugucaccaucaggcuuccaucucccagcagaugucagaggaucucugguuuucacuucuguaacuuuucaaagcucuaucacccuuuggagaauauaagaacauucugagacagacauacagauuugucaaaacugccgaguuuguccaaacucacugaacuguacccuuaaaauggguguguucuauuauauauaaguuguaucucaguaaaguugauuuuuaaaauuguucucaucacaaagucaaauggauuuggaaagcuuuaauuagagaagaaaaaaagaaaccuuuuuuaaucagaagaguccagccucuuccaacaaaaguuguaauugcuuuguuuuccaagcuagcuauuuaaaaaucaggaguucuggccaggcaugguggcucacgccuguaaucccagcacuuugggaggcccgaggcaggcagaucacgaggucaggagauugagaccauccuggcuaacacgacgaaaccccgucucuacuaaaaaauacaaaaaauuagcugggcaugguggcgggcgccuguagucccagcuacucaggaggcugaggcaggagaauggugugaacccgggaggcggagcuugcagugagccaagaucucgccacugcacuccagccugggugacagagcaagacuccaucucaaaaaaaaaagaaacaaaaacaagaguucuuuuacuuuaauuuuuauccucagggaaaggaaaaccucuucagcgcaaggugaaaccaccuaagaagcaagaggaaaaggagaagaagggaaagggaaagccacaggaagaugagcugaaggacucuuuggcugaugaugauagcuccuccaccaccacagagaccuccaacccugacacagaaccgcuccucaaggagguacgggcugaucucacacaacaaaacacgagggagaaagagaggucuccugcagcucacaagaccuuccaucucauagauucugguuuuaguacaaaaguaauguuuaaaucuaggaugagcaccuacugaggaaugguuccugugcugggcgugccuccagagucauuccccugcagacaacagucacagcuguggggaugaauggcuccauguccuccagggaagaacagcuggaagcauguuacuaaaguaagaugguuagaaacuggaaacacugcuugaaagcuagggacuaucuggaauaguaacuauucuaccucaugaaacuucuuucagauuuuaaggaucaaaagaaugagaaggaacucuaccauuuuaauuagguuguguuuuuccugucauguugcuccuagcaccugcuggaagcgggguuuugguggccgcuuacucccaagcaguagaguggugaccgcccuggagggaguguggccccaggaaagaccccaggcuuuaguggcccccagggacgaggagcccagcccaggacacaucagcacgccaagaagcugccucgcccguuggaggccucggcucccagggcuguuaucacagcaggaagagcagugcaaagugucggguccagugggccuuagugacggggucagauuacugcugugaguaguauggggugugcaagaaaggguaauaauuccacucuggcgcuuuuauuuuuagauaaauggauuucaaaucuaaacugauccuaauauagccuuuaauguuguagaacagacuuucuuuuuuaguuuuagucuauugaccaaggaaucacuucuuacagauuuccagcagugucauucacaugcauuaaaauguuuaaaaugaaauguauauguaacuuacuuucaaguuagccaccuuucccuuugcauucccucaccguuaccgugguccuccaucuaccccuagcccaacuccuaaauaguucuggagcucuguaguuuauagcacuuuaacaaauuacuucagagaaacagaaagcccugugcuaaacuuugaguaaaaucccagcaguuuaaacccugugcaucagcguucggaaggcauuuucugcacgacuuucucccacuucccuucccaccugccagccucuuccugcucacaccacuguggcccccucuccagcggcccccaguggccaguguucugugcucacccacugaugucauucuuagcucccuguucauucccuccuguguucccagcuucuuccgugcuauuugugcagcucagaacucacauccuucaugaggccuccuugucugguuacuacccuguccccuccaacgaguuauuccuccugcucagcaaucugcauagaggccgugugcuuuuauuucucugcaacugaucucaguuugucaguuaauguguauuuucuucccagcuaaaucacaacuuugauaggucauuuucucuugcaugucuucuccaauucuguucuacccauucagucaacacauaggaauugagcacccacgugccaggccacgugcuaggugcguaggcaacaacaguggacaaaaggccacauccuuguccucgaaaagcucaugguuuacaagauaccugaugggucaaguauucaagaaagacuucaugaauaacucaaaguaguuucaaacgauaugugagccagggagauguuuuagcccuagcucugguuauuuacucuugacaguuaaauagauucaccuggugugaccuauuaaaauccaggcugucuucauaaucauaaauuuuaaagcucuuggguagaugcuaauucaccacaugccuauagcuccccuccacagccaucacuguccccuuugcugaguacguccuuccccaucugucccugccagugcuuccguaaacacaguauuucacagauugucuggggcaaagaaccagguugcuuuuaguacacagcccacuccacaugcagcuccccaggcgaguucagcaauaccugagugcagccugggcaacauggugaaaccccauuucuacaaaaaaauacaagaauuagcugggugugguggcaugugccuguaguccuagcuacucaggaggcugaggugagaggaucacuugagcccaggggugacagagugaguaccuugucucaaaaaaaaaaaaaccacacauaauacaugaguagauguguacccuguuggggagacagguccacugaucucacacucagaugcugcaaugaagucagauugccacagaaauccguggggcagguucuguacuuuccugguccuggcugggccagcuggguagcacagcuuuaagaugcgucuuggauguggccgcccacuccagauuccacauuuuagcgggcaggacagcccuucugugcugcugcaguggccaguaacauucccccagcagagguccaugcuggcgucugucgugugucucccuccugcuagacuucaccauccuuaggaggagaaacugggcccucuugguaauccuauggccuggcaccaagcgggugacccguaaauguguguggaugaacuggacaaacagccccucccauugauggagcagcuguuagcuuagcauuaaaccagccggaacccugccgcaaucgcaggcaggcgagcauggccccuuuggcugccgcacugcucucuuguccugagaguugugcucaggauggggugcauggcuggagugcuugacuuuauacugcagucucuacugaacuuuucuuuuaaggaaauacaguguuuuacuccccagugcuugaaaagaagcuaccaauuugcuacugccacugccaccaccaucuccagucaggauaugaguauaaauuaaaaugacguucuuuauaacuccaacucaccaaaacguagucgagacaaauuuuacuuuauuuuuugagauggcgucucgcucugucgcccaggcugaguuuaguggcaugaucucagcucacugcaaccccugccuccccaguucaagcgauucucaugccucagccucccaaguagcugggauuacaggcaugcgccaccacgcccagcuaguuuuuuguauuuuuaguagagacaggguuuuaccauguugcccagacuagucuugaacuucugagcucaggcaauccaccugccucggcuucccagagugcugggauuacaggcaugcgccaccgcacacagcugagacaaauuaaagaaggccaaaaaauugacagaaccgcagugaagacagauuugaagaaacgaguuuguuuuuacguauaugauguguauauuuuuacaucuuugauuuugugucuguaucuuaaaauggaacuaauuucagucauuuuauuaauccuucucagcaauuaaguguccauuuuuuacaggauacagaaaagcaaaagggaaaacaagccaugccugaaaaacaugaaagugaaaugucucaagugaagcaaaaaagcaaaaaacucuuaaauauuaagaaagaaaucccaacagaugugaaacccaggugagagaaauaaguguacagagaaauaaggucuauaaagaaguugcuggcgaaaaccaggugcuguuuugauuuggccauuuggcuggcugguuggcuuuuaggggaguugauagcaaaauccaggugcuacgucacauuccucuugggauuuuucugucaccugauauguacuguuguugacucggaauagccauaugcuucucaagucagauaugcagagggcagagcucacgaucuguuauaaaaauuuaggaggaaaauuucuguuggugauucagucccaggcugagauccauuuuacuucugcacaaagaugaccuugacgauugaaccacagguacaagcauaacuuuccuccaaaagaucucugagucugucgaauuguuaacccaguugggaucuagaguuccaugccauaaaacuuggaaaaguuuauucuuaccuuaaaaaugguucagagcaggugucaccagucagacgguucuaccauuaaauaacuccaguuccuccccauggaaugggauucaguggcccccggggagggcuugugcaggcuguuuccccagggagaugagugaguugaacuguuggguuauuaacugaaguuacuucacauuuucauuaaaccuuggcucagcaucuaccugauaauuuuaguguuggugcaucaguaauaccuuuccugguucauuguauagaacugucaucagcacgggagcugcugucuacccgcuuguggguugugaucaguagaaagugacagaggaagucgaauaaauuagguguaaauuuaaaaggaagacauggcuugucugucaucauaagugugggccauagauuuguggaaggucuauucuuacucugauccugggaaucauacuugaguuuugcaaaaacaccacuaaccuagacucugucccuagauuauauggcuucaggcagggccaguccuguucuauagaacccaaaagcuaguaagaaauuagugauaacugcaguaaaauuuaaccuugucccugaauuuaugaaauaauacaguauaugguggugcuuaguaaugaaguauuuguaccuaaaauuuacucuuuuguggcaauuguuaguucaagugaccaggucccacaauuuguugagagcagucuggcccagguagaaggaacgucaagcagagugguaucaggugguugaucauuugaaggggagagagaaaaggagaccaccucuucugaagaggagguucacauacuuggaucucuccugagagaaauccaccugagacaccaauauccuggcacccaggacaggaauaacacugggcuacuagcuagagauucuucuucuuggccuuuuucaggcuuaggugagugaucagauauuuuaaaguaaaugaggcuaauaaguccaaauaaugaaaauccucauuuuuacauuugcagaaaucuugugagguagacagacaugcaguaauuccuaugaugauaaauuuuaaaaccagugcaucuaagaauuaucuuagagguaccauuccauaggugacugucaccaaauuggcccuguugauuagcccucaggccugagcuuaguauuguuaagcagauagaacacacuaauccuaacccccaucccuguuccacugacuuacauuguauucugauuuuuuuuacaaguugaccaucagcaaauuugcauuugaaaaguuagucaaagacgucgcuugagugucauuaccuuugcaaggguuuuuaguucucuuguaaaccaaaaagcuuagaguggucaguccugaaccgccuagucaaggggcaguuauagcaauaaccggugcucucucaauauguaguuaaaagauaaaucauuaccagaacacaaaucaagccgugugcuugaaacugucuuuuguaacuggagaaaucuauaugcaaccuuucuucuauccuccuuuaucugaucucuuuaaacucacugaucucuuguuuuucugaacucgaggaugaaaguauugagucagaauuuauuaguucaucaaucauuuaaucaaauaaagacugguuuuuuuaauaaccggagaagguuggcuuucugaacagagccauucugugacuccacugcauucugauaauaaaugucaaacacugucacucagaaucacagccaguacuagcuuuagugauuccugaaauuccugucaccuuuuaguguguuaauauauaaccccacaugucugaaggacagguacacaucuuuuaauaagauaugucauuaauaaggcauauaucauugcugucuuucggaagcuuugugagaggugauaaagccagaggaguggcucagccccauccauccacacucccaagaguugaccucaaaaaaaucacuugcuaggaaauaggaggguggggcugcagcaacagaaaucugaucuaaccguguuuuccagcuguggcaacauagaaaugggccugcagaccuccggaaaacuguagucuauggcagagaugccaaggaaugggaaucagaucucaggcacugaagguuucugcagaaccaggaagggcccagggcaucccugguuuaggacccugaguauucacugauccuuuuguuuuucuauuuguuuaucaacaguauauguuuacauaaauguaauaaucuaaaauaagcaaaagaaguagauuaaucauauuaucuguaaaaaucugcuuaaauaacacucucaacucaggcccaagggcugugaacaccacacugcacacgccagccccagaccugucagcacucagaaaacccugcuccacagcuggucaugucccuagcuguguccucagcucugccucucuccuccccagacagaaauguguacuguguauuacaggaauaaaaauaggccaggcuugagucagguguaacguugugaaaagcaaaaauaaaaagaauacgaaaucucagaauauuaagaaaaagaaaaacauuauuauuaaaaaauggaggaaaauauauuauaaaaauaagccaggugugguagcucacaucuauaaucccagcacuuugggaggucaaggcaggaggauugcuugagcccaggaguucaagaucagccuggaaaauauagcaagaccuuaucuuacaaaaaguuuuucuuuuaaauuagccaggugugauggcacacaccuguagucccaacuacuagggaggcugaggcaggaguuagagacugcauagagcccaggaguuagagacucaggaguugagcccaggaguuagagacugcagagagccgugauugcaccacugcacucuagccugagcaacagacugagacccugucaguaaauaaauaaauaaagccuggcaucugaaccaccuguuuuuccuuuuuaaaaagaaucacuucagucugggcacgguggcucacaccuguaaucccacuguaaucccagcacuuugggaggccaaggacggcagaucaccggaggucaggacuucgagaccagccucaccaacaucgugaaaccccaucucuguuaaaaauacaaaaauuaaccaagcaugguggcacacaccuguaaucccagcuacucaggaggcugaggcaggagaauugcuugagccugggaggcagagguuacagugagccaagaucgugccacugcacuccagccugggugacagagugagacucugucucaaaaaaaugaaucgcuucaauuaaguuggccguuacccauuuuauucagaagccuuaaaaaaggauucuugauagagaucaucuggcuuaauuuaggaaaguaugaaucagcaaaaauaacaggaguugucuggcaccuuucuucuuaaaaaccaauuacuuuuacaguggcacagaauuuaguuuuguauaaauagcuacccacgcacacuuaaaaauagaucacacccacaccaccuccaccaccagagggcuggugucuacuaugggagccuuugggguuuuuuuagaagauggguuuuuuaaauaacccugucagucagaaguagaagagauacaaaagauuuuauaauguagcauucaucaucuggcccauaaacaguggauuuuucacuucaguuuguuauccuaccuaaaauucuaguuauuugggcuaacggaaacccuuuggcuuuuugguuugcucucuuacuaauuccagauauaauaccuacuuauuauuauauaauaccuacuugugaaauacaacgaaacaaaagaaaauguccuuugacccuaccaccuuauaaaauguuuguaaauagccuucuuaaauguauuuguuuauuuaugagcucacacuuuacauugaggauguuggggaaugaggguguuauggugccguuagaucgggaaaguuggaacucuucucaccuuugaaaucuccugugaaugagcacagcagauugccucugacccagaaccuagcugaaauguacuguauccugugggcugggaggacagaaggcaacauggugcgugaagaacuuggaggauggggccgggaguccugaguaguaucacacacuugaggguugggagcagaaagcacacugaaauguggaaaaugccggcgaugcauccauuuuacaccaucuguguagacuuuguagauuuggaaugaaaagcuagccaucagcucagcccugaacugacagcugucaccaggagcucuguagagaucccugaggauucuuggaagauuucuccaaaggggccacugggcucucugagcugcaucucagccuuugcuggaaaagguccuucuuggaccacauuagcugagcuccuuccggagguccucccagucccagacauggucuuggugggcauuagagauguggcuucauaaagaaugccuuuguagcccauauagguauucuacucacaaugcugucuuccaugggccagcuacccaguucauuucucucagagauucauucuuuccagcugcugucucccagcagguuuuccuaccucacuuauugagcuuuggaaacuuaagauauauuuauacaugcuuauuaucuuaagcuuaccucaauaucuuucagaaagcgucacucuaaauaaaucaauaaaaaauauauuuaauuuuuuugcuuaagauuaacccugaguucaagaauaaggaagaaaauucauccuagcccacucccuguaguaaccaggaacuuagcucugggucaccucauaauuucuaugagaaaaauuuguucaguuuugaauaguggagucucuaauguuauagaugugagaucuuucaaaaucuucauguucaggaaucccacuggugguggucuagaugcugggagagacucacaggcagaaugaccgcacuuccagcccugagcagcaaguuggagcuaagggcuuucuuucuaugccuuaucugagauagauccucccucacguuacguauuauuaaauaauggaccucaguucauugucagcacuuggaauagcaaagguucagucugcaagugcugaaugucugcugggcagucuuagcuacagcguugggcaugcagccaguccugaguuaggaccaaggguagauaacgccccaggaagccacauuagcuuccugcaugcaguuguauuguagaagaauuacaaucuuaaugacuucuguccuccaaaacagaggaauaaauuuguauuuuccaucccugauugucuuucaguucauuagaacuaccauauacucccccuuuggaaaguaagcaacguagaaaucucccaagcaagauuccucuuccaacugcaaugacaaguggauccaaaucacgaaaugcccagaaaacaaaagguauugucaucuuguucucuaugaucaugucuuacggaucuuuucauagugcaccguauuaacaauuguugugcauuaucaguaagcagucaguaguuauuagucaugcaaggcuaaggcuguguucuuguccucauuagaagguucauugaaauagaccugaaagaaaggaaugauucuccauuaaccauguucuuuucugauuuuugugcagguacaaguaaguuaguggauaacagaccaccugcccuagcaaaauuccucccgaauagucaagaauuaggcaacaccaguagcucagagggugaaaaagacucuccuccaccggagugggauuccguuccaguucacaaaccuggcagcuguaaguauaguaguuuagaaaccacagggcuccacuuacccacaauccaccccacucugggcauggaacucuucaggggcauguugcuuuaaaauacccauugacagugcuuugccagcuaagagcccauuguuaacuagccuaaucaguggcuaaacugccguagguugaaaucaguccugguaagauuauuuacaucaggggacucauucaacaauucacaucagggcuuuuuuuuuuucagggagcugguauacuagcacaccacugcccaaugugcaaaauggaauggucuguuuggagugguuaaucuucuaaagaauuguuugccuuauacaaguauugacuuagcuauccuuuaccugaugaguuccucauuuauaguguaauuguuuuuguaagaauuccauccucucaacuuuacccacaucuuuuuacaugagcaaccuacacaaagguuucauuauuuuucucacuaccuugaccuuguuucuccaguuuggccugcaguaaaucaagacaguaggcacagucaaccaaaauagaaauccucacccuacagacacuugaccugaaauagggggcaacagagaccagaaaagggagcagcugacagcagggauuugagaucaagagagguccuggcuuuaggacugauugguccgcacucaccacuguguuggaguguaccagagggcaagucaggaagaccagagaugcagucagguuugagcaacagucgggucauugaaggugaaaggaguuggacgaagggcaggcucacugggcugaaugagggcagagagccuuggaggcucggguagggcguccacgcucucgccggaauguguagauacauccuggaaagagaugcucucugagauacauccuguagcccuauuugccaugagacuuucuggcaccuuuuaguacuacuuuuugccaggggugggauacaauccuaaauccuucacucagcaaaucuugaagaagaccgugggugguccguguguccaggugggaugcuucugcuuccuagcgcccccugagguuucugcuggccauuggcucuuggcuuaacacuccacgauuuaggcaguuccccauuaaacagaugccacuuucagcaacagaacacagccccuggagccaguuucacagggguguucugaggcccagugaggugacaugagccguguuggugacguaaugacacaagcaugcagaaccaugcugccgggagagcaggugacagccagacacagccacaaacuggcuggcagcauccccaccugguggcaccugagccacauguugacaucacuccuucuguguggaggggaaaggaugacaggacccaaccccagacaggagauuuuggugccacuccucggggcaggaaugugggaaauggcaggccagcccucuggaggaggaacugugaagggcccagugccgcaugccucaguuuccugccuggcucuuccacagaggccagcuggugcaucugagcauggcgccucagggcagagcuccacggugggcacugggggaagagaugcagagcuugucuccucagcccacgucugugcaguccuuuuguguuuuucuagccaagcagucccuuacacugguuccaagcccugugaccucucugcccucacugccagcguuacuaaaauguuccagcagagcuccacucgauagagaauauggguggaggaaacccagaagagucggucccacaugcucuccaucacuuuuaccuuccugcucugccccagcuuucucauccccuuuuaucccuucgccucccuugguguuucgucuugcuuagaccugaaguucugcgagcgcuguuggcagugccaagcuuagugcaguuccuuggggugaaagcguuggucccacccaagacugugcagccagcauguggcaguagccgcugggggaguugugcagccucuguguaaagaucucuccaucccaaguagcaccccuuagcauggugcccuauaccaucuguaccacaugaguugcagagaaaaugcuccuugaauaauuucaugauuuaaaaaggcaaaaaauacaaaggguuauuaaaaggaaaagcaaaucagaagccacaaaggaaaauuuuaauaauauuugaaucaaaacguucucuaauugcagcucguguacuguucagagucuccccuucacuccuaccucaagcacuguucaguaggggcuuuugcuaacuucccuuugcuuuuccuguuucauuucaucaucacugucuugggagcaucuguaguucugggcccugugaaacacauuccacccacaggagcugcccgcaccuuuccccaggacaggcaccucgggaggaucgagcgcacacaaaacggagcacagccugcuccaagugugggcacugccugaggggacgagucacugcaggggcggagcgaggccagaggaaguggcuagggaagggucaggacaguuguacaaauagcaagccgacaguguagacguggugucagaugggaggccucagaggagcuugauggggacaaagauucgagcagggcucguaugggagagcggugugagacacguccugagugugggcaucaggucagcagauccacagaaccagcgaggaggggcccaugucaucaaggggugagagugggcgggugggagacaggaccgugagucuggcaccaguaccagcagcacuggggaaggugagagagaagguagcaggcagcccugaggauggcggaguggagagcacgggcuuccaagggaaggcugcuuugcucggcagggccaugcuggaggcuugaccuagccaagacaugggaaaccuugagcccugagcccuggggguaggggagaagcagcuugugcuacagggugugaccagggaagcaagaggcagcaggcagagcggcugcaauguggcagugaggggacgggagaaguggagccggggguacucaggguacgcggaaaucucacaaggcaggaggggccagccagguagcgagcuggccaggccugggcuggggaucgugcccuguggugaugggaauucacagguccaagcucucccccaccuucuuccucuugcaguagcuacagcagcaccaaguugcacacaauagaugugcaaaaugauacauuuuucugauaaaagguauacauauuuccguuuacugaguagagaauguuauuuuaugacugaaauuuuuuguuuuaauuucagagauggggucaggcuggagugcaauggugugauuauagcucacugcagccucaaacuccuggcucaagccucccaccucagccucccaaagugcugagguuacagguccgagccacugugcccagccuguuuuagauuuuuaaaacagcuguauagacauuacuuuaaagggcacaggaauauacuaggagcuuaauagggaucagagcugcacaucccagucacgccaauggagaggcuuuacugaacuuggggauucagcccggaacacugcaccucccacagcuguaaaccugcguguaggcacaaggauuuuccagguccccaggcagcggccucagcuguccaccccuggaggauguggaagacccuccuccccuaccugaggugggagaagugaagacauugacuguccgccacacaacacagcagggaccgggcacgcucuugcuccccucaaauccccgagugcagagagauguggcugcuuucucuuuaaaaccuguuaaacagaacacaucuaagagcuuucguuuguuuucuuuguagaagggcuugaguuaugcauagucuuagagaacauucaaagugauuuggaagagcgcuaaucaaaacaccacacuaacgagcccguuuguuuuuaauuuccagcuacugauagucuuuauaaacuuucucugcaaacccucaacgcagacauuuucuuaaaacaacgccagaccucaccgacaccugcuuccccgucucccccagcugcccccugccccuuuguggcccggggcagcuacagcagcaucgucaacagcagcuccagcagguaggccugcugcuuccuuuccgguucucagcuugaaaugugccuaaaacccgaugucacacccuuuaaauggaaacacuuagcggccacaggccacugucugguguuacuucugauggcugccagcuuguguggacccuuuuaccugggguccacccccgcuuccugcugcugugcccagcuccaacaguaacccgguucccauucuaauccauucauucuuaccaccuguggaccgagaaaugcaccauuuaacucacuagagugauauucucagugagccaaugaacauuuacuaagccuuacaugaagaccuaaaggggauuccugugaguugggaguauggguuuaugugacacuaauuuuggccuuuggacaauuuggcuuaggacuuagaagggcaggaccugguccaagaccguugugcugggugaggugcugcaguaggggaugugugcacccgggagggcagccuccugaccacacagacaggaugcaggaagcaugcuguucuccgaggcacggagccucacucguguccgccugccacaguguaccgcaagccugacagucacggauggcacucucaccgugugccucgccguggcguggguuucugugcaucgcgucaccggccagccuagggucagguccuccccgccguugcccaagaggcaguaaccacugaggcugggggagccaccccgcuucugggccuugccacaggagcaccucgccguguccuggcagggaaggagacucccugaggccccgcccuuuccggugucgguggcugcccucugcauuuccugccgaguggcucucuagcauucuucacaaaagugugaucgaagccucugccagucccuaaauugugaucccugcccuggucucuuucauagugaucuuuuguuuucuuaccuuucuccagaaagcccucuaucucugucugauuaagcagucugaggccccagagcaugugacaugaggcugagcgaugcucugugagcugccccgcugcagagaagcccacucagggcucaguccugccagccccacaccuccccgagacagggcacugcugaugaggaaugaguucucucuuugcuucuuuuucaagugacccuaaaauaaaacagccaaauggaagcaaacacaaguugacaaaggcagccucgcucccgggcaagaacggcaaccccacuuuugcugcagucacggcuggcuacgacaagagcccaggucagugccuuugcuucagagaccugccacgccaggcgccaggccugguggaaugaccucuguccuaaugugccuuccauugauugaacguccauuguuacaggugggaauggcuuugcuaaaguuucuucaaacaaaacagguuucuccagcagccuuggcauuucacacgcuccuguugacagcgauggcucagacagguacgguagaccaccacuaaccgcuagaaagacggaaggcuucucaagucggguuagcaccuuuuuauccauaaauggguuucagggcauuuuuccccuaauuuacaaggaggcauuugucagaaguggucaagugccucuaagaaaucaugucugcuggguggaagcagaaagccggcugcggugccuuccccaggggguccagauagagaaagggggcacccaugccugucucagccaggcagacacacguuacaccuguucucacucuccuccaucuccuggucugugguaagaugugaucugaucauuaaaaauagaagagcgaaagugacuugggaggggggaaaucuggagcaaauacuagccaauuuauaguaaaucacuggccacgccucuuucuugagcaggcuuguuuaucaugcagggggugugguggccugcagcagucaccuugguugacuuuuccagauaagcaacaauagagccccaauuuaccuacuuugcacuaauaggaaaugaguucuagauuugaaauaguuuuuaaauaaaucuuccaguaccaaaaagcaaacagaaggaaaaaaugucuguuucucugcaaaacacuugcuuugaaccuggcugugagcuagugauagggcauccggagcucuggggcucccuccgacucaacccuugugguaagcagccauuguucagcucuuccuuuugucuguuuuuaauauuugaguacccccaguugaagcagugucuccuguuugugaagcugugcacuauggauccguuugcacuaaccaccauacauuuuuguguguugcguuuuccucuuguaacauuuagcucggguuuguggagucccgucagcaacccaagcagcccugacuucacuccccucaauucguucuccgccuuuggaaacucuuuuaaucuaacugguggugaguguuuaacacuagauguguaacuaauaagccuguggacagaggaagggagaggaggugugguuuugugugcuggagaacacagcacagcagcacuguggaagaggccccgcaggaagcucccugggaaggguccccuccccucuuccucccucauccacaccagcagcccagaggggcaguggaccaggcucgacacggugugcgcacaccaguuggugugaguuccauggcggguauugaagggcuucacagaaggguucuggucugaaaugggaccccugagugugccagggguccucuucuugcuguccagaacuagaggucaccauggaagcuucccauuagcuaucaugugagaguggggaaaguuugcauuuggaugucauugguggcauaucagcucgugcacuaugcguuugaguucuggaggacacuccugccccuacuuccucugggcuguggugggcuggugaagugggugugguggcuccaggagcagugguuggagguaugccauugagugaagccccauaugcuauagugaucauggcaaaaccaaauauggacuugaugacuguugcuuuauuuccagaaguuuucagcaaacucggauuaucucgaucgugcaaucaggccucacagaggagcuggaacgaguuuaauaguggcccuucauaccuuugggagucgccagcgacagaucccaguccuuccuggccagccaguuccggcuccccgacccacacagccacagugaguacuuggggcuggggcuggggccuggaccuggcccacccacucgccaucugccauugcugugacauggauggcacugacauaguuauaaacaacaaacagcagcaucagagggguggguuaguacuuuuauugucuccauugcuuugucuucauauucugucaaaaugacugaucgauguucuucagagccauuacaaucaggaaguuuuaggaagaacaacugaacagcuaugggguuggucucuggagucccuccuaauagcucaagggcauuuucugccucuucccaaccuguaaauggaccacaagggugaccauaggccuauggcagguucagaugguugagggaagccuucggcaucugugcaaugcagccacuggccacccaggagcaagcuagauacugcauuuacuuuguugcugagaagcaccugucucuuagguuagauuuucaagagugcauuuguuugcuucuuggcuaaagucuucugcaaagaccaugcugaaaagaguauucuugccaaggaaaauaauuagugguuuuggcuuccacaaaauuaugacagaaaaauaugaccccacuguguuugccucuuuguucucagagaaacuaaacaugcaagguuuuauaacagauauuucaacuuuacagauuccaaagguugucuucauguguaauuauucagccuuauguuuuaaaaccaccuuaaccauucuuuaaaagagaagucagcaaacuuuuuuuuuuuuuuuuugagacagagucuugcucuguagcccaggcuggagugcaguggcacaaucucggcucacugcaagcuccgccuccuggguucaugccauucuccugccucagccuccugaguagcugggacuagaggcgcccaccaccacacccggcuaauuuuuuguauuuuuaguagagacgggguuucaccauguuagccaggaugaucucgaucuccugaccucgugauccgcccacgucggccucccaaagugggagucagcaaacuuucuauaaagagucagauaguaacuauuugaggcucugaaggccaugcuucaccacugccauugcagugcacaggccgaugggcgcagcuguguuccaauacaacucucuuuacaaaaguaggcagagcuggauuugguccacaagcugucuuuuuuaaaauaucacaacuagccggcaugauggcuagugccuguaaucccagcacuuugggaggcugaggugggaagaucacuugagcccaggaguuugaggcugcagugaggcaugaucacaccacugcacuccagccugagugauggagcaagacccugucucaaaaaaaucagaaacaucugcucaaauacauauauauaacauuuguucuaaaguaaacaaaguaagaggaaugcgugccccagccucaucuuuucuguagccuuacccccuuacccacuugacccucugccugccgggcucagugcuggacgcuuucuguuuugucgcagucgguccucgguaacaccagcggccugugguccaccacuccauucagcagcuccauuugguccagcaaccuuagcagcgcccuucccuucaccacuccagcaaacacgcuggcaagcaucggccucaugggcacagaaaacuccccugcuccucacgcucccuccaccuccaguccagcugacgacuugggacagaccuacaacccguggcggauauggagccccacgauuggaagaagaagcucggacccuuggucuaauucgcacuuuccucacgagaauuaaauuaagcaaaaaacaaacaaacauagugggcccucgucuagaucaugaugugccaguuucugagacaucuuuuuaaggcucuuacugcagcuccccuccccacccuccucuucuuugcaaaacagacccaagcagggcaggcucagaccacucgcuucuuucagaucuuucuugcaauuaugauaacaugagauuugcuguugugcuuuuagagaaaagucuggacucagccacaaacucuaauaagaccuguacaucugagaaccuuucccguuacugcguuuucaccaccugucuuccccaugcuuuauuuaucuguaugaacacagauuugacauuacagcuaaggaaauaauuugaguugauucagaaauccuggcaugugacaauuuuguuaaauuaccaaguuugguuuuuaauaauuucucaauauuaugcgccaagaucuaauuuuaaaacuguaugaggacuuugugcugaaaauagaguauuuuuuuaaaguaaggcugucuugguuuaaaagcagauuacagaaauguaagucaacuuaagaacggugaaugaauguaaaaacauucaguugagaccauaugcauuuucugugcuguuuguacuugagguauguaacauuuguauaccugaacuuauuuuaaagaugaacugaaaugcacauagccaagucuugagauacaagauugaauguguauuucuuaaaaauacaacuuuguguuguacuuugaaauaaaugaugcuuuuuucaa

SEQ ID NO: 191103 - RNA, 17374 nt, Homo sapiens
uuccaguuacagguauuuuauugagcagagacagugaaguuccuuaugcuguuauuucaaaaguguuuccugguuucuuuuuaaugaaugucuuaaaauacaagcaaucaggacccuuuaaauaaggcaguauguucacaaaucaaaauagcuuucugcuggcaucaguugauucaacaucaacaugcaguguccagaaugaauaagcaguucuuuaaugguuauuuaaauauauuccagaagagcguuuauaauucauuuacaagugcaguauugcgcuaguaaauguuacuugaccucuuguauaaauaaugccgauuaagaauuaguccuggaauaguuuucgaauuucuaacucuguagaucuaaaacacaauuguaaaugguauaaagauguaagaaucauauugugauaaagucaaucucaaaaauagagaauccagacccuucccagauaauuuaagaacugaguuuuccucaacuuaaacaugauggccacacagaaaacaguaaagacacuuuucgaugugauacaacuguauaaaacucgagaauaugaguauuuaggugaccaauguauagacauuaauagaauuuuaaaaacacauuuaaaucugaagcagaaaaaaaaagacaauuuacaaagaauuauugagcucuaaucaucaucagagucugaaucauauuucuuuccucggauaguuuucuuuuccagcuuugugaaguuuguuccaaauuucuuuugguucugaaaugguggcuccauuaaauuuccacuuaaaaaaaaaaaaaagcauuuuauucuuuaugauuuaguacuaguauacuaaacugcacaaaaaucuaucuuuguuuucuuccuguaacauagaauaaaauuucuuuaaaaugcuggugucagggaagagguauaaugcuuauauugauauugaugguuaauagccuuaaaccuuauuguguccuacugaauguuuuagaucaauuuuauuuuccuuucuuuuugagacagggucucacucuguggcccaggcugaugugcaguggugugaucacagcucacugcaaccuccaguuccugggcucaagcgauccucccaccucagccucccgaguagcuuggacuacaggcgugugccaccaugcucaguuaauuuuuacauuuuuuguagugaugacaucucacuacauugcccaggcuugucuugaacucuuaggcucaagcaauccuccugcuuuggcaucccaaagugcugggauuauagguaugagccacugcaccagaccuauuuuccuuuuuaucauuaauuauggauuaacauuugguuaacacagugcucaguugucaccggaaaugagagaaaccaucacacaccucccgauaugaugcaucacuuccauaauaugcccgucaaaaaucgauaaucugaaucuaaucuugaggaaauuuaagacaaacccaaacugggagauguucuccaaaauaaacaguuuguacucuucaaaaacaucagucuuaagaaccaaagaauaacaaugguaacuaaagacguaauaacuaaaugugcugcauuuuugguaugaaggacaauuauugggacaaugagaaaacuugaaauaagagcgguaaauuacacaauaauuccuguuucaauaauuguacugucgcuacguaagaaaauguucuuguucuuagaaaauauauauggaagucuuuaggaguaaagggacacuguauucacaauuuccacucaaaugguucccaaaauacuucauaguaucuauaaagacaaugauaaaacaaauauaaaauguuuaaaauuggguaauaugggcaaagggucaaugaggauucguuguacuagucugcaggggguuguuucuacuaguuuuuuguagagacgaggucucaucucacuauauguugcccaaauuggucucaaacuccuggccucaacugauucucccaccucagccucucaaagucuguaaucuucugagauuacacaagugccccacccggcugcaauuuguuuaaggcuuaaaauuacuucaaaauauauaacuuuauuuaauaaauauuaauauuuuauguuaauauuaaggaaaugaaaccaauuucuacaacauaggaaugauuucggcaugucuaggagagucagagaaaagacgggagggaaaugggggagaaagaaaaacgugagagaaccuucuacuuccugaaaggcaccaugacucuggaaugguaagugcacaauuuuaccuguuacuuuugcaaaucaagaaaaggcaaaaaagacaagaugauaugcucugauuuguggaauuagauaaauuauuugucugaagaaguggacaaagaaauggaaguuggauuuuagauuguuuucaaacuaaaacuguucuucauagcaagcaauguaagcuaggcauagaaaccuuuuucuauucaucagccucuauaaguaaaacagaaauauccauguuaaaaaucuaguauuuuaaaauauaacuuucuuugcaagagucugcuuuuaauuuuuauuuuaucaaagagaaucacuuaagucagaauucauuugagcaaucuggcuuaaauuggggaauagucaacacuggauugccauuuuaaguuuccagauuaauacaaaauuagugucaauaguauacguuaagcugaaaacuuuuauagucaggaguacggugagacucaguuuuaccuauuaaaucaguuuaaucuguaaaucugauuuugccguaaaaucacgcuaauauuacacacuucaaaaaaacaugcuuuuccuuugagaaacuuuccacaucucagccaaaaugccuuaauuucauaaaauaaauguuacaauacaaaaaucuuuuguaaaaauaucaacuauauaugaauuaaaaucaaucucuucuuuuguuaaaaguuaccuguaauuaagaaugucagaagaaccgagccuccauucuaaaguuucuguggugaagucaucuguauuuccuaggucaguaaacccaacaacauaaucuuguguuuucccaucuuuuagcagugcuagugugggaaugacuuugauaugcagucucucacaaaggaaaggugcuuuuuccacauucagcuucaaaaauuuggucucgagguguuucuuggacaauauugccagaugucugucuaguauuuuacaccuguaagugaccacacauagaaaauuauaagcuaaaaccacagaucgcuuuuuucaaaauaaauaucaucaagggaaaucuaauuauguaguuuuucuguugacucucauaacauggcagccaacuuaaacuugugucagaugaccucacuuccagaucagagguuagcugccugauuacgagaugggaaaacagccuauaagauucuagaaagucagauuugcauuaaugauauucucuuuuaaaauauuaaauauaugcuuuaagucauaaaggaaguuguccuaucuccuacacaggaaacuugaagaggaacaaacugaaacuugacaaaacucggaagagacuuacaagaaucagaagugcacacauggugccauauuuggaagucaugaagaaaaacugaacagcauuaccgaggaaaaacuucuuacuccuaaauaugcaacgcugucaguaagaagcacauuaaggcuaaggguuacuaauaauauuuaaauaaauguggccauuaugcuucuaggaaauuaaaaaauaccaguaguaacuuuuuuauuuuuuauuuuuuuggagguggcguauugcccugucccccaggcuggagugcaguggcacaagcucggcucacugcaagcuccgccucccugguucaugccauucuccugccucagccucccaaguagcugggacuacaggcgccugccaccaugcccggcuaauuuuuuguauuuuuaguagagacgggguuucacuguguuagccaggauggucuugaucuccugaccuugugauccgccugccucggccucccgaagugcuaggauuacaagcgugagccacugcacccagccuaccaguaguaacuuuuauuaagccaucuuccaaugaagacggaaacagaagugagauuuucuuggccaggugcgguggcucacaucuguaaucuuggcacuuugggaggcugaggcaggcggaucacuugaagucaguaguuugagaccagcuuagccaacacggugaaacccugucucuacuaaaaauacaaaaauuagcugggugugguggugcaugccuguagucccagcuacuugggaggcugaggcaggagaaucacuugaaccugggagguggaggcugcagugagccgaaacugugccguuguacuccaaccugggcaacauagugagacuccaucucaacaaacaaaaaaagugacaucuucuuuacauuaaaauuuauuuucuggccugaugcaguggcucacgccuguaaucccaacacuuugggaggcugaggcgggcagaucacuugaggccaagaguucaagaccagccuggucaauauggugaaaccccaucucuacuaaaaauacaaaaauuagcugggcgucaugaugggcaccugaaaucccagcuacacaggaggcugaggcacgagaaucacuugaaccugggagguggggguuacagugagcuaagauuacaccacugcacuccaggcuaggcgacagaguaagacucugucucaaaaaauucauuuucaacuggccaauucacgaguguuucuaaaacagacuauuguaacaaucuuuuagaccggugguucuuaaccccagguguucauuaugaucaacuuuuauuuauucaucuuuuuugaguuggacucucacucugucacccaggcugcagugcaguggcgcgaucucggcucacuguaaucucugccuccuggguucaaucgauucuccuuccucagccucccgaguagcugggauuacaggcaccugccaccacgcccggcuaauuuuuguauuuuuaguagcgaugggguuucaccauguugacuaggcuggucuugaacugcugaccucaagcaauccaccugccucagccucccaaagugcugggauuagaggugugagcuaccacacccagccugccgucaacuuuuaaaauauccagaugaaucaaaauucucuggcaguggaguugggaaacauacagcuguucuuaugcucaaauaaagcuugagaacuaccucuagaugacucacacacaaaauacuucaugguuauuuuuaccaguaagcuuuuugugcacuugauguaguuuuuccugaacuaaguuuggcucuaacauaaguuauguguaaccuuggugccucaucacuuuuuccccggauauguuuuuucauauguuacucauguaguucaguaacgagauuucagugaaaaaugguaagagagaacaaauuaauaaaugguuuuuaaauaaagcucaaaacaaaugauaaaucaaccuuuauaugagaaauauguuccugaaaauuuguaaauaaaucaacuccauacuuuaacugcaguaaggaacguauuuuuuuuuugagauggagucucgcucugucgcccaggcuagagugcaguggcacgaccucugcucacugcaaccuccaccuccuggguucaagcaauucuccuggcucagccuccuaagaagcuaggauuacaggcacccgcaccauugccuggcuaauuuuaauuuguauuuaaagagcaagacagagugucuugcucuguugccaggcuggagugcaguggcacgaucucagcucaaugcaaccuccgccucccagguucaagcaauuccccugccucagccuccugcacaacugggacuacaggcacgagccaccaugcccagcuaacuuuuuguauuuuaguagagauggguuuucaccauguuggccaggauggccuugaucuccugaccucaugauccaccugccucagccucccaaaguacugggauuacaggcaugagccauggcgcccaacccgucaaucaauuuuuaaaaauccaaaacaacagucaugguauaaauagcuauaggccuuuacguauguuuaaaaauaacuaaaagagcauaauuagauuguuuauaacacaaaggauaaaagcuugaggugauggauauuccauuuacccugaugugauuauuaaacacugcaugccuguguuaaaauaucucauguaccccauauuuaccuacuacuacccacaaaaguuaaaaauuaaaaaaauagcaauaggcuuaaaacauggguuccaaucucucucuuuuuuuuaucauuuaguaucugagugauacuaggugagucaauuucuccaaaucuugguuuccauacaugaaauacaggaauaauaauaagugccucugaagauuauugugaauguucuagggauaauauacaugaaagcauccugccuacuaugugcuaggaacuuugcuaauauauaaaguucacuggaugauuuugauuuuucaguucuguuugaaggugaguacuccuggugaugcacuguuuauacaccaucaaauguauuuauugaccaccuacuaugcgucaggcaguugcuuuagggcuaugaucccagagaacaguaggucacaauacaggcaaaugcgcugccucuacaaaacgaacaaucuaguugggaaagacauaaaaaaaacaagugaggccgggugccguggcucauacuuguaaucccaacacuuugggaggccaaggugggugguucaccugaggucaagaguuugagaccagccuggccaaucuggagaaacccugucucuacuaaaaagacaaaaguuagccggguguaguggugggugacuguagcccuggcuacucgggaggcugaggcaggagaaucacuugaacccgggagguggagguuggagugagccaagauccugccauugcacucuagccugggugacaguguaagacucugucucaaaaacaaaaaaaaacaacaaaaaaaaaacaaguggacaaauaauauuuuacauacuaguauauuuauauaucaccucaucauauuugucagagguuggcaacuugaggaaugugugccaaugcgagaugguuguguaccauaagggcagagguuucucugauaccuuucuaccugccuaaucccuucucucacuguuccucacaagggauuucaccaucucaauauuuuguuucauuuuuauucucuuagucaaugaauaccaggcaaucaauucuugaaagguguuaacuaacaaugaagcuguuggguugugagaucaagacaaaggggcaagaaggccacagaaaugagaaagagagcagggcugaaaccacagugagugccagagacucuagagcacagugcuugucuguccuggguaggcaggugccagucagcagaugacugccaucauaguuccagcuaugcuauuagcaaguuuucugauuuuuuaaagaaaaauucuaaguguggauauuuucaaaaggaguuaucucucgauuuuuaaguguuggcaacuaaucaaaucugugcacaaaaaaccacaaaggcuuggguccuuugguuuacgaugugaccucuucugaggagguauuaacauuuuauaagagaucugcuuccuuagagaaauuuggagaccuaggguggucuaagaaaaaucacuucuccuucuagccaagacuggcagucccaacucugcucuggugaaagguuuggccaagccaccaucuccccaccacaguugcuaguuccuucaaggaggaacugaaggaacacugacucucaacagcuguugcccguucccaauaucauggcuacaucacaauacuagagggaaauaauuacugucauggugauaagaauuuuaaguguacauuucuaagauguuuuuaguuagcuagugaaaauacaauucaaaaauauaagccauuuauaugggaauauugacuuucaguaauauucauuuauacuuuugcauguaacuguucuuuaaguuacucuuuaaaauaacaauuaacuuuuuuuuucuuucuuuuuugagauggagucucacucuaucgcucgagcugaagugcagugucgcgaucuccgcucacugcaaccucugucuccuggguucaagcaauucucccaccucagccuccccaguagcugagacuacagguaccugccaccacacccggcuaauuuuguaguuuuaguagaggcaggguuucgccauguuggccaggcuggucuugaacuccugaccucaagugauccaccccccacuuggccucccaaagugcugagauugcaggcuugagucacugggccccugccugcuuaacuuaauacuaaauaacauaugagagaguacaaugaaacaacuuaggaaguuuuuucuuuuaguuuucuucauuucucuaguaagccaguauaucuccagccaaacaauucacuguguuuuuuuagaaaaagucacagauggaaacaaaguuaccugaauguggagucucuguagaaauggcaaaccacauuuucacucuccuugacuucuugaaaaaagucucuuucacuagggauuucucuguauuccccauguccuuuagaaagccauuccuaauuuggagagaggcaaaacauuacacaugugagauaucucuuucagaaccacuugacauuuuaaguguccaaaucaccaucguauuuuguaaugaagucaauuaaaaaaaaaaguuuuuuuuuuguuuguuuuuguuuuuuuuuuuugagacggagucuugcucugucaccaggcuggagggcaguggcgcgaucuuggcucacugcaaccuccgccuccuggguucaagcaauucuccugcuucagccucccgaguagcugggacuacaggcgggcaccaguauguccagcuacuuuuuguauuuuuagcagagauggguuuucaccauguuggccaggauggucucgaucucuugaccuugugauccgccugccucggcuucccaaagugcugggauuauaggugugagccaccgcgcccggcccaaaaguguuauuuauuuauuuuuuuuuugagaaugggucuugcuaaaguugcccaggauggagugugguggcaugaucauagcucacugcagccucaaaccuccugggcucaagagauccuccuacgucagucucccaaggaauugggaccacuggcgcaugccacaccacgccuggcauuuuuuuuuuuuuuuuuugguagagacgggguuuuuacuauaucgcccaggcuggugucaaacuccucgguucaagcaauccucccaccuuguccuccaaaagugcugggguuauaggcaugagccacugugccuggcugaagucaaagaaaaaugaauguuuuuuagcaauuuacuuuccuguuucuacugucaaugcaaaacuagucuacggacagugaacgucuccacagcauggccuggguucaagacaauuaccugucuuuguagcuuaaaacaucuauuuucucagaacuuucaaaauaaaaauuuagacuugagagacucagaauguaaauauccacuuaacucuauccauguacucuuaaacuacuaaaaccagaagcauuugauccaaguuacuacaagucuuuuaaaaauaaugcucaugaggcugggugcaguggcugaugccuguaaucccagcaccuugggaggcugaggcggcuggaucaccugaggucaggaguuccagacuagccucgccaacauggugaaaccccgucucuacuuaaaaaaaaaaaaaaaauacaagaaauuaccuagcuguggugguaggcgccuguaaucccagcuacuugggaggcugaggcaggagaauugcuugaacccaggaggcagagguugcagugagcugagaucacgccacugccugggcaacagagugagacucugucucaaaaauaaauaaaaauaaaaauaaugcuuaugagauaaacccaauucgucuuggggagaaaaggaggauacugcagcucugaagcucaagagcccugucugcuuuugauaaccacuuuauaaaugcuuaaaaagucucuauaccugcacuaauuguuagaaaggucaucucacacugaacugcaauauauccauaauucuggucuguggauuccagcuuggauaaagauuaaaguuuuaaucucuuucccacgugggcccuucaaacaucacauauugccuaaguuuucccuucuccacacugaacacuuccaguuccuuuuaacuguucucauaugaaaagauuucuagaguuccuacucuuccaggauaucaacuaaacacacucuaauucaccaaugucuucuuaaaaugugacagaggucugaauccagccuccagaagggguccaaccaaagagccaggagggccaucucccuuccuccucuggacgucagugaacguggcccagacuauauugaugacugcggugucaaaaucacauccauuuacaucgagcugacacuugcaggauacccugauauuuucuuaugugaaauuucuacacacaguuuaacucucaaauacaauucccuaaugacauaugacauuucaugacugcuuucacaacuuaccaaugauaugugcccuuaaaaaguauuuguuaggcuggacgcaguggcucacaccuguaaucucagcacuuugggaggcugaggcagguggaucacuugaggacaggaguuugagaacagccugggcaacacggcgaaacccugucucuacaaaaaauaugaaaauuagccagguguguuggcacacaccuguaaucccagcuccucgggggcugaggcacaauaauugcuugaacuccgaaggcggagguugcagugagccaagaucacaccacugcacuccagccugggugacagagcaagacccugucucaaaaaaaaaaguauuugucuuuuaaaaagcugcuauuucuaggccgggcgcaguggcucacgccuguaauacuagcacuuugggaggcugaggugggcggaucaccugaggucaggaguucaagaccagccuggccaacauggcgaaaccccaccucuacuaaaaauacaaaaauuagccgggcaugguggcaggcgucuguaaucccagcuacuugggaggcugaggcagaagaauugcuugauccugggagguggagguugcagugagccgagauugugccacugcacuccagccggggcaacagagcaagacucuuaucucaaaaaaaaaaaaaaaaaaaaaaaaaaaaagcugcuauuucuuuucauuauuuauucucagguauuuaaccaagaggcugaagacccgaaccuguccugggcuccuuugagggaggaugugcccauuccaaaccucuaccaaugcucagggccucuccugacacauucacuacaccccugugcucuuagcauagccccuuuuggacagcaugugcuccuaagguaucugcagaacagaaucaagcaggaugggccuaccugaggcauggcagcugggcagcaccuggcugucaguggcugucacccaagccucugcuuaacuccuauuucuuaccuuaucccucuauucugcucccuaccuaagugugccagcucuaguuaacaguaggagggugcuuggcugacagaagaauauagauucaccuaggucuauuaagugccgacuguaagucaaugcauacaaugaucuccccaauacccucguggaucagaaaaucaaaauuacugcauaaucuaauuacuguauaaucucuuauaaaaagaauaucuauacaaaucacuagguuucuugacuauuuccagaaaauauuuuaauaaaagaccuacuaaaaugcagugaaaguucuaaaauaagacccucugaauuacucgaugacaaauucauuuuaaauugauuuauacauuaauaauaaaaaaggcuuauagccagucugccuuaguugguuuuaauuauauucagaccacuguuuugaacugccaaaaaguuccuuuaagacauuauuuaacguauguucaucacugcaaaucaggugaauucagucucucuacaaaaauauccuaguuacaaauaauuauuuuuaguugcacauuagcaauuaguacuuaaaugugacuaugaaauaugaguuuguggcagaaccuaaacauauauuaccuuaaauuccaauaauccguccuuugcauacuaauuaucagcccuauacuaugaaaagaagccaauugggccuggugugggguggcucacaccuguaaucccagcacuuugggaggcugaggcaggcggaucauuugaggucggaauuugagaccagccugaccaacaugaugaaaccccaucucuacuaaaguacaaaaaucagcugggcaugguggcaggcaccuguaaucccagcuacuugagaggucaaggcaggaugggcaacagagugagacucccucucaaaaaaaaaaaaaaaaagaaagaaaagaaaaagaaaagcagccuauuuuuuaaaauacgguaggguacagguaaaagccauauaacguacucuauuuuagaaacucaaaauauaaaaauuuggacucacuuauaaaagauuauuuccuuuuguaguaacucuucuaaacaugaggguguaaacauaucaaagugaugcuacagcaauacaaacaaaacuccuucucuuuuuuugugggggaacugggucuugcucuaucauccaggcuggagugcaguagcacaaucucgacucacggcaaccuccaccucccggguucaagagauucuccugccucagccuccugaguagcugggacuacaggugugcgccaccacaccuggcuaauuuuuguauuuuuuguagagacaggguuucaccauguuggccaggcugguauugaacucccgaccucagguuguccgcucaccuuggacucccaaaguguugggauuacagaugugaaccaccaugcccggucaaaacucccuauuucuucagaaaaguuaagccucauguuuaagucacagucaacugaaaaggaaccagaguuggugauaaaguauuuccauguaacccaguggaaaaaauguuuuaaucaaaauucaauuuggccaggugcgguagcucacgcuuguaaucccaucacuuuggcaggcuaaggugggcggaucacuugaggucagaaguucaagggcagccuagccaacauggcgaaaccccaucucuacuaaaaauacaaaacuuagccaggcaugguggugugcgccuguagucccagcuacucggguggcugaggcagaauaauugcuugaagccgggaagcggagguugcagugaguugagaugacaccacuguacuccagccagggugucacagcgagacuccaucucaaaaagcagaaaaaaaaauuucaauuuacagaauuuaauccacugguuucagucagaguuuacaacucugcguuuauucuacacaaacauucuaagaggcaacaacgauagagcuguggccaccuuuguuacaaagcaugcauucuuuugaauaugccacauaauuauuucauuggaaaugccugaaauacauuuuucaacauaaauugacuuaauugcucuuaucucaucugucuuaucucguuugcuuugaaaauagcuaaaucggcuuuaauauuaccugaaauggaaaccaaugacucccuagcccuccauucaaccaaacaaauccaagcucagaaaaacgaucuugggcagaucuuucuuuuacucgacuguggauuaauauagagauugggcuaauuuugaaugucuuuaaaacauauuuuuuucugggcaaauuuuuaacaguaauagguauucugaauuuuaaaaacccuaaacacaaagaacgaaauguaacuacuacagcacauguauauauaaguuguuaggcgcauacuguuauagcaauuucagaaagcagggcagagagguuacuuguuucugcuguugagcuuuccuuagugccuggagucucuuuucuuuaaggcguuccaauucauccucauccaucugauccaguuuuugaauuucagaauccaaauguucuuccaccaguuugguagucugaagcagcugaugcuccaggacuuuggaaaacaugucaacagaugcaucagcuuccauucuuccaaaugguacagaguucagccugggugcuggggagaagauuuacaaaauacauuuuaaaaaaugcaaacaauaagcaagguuuucucuaccauuuucaaaaauucuggcaaguguauaauguguacucuauggaguauucuaacgacauccaagcacuugaugcugggcuuaacaauuuuuauguguuuuuaaauuuaauucucaguagguucuagucacaccacucaaaaacuacuuacagcaaauuuagggugcuucugauuuagcauauguuuuacuauacuaaagccaagacaagucuuuaagaccaucaccaaaccacagagaaaugaguugugaaguuauaccuagugauauauacugacaaucaguguucuuuaccaaugggaaagagaaaucagaaacaacugcgaacaauaggaagguauaccuacugagguuuuacacauaaauauauauauuaaacuuuacuuaaacacagaguacaguugagcaaaacacagauuuuuuucauggcugcugcccaaaugaguuucauuuaacuccuaagacgucucauuaccauuuauguaaagaagagugccugguguucccugagcauuaauguccauuccuguucucccauuaccuaacaaaaaagucuaugaggucacaaaaauuaauacugguuuccauuuacugacaguguuaacuuugauguaaaacacuccaaauacuuuucuaaauuuuggguuuuuuuccaacaucacuccucuguguaaaaucagaguuucaaaauagaacuaauucagauuagaaaggaagaccuaucucaauuagucaugcaucacuuaacaaugggaauauauucuaggcugggugcuauggcucacgccuguaaucccagcacuuugggaggccaaggugggcagaucacuugaguucagauguuugagaccagccugggaaacaugauggaacccugucucuacuaaaaauagaaaaauuggccaggcccgguggugugugccuguaguccccgcuacuagggaggcugaagugggaggaggauaccuugagcccaggaggcagagguugcagugggcugagaacgcaccacuugcaccccacccugggcaacagagccagacccugucucaaaaaccaaaaaccaaaaacccacaaaacaaugagaauacauucugagaaaugcaucauuaggugauuuugauauuguuucaaacauuauagacuauuuacacaaacccagaugguacagccugcuacacaccuaggcuaugccauacagccuauuacuccuaggcuacaaaucuguacagcauguuacuguacugaauacugcagacaacuguaacauaauggcauuuguguaucuaaacauagaaaagguacgauaaauacaguauuacaaucucauaaaacugaaauguccuuauguggcacaugacuauauauuuuaaaagaaauggaguauuuuguacuagcaauuaguacaaaauuuuacuuuuuuuuuugagacggagucucgcucugucgcccaggcuggagugcaguggcgcaucuccgcucacugcuagcuccgccuccuggguucacgccauucuccugccucagccucccgaguagccgggacuacaggcgcccgccaccacgcccggcuaauuucuuuuuguauuuuuaguacagacgggguuucaccguguuagccaggauggcuacgaucuccugaccucgugauccgcccgccucggccucccaaagugcugagauuacaggcgugagccagccgcgcccggccaaaauuuuacuucuuuuaaaagaaauggaguauuuuguacgagaaauuuuauaccaacaauuagagggcaaguuuauguguaucucaggguuauuacugcagaaaugauuuauaauuugccuaucaaagcaggaggcuguugcauaucaaugaacuaugauacauuugcaaauaauacugaagcaccccaaacuucacaacaaacugugaauucauucacucagcuucugacacagauucugacccacacaggcccucuauaaacguugagcugaagagaaauauucuugcaaacuucaauucugauuccuuuuucuuuacaggaaaaggauuugaaaagcauacuugauuucaucuuuguaucuccauagaacacagcagguacucaauaaacauguauuuaacguugaaugaacacgugccugacuucuguucaaauuacuacacuguuaaguuucaaaaguauuugagucuaaaaaaccaaauuguaagcuccucgugagugcuauaaaauuggaaaggugcuguauuucaaacacagcaaagauuuccacgcucccuaucgcccaagaaaaaugucaguaggacugugacccucagugagggggcuggaaggagaagauaauaagauacugaauugaacguuggaagcugugcuccagggauaagcacagagaaugccuacccuggaacuuuauagaaugagcccagaauuuaauuaugggauaacuggaaaaagacgagauuaagaagagcuauucuggguguagguguugguggucagagcauugagaaugggguaaagagacgaugcaaccccucguuagcuuuucauuuuucaaaccacagccucugauucuuccuuuuuacagcuccgcuggaagggugggacgggacacagcgcguccucaaauucccuagucauuuccuggacacccuuacagguauccgccaaaacaaucaaggggccugguccuuaacugaaccccagguaccuccccaauggcaagccggccacucccugcgcccggggaaacagaggaaagcacagucccgguggccccaacuucgacgccuccuggugcgcuugcgcaagagccucugccaggacaccgacaccggugcuggggccgcgccccuccuccgcuccggauguggagcagcagaauguucaccagcacccggacgugguggucggauucuucucacuacccucugccucaccugagcucucggugacgccugagaagugaaagagcagcaguuucaaaagacacguccacuccggcuuuugccuugcaguagcugccggcggcugcaaacgggccgucacauccgccuccuuauuggcugcgaaccucgcgcgauaucaccuuggacgcc

SEQ ID NO: 191104 - RNA, 62895 nt, Homo sapiens
uuaauguauaaaaaucucuacuaaaacagaucaagauuaaaacagaucaagauuaauguauaaaaaucucuacuguuaccaggugcuggcauacaagguagugugaugauaguuuaguuuguaagauaauucuuguccuaggaggacaacuugugggagagaagcuacacuaacauggaagccuaacagagcuugcuuacugguggaugucuguuuucuuuauugguaguuugguuuagaauugugaugauuacaauggacucgugacuacacaagcaguaaaaagcagccagcugugcuuuuacaccaugguuucacacaaagcagcuaaagaaauaucagaaugccuaauuuucuauuuuauaaaagcccuaaaggcauauggcagaagaaugcuggaaaaaucacugugggaagaauaugcauaaauaaagaaguauuucuuacgucaaaaaagucccaagaaucacaaaaucugcagaagcuugguuaaucaaauacugcaguacugauuuaaucaguauaaaaucgaaagagcuuuagaucuguaauaaaaauccaaauuuggggaagggcaaacuuuaaaacagcagccaaguagagaaggguuggggaagggagaggugagugaacaggcacauuggaacuguggggacauguaacugaccacugucaaaccaguguaaguuucuugguuucucauggaaaacauuuuauacaccuauuuuucuuccuuccauacuuaaguccaucaguguccaaauacgucuguuccauuuuuugucugauuuuuguugggauauuacaacacaguauugcauuuacuccaguuccugcuccaugugaaaaaauuagaugauuucaaauacuuucuucagcuccacaauaagcugccagucacucuucugcauuucaucucugaaccagucuuugagugcaucaauggacugccggcugaucugcaaugcccgaggcacaaacaggguaaacagaacauaacaaacgugccaaagaaagcuguggccccagaugcccgcucucacuguacuaaaaagcuuaagcagaaauaaaaaacagggcuugccugccuaagggaguagaauuccaaaaucacaucugguuugcaugucaggcacgaggggaccuaaaaguccuagcuuucucuguuggugcugcuuuccugauagagcaacuuccucaacagacaaggcccagcuagaggucaagcccuaaugggggauccagucccaucagauucuacaaucaaacugaagcccaaggagcuacagguacaggugacccaagaagagugauucccuguugcuuaaagugugccacuuuugcugaaauacuuaccuuacuaacaagaauaucuguagcuucaaaaugucuuccaaacauuuugggugacucaccagggauagguucuauuuuuacacaaacuucuuguccuuuuuuugcaacauccacuuguuuaugguuuauuucaauacuuguuacuauuccgaugucaacaaacuauaaaauaagaacaaauuaaaaugcaugcagaagaauucaugccaaucacaggcgccauggcuggauagcugaaguaagaacuagagcaaaagccuguuuuaaaagucauggcagugcgauccuuucaucacucacgguguaacauuuugguaaacuaggcuggcaccaccaacacccuauucccuucaugaugguuguaagaaugacaggagauaaugugcuuugcaaaacauuccaagugcccuguugacccaaugucauuuccuauuuuugcucuaccauuucacgugacaggugccguaauaggagggaucagcaggcacaaagggucugagucaggaaugagcuugaaguggcugaugggaaugaagucagagugaggaccaauccugaaauuuuaagaaugauggccugugagcagaugagugaugugaucucagaguuuggggcaaaaaacccugacuccuuuguggagaaaaagauucaggagaguaagagugaaaacagggagagcucugguugguuuaggaggccaaagccacauagaaaguaacacaaauaaauguccaggcuuaguccacugaaaugguagaaaagcaaugacaacuucuaagugccauugcccauuacaagaaccagguuugggccagggaaaguacuagaugaggcuggaacaucucaaccagaaaggaagaugaugcucagacugcugugugucaaggauacaggagccaguugagcuccuacugaccacaauagaaaaucugaguaucaaaagaauaaagguaauggauuauauuaaaaaaaaaaaaacccacugagucuaugacucaauaaaaaggucagugggaagagguucuuuguaagaaauggggggacagguauauccacaauuuugcaaccaucuacguaauaguugacuuaggcaacgcuugccaguggguacuaaaggcacugggauaaaggcuguugagaaacaggauauccauuaggaacuccagguaccagacagauuacagaguaauuauaaaggggcaaguuucuaauggagaugguuggcgucuagcacuuuccccaggaaaucagagcaucagcagcagucagacaggcugggucaugcaagaggcaggcacacagggaaacugcaugagugucuuuccaauaauucuaaccugugucuaguugggagggagagaaacagauaaauccaaauggaggagggauuugcaaaacaacagggacacuucaaaaagaauggaggacuguucuugacugaggcucagccacaaaacaagccccagugcaaugcagcuugcagggcacugggccagauugguggggagaguuaccaaaacaucuuuggaauaacuggugaaauaauguugagggcugcaaauuauaggauauuguugaaauauuauuaauuuuucuuagguaugcugacagaaagggaagguaaacaugaguguucauuauacuaguuuuuaaacuuuuccacaggcuugaaaccuuucaaaauaaaauaaaaggcaauaauguaaagugccuuggagccccaauuaacugaagcacugagaucagcacugagucaacacugacuauggagcacugauauuuaccaauacugaagcacaacagaaggugacaggcucugcuuguuuuaaaguuaccacauuuucuuccuacugagguaaaaacacugaaacauuuguuaagaagguggagaccacacuaaauacacagcacaguacugugaacuacaggcacaaagcuguguugguacgacucuuggacacucauuuagugcuuuaagaaaugacccacagaauguacaacuagaacuuacauuuuugcuugggacacacauggguguccccuguuucaccugaccugcuuccaccgucacccccaucacuaucggaucucgagaauuaaaaauguacugagggaggauuuuuaucuugcagggaaauacugcuaugugccugaaaggaaaaaagaaaagaauuuuaagcuuacagaaucacuuaaacauaaaaagaaaaacugcagcugaacaucaggcuucucccauuagaggaaagcagcuuuccccagcggccacaggagaggggcaggcagggugcugcagcccagggccaccccaugcccagagcgcuucuuccuuguucuuaaccuccuccuccccauucuguugcuucccaagucuuugcuuucuucucuuuuaaagcccuaccuccaaaagaagcugcaucacaggagcauucuguuccuagucuaaaacacugagcuuggcugcugaagaugucagccacagucuggggcuuagaaccuaggcaguaccuggugacaggcaggucuucguuaggcacauauguaggcuacugggggaucacauaggcaucagaccguauuaucacccuccuuuucuccaccacguucccaaaccauugauccaaaaggccacuacauaacuacccugcuuauugagcacacgcuuaaaaugcuuuaaaaguuuccagcagucuuguuaaguagaauucuucucacuucagguuucaugaucuaaagugagcauauaccagucuaaauccuaauauuuacuaguaagcuccacuuaaaaauguaucccaaacuacgccaucacuccuaucaucacuguggucugaaucaccuagaccucuugcuuggacugugggagccuccugacaggcucuugccacugacuuccuaacaacccaagguccacauaacaacccaauuaaccagucugauugugaacacacagccuuggcaauggcuucuugcaaaacucagagaagcucaaucccucccauggccuguaagauccuugacgauacagguccugccacccucucugaccucauuuaucacugucccuucuggucacucugccucgcacugcuguucucucuggacacuccccaugugccuguguggcuuacucugucugaagaggugagaugccuucccaaaccacaucauuaaucacagucccuccucuccuuaucuaggcccuucccugcuuuauuugguuuuucagcacuucucaacaugugucaauuguccugcaauaagagcaugucccagaccaggcacaguggcuuacaccuauaaucccagcacuuugggaggcagaggcagguggaucacuugagcucaggaguucaagaccagccuggccaacauggcgaaacccuaucucuaccaaaaauacaaaaaauuagccaggcauaguggugugagccuguagucucaacuacucgggaggccaaggugggaggaucacuugagcccaguaggcagagguuggggugacccaugaucaugccacuguacugcagcaugggugacagaacgagacccugucucaaagggaaaggaggagggaggcuggccugguucucugcugaugccuccucuaccacugcagcaauguagguacugugagugcuugagugaaaguuugguagaggaauggacuucucucccacagaaucucuuauuucccgguuuuccucacucaaguuuuguuacuuccaaucuauauaaucccagaugagcaacauaaagucccuacauuuaauaacuacgaacccauuaacaagacccaagucugccaagauuauuaaacugaagucacagacaagacuuguuugcauacugcuggaauguccccaguauguuggguuucugguuuguaacacaccauuucaggaugcagccucugguagaugaguaaaugccaugauuuugcuguuuacagcccuuucuggaauucaguaauucucaaucauguucauuaacaaagacucaaaguaaauaaaaacaguaacuuacuuaaauucuucuuguuucuguuucuuguagucuugucuauauuuuguaaaggcaucaaauaaaugauaaauaauuucugcacuaaaaauucuaacuccuaaacuaucagccauuucuugugcaucucguucaauucucacaucgaaggccaaaauuacugcauaccuaaaagguuaaaacacaucaaagaccauucagugaaaaacagaguaugucacagaggacaguuuuuuaagauaggacaguuuuaagauagcuacguaacaugaaagccuucauagcaagagaaauuacuuacugagggucauguuccaacaucacugaagccuucauaacaucuuuuuuaugcacugggccaauguuaauuccugcauacugaaaaaaugggaguuuccauguuuaucuguauguaucagguaauggcgauggcaccaaaaaccacgaccaaccaccauucacuuguggagcgaguuguaguuacuuacgggcacuucugauguuuucagaaauuccaguagagcuuccaaagaacccaguguagaugccuggacauagacuccuuuuucuucuaauuugauagcauuuagugucugcuuuaacucauggaucaauucauccuugaaaagaaaucagauuugauaagguugucaacacaccucuauccucagcagucuagaauuaaauuguguuucucucuuugguuaaguacucaucugcaaauaugaaacuaaggcuuagauagagcaaggcaucacagaaccugugcuggaaugaaggaggagauuucggggccauacccuaacuguauuucgcuucaccuuugucuuagguuuacuaacuuugaaauauguuuaaucuccgcuccacuuggcaaauacaguagaugggugggcagaauuaaacaguagagaagaaaaauuuuuuuaaaguuaaaaaaguaccacauaaacguaauguguuaugauagcccaaaaguucagcuugucuguguuaacuaggaaauaccauaaucucaugaucucagcagcuccuuccuccaucacugcuugucgggaaauggaagaagagauuuuuaaccagaaauaaguaaaacaaguuuaucaaugccacugaagggacguaaguccacuccauacucaggacugggugaagagacaggccugcccuauucucucacuggcccuaagauagcuuauucccaacagcaugacuugaugcugccuaaauaauaaacacggccccaggacacaagagccaugugcugggaacaguuguauuuucucuuuggcaaaugaacaaacuauggcucaaaguccacuuuuaugaaacuacaauggacaugggccaaaaagaauauacaauuucuagcuuuuuuuuuuuuagacaggguccugcugucacccagguuggagugcaguggcacgaucuuggcucacugcagccucugccucccagguucaagugauucuccugccucagccucccaaguagcugggacuacaggugugcauucaccaugcccagccgacuucuagcuuuugacucauuuuuuuauuugaauaaaaugcauuauuuuuauaauucuaguacauauaaaaauuauaccaauuucuaugauuguacaaacugaaguaauucaaaagcaucaaguuugcuaagaggccaagaaauggcaggcuucacaaagacaaagccaguuuuggucaccaucccuagcaugugcaaugcugacacaugccagaacucaaauagcuuuuaaggaaaaaaauuuuuaaaugaacuuacuuuaagaacagggauuucaucuucuuuauaagccacaaggagggguaaaccagccaauguuuucuccaggucuuuuccaagaaucuuuacccccugagcugcuucuacuucuuuaugcuuuucauacugguucuacagagauaaaaacauuuguuaccaaauguacuuuaaaagugguuagcaguagaagaugauauaagagaaucucaucaugauauuagagagagguuucuuaaacgaggcacaaaaagcaauaaucacaagacugauaaauuuaacauuaaaauuaaauauuuccauuucucaaaauaccacaggaaaaaaaaagucacaagaguagaagauauugcaaaacacaccaacuaacaaaccgguauccugaauauauaagcgcauauaaaucuguaagaaagauaaugcagaagaaaaauguacaucucacgaaggaggaaauaaauggccaauaaacauuuuuaaaugaccaaccagguuaacaauuaggcaaaugcacacugaaacggcaaugagcuacacacuuagcagaauggcaaaaaaaauuuaaaaccuaacauccaagaacugaugaagcuguaaaacaaugaaacuaaaauacugcaguugagaauauaauuuguuacacccacuguagacaaguguggccuucacuccuagguauacauacccugggaaacuggcacaaacacaucaagagauguucacagcagcagcauuauuaguaacaacaaaaaucaaaaacugggccgggugcgguggcucacuuagggaggcugaggucaggaguucgagacuagccuggccaacacggcaaaaccccaccucuacuaaaaauacaaaaauuagccgggugugguggcgugcaccuguaaucccagccuggaugacagacugagacuccaucucaaaauaaaauaaaauaaaauaaacauaaaaaacuggagaucaccuacauuucccaucaacagaacagauagauauguugugauauagucacacaauggaauagaaaucuuaaaauuauauacuuuuuuuuuuucacuaaaggaagccagauauaggccaggcaugguggcucaugccuauaaucccagcacuuuggggagaucaagguggguggauugcuugagcccaggaggucaagaccagccugggcaacaugacaaagucccaucuguaaacaaauuagccaggugugguggugcguaccuauagucccaacuauucaggaggcugaggugggaggaucaccugaaccccggggagguugaggcugcagugaacugugacugcaccacugcacuccagccugggugacagugagagccuaucaccaaaaaaaaaaaaaaaaaaagagccagcuauaaaaguacacacugagaauaacuccauuucuacauaaagucuacagacacuucuaagggaaguacucuuagacacaaaaacaaagcaaagcaaggauauuuguuacugucauaaaaugcaaccaugguuaacucuaugaaaggucaggggguaggaggggaaggcaggggaguugaucaggaagaagcacacaggaagcuucugggugccagcagcguucugauucuccaucugguugcuucccaaaaauguguuaaacuuuucuucuauguuguguguacuuuucaggagcaauguuuuauuucacaauuaaaaauguuaaaaaacuacagcugacccuugaacaaaaugggcuugaacugcauauguccacuuauacucagauuuucuucugccucugccaccaaacacagcaaggccuaccccucuccuucuucccucucagcuuacucaacaugaagaugagaaugaggaccauuaugaugauccacuuccacuuaacaaauaguaaaucuauuuuccuuaugauuuucuuaaucacguuuucuuuucucuagcuuguuuuacuguaagaaugcaguauguaauauauaaaacauacaaaacauguuagucgacuguguaugugauugguaaggcuucuggucaaugguaggcuauuaggaguuaaguuuuuggggagucaaaaaauauauguggauuuucaacuggccagggagucagugccccuagcccucauguuguucaagagucaaccguauuuagcaguguagaaccauaacaguguaguuuagaaucuggcaaaggcccagucugguaagcagguacuuucacacaucucuacucugacagacaggccuuccuguaugaugacaacuaaaauaaaagggagagcgagggauguauguguucuguauuaagucaaacagcuuucaaagugaggaaaccaucucagcagaacuucuaaacacuguacaaguccccacgugucaaugcuucccaccucagcauaccuucacucguaauuccuucauaggaggagguaacaggaggccucgaaucugaguuacaaugggcccuucuacuccaggaacaaugauuguaucuccuuccuucaaacgcccauugaucaagaugacaucuauaguggugcccauccccgggagagcuuuaaccuaaaaggcauuaaugcaaagagaaagacauacauacaaugcaccauguucauuaaaucuaaaaguaguaaauauccuccacucaaggaacuugcuauuuuuaaaaaaaaaaaaaacaauaaacugaaaaguugaucauuaccuccaucaccugugcucucagcucuucacagugugcaagucucuugcucaacauggucugaguuaacucuacaagaagguagaucagacuucccaugccaucaccaguaugugcagagguagguaccaaagacacaaaagugcggggaucuuuauucucauaaaacaaagcagcauucaaacccuaggagcaaaaaucauccaaaaugccaggcuguaaagaaaacguaucuggaauaggugugccucacuagaagccggaugagcaaauggcucaucauuuugaaacuccucauaaacacuaaaaaugaucauguauauccuauaagcauuaacuguauuauagcaaaguaguucuaagucaacucaguuuucuaaauuaaaguauucagacugcaaagaaaaaggagaaaagggaagaagaauuuaaaaaaaguaauugcugucaacagaggaaaagaaccaguauuaaugaaaaugcugacuucauuauaaagauaauauaauacauauucugagauaggcucuucagaaagaaggaaggccuucuuaccugcugugcaaauucuacaauaauagccuuugcucgcuccucaaauucaucuuuuguauucuuuuucugcuucuuuaaaguagcagccacaucagagucaggacucuuuuuccaaucauauaaccuaucaaucugaaaaaguuuuuucaugagaaagaucucuaaaaaauucagaacauucaagaacuguauuaauagcuccagaaaauuccucaugugugucucauauauacagaacagugugacuuacucauacacuuuauuguaccaaaagcuccuuucagacugcuuaucggcaccugcucuuaaauuagaaacugcuguggugccaugcugccccugucagccuccaugaguuccuaaguggcugccauuuguuugcaaaagauaacauccuagaauuauccuaagacuauuaauguauauuguuggaauuccgaaacaguuuuuguaacaaaucaaucaaucccagcaaguaccaucacuauaaaauuauauaccaaaaaauuaaaaaauauauauuuucuaagggaacagccuauuuuaauuauuuuauugcucaaauuaggauuaaaucuguuuuguuaaugacagaaucuauuuucccucacuuuucaacaugagagauaaaugagcauagaagaaaugaaaaauacuugcuagccaaacaaacaaucaaaagcauaaucugucuggggacagagucuagggugacaaaauaaagaaucagacgaaucugaaugcuacuaaggagacaaaucaguaggaaaugacgaagauguuaaaauuagcauaugagguccuuagaauauuuauaaacaugcucaacaccuuuaaaggaaaagccugaagcuuguaaagcuaaauaauaaaaacaugucuaacuaguaauuagaaauuaacacuuuuaaaugcuuauauuagaaaagaauaucaauaaaaccaaaagcuaauucuuugaaauaauccaauuccugcacauucuuucagaaaacagaggaggaaacacuucucaacucgucuuaggaggccaacauuacucugauaugaaaaccagauaaaagacauuacaagaaaacuacauacucauaucacucaugaacauagacacaaaacaacaaugaaacauuacaaaucaaaucuagcaauauaucaaaaggauaacaaaugacaaccaacuaggguuuauuuuaauaauguaaaguugguuuaacauucuaaaaauucaacaguaauuauguuguuaacagaaugaaggagaaaauccacaugaacaucucuacauacgcaggaaaagaauuugacacaaucaacaaccauucaugauuaaagaaauaaaaacauaaagcacuuuaaaccaccuagaauagaaggaaacuuccucaaacuuaauaaagggcauugacaaaaaaaccaaaaaaacaaaaacccugcagcugacaucauacuuaagggugaaagacugagcacuuucccuuaauaucaggaauaaggaaaggaugaugucuacugucauuccuucuauucaacauuauuuagaaggucuaguuaguacaauaaagaagaaaaagauguagaaagcauauagguaaggggaaaaaaacauaacugcauuuauaagcagauaacauaacaacauacuuagaaaaacucacauuauuuacaaaagaagauacuaggccuaaucagugaauuuaacaaggucacaagauacaaacugaguguaaaugugauaaacagcuggaaauuuaagaaguuuucaugcuauuuacaauagcauuaaaccaugaaauacuuagggauaaauucagaaaaauauguccaacauguggacaauaaaacuacaaaauauugccaagagaaaguaaagaaggccuggccaggcaugguggcucaggucuuaaaucuuagcacuuugggaggcugacgugggcagauugcuucagcccagguguucgagaccagccuggguaacacagaccucgucucuauuuaaaaaaauaaauaaaaugaaaaauaauuuuuaaaaaugguaaagaggacuaaguaaauguacagagauaccaugcucacugaucaaaagaugcaauauugcuaaaagagccaauucucucaaaauuuaucuacagauugaaacgcaaucccaaucaaaauccuaaaaggcuuuuuguggaaacgaacaagcugacugaaaacuuuauauugaaauccaaggaccuaaaauagccaaaacaauauaaagaaaacuaaguugaaggauuuaccacuaccagcuuucaaaacuuuacuaugaagcuauaaugagacaggguaguaguggcauaggaauguauauagagcaauggaacaaaagauaaauucuaggaacagacauauauggucaauuaauuauugacaaagauuccaaacuaauuccauggggaaaaaaauaauuuuuucagcaaagagucuuuaaauaacaaaauauuucuauggaaaaaaaguaaacccugaccucacacuauauaaaaaaaagaucacugaucucaauguaaaaaaagcuccaacuauuaaacaucuggaaacaccagagaaaaauuuaaugaacuugggauaggaaaagauuacuuacauagaacacaaaucguaaaaaaauuaauuggggccaggcacgguggcucaugccugaaaucccagggcuuugggaggccaaggcuggcggaucacuugaugucaggagcucaagaccagccugaccaacauggugaaaccccgucucuacuaaaaauacaaaucagccaggugugguggcauguaccuguaauuccagcuacuugggaggcugaggaacaagaaucacuuaaacccaggagguagagcugcagugagcugagauaaugccacuguacuccagccugggugacagagcaaggcccugucccaaaaauaaauaaaauauaaaaauuaguuggauuucaccaaaaucagaaauuucuucucuucaaaacacacuauuaagaaaaggaggcugggcgugguggcucacgccuguaaucccagcacuuuggguggccaaagcgguggaucacuugaggccaggaguuugagaccagccuggccaucuuuacuaaaacacacacacacaccgcccccccgccccccagaaaaaaacaacccuaaccgggugugguggugcaugccuguaaucccagcuaccuguggcuuaggcacaagaaucgcuugagccugggaggcggacguuguaguuaaccaagagugcgccacacugcacuccagccugggcaacagcaagagauggucuccaaaaaaaaaaacacacacacacacagcaagagacagucuccaacacacacacacacacacacacacacacacacacacgcaaaacaaaacaaagaaaaugaaaaaccaagucccagaccauaagaauacaucagcaguacauacaagugaaaaaggaauuauauacauagaaccagaaguauaaagaacucuuaaaacucaacaauaaaacaaucuaauaaagaacaaaggauuuugaacauauuuuucaaagaaacagauauggucaucucucuaagcauaaguacaugaaaagaugcauaaagccauuagucacuguggaaacaaacuagaccacaauaauuuugcacucaacuacacaccuacuagaaugcuggagguagggcgaguauucgcaaagauaugcaggaacuagaauucucaacagauaaauggauaaagugcaguauuauucagauaauggacuacuauucaaaaauaaaaaggaaaaacccuuuauacauguaaugacaacaugaacaaagcauaauaacaugaguaacaaaaaaugccaaacuuaaaaaauuacauacuauaugauuccauuuauaugaaaucauaaaacaggcaaaacuaguccauaugacacagaaagaucaauacuagcuugaguuuagggagggcagcagaaugacugcaaaguaacaugagagaacuuuucuggaaauauggagauggucuauguucugaaugacagugguuguaaauuugucaaaacaaauuaaacacuuagcauggggugcauuuucuuauacaugcguaacucagagauacugcagguuugguuucagacaacugcaguaaagcuaauacuacaauaaagcaagccacacaauuuuugggguuuccuaguagugcuucuaaaagagaugcuuauacuauauuguagucuauuaagugugugacagcauuauaucuucuuaaaaaaagcaauguauacaccuuaauuuuaaaauauugcuaaaaaugcuaacgagcaccugauucuucaacaagucauaaucuuuuugcugguagagggucuugccucgauguugauggcuacugacugauuaggaugguagcucauaaaggcugggguggcuguagcaauuucuuaaaagagacagcaaagaagucugucccaucaauuaacugauucuuccuuuuaugaaagauucauuggcugggcgcaguggcucacgccuguaaucccagcacuuuggcaggccgaggcaggcagaucaccugagcucggaaguucaagacagccugaccaacauggagaaaccccaucucuaccaaaaauaaaaaauuagcugggagugguggcgcaugccuguaaucccagcuacucgggaggcugaggcaggagaaucgcuugaacccggaaggcagagguugcggugagcugagauugcagcacugcacuccagccugggcaacaagagcgaaacucugucucaaaaaaaaaaagaaauuuaucuguagcauguaaugcugcuuagagcauucuacccagaauagagcuucuuucaaaauuggagucaauccucucaaacccugccacugcuuuaucaauuaaguugauugcuauccuaaauucuuuuuugucauuucaacaauguucacaauacccucaccagaaggagacuccaccucaagaaaccacuuucuuugcccacccauaagaagcagcuucucaucuguucaaguuuuacuuaagauugcagcaauucagcuacaucuucugguuccacuucaaauuccaguucucuugcuauuuuucuaccacauccgcagugacuuccucuacugaaaucuugaauuccucaaagucauacaugagaguugaaaucagcuucuuccaaacuccuaucaauguuuauauuuuguccucuuauggaucaugaacguucuucauaacauccagaagggugaauccuuuccaaaagguuuucaacuuuugcccaaauccaucagaggaaucucgaucuauggcagcuauagccguauaaaauguauuucuuaaguaacaauacuugaaaguugaaaacacuccuugauccaugagcugcagaauggaugcuguauuagcaggcacgaaaacaacauuaaucuccuugugugucuccaucagagcuuggguaaucagguacacuguuagcaagcaguaauauauugaaagcaaucuuuuucucugagcaguuggucucaacaaugggcuuaaaauauucagcaaaccaugcuaugaauagacgugcuaucauccagguuuuauauuuccauuuauaaagcacacaauggauuuggcauaauucuuuuuuuuuuugagacggagucucgcucugucacccaggcuggagugcaguggcgcgaucucggcucacugcaagcuccgccucccggguucacgccauucuccugccucagccucccgaguagcugggacuacaggugcccgccacuacgcccggcuaacuuuuuguauuuuuaguagagacgggguuucaccuuggucucgaucuccugaccucgugauccgcccgccucggccucccaaaggauuuggcauaauucuuaagggcccuaggauuuucagaauggucaaugagcacuggcuucaacuuaaagucaccaaccacauuagacccuaacuagagagucagccugaccuuugaagcuuugaagccaggcagugauuucucucuagcuaugaaaguccaagauggcaucuuuugccaauagaaggcuuuuuugucuacacugaaaaucuguuguuuaguguagccaucuucaucaaucaucucagcuagaguuucuggauaacuuguugcagcuucuguaucaguacuugcugcuucaacuuguaacuuuagguuacagaaacagcuucuuuccuuaaaccucaugaaccaaccucuacugguuucaaacuuuucuucgacagcuuccucaccuuccucaacuuucacagaauugaagagagggccuugcuuuagauuaggcuuuggcuuaagggaguguuguggcuggacugauauucuaugugugacuccuccuuucacuugaacacuuacaggucauuguaaucuuauuaauuggccuaacuucaauacugucucaggaaacaggcccaaggagagagaaagagacaagggaacagcugguugcuggagcagucagagcacucacaacauguauugacuaagugugccaucuuauaggggugugguuuguggcaccccaaaucaauuaaaauaacaaagaucauuuaucccagauaaccuaacaaauguaauaaugaaaaaguuugaaauauugcaaauuaacaaaaugugacaagaagugaacacaagcuguuggaaaaauggcaccaacagacuuaauacucuugcuugaugcaaggcugcuacaaacuuacaauuuguauuuaaaaaaaaaaaacuauacacaaauacacacacacacacaauaucugugaagcacaauauagugaagcacaauaaaaugagcuaugcuuguaaguuaauuauacuacuuuuuuuaaucacaaaaaauuaagaaacauguuuuccuagguuaauuuuucagaaggcgcacauaccuuauugagugcaacaaugaagggacauuuuuuagauuugagaagguugauagacucaauugucuggggcuccaaaccaugcauaauaucaacaacuaaaauggcaaugucacaaagagagcuuccucuauuucucagauuacuguugaaaagaaggaaaagaucuauaaguagaaaaucuugaaauuaauacuuuucuuaaacuuuuaaacuucucuguaaaacccaaacaaaauagaguauauguauuaaauuguucaaguacuauuagcccuuaacuugccaaaggcucaucuaccaaucacuugaauugaccucaaguggaaugagcuaguuuuagaaccaacuaauauuucuaauaauuuuacugaccaaguuuucuguguuaaagaauauggacaagagacaacagcauaauauuccacuuguaacggguuuuacaggagauaggccuggcauguauuagcauguuuucugcauuccacauuaagggggugcucuuuuaaagcaguaaagacuucccucuauaaaaaacaaguauucaaagaaaacauuacuaaaucaaugagguacaaagguggagugguaguuauagagaucaaauuacuacucaaagguuaaugacucugcugaacuuuuagacuuaaugguuucaaguagauugcuugaugagaaaagacucaaauugcucuuaccugaaagauucaugcccaggaguaucaauaauuagcauuccuggaauccguacauucucucuaucaaacuagaaacaauggggaaaaguucaaaguuuaagaaagucagacaugaaagcuucuuuacagaacaauccuuuugccauaaaacucugaaaguaucacuacucccuuuuccauauaaauggcuuuagaaacagugaguuaaccagcaaaguacaguugucaguauuuucauuaaaauccaaaggcauuuuaacaaaaaaauacuaaaugagaaaauaucuccuuucuuaaggucuuacaacuaugacuguaguccaaguuugagcagauuauuaaguaaguggugauacgaaucgcagggcagucaucugaaauauucuauagaaaucugacaugcaagaggugguucucagcauugggaaaauuuaugugguccaauuuuaaagcaauucugacuucaaauauaucccaaaaguacauuuuaaaguaaauuuaccacauugaucaaaaguguuaaagaguaaaugcauacccuguuguauucaaauaacgucauaaaugcuugacuuucuggacaaaaggacauaaaugaauggaaguaacauuacaacagaucuaaucuggacauucccuuuuagucuaaaaaguaacacugaccaacuaauuucacacacacacacacacacacacacacacacacacccccuuuuuguauuaugcuuaucuacauuuucuuuuugcuaaucuucaaaugaucuuccaaaauuugguauccugaucuacaucaaaauaaugcaacguaaaacauuucagauccgcauucugguucacugagcaccauaauuauuuccacuuuagugucuuauauacuaacaguaaguaauuacaauugucauauaaagguuaucccaagaacuuuaauacaggccuaauaauaaucuuguuccuuacguucuaaaauaacaacgagaguucaaguucuggcaacugguggaauaagguguuaugaacccucuccucuagugacuaaaacauagaaauacuguuuaaaauaggaugaaaauaaauuauaaauuugaaaagcuauaauucaagaaaacuguucuaaaauaaaaauucacuacuacauauuauaauagaacaccacauaacuggaaaacucagaagcgacaucaagauguaaaacgaucauaggccuuauaaaaagacgaaauucagcugaugaucaaacuuaacagcaauacuuuaugcgagaauaaaugggacacaagauacuuaaggaaugaaaaugucaaccaaggauuuuauauguggccaaugacuuuccaguauaaaggccacaaaauaacucuucaauauucaaaaauucaaggaauguuaauucuucuaauuccuuccuuagaaauugacuagaagacacgcuucauaaaacccagucacaaagaaacaaaacaaaaacuggagagacaaacucauagacucuuuuuacaugcagaacuaagacucaauaaggaauaaaaggggacauuagcauauaauaacauaugcucuguuuguuuuucaacuuacugcuucucaguuccaaagcuaccacuuucaccugcucugugauaaugaaacugaggaauuauuaacaaggcccaguucucagucuggguaguuucuauauuacaugagccgggaacauccugcuauaucagacagcaugaaugcaaccaaaacuaggacaaccagaauuguaugagaaagauucaagagccaaccacugggcaaagaugggacuaucucagcacaauaauaacugaaauggacuaaugcacaguaaauauguuuaaauccaugaguucauaauaauacaaaacagaaucaggcugggcacaguggcucacaucuguaaucccagcacuuugggaggcugaggugggaggaucacuugagcacaggaguucaagaccagccugggcaacauagggagacccugucucuaugaagggcaaacaaaagaaaaaaaaaaucauauuggccacuuuuuauuuuaaaagcugguuaaaagaagguaaaggaucaggcauuaauucugccuuuccuaaauaagccaucacugaauaaucaaauaguagauuagguaacguuucucuauagaaguaauccaauaauggcugauggaguucgaguaucaacauuuugcaacuccuaacacauuaaaagguagagauuaucuuaaaaaguuguggcuggagaagagaucuuugauuggaaagcuacaccuggagggcuucugaagcagcuugcaagguuauauugcucaacaaaggugacacuuaaagggugguguguauuauacugauucuuuaagcuuuacauuuaucuuacuguguuacauuuaacauacauaaacugaauaccuccaaacaaguagaaaaauaugggagaaaaagaaaagaaauugauuagauuagaaggggaaaagaguagagaaggaaacaaaauuuuaaauuauggggauaaaugguaucaguguuaaagcauggaggcaaaugacuaacuguggaauaguggcugccucugggagagggagggaaggaaauggaaugugagagcuccuauaauauguaguguuuuauucuuuaaaaagaaugaucuaaagcaaaauaggcaaaauaguacauguuaauucugaauggugaguauauggagcuguuauccuagucucuguccuuuuucuauguuugaaauaguucauaucuuaauuuuugucagagauuaaaauacaugaaauacaauguacuuacauuuuuaaucaucuuagucuguucauuaauagcuucaagaggaacauugguggccccaauuuguugugugauaccaccugcuucaccaucuuguacaugugugugacggagcuaugagaagacagcaaauacagauugguauuugaacauggaaaagauagcagcaaaaauaauaagaaauuagcaacuuauuuauuguaagcagaauugcuuauauguccuauuggucucuaaaguuuuuuuuuauaagguaccauucacuuauuuucaaaguucuaucaauacauuuaauacuuucuuaccuuaucuagaauuuuugucuucccuguguccacaugcccaaguacgcagauaauaggggcucuuagcuuuucgguguuuacauuuuuacuauguucaagucgccguuucuagaaauaaaaaaaaaaaaaaaucaaaaauuaaauauuauuucaaauccucacuauccuuauuuucuguuuugccuuggcaaaagaaugcuacaaccugcauccaaguucuuuguugauuugacuacacauaauuggaauuuauaaugugaacuuuacaaucgaauucccaucacagcaccucuggauaaggaaaaaccuguuuagauuucacagcagcacugcugaauacgaauaggaauauuguaaagugucauuucaaaauuuuugaauacuuuuguacacaguuacuuuaauggaauauaaugacuagaaaaggaaucaaucuucccaucauacugacuauauagugcaacccugaauuugugugaggauuuauauaaaaacaggugaacuuguacauuuuaaaaaauucacuggaaccuaagaauuuuaaagauuuuuaaaggcaauuuauuucacacuuuuauccaauauacaaaugcuauaaaaccuuucaaggaggagacuguuuauuuaagguucagcuuaaauaaguaaaacauguccugacuuuccaaggcucuaccacuuuaugaacaccaguaagagcgagaaagcuuuuccuugaaccacaacgugcuucuccguugcauuuaccuaaaugcuucagcuuucugaggaccaaaaacacaugccagcaauagguuuucuuugaaaugaccucucaaauacaguaaaguuggcauucaaauuagauaaacuugaagcaaaaacuaugaaguaaugucauuuacaaaacuauuuuucaucuaaaaaccauuucuguaagaacccuuuacuugcauuucuaguacuagacauuagauuuuuugguagaaacugaaacugaaaaacuuuuuaaaauaccaaaagugagaugccagggaugagcacaaaguaggacuuaaucacuagcaaagaguaguacccgacaaccucacaguacauacaacucaaauucaaacaucaugacuuuauuugauauggcugaaaacugccucucucucccacacuuagugaaguguuaaaaauuuuuggagggcaauaaguuacaaacugacucagaaauucuaaguauacugaagcaaugacaggacaagaauacaaaccccauuccacaauggagauucugacccaggaauggagugaauuucagaaaaucauaauauguagcaagguuuauggauccaugaaguuuguuauggacugaacauuuccccaaaauuccuaccuugaagcccuaaccccucauaugacuauauugggggcuagggccuuuauuuuuaaaaacaugaagcucauacacacuaccauuaacuaaucuagggagcaggauaauugagaaacucuucugcuuuauacuuauuuuguuuguuaaucagcaagcacaguacagauauuccaucacucucucgaacauggguauauggcaagggagcuggugggaguaggugcuacgggaaaagacagucauaacugaggugccagguggggaagaaugcuacaggcaucuaguaggcaaaggccaagauguuguuugguaucauacaaggaagagaacagucccuguccccaacaacaaagaauuaucuggcccccaaauuuuaauagugccaaggcugagaaacccuaauuuagaauaacaaauccucuuaguccuuuagaaauuuagacaauuuauccauaccuagacuuuacaggagaaaaagcaaauguugauauauagguaguaaaacaaaaaauuaaaaaauuaauaauacacaaaaaggaaagcuaaaauaguuuuuagcuuuaaaauaguuuaauauccucaagcaaacuagauuuuaauguauuauuuacauuaagcugacagaacuaaagaaaacuuucucuugaagcauacugaaaucuacugcauuaaguaggaaaaauacagaaagucuaucagguaucggacuuuacuaaauagaagccucaucaacccaccagauuuauauaacuauagugaucagaugccucauggugacuaaccuaaauaugugaggcaaacacauaacugauguuuauaagcagagggcauaugcucagaauaccucugcauacuuauaaacuaucacucaaagaguacauuaaaauuuggagaaaacaagaaaaaaaugaaguagucacaccauucuaucuuagguaagagcggggacgggggguccuuggguaagaccaguaucaaaggccaguaauauuucaacauuacaaaaacugaacgguguucuauucuugagaauacauaaagugcuguucaaagccuuuaguuguagaguacuguuuuaaucaucacagaggagugggaagaaaaguagagagaaacgguaaaauaaauaccucaauccuccguuuugcuuugucauaagcccuuucuucuuuaguccgaucaucaucagagucauauucagaaucugagcucauuucuuuacuuggcuuuuuaucuaaugucuucccugaauccuucucaucugacaccuuuucaucuuccucaucaccuucacugccuucacuuucucccuccucuuccuccucuucuucacuuucuucaucuucuucuuccucuucuuccuccuccuccuccucuucaggguuuucuuuuacuucuauaugaacuuuguuuccuucuacuacgaaagcaaauauauuuuuaaauaaauaaacauuaauaugauagauuuauaucaagauaagagacuuuaaagcagggguguccaaucuuuuggcuucccugagccacauuacaagaagaauugucuugggccacacauaaaauacacuaacacacuaacacuaacaauagcugaucagcuuaaaaauaaaaaucacaaaaaaaagucucacguuuuaagaaaguuuacaaauuugugcuaggccacauugaaagccauccugggcugcauguggcccacaggcugcagacuggacaagccugcuuuaaaguaaggggaggagauaaugccuggaccagaacuguuucagauuuuuuaaaauuuggaauauuugcauucuauacuuacuucauauuuuuuuuaauuuggaauauuugcaucugaaaucggaaaaaccugaaauacgaaaugcuccaaugagcauauccuuugagcgucacguaguggugcucaaacuugauuuuggagcauuucagauuucagauuuuugaauuucagaggcucaacuuguauuuaaggcaguaacaugguguuuucauacaucauaaacgcaagguguuugucuauaugcuaaaacgaaaucugucacuuaacaguaaaaccuuaaggcaguaauccagacugaagucaguauuaguaagacagaauccaugggagaacaaaacucaaggagguggaacagucuuuaguaccacuuuccccuuauggucauuuguugauucgggaagaggcagaugaaaggcuaagcugcauugggaguccagaccuaccaaaauacuaagaauucaguggggugcagugagcagacauuggguuacacccuuacugugggguacaaucaugaagagcuguacccuaggaauaaggaugaauaagaaauaaacaggaucuccccauuauuggcagaucaccuucagauccucuggauucuaaaucuagaauaagauuauuccauauugcuaguucacucagguaccuuguggaaguaacacauaaauuagcucuggagaaaagaaaacaucauccuugaccucaaauuacuucuccaagcaaaauauccagcuauaaaaauagcaaggcacaugagaaaacaauuuacgugagaagaaccaacauauaaaacaccaaaaggacuuuaauaaagucauaaaaucaaaauuuuaaaauggcugugcuucuaacauucagucagaagcaaaagacaaaguuaaaauuuuagaaggugaauuaaaacuauaaaaaaaguuaaauggaaauacuaaaacugaaaaauauaacaaaugaaauugagaacucaaaagauggaucuaaccucagaauagaaagagccaaggagaaaaucagugaccuagaagacagucaagagaagcaauccagaaugaaccacagagacucacuagguggaaaauacagaaaagaaaauaggaaacaaugauacaauaagagggccuaucagagacaucauuggaauucugagggagaaaaugacuccuaacauaaaacugauaaaaacauaaaaccauauauuaauaaagcucuacaaguagaauauauuuuuaaaaagccuauucuggguacgucaugauaaaacugcugaaaagcaagaccauaugaaaaauuuaggcugauaccugacuucucaacaggaacaaugaaagccagggcaagggaauaauaacuucaaaguguuaaacuucaaccaauaauuccucacucaguaaacauauaaaacuaaagaaugaagaugcaauaaagauguuuuuagaaagcaaaacagaaugucuuacuaacugauccauacuaaaaaaaacucuaaaguguucuucagauaggaagaaaugaucucaaauggaagguacaagaugcaggaaacgaagcgcaacaaaauguuaagaauguggguaaacuuauaaauaguaaguauugacuauauaaaauauaagcuaauuugagguuuuaaauagauaaugaaaagaaaugagaaaaauuauaucuuuuuuuuuuuuuuuuuuuuuuagguaagagucucgcucugucgcccaggcuggaaugcaguggcgcaaucucagcucacugcaaccucugcuucccagggugaagcgauucucaugccucagucaccugaguagcuaggauuacaggcgcacgccaccacgcccagcuaaauuuucuaguuuuaguagaggugggguuuugccacauuggccaggcuaaucucaaucuccugaucucaagugauccgcccaccucggccucccagagugcugggauugcaggugugagccgccaugccuggccgagagcaaugauaucuaaauagaguauuggguaaaugucauucaaguacucuaaagucccugcauuguuagaggauaacaucagacauuguuaguucaaagguacuugcuaaaaauuuucuuaaucacuaaaaaguuguuugaaagguauacaacugcuaagcucaugaaaggaaaaaaaaauaaaaauuuaaaaaccuaguaaccaaaagaugauuagaaaggagagaaaaagaaccaggcagaacaaaaaacgacuuaguaagaugaaauguuuaaaaucaauauacuucauuaauuacaccaaauguuacauuuaaugaacaggcuaaguacucuagguaaaauauaaagauugacaaacuggauugaaaaaaucucaacuagauccuagcugugauuuguaaaugguguccccucuaaaauucauguuuaaaacauaauccccauuuugcugguaggagguaggagggugguggggaagguuuuggggagugauuaagucacucucauaaauggauucacgcccgcagaaaagugccuucaaagagaguuugcuccucuugcccuucccucccuuccaucaugugaagacacagccauccuucccucuggaggaugcagcaccaaggugccaucuuggaagcagacagcagccuuuaccaggcaccaaugcuggugccuugaucuuggacuucccagccuccagaacugugagaaacacauuucuguucuuuaguacuacugagucugugguauuuuguuacagcagaacaaauggacuaagauaaugcuauuuacggauacaaaaagagucauaaagauagaaaaagaucauguaaaucaaagcucguguaccuauaugaguuuuagguagacuuuuauaucaaaaggcauuguuagaaauauauauaucaaugauaaaagagucaauucauuagaaagauacaagauuguguuuaccuaaugacacagcauaaaaauacauaaagcaaaaauuaacagaacucaggagaaauagacaaucuacaaucaugaugggagauuuuaaggcauuggucccaguaacagagagaaaaaacagaucagaaaaaaaacaaaagcaaaaacaaaaaaacccucagaacgcuaugaaagacuugaacaaaaugauuagcaaacuugaccuaaauauagaaagcaaggcauccaacuacugcagaauauaaauucuuuccaaacaugaaacacuuacaauaacugaccaugcuagguuguauagcaauaaucaacauauuucaaaggauagaaucauguaucuucucugaucacaaugaaguaacaaaagacaauuagaaaaugcccauuuuuguaaauuaagaaauacacuaggcgggcugugguggcucacaccuauaaucccaggacuuugggaggccaaggcgggcggaucaccugaggucgggaguucgagaccagccugaccaacauggagaaaccccaucucuacuaaaaauacaaaauuagcugggcgugguggcgcaugccuguaaucccagcuacucuggaggcugaggcaagagaauggcuugaacccgggagguggagguuguugugagccgagauugcgccacugcacuccagccugggcaacaagugugaaacuccaucucaaaaaaaagaaauacacuaaauaaaucuuguaaaacuuaauacaucaaaaugaaaaugagaaaauaucaacauaucagacuuacagaauuugacuaaagccaugcuuaaagaaaaagguauagcuuuaaaaacaaagauggggggaggcugaaaaaaaucaaagagccagauaucauuaucaguaaguuaguaaaauuaacaggaaauuaaaucucgaaguagagauuucaguaauaaagaaggggaaacaaugacaaaaacguuuacuuucuauucauacuuaucaggaacuauaguauuuaucucauuaccuuuuaaguuaacagugcuuuuuguaggucagcuuuaguaacaacccuauuuuguaacaucaucacucugaaaaaaugcauucuaaaccuuaggcagcuaucuuacaaauaacauucugaggaaccacucauucacaaaaugaagauccacuugaggacuuagaaaccauggcaaaggagagaacaagagacuuaucccuauccccagaaauguucauauggcuuucauaaucaaaagacuauucauuuaaauauauaucauucauuucuaauaaccacuggauguaucagugugugcuuaugagguauucaccuuuuucugucuccucaucacuggccauagcuucccaaucauccaauccagcauccucaguaucuucuucuucuucuguaaguaaaaauuugcauuuaagacacaaaaauuauuuagaaauaugaaggucuuuuagaaaaaaguaaaaaauuaugcucugacauaaaaaaagaauguuuuaauuauguaaaaaauauguaugcagcuauuaucuuuagaacuaucuuuuuuuuuuuuuuuuugagacggagucuuugcucugucgcccaggcuggagugcgguggcgugaucucggcucacugcaagcuccgccuuccggguucacgccauucuccugccucagccucccaaguagcugggacuacagaugcccgccaccguggccagcuaauuuuuuguauuuuuaguagagacgggguuucaccguguuagccaggauugucucgaucugcugaccuugugauccgcccgccucggccucccaaagugcugggauuacaggcuugagccaccgcgcccagccagaacuaucuuuuuaauauagcuagcauguuauaauuuacuauuacuuaaaugcuuccauuuccuacuacugccaacauauuaaacuuaaccaauuuuacauucaagcuaauuguuucauuaauuuaauuaauuuaaauguuucuuuagaucuugaaaaagcuacaugaauauacucaguucuugaaaacaaaugaaauuucauauauaucuucuuuuugaucauccaacucauacuuuaugcaaggaauuuauuauuuugcuuuuaaccuuuacagguauuuaaauauacuuaaauucugaaguugaagguacaaaacuaccaccaucacucugggucaaugcugugcucauaaccccaaaacagccagaaagcuaaaauucugaauauuauuuagacauuaaagaccuaauacucuucuuaacaagaaugcuuuucuuuacugaaaucuaaccaggcacaacuauucuuaaaugaaaguaagaugacggguaggacaugugguaccugcuucccugaaauaaucauuauuuacuaacaagccugcauaaguuaucuugaggaggaaaugagacucagguacccaaaacauccaucuaaauuagcaauucuuucuggugcuaaaaauacgaucuaaaauaguggacugcuauuaagcauaucaaucuaaauuucucuaaucucgucauaucagugcuaggcugaggucuacccaggugagaugauccuauucgcucagaagagaaaagagaaaaagaaggaaaggaacuaucaauaauauaauucaccaauguaaaucaggcuuaguauucuguaaaggcuuuucccauuccugauccuaucuuuaaucgcuggggauucucuugaauaccaaacauacauuuaggcagccccagcucucccaucaauaucuagucguaagaguuagaacaauguuuuuuuuuuaaaaccagagauuuuuccccaacuccucaacauauacacagauaccccacaaugaguaaguugaauucucugauuauuguaaauagaagccgaccuuuaggaaggucuaaaaaugccaauuuuuaugguucuuaaaaaguucuaguuaaaaauccuuccaauuugcuucugaagcauuaaaugaagaccuucagaucuuuuuuugagauuucugacucauaaauaaaagcaucagagaaaauccaaaaccuacuauccuuucuuccuuuuuuuuugagauggacuguugcucuguugcccaggcuggagugcaauggugcaaccuaggcucacugaaaucucccugcaaccucugccucccagguucaagcaauucuccugccucagccucccaaguagcugggauuacaggcacccgccaccacccccggcuaauuuuuuguauuuuuaguagagauggaguuucaccguguuagccaggauggucuugaucuucugaucucgugauccaucugccucacccucccaaaguguauccuuucuacaaaacauuuucuaacacugcugaaaagaacacaacugauucaagucucacuuggauacuuauucaaaguagaaaugaaaagaaauagaaaagaaagaacuaugaagaaagagggccauccagccagauacuuauuugguucuccccaauuauuuauaauaacuaagacaacuuaugacacaccaacacuauuuaauaagaauucacuaauuaaauaaucagauaacacuacccgccugguucaacaggagguggugucucuuccuuuucugguacuccuuguuccauaacuucuacagcagcacauaauuccauugauucagacacugaaaaaggggcagaaaccaagauaauauuuuuuuugguguauaauuucuguuaagauacuccauuaaguacugaauaaaaaacaguaguguaaaccuauuuauuuuuuauuuuuuugaaauggagucucgcucugucacccaggcuggagugcagugguacaaucucagcucacugcaaccuccaccucccggguucaagcaauucucccugccucagccugccaaguagcugggauuacaggcaccugccacuaugacaggcuaauuuucuuauuuucaguagaggcaggguuucaucauguuggccaggcuggucuuggacuccugaccucaggugauccgcccgccucagccucccagcgugcugggauuacaggcgugagccacuguacccagccugugcaaaccuauuucuucaaguuuagaaaauguuuaaauauagucauauguuuuacaggaaacuacucuuucugcucaauaaauaaaauacaaaaaucacagaaggcuaagaaggaaaccaagaaaagauaagaaugguaguuuuacuucucagaguuaacaacaguuacaauauucauaggguagaacccagauuuuucaaaguaaaauacuuuuuccauuagcuugucauuugaaucaagugagaauaauggcauuaauaagaaauaaguuuagaaaauaaguuucaauaugcauuucggauuuuuuccuuucuucuuuacagacacuguuuugaagauugugggggaaaggcaaacaacauauuuccuaaauuagaggcuauuuuguauacaaaccuucuuuacuuucuagcugcugugguauuuuuuuccucuuuuuaucuucauaaauuggccucuucuuuggcaaagagucuuuugauggcacuucaacaccugagggauaaaaaugaaaaacuucaggcuuauacuacuugcaugucaccugagaaguacuauuuaaaggauagcauuucauucaccacagagacacauacccuaaaauaugaaaggauauucauggaaaaacuuguaucuuuuacauauaagguauuuuaaaauuuacauacaguaaaaauccucguuucacauacagugagaguuuugauacguguaucaccaucacaaugaagaugcagaaaagcuccaucacuccaucauccugugcugcuccauguaaucaaacccuccuuaccuucuuagccucugguaaccacugaucuguucuccaaccaaaagauuugcuuuuucuaaaaugucacauaaauggaaucuuacggucuggccucuaucaucauaauggauuugagagucacucacucugcugcacaugucaauacuucguuuacuuucauuguugggcagcauuccauuguauggauauaucaguuugcuuauccauucaacagcugaaggacauuugaguuguuucugguuuuuugcaauuaugaauaaagcagguaugaacauuuucagacagguuucugugugaacauuucucuugggcaaauauuuuguagugugaaugaugaaacauaagguaaauaugaccuuaauuuuuauaaagacacugccaguuguuuuccaaaguggcuauacuaucuugcauucccaccacuaaugcagaagaguuuuggccaggcgcaauggcucacgccuguaaucccagcacuuugggaagccgagguggguggaucaccugaggucaggaguccaggaccauccuggccaacauggugaaaccccaucucuacuaaaaauacaaaaaauuguauuauauaaaauauauauauauugugguggugggugccuauaaucccagcuacucaggaggcugaggcaggagaaucacuugaaccugggaggcagagguugcagugggcugagauugcgccacugcaauccagucuggacaauagcgaaacucugucucaaaaaaagagagaaaaaaaaaaaaagaguuucaacugcucugaaugugguaaagguuucucuuuuuuuagaacauucuuuucagaugcguauagcuuucuggugaaagugucuguugauaccuuuugcccauuuuuaaaugaacuuauugguuuucuuauaguugaauuuugagaggucuuuauauauuuuggauguuaauucuuucucagauaucugacuuggagguacugucuuggaauucucuugacagugucuuuugcagagaaaaguucugaacuggucuuucucaaaauguaucuuuuuuccuuuuaugguuuagaguccuaucuaagcacucugccuaacacaagauauccuccuauguuuuccucugaaaguauuauuguauauuuuacauuuacauaugauacccauuugggucaauuuuuauacagugggaauuaaaacugguuuuggguuuuucugcauacagauguccaauuguucuaguaccacuugcuacaaauacuguauuuuauccacugaauuaccuuucaccuauauacuaaccauguauagacuauuuaucuguuugucuaucuuucuggcaauaucacacuguauuaauuccuauagcuuuauacuaagucuugaaaucagguauucuaaguuuguucuccuuuuucaaacauauuuuggccauucuaacucucuggucucuucauauccauuuuagaacuaguugacagauagcuacaaaauaccaugcugugauuuugacugggauugaacugaaucuacagauuacuggauuacugacucagucucucacuaugggcagaagccuuagaauaaagacaacagaaauuguauaccaugggauuuugaaugaagucacuaauaaaggaaaaugacuaaaaauguuaucucuaacguaggaauguauauggauguguguugugcauguacugaagaauggcuagaaugguaaaaccauagcuaugacugguaagacgaauacauuaaacaaaccaaagaaagaggauaaagccagcugagaaugcagagaucaucacuuuaaguuuuccuugccuagcagccuacaccuacuaagaugaaaagcaugggccugaggggaaacuguaggcuggauuaccugaaggguggucccaauaacacccuagacuuaaucaacugacuacugcucuagucucagacucucaaauaagcugcuguacuuggaaucaacaccaagacuuguauguguuuagacauuccauucacuuugcaaacugagacauaacaaucaaguucuugaagaagcucuuugccugaaaugaguuuauuacaaauuauugauaaaguacucauauauguguguguguguauaugcuuaguagucacaggcuaaaggaugacugaaaaguuaaccugcugcacauuucagagcaauuauaugaagacaccugcagaugccuacacucucugagaguacauuuuuagcucaaugaauaaguuuuacaauauucuagguaauaaaugugguaagcagcugucuuucaaacauacgaugaaacaacacuguaggaucuuuuaaugagaugacucacaugagugggcugugggugggggggaaccuugaaugucaagcuaaggaauuuggauucuuauuaguagacaauagggaacuaauaagaugguaaacacuggacaacacuaugaagaguaagagaccagcgucagggaugccacuugagagagcaucucuuacaagccuaaugcuaaagacugaugcuaaaaguccaccauucuacacuguaauuuccauaacuacaagucuaacugcuccuuaaaacagcauuuuugagacuggcaaauuacucccugcuuggucccaucugaauuucuucaugggugcuuuuagccucuccaauagucaccaaugaaaucugauguaugaaugcuaacuauauucaaguuuguaccuaauuucauuuaaaauuuuacaaaagcuauauucuccauuaagaauaaaacuuucuaaaaucuaaguacuggguuucuucacaucuaauguuccuagcugaacauaugcguaagaaaaaguugcacagaccagcuuaaauuucagcucuguggccuuggguaagcuguuuacacucugaaccaccauuucuucaucuauaugauggaaguaaaaauagcuauaagauuuuuuuaugagggaaaaauagacaaugucaaagacauuguagcaucaguuacacacuaagcacacaauaaaugguagcuauuacuguaauuauagcauaaacaccaaaaugacuguaauauaaaaaucuagggaauauaggagcaggaaauuuaagagaggucccaauauauucuucucauuggagcaaagacacuauuuuaaaucaccuuaccuuucaaaaaaguaauaaauuauaugcccaguugugaucucuaaacacuauuacccucuaaaaggaacaaaagcucuuuggauaaacaaccgauuccaggucucagcccaugcaagaugaaccugggauaucuuguugcaucagaaaguaaggaaaggguuaaaaaaaaauggucaugaauacuuuuucaccguggucaugugggcaaacuaauaugcugucugggaaucacuguauuucuuuuuuauuuuuugggauucacuuuaaaacaugcuaggauaaaaaguagauggagagguacaaaacaagaaugucaaaugguccuaauuguugaagcuggcugauagguacacagggacucauucuauuauuaucacuauucuuguuugugggaggauaacuuauuuagacauacuaucauuuacauauaaauuuuuauccucauguagaugucaucuuccuaaacaaugaaaugacaucaccuauuccuuacguuuuacugaacuuuuucacagauuuuucauaggaacuguccugaugcaaauuccauucuccuucugaacauuaagggauauaacugcaugugcagagcucucugaccauucaguuaaugaagaguaccacucacccugagcuuguagcaguuuaagaguagcuucggcucuggcucuggcuucucucugggauuuaguuaaaaguuucccuucuuuuuucaagcguucuuuucuuucuuuuucuuuuugcuuuuuccuuucucuuuuuucuuguuccaaucguuccuauaaaagaguacaugucagacaaaaccuguauucauuuaaugaacuauaaaauucaaauguaaacaauccaaacuucaaauaaaucucuugagacacaugcaaaguauuauguuaggagauuccaaaucaaaguauuuuaaauguuauacaugauuauuaauuaauaucacaucagauuauuggcaaugauacauaagcaacuuauguaucgagcaaucuguucuugagaaaauaaagauaagaugugcuguaccucuucaucuuauuauuuguaucggaacaauaauauaacugaauuaccaugcaacuaugaaauuuucagaauuagaagaguaaagauauuuuacagagaauagauuuuaaguuaaacacaauaucaauguuaccaacuucaugaaaacauaccucuucuuuacgcuuggcuucuaauucuucaagccguuuuauacguucuuccucuucucucuucugucuuucuucuuccucuuuaagcuuagccagagcuucuugcauagcuuuaacaguggcuuugcuagguccuuuuuucuucucuuucucuuuuucuuccuuuucuccuuucuuuuucuucuuaucuuucuucuuuuugucuccuucauugucaucuaccaaaaagaauaaaggcaaagcauugaaaugaaaaaacaauucccuguggugaugacgagcaaaacccaaccacaauucaaggaccauaaugggccaaggccgaugccagcagcaggcuaaguucuacaggcaucaaggcauccugagcacuuugguaacuagaauagcucagaauaacucacagauggccuccugagaagucugcaauacugauguuggucucagauguccugaggaauacaguaagacagaaggauacugucagcagcaaaagggcaauccuguaccuaauguaucucuaaauccaugguaccugaguggcugguguccaacagaugcuuauaugaaguucuaacaaucagaaugaacuaacacccacguaaguucuguagcuaauuucacuucuacaagauggaguuaaugagaaugauguccacuuuaggggguauuaguaggauaaaauacaaaaauauagguaguuauacuccaagaacucuaaagaauuaaaagcuaugaagguacuuucaugguguuccuccucgaauauauccagauaauaaauaugcuagcauuuaaaaaaguugcugggcacgguggcucacaccuguaaucccaacacuuugggaggcugaggugcauggaucaccugaggucaggaguucgagaccagccuggcgaacaugacgaaaccccaucucuacuaaaaauacaaaaauuagccgggcaugguggcgggcuccuguaaucccagcuacuugggaggcugagacaggagaaucacucgaaccuguaaagaggagguugcagugagcugagaucgugucauugcacuccagccuaggcaacaagagugaaauuccgucucaaaaaaaaaaguugugucaauuuucccauuaaaaguuuuccagucaaaagaaaaacuacugcuuuuguugguuuuuugagacagagucucagucuguugcccaggcuggagugcaguggugcgaucuccgcucacugcaagcuccgccuccuggguucacgccauucuccugccucagccucccgaguagcugggacuacaggcgcccgccaccaugcccggcuaauuauuguauuuuuaguagagaugggguuucaccauguuagccaggauggucuauaucuccugaccucgugaucugccucagccucccaaagugcugggauuauaggcgugaaccaccgcgcccagcccaaaaacuacuguuuuaagaauauaguauggccaugcaaaccaucugaucuuuagcuauuuucauucuaaauaagaggaagaaauuagcuagaacuuuuauuuuauaauugguuguuaaaaaaauggcucauuauugcuuaaaagacacuaauuuuagcauguugaguuuuaagugaagcagaaaauauuagcaacuucaugaaaacauuucuuugugaauuucauaaauugaacuagguuuuuaaagacaggaaagaauucaaauauuaucugacacugaguuaucagaaaggaagaauaaauuuuucauuaaguaacuucuauagccuuuaucaacagcaaaaaaaauaguuuucauaaugcaauucuauaaaaauuccagucuguacauaaauaaucugaaagauauuuauacuauauauguaaagaauuaacaaugcaaaucaagucaaauacuuagacguaauuuuuuagauggcuccuuacaaucaagugucuuuauacccauggacaaauaacaaaacgaccuuggggcacaaugauuacaacuuauacugugaaucaaaagccuuuugcucuuuccucuaaaguauuaaccaaccuucugcagcugugggagucucugcuuucucuucagaggcaggaauuacuccaguaucaacagucacuuuggauuuuacaguuucuucuucaaauuuccuuugagauuccuuuuguuuacucugauccuuuuuaccuguuucuaacucuucuuuuucuuucagcuuccgcaguuucgcuuuuucuucaucucgcuuuuuucucucgcgcuccuucuuuucugccuucuuuugggccacugucuuaauuuugaaggaggcgucaucaucuucauucccacuuucuauguuaggaccuggcuuguuuuucugauuuuuuuucuguccuuuucuagauugcaaaaauucaucugauucaucaccacuuucaccagaagaauuuauucuugaacgcucuuuaauuuuuuuacuguuauccucauccuccucugacccaucccacuucuuauuugauuuuugagcuuucccuuuagcuuuuuuaggaaguuuguuaaaaucaucaucaucaucacucccagaguacauuuccacuuucgguuuugcagucuuuuuugauuuugaaucuuuaucuuccaauucuucgcuaucauuaucaucaaaacucuguuuuuugcccuucuguccuuucuuuuuuuuaucuuuugaggugaauuccucuucauuguuuucuguuggcuaaaaaauuuccauuguuagaaaaaauuaacagaauuauaauugagaccagagucaugugcuucauuaaguaaacauuuuuuaaaaaucucaaaaugauuucaaaaucuuuuucaaagucuuuuucacaggaauauaaaauucaaacaagcaagagagguuggccuuggccucagacacaucucgcaucauuguaaauugcagaauccaggggcucuugaaacaggcacuagucaccacccauuuacuaacuuuacaaagccuaagggacaaguugaaagaagaaaaaauaucuaugauuuucccauuacucugaggcuuauccaaauucgaaggaugaaaaagaaacaacagagaaaacugaagauggaacgagugauuacaucacaacuccaaauguaccaauuuuaugaacaaucaacauaccacaaaauaccuuuacauuccuauuuuucccuuugacaucagauuucauagaagcuuuuaaauaacauauuguacacugcucaaaaguuuccaaauguagcuccccaaaccaacauuaagaagaaagaauagaauacgaaauacgaauagguaacaaaggucugucuuucaccuucacugcaacaguuucucugucagcuuugaugccuugagcuuccaaagacaauucuuccaguucuuucaggauaucaucuucacuagaaaaggauuaaaauacauugugaagcacugguauaguuuuuauuaagugaauccaguaccaaaacaaauaaaaaucaaauauauuuaaaauauacuuacucaaaguccugcuuuuuuuucucuuuuuucuuuuucccuuuugacuuuugaggcuccuguucuuuggcagcaccagcuccuucuauuucugcagccaaggcaucaagaucaaugucauccuuggugcuuaaaugaaaacaaaaacauccuaaaugcuacuuaaaagcaaaauaaucauucauuuauauagauuuuaucauuuuaaccuuuuucaugcauuagcagcacaaugagaaaaaucauuuggcaaguucuuucauuacaacacaaguuacaucuacuuaucagccucccuacaucugcuucagugaaguuucuggauuacacucaaauaaggaacagauaaugaaaagcuccagaaaaaaaucaggguaaucaagaaaaggaaauuaacuuuuacagauaccaaagguuuuuugugcgucugaaugaaguuauuuauaaaaugggagaucuuaaaacauaaaacaagucuuauuucucgacgaucaauaacaacaccuaaauauuuggaucccugugcauuuuuacuuggaauagcagaaauuucagaguuggaaggaaguuuagagaucagucaccuagccuauuaucucauuuuaccaaugggaaaacuaaaaugcacaaggauugaauguccugagaaaaacauaaccacacauucaaaucuaaaugaauuaggaaugauucacuaaauaaaauacuuaaccaaaaauccagaacuaaaccugcuugcuccugguuucauuucuggauccauccaacaaugucgucaccuaccaacuuacuuggaguaaaccaaauuaaguuccagcuaaaaccuacagaaaaugaaggcaguccagucuaaaauguccaaguagcaaaggcagaugaauccaaaugaauggcacaguaagaaaacaacucauguaauguggccuuuauaauggacaccuuguaagagaugcuuuaguucaguaaagaaaauuucuuuuuuuuuuuccuuuuuuugagacggacucucacucugucgccuaggcuggagugcaguggcgugaucucggcucacugcaaccuccaccuccuggguucaagcgauucuccugccucagccucccgaguagcugggacuacaggagcccgccaccaugcccgguucauuuuuuuuuuuuuguauuuuaaguagagacgggguuucaccauauuggccaggcuggucucaaacuccugaccuugugaucagccacccucggccucccaaagugcugggauuacaggcgugagccacugcucccggucucaguaaagaaaauuucuaaagagaaguaacuuucaaccauauuauaaauauaauuaaaagauuauaugacaagacauugaggauauagaauuuagccuuaaggcgcuuaauagggaagacagcaaaccaguaaaccccaaauugcaaaauguuaaaugccuugaaguaaaagaacuuaaugcuuuuauaaauaguuggccagaauugaaaugugcuccuuuucuuccuacauuuuagauaauuugacacugaucugcugcagugguggugacuuccuacaguaccaaauccagaaugggaaagucagaggcaccuuauucuuaguaaaagggguacacauaccagacacaguaaguacaaaagccuaaaggcaacaagguguguuaugccucaagagggcucacaaaaggcaucugaaccacccaagaaauguuugagcauuauguauuuauugaccccacccaagauagagggaaccagaaacugagggggaagccaggcaguauauuuuuagcaacaauauuuccaggugauuguguaccagaucugaacacugucauucuucuuccuuuacagaugaaguaacuacuaacugaggcacagagaaucugcccaggaucacacgagucggagauaugggauuugaauccaggaagucugauuccauagccagaugucuuacuucugcugacauaauccaauuuguauuuuaggccuggaugcagugucucacaccuguaaucccagcgcuuugggaggcugaggcaggcagaucacuugagcccaggaguucgagaccugccuggccaacacuaugaaaccccgucucuaaaaaauauaaaaaaauuagccaggcaugguggcgcaugccucuugucccagcuacuuggaaggcuauggugggaagauuaccugaaucaccugagcccaggagguugaggcugcaguaagcuagaauugugccacugaguaaaacccuguauauauauauauaaaagcauuuuagaaugcuacaucugguacaaugaguggcagggcugaauccugacuagucaggaagcaaggagaccaguuaggaagcuuuuguaguaacuguaaugagaaacaaugagcaccugacuugcaccaguggcaggcaagauguaaaugaguuagauaaauauuaagggaauagaaucaacaacacuuaaguggucaacaggaugaauauagaaaggaguaaggaagaaucaaggacaauucucaggucucuucagguaacaagaaccuaagucugcccuagcaucucccaggaguauccccaaaggcaucucuggcaacauuucacacuacagcagcuucugacaacugcaugagaagagaaggcugaaguuuggcaucucauuuccaaaaauuuaucggcccucacccaaacuauauucaccucaucaaaauagcuucaagaaucuucuugugauuagcuauauuucuggagaauucaucaauaaacaucucuaggauaacaaaguauaggacuacauuuguacauuauuaagucugaaaggcuuuuugugacuaacaauauaagaugaacaguuuuuuaauaugcuuauauucaggcauugugcugaccaaugccuagacauaauauauacacugucacuuaauauucauaacaauuacauaaaauuauucuuaaagaugguaauuuuuuaaaggccaccagcuacaaaguagcauaccaggaauucaagcccaaauuuuaacaccagguucuacugccuuccuagaaaaugggaaaugaucuaguuuuuuacuugcuugaaaaauucaaacauagcuaugaaauuccuacaguuuacacagaaaggcaaaagacuuagcauaagucaacauaauacugaagaacaaagcugcaagccucauuacucaauuuuaagauuuauuauaaaauuacuaucaagacaguguaguacuggugaaagaagagacacacagaucaaggcaacagaccaggcagcccagaaauagagcucugaggauacuaguauuaaaaugaaaacacuaaccacagacugaaagagauauuugcaaagcacuacuagcugaaagaccuguaucccaaauacacagagaacucuuaaaacucaacaauaacaacccaauuaaaaugugggcagucaccuugucaaauuaggggcagggggaguagaugaaaaauguucaucaucauuugucacuggggaaaugcaaauuaaaacaaagagauagugguauauaccuaucagaguugcuaaaauccaagaaacugacaauaccaauuccugguaagaaagcaaaauggcugauucuggggcaggggcuggacacagacaaaacaagccuggagcacuguguaaugguaggaaguaaggaaaugauuuaaaaacaaaaaacaaacacacaaacaagaaaaugccaaaacacacgaaaacacacacacacaauguugagucuaugacaaagggacacaugagccaacugaaagagcucccaaugggcaaugggagcaacaaauuaauauguuaauuaauuagaagaacaaauuaaguaacaauauuaaauuauaagcuaaaguaugaaauaauuccacuagucauacuauuagagagaaaugauuaaguaaauaaauggggaagagacaaacgugugcagaagaaagcuaaauaugcagaaucccauccucaaggagguggaacauaauuuuccacuccuaaacuaugagcuguguacagugauuucauuccaaagaguacaauauagaaagaggaagaaaagaguaacauuauaauguagaaaucugacaaacacagccucagccaagugaucaacaucgacaucagugauauaaugaaaucugagaaacuaucacagauaagacaaaucuaaggauaaaugcugacuaaauguaaugugguauccuguauaggacccuggaacagauacaggacaguagagaaaaacuaaagaaaucuacacaaaguaugcacuucgcuuaauaauauugauucguugacugaaacaaguguaccaugcuaauauaguaauaacagaagaaacuagguguggggcacauggagacucuguauuaucuucacaaucuaaaacuucuacaaauuaaaguuuauuuuuuaaaaacugagcagggaggccgggugcagugccucacgccuguaaucccagcacuuuggaacgcccaggcaaguggaucaucugaggucagaaguucgagaccagccuggccaacauggugaaacccugucucuacuaaaaauacaaaaauuagcuggacgugguggcacaugccuguaaucccagcuacucgggagacuggggcaggagaauugcuugaaccugggagacggagguugcagagagcugaggucacaccacugcacuccagccugggcgacagaaugagacucugucucaaaaaaaaaaaaaaaaaaaacccaaaaaacaaaaaaacaaacaaacagaaaaacugagggggaaaaaacaaucauauuacuuauaguuauuccaaagaaaguaacauacuuaaaucuaacaaaauauguaaaguacuuauauguggaaaauuacaaaaugcuuaugaaagaaauccaagacuugacuacgugaagagacaugccauguucaugggcuauaagacucaacacaguaaagaugacaaucagcccuaaaaugauauacagguuuaaugcaauuccaauaaaaaucucagcaagauuuuuaggacauaaccaauagagacaagguuauucuaauauuuauaugaaaaggcaaagaaacuagaauagcuaaaccaauuuugaaaaaagacuaaaaugugaggaaucauacuaccagauuucaagacuuaagcaaagcucuugguacuggcaaaggaauagacacagaucaagacgagaagagagagaacccaaaaacagucccacagaaguauaaccauuuaggcccaggcgcagugacucacgccuguaaucccaacacuuugggaggccgaggcagguggaucacuugaggucagaguucaagacuggccuggccaacaugguaaaacuccgucucuacuaaaaaauacaaaaaguagcuggguguggcggcaggugccuguaaucccagcuacucaggaggcugaagcaggagaaucucuugaacccaggaggcagaaguugcagugagcugagauagcaccacugcacuacggccugggugacagacggaaacacugucucaaaaaaaaaaaaaaaaaaaaaaaaguacaaccaauuaauuuuugacaaaggugcaaaagcagaggguagccucuuuaacaaacagugcuacagcaaauggacaccuaucacacaaaaaugaaccucacccucaguccuuauccaagagugaacccaagauauaugauguacuuaaaaaaauaaauaaaagcauaaacuuuuaggaaaagaguaaaauaucuuucagaucuagcacuaagcaaagaguuaagaguuaagacuugaaacuaaaagcacaauccaaaagaaguggaacucaucaaaaacuuuugcugugaaagacuaugugaagggaaugaagaacaagcuacaaaaugggaaaaaauauuuccaaaucacaaggauuaacaacuagaauauacccaaaacucucaaaacucaacaguaaaauaaauccaaacaauccaauuaaaaaaugggcaaaaggcauaaaaagacauuccacugaagauauacacauggcaaauaaauguucacaucauuagcuauuugggaaaugcaaauuaaaaccacaaugggauaucacuacauacgaaucacuacauaccaaugagaaugcccuccucccccauaauagugauaauaaccaauacugguaaggauagaaaggaacuggaaaauucauacacugcugguagaaauauaaaauggcaaugccacucuggaaaacagucuaucaguuucuugcaaaacuaaaaauguacuuaccacauaacccagcaacugcauucuugcacauuuauaccuaaauaacaaaaauuuauguucauggagaaaucuguagacagaaguucauagcaauuuuauuuucaauagccaaaaacuggaaacaacccacauguccuuuaauaggugaaugguugaauagacagugguucauuuccauuccaugaaauauuauucaucaauaaaauggaaugaaccauugauacaugcaacaacuucgauagaucccaagagaauuaggcugaguagaaagaagccaaccucaaaaggucauauauauacuuaauuccauuaauacaacauuuuugaaagacaaaaguuuagaaacauacaagacaccugagguuagagacaggugagggguuggggagguggguagggaguacaggaaggagaugguuacaaauguacaacaugagagauuuuugcacugauauucugcaucuugacuguguaauggauauacagaccuacacauguaauaauauuguacagaacuaaauauauaaacacacacacaaacacaaagaguacaaaugaaacucggcaaaccugaauauaaucaguggauuguaucaaugucauuaucuguguaauggcugggcacaguggcucacgccuguaaucccagcacuuugggaagccgagguggguggauugcuugagcccaggaguucuagaucauacugggcaacauggcgaaacccugacucuacaaaaacuacaaagaaauuagccaggcaggccagacgcgggggcucacgccuguaaucccagcacuuugggaggccgaggcuggcggaucacaaggucaggaguuugagaccagccuggccaauauggugaaaccccgucuuuacuaaaaauacaaaaauuagccagguguaguggugugugccuguagucccagcuacucaggaggcugaggcagaagaauugcuugaacccaggagguggaggaugcagugagcugagaucaugccacugcacuccagccugggcaacagagugagacuccgucucaaaaaaaaaaaaaaaaaaaaaaaaaaagaagaagaagaaaaaauuagccaggcauaguggcaugugccuguacuuucagcuacuccaauggcuagggugagaggauugacagcccaggagagggaggcuaugaugagccaugauugugccacugcacuccaacuugaacgacagagugagacccugucucaacuauaugaaucuauaauaaucuugaaauaaaaguuuaacuuuaaaaaagacacuguuaacaaaauaggccaggcacaguagcucacgccuguaaucuuagcgcuuugggagguggguggaucacuugaggccaggaguuugagaccauccuggccaauauggugaaauccuguuucuacuaaaaaauagaaaaaaaauuagccaggcacgguggcacaugccuguaaucccagcuacucaggaagcuaaggcacaagcaucacugugcuccagccugagcaacagagcaaaacucugucaaaaaaaaaaaaaaaagacacaauuagcaaaaugaaaaggcaagacaggcugggcacgguggcucacaccuguaaucccagcacuuugggaagccaaagcggguggaucaccugagguugggaguuggauaccagccugaccaacauggcaaaacuccaucucuacuaaaaauacaaaauuagccaggcaugguggcgcaugccuguaaucccagcuacugaggaggcugaggcaggagaauugcuugaacccaggaggcggagguugcaguaagcugagaucauaccauugcacuccagccugagcaacaagagcgaaacucugucucaaaaaaaaugaagaaaagaaaagccaugacaaagagugagagaaaauauaugcaauacauauaucucauaaaggauuugccuacaaagaaacaacacaauuuuuuaaaugggaaaaugauugaacagacacauaaccaaugagaugaaagaaugacaaacacaugacaagauguuaucacuaauaaggaagcauaaauuaaaacuacaauaaaggcagggugugguggcucacaccuguaauuccaacacuuugggaggccgaggugggcagaucacaugaggucaggaguucaagaccagccuggccaacaaggugaaaucccgucccuacuaaaaauacaaaaaaaguagcugggcaugguggcucgugccuguaauccuagguacucaggaggcugaggcaagagaauugcuugaaccugggaaacaaagguugcagugagccaagaucacgccacugcacuccagccuggguaacagagugagacuucgucucaaaaacaaacaaacaaacaaaaaaaaaacacaaugauaugucacuacacagccacuagaaauccuaaaauugaagauugguaauaauaccaaguguugagacuggauauggaguaacuggagcacauacaucccuagagggaaugcaaaaauggcacagucacuuuggaagagaguuugacagcuucuuguuaaauauacacuuaccauacgacccagcaaucccacuccuaaucccacuccuagguauuuaccuaagagaaaugaaaauacauguccacacaaagacuuauacucaaauguucauugcagcuuuacucgaaaucaggaaaagcuggaaacaacccaaauauccaucuaccagauaauauauaaacagauugucauauauccaggcaauggaauaauacuacuggguaacaaaagggaaguacuaaugcuacaagcacuaacauagaugaaucucaaaaguauacuguacuaagugaaacccagucagccaaaaaggacuauguagucuaucauucuacuuauaugaauuucuagaaaaggcaaaacuacagugaccaaaaauaaaacaugaaaacuacagugacuacugggcucaagugauccaccugccuuggccucccaaagugcugggauuacaguggugagccaccaugccuggcccuuuuauccauuuuuauaaguuacaaaaauaagaacaaaucuauaaucuuuuucuaguaucuuaauuucuauuaaacacaguaauguggaguuaaaaugauacuuaaugaaggagucuuuuaaaaacauuuuauucuuuauuucuucauucucaucucaccacuuaacaaaaaucaacucaaaaugaacuacuuaaauguaaaauccaaaacuaugaaacuauuagaagaaaacaggagagacacuucauaacguuguuuaagaccucaaaagcucaagcaacaaaagcauaaaccgacaaauacaauaaaggaaacaaccaacagagugaagagacagccuauagaacgggagaaaauauucacaaacuauauaucuaacaagggguuaauauccagaauacauauggaacucaaaacaacaauagcaaaaaagcaaauaauccaacuaaacaaugggcaaaagaucagaauacacauuucucaaaggaagacauaaaaaugggcaccagguauaugaaaaaaacaucagggaaaugcaaaucaaaaccacaaugagauaucacaccuuagacuagcuuuuacaaaaagacaaaaaauaauauggugagaauauggagaaaggagaacuauuauauacuguggggggaaauguaaauuaguacagccauuagagacaacaguauagaaguuccucaaaaaaacagaacuaucauauaaucuaacaauuccaccauugggucuauauagccaaaggaaaugaaauugcuauguugaagaauauuuacacucccacauuuacugcagcacuguuuacaauagccaagaugugcagucaaccuaaauguccaucaacagaugaauggauaaagaaaauguacgucuacacagugugaauacuauucauccauaaaaaagaaugaaauccugucauuuugugacaacacauaugaacuuggauguaauuauguuaagugaaagaugccauauauggaaagacaaauacugcaugaucucauucauauguggaaucaaaaaaaguugauuucauaaaaguaaagaguagaauagugguuaccagaugcugggaagaguaggaaggagagggaaugaggagagguuggucaaguuacaguuaggagaauaaguucugguguucuacuucacaguaggaugacuauaguuaacaauaauguauuauacuucaaacagcuagaaaagagcauuuggaauguucuuaucacaaagaaaugacaaguguuugacgugauagauaugcuaaucauccugaucugaucauuacacaauguauacagauaccaaaauaucacauuguacccuauaaauauguacaauuauuaugugucaagaacaaaauacaacuuguauuuuuccaguuguauaaaaacaguauuucuuuauugugugugcaggcauguacucaacuuuggaguuuggcuuuuggaauuaaauaaaaaucauacauaaaaauaaaaaguaagacaaauacuucaucuugagaccaauguaguagaaagccuuuuaaagacacauauuacaaaaaauuguucacugcaaaguaaaaggaaaauuaaccucauguacaaaucuccucucaauuccaaacuuagcaaauuucauuugauaaugacagguauuuuccacugaaaacuuguguaaugaauguaaaguuagacaagaaacacaggaaauucaacuccuuuccaaauuauuccacacuucaaaaucuccaagaugucuaagacuccuuuuuaccaaccucucuucuccaaugccucuuuacccacugcagagguuuuaaaaccuggcacaaaauaucucugacacucuuugagagguggaggucuaucuccuuuaaugugggaguuguaugacugcuugcuaaauagaaggaugcaacuuuuguuauaguuucuaggccuaggccuuaaccuggcagcuuccugucucuuggaaugcucacugccaagcuaauggggauguccaggucaggaggagagaucaaauagagaugcuccagcugacaacuccagcugauuaagcccagucaaccuccagaaccaugaaagauaaucacaaguuuucuuguuuuaagccacuguuugggaugacuuguuaugguacaauaauaaccgaagcacccccauauuucuuccuauuccuaaucaauaccaggaccuauaguaauggacagcauguugguagaaguguaaaauccaaacuacaccacuccuuccuccguccccauccccaaguugauggacaaauuguccaaaaccucaaaguauuaaaggaaggauaagucacauauaacacuguugcugcccuuuuucacuuacuuuggcuucugccccucuccgccaaaacucuuaauaauaguaaacaagaagagcauaagagggaauccuucucuuuauucuuaacucuaucucagcaguaacagcugcaauaagagaaaccgggaaauucagucccaccuucucuacagguuaccuucugacaucucauuuccccagucuucaucuucuuacccagaacaucuuugaucaucaacaguuacauacaaaaagaggaaaaacaagacaaaagaagggaaagcccagcagucauugcuccucaguggcccccaccacuuauaaccacaaaucuuaacaguuuucacucucaacucucuuaaugaaguuauggcucaaguacuacaaucaauaagcugagaacuagcuaugucucaaaagaaaacccucccagcuuacgauguccuuaugaagucgugacuccuuuaaaagggauaugaaaccauacugcuacuauauuauacaaugcaaugcaaaggguauguguaucuuaucaccuucuacaaaauucagccuaacccuuuauuuucuaaauaucugauacauuaauuugauaagaauacaaaucuuguagacgcccccgauacacauacccuaaguucauauguauuauagauuccaguaugucuaacuaucagaucaguacagcuuuuacaaacuggauuaaguggggaggaacacagaguugcagggauuucagaagcuucaaaauucucuagcaacuucuguuuuaccuguuuuaaauuuuaauuugauaauaaagauuuaagaugaauacagacagccacuuuaucacaguauacugucauagaacagcaacccaagguuuuguuuacaaccccuaccccccaaaauuguuuccgguugaugaaaaagaucagaugcacacuuacuagguaaauuaaaccuuuuugucaagagaagaaucugucauguaaagcucaaaaucacuaguucaaauaaaaaaaaaaguaucagaagaauugagcucuugcuaguucaggcaugcugaacucaaaagaaauccauuguaagaggcaauacauucacaaugaaaauggucauuuagauccuacuacucaaaguauaguuauaggacaagcagcaucaguaucaucaccuuauugaaaaugcaaaaucucaggccuguuaaaaaaaaaaaaaacugaaaaaugcagaaucucagacccucaccccagaucuacugaaucaaaaucuccauucuaacaagauccccaggugaacaaaguuugagaagcccugauuuagauucaacaacguggcaucaucuuucaaaucaauacugcagauuggaacuuuacaaaauuuuauauuuguuacuauuugauauaagacuauuugggggccuggcacaguggcucaugccuguaaucccaacacuuugggaggccaaggcaggaacaucacuugaguucaggaguucaaaaccagccugggcaauaaaccaagaccucaucucuacuaaaaaucaaaaaaauuagcugggugugguggcaugcgucuguagucccagauacucaggaggcugaggugggagggucacuuaagcccaggagaucaaggcugcacugagcuaugaucagaccacugcacuccagccugggcgacagggugggauucugucucaauaaaauaaaauaauaauaaaaaaagaauauuuuggguuucauaauuacagagauacaaguuuauauuuaggauuaugucugcagauauauauaauauugauaaaaauucagauccacauucucaauaaacaccuuaagauacaacuuauaugggccaggcgcaguggcucacaccuguaaucccagcacuuugggaggccgaggcggguggaucacaaggucaggagauugagaccauccuggcuaacgcgaugaaaccccgucucuacuaaaaauacaaaaaauuaucugggcgugguggcgggugccuguagugccagcuacucgagaggcugaggcaggagaauggcaucaacccgggagguggagcuugcagugagcugagauugcuugagacaccuucucaaaaaaaaaaaaaaaaaaaaaaaaaaagagauacaacuuauguucuaaaauaacuaaucacaugguaagugcucaaagcaaacucagucucuguacuccauagaaguuaacucugauccuuaaucacuguuaaaggauuuuccccaccuaacuuguauagugccuggcacucuaauauuaauaaaucauuaauauuaacaaacuaauaauuacuaauaaauuuuaacaaaaaguuuuauguagacaaccacucucaagaccagauuucugaauaaccaauuuggugaacaccaucauuagaauggucuggcugcaccuguguacaaaauuauuggcaauacaggagcaacugaagaucucaaauauuccucauggucacccuugguacucuagagacacagaaacacacagcauacucccauuccuuccaaucugcacgcucucuugauggcaaacuuaauuagaaaaggauuuuaaagaugcauaaacaauaacuuuaagaggcaaaugugaaaucucgagggugguacucucauacuccauuuucucccuucagcacuucacucuguauuaucugugcauaugccuauuugcuauguuaaaacguaacucccuuugagaacagcaaacucccuuuuguauucccaauucaccacauuuuuuuuuuuuuuuugagacagggucuagcucugucacccaggcugaagugcaguggcacaaacauggcucacugcagccuugaccucccaaggcuccagcaauccucccaccucagccuccugaguagcugagaccacacgcacacaccaccacacucagcuauuuuuuuuaggggguagagauggggucuccccacguugcacgggcuggucuuaaacuccuggccucaagcaauccuucugcuucagccucccaaagugcugggauuacagacaugagccaccgcaccccgcccaccuaccuauguucuacaaguggcaaccagaaaggcauguuagacauuccuuuuuuuuuuuuuuuuuuuugagacagucucacuccauugcccaggcuggagcgcaguggugcaauccuggcucacugcaaccuccaccucccggguucaagcaauucuuaugccucagccucccaaguagcugggauuauaggcaugcaccaccacaccuggcuaauuuuuuguauuuuuaguagagacgggguuuugcuauguuggccaggcuggucuccaacuccuacgcucaacugauccacccgccauggccucccaaaguucugcaauuacaggcacgagccaccaccaugcccggucgcauguuagacauuucaaauaggcacuaauaaauaaggaaaaaguccuauucuggaguggcaaucacgacucucauacaacaggcaaggcuaaccaguuucaacacagcaguuuaauaaaaaacacgucuaacacuauaauaauuacuguacuuuugaucauaaaacuuccaaauggaauuuucugaagcaauaaauugaaacgcuaguuuaaaugccucugaaaaaguacaaugacauuucauuuaucugacaacacagacaacgauuccauuguaugugaauuuuccaaaugaaugaaauguaccacuucuaaaaauuuauauuuaagauauaaauguuucuuauaauacauuauauaauuucuugaaauauuuacaaaugucugagguuguaucaagauaauggagaaaagaaaggagggggcagaauacauaugaaaugagauuuaugaaugaauuugaaccugggugauggacacauguuuguucauuagacuauucuacuuuuguauguguuugaaauuuuucaucuaaggaaauucacaccacaguaaucaaaacuguggugccggcuggaugcaguggcucacaucuauaaucccaguacuuugggaagcugaagcagguggaucauuugaagucaagaguuugagaccagccuggccaacauggugagacccugucucuacuagaaacacaaauauuagccgggccugguggcgcacaccuaaaaucccagcuacuccggaggcugaggcagaagaaucccuugaacccaggagacggagguugcagugagcagagaucacaccacuguacuccagccugggugacagagugagacuucgucucaaaaaaaaaaaacccagaaacaacaacaacaacaacaacaacaacaacaaacugugguggcaacacugacacagacauacagaccaaagaaauaaaacuuaaaguccggaaauaaauccauauaucuagcaucuaaugaucugacaagggugccagaaccuuucaauagggaaagaaaucuucucuucaacaaaugguauuaggacaacuagauauccacauauaaaagaaugcaggccgggugcgguggcucacgccuauaaucccagcacuucaggaggccgaggcgggcggauaacgaggucaggagaucgagacccauccuggcuaacauggugaaaccccgucucuacuaaaaauacaaaaaaacuagccaggcgugguagcaggugccuguggucccagcuacucgggaggcugaggcaggagaauggcaugaacccgggaggcggagcuugcagugagcugagauugcgccacugcacuccagccuaggcgacagagcgagacuccgucucaaaaaaaaaaagaaugcagaugaaccccuacaucauaccacauacaacaauuaauucaaacuggaacaaagaccaaaaugcaagagauaaggcaauaaaaguuuuguuuuuuuuuuauuuuuagagauggagucucacucugucacccaggcugacgugcaguggugcaaucuuggcucacugcaaccuccgccuuccagguucaagcaauucuccugccucagccucccgaguagcugggacuacaggcgcgugcuaccacacccgacuaauuuuuguauuuuuaguaguagguuuugccauguuggccaggcuggucucgaacuccugaccucaggugauccacccaccucggccucccaaagugcugggauuacaggcaugagccacugugcccggccagcaauaaaacucuuaagaaaacauacagguaaaucuucacgacccuggauuuggcaacagauuaucucagauacaacaccaaaaugcaagcaacaacaacaaaaauaaacuggacuucaacaaaauuuaaaacuuuugugaaaaagaaacuuuaaaagacaguggaaaaaacaaacuacagaaaucagagaaaguaucugcaaaucauauaucugauaaggaucuaguauccagacuauaucaagaccucuuacaacccaacaauaaaaauacaacccaggcugggugcgguggcucacaccuaugaucccagcacuuugggaagccaagacggauggaucaccugaggugaggauuucgagaccagccuggccaacauggugaaaccgcaucucuacuaaaaauacaaaaauuagcugggcaugguggcacuguagucccagccacuugggaggcugaggcaugagaaucgcuugaauccaggaggcagagguugcagugagccaauaucacgccacugcacuccagccuggccaacagaguaagacccggucucaaaaaaaaaagaaagaaagaaagaaagaaagaaaaagacaacccaggccaggcacaguggcucacaccuguaaucccaacacuuugagaggcugagaugggaggaucacuugaggccaggagcugaagaccagccuagguaacaaagcgagaccccaucucuacaaaaaauuuuuaaaaauuagcugaguacagugguguaugccugcaguccuagcuacuggggaggcugaggagggaggacugcuugaguccaugaguucaagguuacagggagcgaugaucacaccauugcacucuagccugggugacagagugagauuccaucucucaacagaaaggaaggagaaaaggagacaaaaaagacaaaauuuuacaauuuaccaaaaaaaaaggagggggaggaaugauuacauuaacagcaacaaaaauucugugauacaugggaaaaagccaaauccuaaagauuaaaaugaagaaaauaauauuuuacuguuauagaauuaaauuaaccaacuaaauggagaggcaaaucauauuacuuauuuguucacaaauauauuucuagcauccagaaaaauaucuggcacucaagugcuuaaaucucaauauauuucuugaauggaaugauucaacaccauaaagaugucaagugucacaaauaaucuauaaacuuaauggacucccaauugaaaucaaucucaacugauauuuaccuuggcaaguauuacauuuaaaaaaaaaaaggaaaaaucucaaauuguuaaaauaucaagaacauuaacaugcccacagaugucuucaguugccuuuaagugauucucaagcauucucagcaccuguaagacauacaugaacgauggucaaacagcuugagaaaugucucacaaaugccuaaaucuaguuuagaaaucccuaggccagcaguccucaaauucauucccaaggucucuuuagggaaucuaaacuauuuuagggggucaaaacuauuuucaaaauaauacuaagaggauacuagccuuuuucauucucauuuucucacaacuguacaggggaguuuuucagaagcuaaaugaugugugaugaugcugcagaucaaaugcauaagcaaaugugaggaucuaucuucuauuaagucauauaauagugaagauguuugcaaaaacgcuuagcucuucuauuuuugaaaauaugguuauuuaauaauguuauguaucauaguguaaguuuauuuuuauuuuuaaauuaaauauuugaagaacuuuucaguuuuaguuuguaauaccuguaacugguagauauaaccuacauacacagaagccuuuuguguuccuuaggaauuuaagaguguaaaggagucuaggaccagaauuugagaauugcuauucuaaccuaaccacugacacucaguuccuugguaaaacaacacucugcccaccuuauagaucaacugcaauacuggaauaaacuuagaagcauaaauaaagcacaacaaaugagcaaguaacauuaaaaguagcugaaugaguuccccacagggacagcauggaaggcuagagagguuacuaucaacaaaaaucuauaaucuguuuucuuauuaauuuauagcaaacuaggacuucuuccccuaccacuuccuaaagcgucaggauaggaacaggcuagaccaaaagaauucugauuaugcaucuuuuuuugauguaauuuaugcagacaagaguuucauucaaauauaugcaaguaagaaaugaauuccuuuauuaaaccuaggcuauguguauuauauuuguuugauauguggauauugaauccuagccuuugucucaacaaguuucccgagucaacugaaaaaggucaggaaaacuugcugaacaaacaccacaucaaaaucucauucuuagaauuacacaaacuggggcugagcguggugaaucacaccuguaauuccaggccuuugggaggccagggugggaggaucacuugaguucaggaguuugaaaccaggcagccaacauggugaaacccugucccuacuaaaaacacaaaaauuagccagguguugggcgccugucaucccagcuacuugagaggcugaggcaggagaaucgcuugagcccaggaggcggagguugcagugaguggagaucgcgccacuguacuccacccggggugacagagcaagacuccaucucaaaaaaaaaaaagaagauuuuucacaaacuggaacagaauucuagaacuuggucuuuaagcaaaauucuagaauucuaaaaauacacagacaagaauaaauaucuugaucacugacacaugcuguacaaauaaaauuagguaaguuaaaaucuaauuuuaaaugaauacugaguggcuaagaaguuaaaauaaggauuaauuaaauauaagaauuaaggacagugaguauuguauguucuguccaagaacugaaaaguggcuccaugccuucucuugauaacuaaauaagcaguugucauuucucacacaguucacaccuugccagaaacaugccugacauagccaaggaggggagguggaaugacaguaaaaucuuuaaaguguggaccuucacccaggagaauaaaaccggaucucuaucucauuuuacacaaacaagaauacuaauccuaaaauuggacuuucucccucuagauuuucuuuccagucuguguuuuugucccauuuacaaauauucaaaauaucccugaagaaaggaaagaaauauuaaaauaaagguaaaaagcugacucacaaagcaguggaacuucccauuccccaucucccaauaucucauguggaagaccaaaauaaaaacccaagcaguuccagucaaagggaacucugcuaaagcucaggauuucuuaaacacaaucugaaagccauucauaaaaaggaguccaugaggcauuuauacacacacacacucacaaaauguaucaauuucauauauugguauaugagaaaauaaauguuuuaaaauuauauugccaccacuuucccuucaacaugagccaaaaacaaacaaaccaaaacaacaacaacaacaacaacaaaacacagauuagguugagagggggaaaaaacagcauuucuucuacacaaccaaaccaaucauuuaacaacagggucuagugugcaauuuaaacuuuacagcaucccugaaaaucuuuauaaaucaaugagacacucacuuuucccuaaaaagacacagacaagaauaaacaucuugucucccaauggcuuuuuucuauugugaaagagccuggaaaguaaaaaguguaaguagggaaacauauaagccggaucgcgccuguaguccuagcuacuagggaggcugaggugggaggaucacuggccaggaguucaagaccugacugggcaacauagugagacugccccuccaucuccaaaaaacaaaacaaaacaaaaacacauauauauguaauuuuaaucuaaagaacacauuuguguaauccuaaaccaaacgaacgaauugaaaaaaaaacuguaauaagacaaucagggaaaucagcaaacugacugaauauuugcuaauguuuaagaaucacuauuaauauuucuuacagauauacuugguggauuuacagaugaaaagcuaaugagauuugcuuuaaaauaucuaguaggugggggccaggggcgauggaucacgccuguaaucccagcacuuugggaggccgaggcgggcggaucaccugaggucgggaguucgagaccagccugaccaacauggaguaaccccgucucuacuaaaaauacacaacuagccggaugugguggugcaugccuguaauccuagcuacucggaggcugaggcaggagaaucgcuugaaccagggagguggagguugcagugagccgagaucgcgccauugcccuaaguuucuuguugucugggcaacaagagggaaacuccgucucaaaaaaaaaaaaaaaauguauauauauauuuguguauauauuuguauauauauauauuuauauauauguguguauauauauuuguauauauauauauauacacacacuucuaguaggugggaugaaaccaagcaggucaugugcuaacaaugguugaaggcagguaauuaauacauaaaggcucauuauacucaguucucuauuuucuagagacagcugaacauuagcaaggaaaaaaguacccuauacaucaaaaauuccugucaaaaguacagaaauuuguguuccccuacaucacccauaauccuuauuuucucauucaucugguuuaacaauaauucaauucuccaaaccaauuaacuuccuccaauagaccuaaaacugaaauacaagacuaucuuuguugucuuuuaauucuacucauaagcuagucaaacgcuaggugagaaaacgauccaggcuuccaauuuauaauuaguaaacuuauuuuaacuucaagacaacauaucuguuuugagucagacugaugaacuagcacuaguuuuuuuaauuuaccuuacucuccgccucguauuuaaguuugguggguaguguacgaacguguaauguaacagauguuguucacucccaggaagucaacucuuuccaucaugaguaacagaacucaaucgaaugugacacacagaaaugucucaaaaaucucuagguaaguaacucgcauauacccuuauccucccuccccaaagcauugcaggugguuagaaaggagcgaccucgguugguugguuucuucuucuucccuuccuuucuuaggggaaggcuagagagcaaagaaacgacaaaaaaaaacaggccggaagaaggaaagcgaaaagcaugagggcuggacaaucagcccuuaaauaaacgaaaacuguauccaaaucagauuaaguugagagacagcgaacugcuaaacaccuccccauaacucuaacguaccugaaaccgcgaguagagaaacccggccguacaucacauucaagcucccuucccucccaaaguacucacagguauaagaggcauaaaaagaacuuccccacccucgccaagaguagcgcggaaaaaaacucacacuggccugggccacgcuggcgaagccgccugacccuccccgcgcgaccaggaacccucaaaugacuaccccgcuccucaggccggggaaggggugccgggggagcgaggcucgacugggaggacccgcccgccgucgaggcccuacgugcccacccggcccgggggcuugggcccgcuccgcacacucugggcccaggccugguaccccgcgaagcucaucgcgagcccagaccccgguccgacgccgcgcccggcgagacccgcacacuccacugagccacggcggccgccgccguacggacccaaccccuaucuaccugucuucgcucuuguuuuucuguuucuuccccauugcuugucaauggcgcucguggccccagccccucuauucggucucucacagacccacugucucccggcugacuuuggucuccgcucagcucuuuuccccucgugcugccgccgcucgcacccggcucuccacagacccgcgcacuggaacaggacacauauggugugaguucucagugcgcaag

SEQ ID NO: 191105 - RNA, 7466 nt, Homo sapiens
gaggagggaccuacaaagacuggaaacuauucuuagcuccgucacugacuccaaguucauccccucugucuuucaguuuggguaagcaucaauuacuuaucuaaaauuuguaauaagaaaagucuucauaauucaugauuguguuuaucuuuauguuaguaaauuucuauguugguucuauucuuccccuuauauuuuaagaaaagaaguaagaaaguaaaugauuauuuuucugaaagaaaaaauuaauguauuuauuauuauucauagaccuucaacuacucuuagaaagccuuuggugacuccugggaacaagcugagucaggaacaaaaguuugaggguuugggguugagaauaggacaauuacuuggcuaaugcuuuagucuaguucugauuuugcuacuccuuaguugcuuugugaugacuacuugcacaugugucuguuugugaguuauuuuugugagcaugcugcuaccagccuguguggaugucugugguuucacaugauacauuuuauuuucuaaagucuacugaauuuuaugguuuuuuuuucaaaaauagaaacucauauucuuuccuucuuaauuuaguuucuuucaggacauucucaugagacuggugaaauauaacugcgaaguagcaugauaacugugaaauagcaugaucauugugaaagcuauaugacccaaaacuuccauaggaauaagugcaaugcuugcauaucugaaaccugcuguuacaucucuuugcacuuaauaaauauguguugacugauucauucuccuggguggugcugagaaaguaaaaaucauggcugauaaaaauucuguuuaugguuuugucuaacuuauuuuucaguugagauauaggcuacucuucccaacucagucuugaagaguaucaccaacugccucauguguggugaccuucacugucguaugccagugacucaucuggaguaaucucaacaacgaguuaccaauacuugcucuugauugauaaacagaaugggguuuuggaucuuagcaauucucacaauucucauguauuccacagcagcaaaguuuaguaaguauugccuucuaaguauaauuuaaauuuuuauaaauuaaauaauuucaagaacauuuaccuuguuuuaagcaguuugcuuccaguuguuccaguugaauuguaaacugaaaaauauauugcuuuuguacaaucauuuuucauuacaaaucuaucagaagaaauucuuuguaaugaauauaucaucaguuuggcuuugcauauucaaaugcagcagaauuuaauguggugccugcacaugggaaguguuguggauguuuauugacugacacacaguuuguuuagauagauaaggcugcuuuuccauuggauaacugugggggauuuagcuccaaauuaauucauuaacauuucauaagagaucuuaacaguuacuuauucuuucccaagguaucacaguauaugaccggcuucuaaauuuaauccuagaagaaaauauugagaguauaagaauuaugaucuuuucauuugaucauuucaggauugucuuuauaucuuuuauuugcagguaaacaaucauggggccuggaaaaugaggcuuuaauuguaagauguccuagacaaggaaaaccuaguuacaccguggauugguauuacucacaaacaaacaaaaguauucccacucaggaaagaaaucguguguuugccucaggccaacuucugaaguuucuaccagcugcaguugcugauucugguauuuauaccuguauugucagaagguauuaugcagaaggcucccaucuucuuucacccugcuccccuuucuucagugguugauugccugagcugcccuugcuuucauuccuucccuaguccuuucuggaacaguuaaauuuauaaaaugauuugaauaaaagugauuuggauaaacuucuaggaauacuaucagguugaggucuagcucauucugagcuauuuggauuuacaguugcagggauugauuuguagcugacuuagagaaaaaccuagcuuuccuagugaccaagauaacugagagcaauugcuuacuuuuggcuggaauuaagaacaaacuagcacagaaaauaguaaucuggauguuuuccaucucagggggccucuaguaggugaaaaggggcuucuaaccuucaaguuaagccacagaaggcugaugagauugugugccuaaaaauuaauuacuuuuguucacaaauuguuaaauguuuugauuuuguggcuguauuuggcacacacaaaaugucaaaugaauuaaaucaaaaagcaggauguauuaguuaagggccuaggucugagacuagacaagugucaaauucaugcucugccacuaguuaacugugcgaugccagcaaguuacuucucugcccuucaguuuccuucucuguaaaaugcauauaauguaauaauauauuucaucucaaagcauuauugugaaaauaaacuaagguaaugugugaaaagugcucaucaucaucacugguacagaguaaacucugaauaaauaguaauuaucuuuauuacacugggauuacagcauuacagcagauguaguguaugaauaaauggugaagaagucauuguuagggcuacuaugggggcuauguuuuuagcucaaguguaacaaaaaaguauuuaaacucuagauuuuaauguuuauuuuuaaauaauaaaauaaccauuauguauauugaugguuuuuaagaagaaaagcaauauuaaguaaaggcugaauuuagauuaaguuauuucacaaugcuaagugacucuuuuaauugucugacuuauuuuaacagucccacauucaauaggacuggauaugcgaaugucaccauauauaaaaaacaaucagauugcaauguuccagauuauuugauguauucaacaguaucuggaucagaaaaaaauuccaaaauuuauuguccuaccauugaccucuacaacuggacagcaccucuugagugguuuaagguaagaagaaauuuggaaggaaauagaugaaaauuacacaauuaaaauagacacaaguggccgggcacaguggcucaugccuguaauccuagcacuuugggaggccaaggcaggcagaucacuugaggccaggaguuugagaccagccuggccaacaugaggaaaccccaucucuacuaaaaauauaaaaaucagcugggugugguggcacacaccuguaaucccagcagcuugggaggcugagguaugaaaaucacuugaaccuagaaggcagagguuacagcgagcccagauugcaccacucacuccagccuaggcaacaaacauucugucaacagauaaauaaauaaaagugaagaauuacugagaaggaaauggaauuucuuauuucagaauugucaggcucuucaaggaucaagguacagggcgcacaagucauuuuuggucauugauaaugugaugacugaggacgcaggugauuacaccuguaaauuuauacacaaugaaaauggagccaauuauagugugacggcgaccagguccuucacggucaaggguaagcuacugacauuaaugagauagaauacuacgugaaagaagucgaagugggaacagcggugcccuucugguuggguuucuugcacuucucccuccucccuuuacuuccuccugcuccaucuuaucuuauacauucugaacuaugacgcaaagagguuuucugaacacacuaucaagauuuaagaaauuucagggggaaauuacauuacuaauucaaagccacaucuguucuuuauucuuuuuuugugacuuaauuuuccaaagauaaagcaaucugaaugcuaacuuaacuuacuuuuuuugaauggcaauacaacuauuuggagagcaaaaccagcuuuuuuuuuuuuuuucuaguuuggugucagaguuucugcaaauuaaaaaagagcuuaaucuuuaguaauacucauuggauucaaagucuaaugagaggcuuugugaugguauacuaugguguacauaaauguugucgagugguuuuuaaucuuuguuugcaauacuuucaacaucaucaauggccuugaguaagucacuucauucuaaaaauguguuuuccaaguuauuuuaaauuuuauaaaagcuuauuuaagggaaagauuucacaaucauagcuuaucaaucuacaaaggauuggggucuccuuagcacaagucgaucuacagacguagauguaauagccccuuuacguaugacaguuuuuucagggcaaagcaauauuggagacaaauuuuuggaguuuuucaauacuccaccgcuguaaaauaagcaucaccagaccacauuccuaucagugccucuuucuguuuaauaucaacccuuacagugguccuuaaucacacugucauuaaauaaaugagcaugaagggauggaggauugcagcagugcuccauaagcacugcccgucuuucagccuuaguggucacaggagucagaauuccguacggggaagauuucacugaggaugggccacccuaguggagaacugcgagcaaaucuguggacucauccauuuauuauuuucaugggucuuuugaaaucuucucuguagucuuauucuuauucuguagaagaguaguuuucuaacaacuacuaggucauguaauuaguuuuauggguuggaucugcauuuguuuaagugauaucagagaauaaugauauuaaagagcaucauagguaauaaaagaaaguuuuauuuaagugccuuucuguuucguguguguguguguguguguguguguguguguguguguguguuugucauuauggguuauugucagaagaacuugaaaaacauugcuaugaaauagaauagaaacaugaaaauacaagcuuuauauugacuagcauucaaugcucuccuaauauuuauauuucuuuuugucuuuaagaugagcaaggcuuuucucuguuuccaguaaucggagccccugcacaaaaugaaauaaaggaaguggaaauugguaagaaaauuuaucagaaugcuguaaauauugccuggaaaaauccuuccauaugaccccuguucugaauucccuuagcaggggucaggcaauuagcauaaggaaccuugaggaguaagugaggugacaucccugaaagcaccugccccaagcauuugcuaauauugggaacagggacacagcaauugcaguguuuacauuuguuuauuguacuuuguaauucaugaugcuuucauguaugcaucuaauuucaucuucaucucuaucccagagcuugggauggagaccugcaggguguucauucugggcaaugguagccagauccgguaaaacauguuuaucuucaaaguagcuuauggagagaugaagagaguucuguagaaagauguggaagagggcaguuggaaagaaacucuaauuucuaguagagggcaauccuuuuacuagaaauccuuuguaaugugggguuggugaaggcagaaucauuggccuuguuaguuucccaugcagaugagaauauagugggagcugagcuucaaacccagcugggugaaugaagguaauggaagcagggaggaggcaagagaggacauagaaagaggaaggugcuagagaugagggagggagguccugguggggugcauacuaaguguucaguaagguuuuuuuuuuacauuaaaugggauaaaaugccagucgcagaaguuaauuuuauuggugaauguccuuacuccccucuaggaaaaaacgcaaaccuaacuugcucugcuuguuuuggaaaaggcacucaguucuuggcugccguccuguggcagcuuaauggaacaaaaauuacagacuuuggugaaccaagaauucaacaagaggaagggcaaaaucaaagguauuuuuauauugaagagaaccauccucuuccccuugcacaugguuugcaccugcaaaguaggcauuaaaaguaacagguugcuuucuuaguuucagcaaugggcuggcuugucuagacaugguuuuaagaauagcugacgugaaggaagaggauuuauugcugcaguacgacugucuggcccugaauuugcauggcuugagaaggcacaccguaagacuaaguaggaaaaauccaaguaaggaguguuucugagacuuugaucaccugaacuuucucuagcaaguguaagcagaauggagugugguuccaagagauccaucaagacaaugggaauggccugugccauaaaaugugcuucucuucuucgggauguuguuugcugucugaucuuuguagacuguuccuguuugcugggagcuucucugcugcuuaaauuguucguccucccccacucccuccuaucguugguuugucuagaacacucagcugcuucuuuggucauccuuguuuucuaacuuuaugaacucccucugugucacuguaugugaaaggaaaugcaccaacaaccguaaacugaacguguucuuuugugcucuuuuauaacuugcauuacauguuguaagcaugguccguucuauaccuuuuucuggucauaaugaacacucauuuuguuagcgagggugguaaagugaacaaaaaggggaaguaucaaacuacugccauuucagugagaaaauccuaggugcuacuuuauaauaagacauuuguuaggccauucuugcauugauauaaagaaauaccugagacugggugauuuauaugaaaagagguuuaauuggcucacaguucugcaggcuguaugggaagcauggcggcaucugcuucuggggacaccucaggagcuuuacucauggcagaaggcaaagcaaaggcaggcacuucacacaguaaaagcaggagcgagagagaggugccacacugaaacagccagaucucaugagaagucacucacuauugcaaggacagcaucaaagagauggugcuaaaccauucaugaugaacucacccccaugauccaaucaccucccaccaggcuccaccucgaauacuggggauuaccauucagcaugagauuugggcaggaacacagacccaaaccauaccacacacauuaucauuguuaaacuuuguaaaguauuuaagguacauggaacacacgggaagucugguagcucagcccauuucuuuauugcaucuguuauucaccauguaauucagguaccacguauuccagggagccuuucuuggcccucaguuugcaguauacacacuuuccaaguacucuuguagcauccuguuuguaucauagcacuggucacauugccuuaccuaaaucuguuugacagucugcucaacacgacugcaagcuccaugagggcagggacaucaucucuuccaucuuuggguccuuagugcaauaccuggcagcuagccagugcucagcuaaauauuuguugacugaauaaaugaaugcacaaccaa

SEQ ID NO: 191106 - RNA, 30161 nt, Homo sapiens
auuuuucauggguuugcggacccaccagcgaaggcgggaggugucgcagggacaucuucuggcuguuuccgucgccugcguggcccuugcaccccggucuuccauuagcggcgcagacguuugggccuaagcgcugggcgaggcgaggcccugccccuccccgccaacggccauucucuggaccugucuuucuuccgggaggcggugacagcugcugagacguguugcagccagagucucuccgcuuuaaugcgcucccauuagugccgucccccacuggaaaaccguggcuucuguauuauuugccaucuuuguuguguaggagcagggagggcuuccucccgggguccuaggcggcggugcaguccgucguagaagaauuagaguagaaguugucgggguccgcucuuaggacgcagccgccucauggggguccaggggcucuggaagcugcuggagugcuccgggcggcaggucagccccgaagcgcuggaagggaagauccuggcuguugguauccuuaacgccgcguugggacuuggggugcagggauucggggcuggauuccucgcggggcucugccuugggcacaguggcaucugcaggaugauggucuugggucggggucggggucgcuauagaaucucugucacuagguuuucuaaguacagucgucccucgguauccccggggcuuugguuccagccccuccuccguauaccacgauguucaaguuccuucaacucccuuauauaauggcgugguauuugcauauaaacuacccacuuccguaaucuuuuaaaucguuucuagcuuacuuguaaugccgaaugcaauguaagugaucuguaaauaguuguuauacuguauuuuaaaauuuuuuguaguuuuuauugguauguuuuauuuauuuauuuuuuuccaucgcaaauauuuuugauccgugguagguugauugcggaaucgggugaugaggcgggccgcccugucugcuuuccccagcuuugcagucuuagcggccugugcauccugguuugucacuuuguggcagugcuuuauguuccucucugccuuaguucucucaucugcaaaguagagguggugauaguaucuacacacaggauuggaaugaggaauaaagaaauugccuacaugagagaaguuuagugcgauuaauacaguaaaucuuaaaguuauuauccuguccgggaggucaguaaggagagcagaguagacuucgacgauuaguuuugcuugagucuugccccauuuauguuucuuagaggaaggauaguguggacagguguuuuacccauuuuuuaaauugacuuuuuaaggacuauuguuucuguacauguuuggcugguuuuguuugucauuggaauuaaauucuuuuuucauuagcaaaacgugauacugcuuuugaaauuuuuaucuuuuucuuuguuauguagucauuuuuuuuuuuuuuuugaguaucuauucuggcucagaaucuggugauaccuuacaccaauuuccuaaauggggaucuaugagucuaggggcucgugggcuuguggaaagaguccuguaaaugauugcggggggauuggggacgggaaauggagugcaagagugugugggcguucagcaaaggaaucccugacuguggagcccuaauucuucaguagguacaaaacuuauaaauaaaacgacauugauaaguuuuaaaacauaaugagauuaucauuuuuugcaagugaauaaucuuuaaauaaaucuguaauugauuuuuggcuuaaaaguuuuuauacaggguacuuugaauuggggaaagccaaaggauuuuuguuuuguuuuguuuuguuuuuuguuuuuuagagcacaugcgcuguugcugcccucaagcuguugcuuaguaucauugcagucuaaagauuuucucagaaauaaaggguaaagguuaguuuucagugacaagaacccuuaaaacuucagcaaagauuuagaucauuuuauguagcagcccuugugaagaauuacuaaagaggacuguggccaggcucaguggcuuacgccugucaucccagcacuuugggaggucaaggcaggaggaucauuugagcccaggaguucaagaccagccugggcaacauagugaaccccugucuacacacagucaaaaaauuagcuggacgugguggccugcaccuuuggucccagcuacacggaaggcugaggcaggaagauugcuugggcccaggcggucaaggcugcaaugagccguguucaugucugucucugaauaaauaaauaaaaaggacugugaaagacauucuagucaugacaaccucauauauuuauaauaaacucguuuaugucaaaggaguauaucugauuacuuguucuacaaucgguuuugcuuuauuucauuuucacgggaauucagacaccugaaauuauuuagauuuuauuguauuguuuguuaaugacaaacuuacccguuauuauacuaguuucauaauuuacucuuguaucucuauacuaaauuguuuggucuuuaaaccaucuauauagcuuagugucuuauuuauacagucuaaaugucugugucaaauaaugcagaaguaaguuaaacuuuugucucuuauagauuuuaauguuuguaauaugcguuuaaguguauuagcaagauauuaccaucucuuuaggcuauguauacuaauggagauuuuuaagucaccuaacuaaagaacuaaagaaacuuauuuuuuguauugaaauguuauuggucuuugggucuuauaccgaaagugauuuuuggcuuugcugcagauuuuaacuuuucuguccgcagaaauuuaauuuugcguauauaaacuuacugaaauuagacaagucaaauuauacaaauauuuucagauugucucauuuuucauauuucuugucuaacaauuuaugugaauauuuucaggucgucuaauuuuacauauuucaucucuaagaauucaagccaaaauucucaacccuagcugagaauuggcauuaccuguaguuaauugaaaaauaaaaaauaaaagaaguccuaccucagucucuaugauuuagaauuuuaggcccaugggguuuaauaauccguauguuucagaagcuucauauccuauucuaauggauagcagggaugagagccacugaucugaaacuagauuuccucacugaaguuaaaguuuaaaguagugggccaaguagaaacuaauuuaauccuauguaauagugagcuucauggcuuuuccagacuauacuuguagcaagcagaaacaucgaucuaauacaagacagaugcacaucaacaccaaguucuaccucugagauguaucuuuuauccgaucucuucucguggucuccaccacuacugucugcguuaacuugggcuauuguaacucauuuuagaacugguuuccuuauaaucuguucuucacauguucaucaaaguuauccuuaaaucauguucuagaaacuucccaguggccguaucaccuccugccauuccuuuuguccugcugcacuggcuuccuggagauagggaccgucucuguuuuguucauggcugaauuguuugguguauaucccuagggucuuggauaugccuggcccaugguauugcuaaauauuauagaaauaagcauagcaguagcuugcuuuccacuagguauuuuguuacauaguguuuuguaaauuaauuguugauggaccuacauuuuuuuuuauguuaguaaaaguuaggcaguguacauucauuuaaauacuaaacuguucaacuuauuuaauagcagauauuuauuguguauaagagucccugugaaagggagugcagugcacaaauugcccgggcaagccauggagcacacaggcuggguuuuuucccugcuagauuauaaacuccauagggccaauacuguguuuuguucagugcacuggauaugccagugcauagaaaaaaugcugccacauaauaaaaacagaaauaacgugauagguggccccuucaauguucuuuuccuauguuagaaauuuaccugcaaauauuagcaucaguccagguuucucucuguuuuuuuuuucuuuuuguuuuuuuuugagacagagucucccucuguuacgcaggcucgagugcaguggcgugaucuuggcucacugcaaccuucgccucccagguucaaucgauucuccugccucagccuuauaggcacacgccaccaugccuggcuaauuuuuguauuuuuaguagagacaggauuucaccauuuuggccaggauggucucgaucuccugaccucagguggucugcccgccuuggccucccaaagugcugggauuacaagugugagcuaccgcacucggccucaauauauuuuuuaaauaggaauguauacaaggaggaugucuucaucuagacugaggaggggaccccuggacugagaccuuagaguaggagagaacuaggcggagagagggagaaacuguuucaggcagaggaagcagcaugugagaagaaccuggaggcaggaaggagcuuagugauuucuggguuugaggaaagcccaguagcaggaagugagcagaggccagaucauucaaggcuuccuagaccaggagaagaaguuuuagauaguaucuugaaggcagugggaagcuuuggaggguuuucaccaaagauacguuggugaaaucuaguauauaccuucaagauacauuagaagauagaauugauagaccugguaauagcuauagguggugaugcccagcauucuggcucaggugaauggcagggacauucacugagaugggggcaugagcagcugaguggagaagacauggaguucaguuuugaucauguuaaguuugaaaugucuaugagguaugggguagagacgucaucugggcucucuguucuggggucaggagcgugcucugggccagacauauacauggagucagggcgugguguauguggaggggaguggagguugauaguucagacaggaggaaagaagagggccugagaaagaucacugaugaagugaauacuuuaacaguguuacaggagcuggcaaagagucugagagcaggaaaaccagcagagcgcggugucacucuuucuuuuggacaaauauaacauuuuuugagaagcacuuuuuagaaaaguuuaaaaauauaagaaaacuucaagaugaaaauauaaguuaucuuuagucucagcagacauaauaucuacuuuaauauuuugguaugugaacuaguuuuuuauauuuaacauauauacuguaucagaaaauggaguuauacuuuauaugguuuuauagccuguuuuacuaucuuuaauaauauuuaaugacuaucuuccuuaucacacaugcuccugcaacuuccauuuuuaagggcuuuuugguauuccagcaaauaggucugccauaauuaguuuuucuuuuuugagacggagucuugcucugucaccaggcuggagugcaguggcgcgaucucggcucacugcaaccucugccuccuggguucaagcgauucuccugccucagccuccugaguagcugggacuacaggugcgcaccaccaugcccagccaauuuuuguauuuuuaguagagaugggguuucaccauguuggccaggauggucucgaucucuugaucucgugauccaccugccucggccucccaaagugcugggauuacaggugugagccaccgcgcccggccuaugauuaguuuuuuaaaaagaccugcuggaaaacuuuuaaguugauuuuuauauuuucauuauuauaaacaagcauucuguaaauaacucucauuauauauccaugaugauuuucugaggaucaaugucuggaagugguaaaauagacugcaaaguuuuaaaaaguuuuuuucacuaugaauugucaaauuguccuccagaaaauuugugcuaauucaugaaaauucuuuagcaaucacuuauuuuuuuuuaaagaagcaauucuuugcaaugagacuucuuaaaaggauaugucugucuuuguaugauuuuaaaaugcaguaugugaauagggguaacaagaguucaacuaaaaguuaacugacuuuagguagaucccaugagagcuaaauguuuuucaauuuuaaaugaauagugauaaguauuuaguguucaacguuuggauaauaucaguuauuaggaaauugaaguugugaggaugaagagaaaaaucccggaguuuuuuccauuaacaauucucccagauauuagcauuugguuaaaccaagcacuuaaaggaguccgggaucgccaugggaacucaauagaaaauccucaucuucucacuuuguuucaucggcucugcaaacucuuauuuuuucgaauucguccuauuuuuguguuugauggggaugcuccacuauugaagaaacagacuuugguaagugucguauaguuuuuaguaagugucaaauaauuuuuuucuuucugcauucuuagaaaaauucacauaaaauuuuuguuuucucuuuagaauuuuagaaacagacuuauuuugacacauacuuaauuacaucuacuuuuuuaucuugaacaauuaauuuuucuuuuaaaaaguuuuaugagaguucaucauggguacaaugauaaaauuuaacuuuuaaauaaaacuaacuacuaaaaaccuugcuguugagaguuuucccuucagaggaucuuguuagguguuuuauauuuauuucaaggaugcggccaucacucagaacacuguggaaacccucuuuugggaagugccucccugaaucugagaucaaguauccuccgugauagcaagccuucuuuuaaggggaauuggauuuuaggaguaagcaauguuauguggugccaaguggugacuaaaguggauuaucuaggaaggaaauugaccaugauauagaagagucagaaugaguugcugcuuuauuguucuggaaguaguuuuaaaaaauguuuuuggaaggccgggggcaggaggauugcuugagcccaaguccagccugggcaacacagggagaccccaucucuaaaaaaaugacauaaaauaauguuuaaacaguccaaaugacagcacccauuuggauauaugacuuuuauuuguugaaaauaccaaaguaaugaaaugaugacuuuguaaucauaccagauacucucuaaaugaggauauaggauaaaaguaaggauauaggauaaaaauaaaaagcauuuauaaaugcugggggaccuuuguugccucaguaagagugucuagucuugaauguugcaguuuucaguuacccaaggcauacuguaaaucagguacuuuguggaaggauuagaaaggaaaagagaauaucuugguuauuuuuauccgauauucagccauaagcacagggacuauccauuugucacuacuugaacauuucuuacaagauauuucuauacauuuuagaauuucucaugauauauaaucuugaauauugaagggcagaauuacauguaaguaaugcauguuuauaaaaagcaauauuagaaauuguuuuuggugucacugugacauuuuauagaauaaauaaauaauuucuuuugggaagcauuuaagcuuuccacuucuugggcauauuaaaagacauuuaaaagaaacugaaaguaaauuaaguuucccaaauauauuguguaguagcccauuaaguaauagauggaaacucuggguguccuuuacguagcagcaaccugaagauauacacugauauggcaauuaggaggaaaugcuaaagcagccauagucugaaaacucagacaaaccaaauucucuggaaaauaaaucacagcaauguuucuaguggucuaauauccugaagugagaucuuacauccuuucuucucauaggugaagagaaggcagagaaaggacuuagcguccagugacuccaggaaaacgacagagaagcuucugaaaacauuuuugaaaagacaagccaucaaaacugccuucagaagcaaaaggcaagaggaaaauuauagucguguuagagaugaaguuuuaaaaaagugauuuuugucuugauuuccugcgauucucuuucccuaucuaauuuugacucucaacagaaaauagagagugaaaugagacaaguaggcugccauuuugaccugguaauuuggaguuguggcaauucuccguucugugagaaucaacuuugcuaaugagaaaaaaaagcugucguguugcgucauguacacuuuuuacuuugauuauggucuucuugacucuaggugagcagccccgccaagguuccuuccuuucucucggcugcauuuauuuuccacagcaguggccugagagcagccaggucaggucccuguucaccauccugagcagggucugcauaaucuguuuaaagauuuguguacuuuccagagaugaagcacuacccagucuuacccaaguucgaagagaaaacgaccucuauguuuugccuccuuuacaagaggaagaaaaacacagguaaauguuuaacuauuuaagaauauuauuuuagucauugcuacauucagacacauuuaaaccuugauguguuaucuacaugauaaggcaugugaacauuucuuaaugcaucugaaauaggcaugcucuauaccuuucagaauauuuuucaaagacuaaauuuuuuauuuacuauucuuuguguuuuggugauucaugauucuuauuccucuucauucuaaagaacuucugccagggcuguggauucuaaauucuccaaggcaugaauuuuaguuuugcuuacacuuugcuuacacaugcugucucuagcugcuuuucaauccaguauggucucucucaccaugaugcuaaaauaccacaacccaugacauucuuguugcuaaaucuagcagacgcuuugcacgucuuagugugcucgacuucucugcacuaaacaccaugccacacugccccgcucccccggcaucucucuggcgcuuucugcucagccucucuguggacuccucuuccucugucucucucuuaaugguuggugguuucuguguuugaagugaagguggagaaccggaagcuuggcaguuugccuuuguccccuguccuucccuccaccucuuccuuucccaggaguucccaagagacaacuuagcuuuuguaucagcucaguucuauuugucuccauugcuaccacugucauuuuuucuccagguuacauuauuagcuuuuaaacuucuuucugucuuugucuuugaucauacccuuuuuguaauaguuccucccaccaagcccaaucucuguuuuguguuauagucuguuuaaaauccaaaucugauauugucauuuccuuacuuaaaacacuuucuagcuucuccuucucauuuuuuucuuucuuuuuuuuuugagauggagucucuguugcccagacuggagugcaguggcacaaucucagcucacugcaaccccugccuccuggguuuaagcgauucuccugccucagccuccggaguagcugggauuacaggcacgugccaccacaccuggcuaauuuuuuguauuuuuaguagagacgagguuucaccauguuguccaggcuggucucgaacuccugaccucaagugauccaccugccucggccucccaaagugcugggauugcaggcgugagccaccacacgcagcuuagcuucucauuucuuuaggauaaaacuuuaacuccuuaauuacacuuuccagucuuaucccugccuuucuucacaucauccacaggcaggcuuucuuuuccuuguuucuauauggucauacaacuuaguucuuuugccuggaacacucuucuccaugaaccuucccgcucccuacaacuacacucauuaauucguggcuaacuccaaccaguguaauugcaggagauccuggaaagcuuuugugacuccuaaauugggugaggugacucccuauugcaucucuagugaccugcccuucccuugugguggaaguuauuagaucccacucuaauugcuuacuuacacgugucccccaccagaccaugagaccaguaguggcacagaucuugcuguuuuauucaccacuguagcccguauaacgagcagagccuugcauacaaguauuuuuguaagggguccuuaaaaaucauagauaucguaaaaguauguuugacuuucaguucagaagaggaagaugaaaaagaauggcaagaaagaaugaaucaaaaacaagcauuacagguauuuagaucauuuuugaauucagaauguauucuguuauuugaaaugaaugacaugaaaaugaauauuaaugagguauaucaaacugugaaaguuccugauaaaaaguaaagacagauggcuuuuugguugugcauauauauguguacauguauguauuuaaaacacacucaccuacacacguguauauauauauauauggaauuugccauuaugcacaucuauauauucaaaacaagcuauuuuucuuuuacaaccaaccaaccaauaguaauaugugcuuacauagaaaauauagaaaacauaucauucauaaauaacuuguaauaacaguuugauauauuuucauccauucuuugccugccccauauaguugaauaucuguguguguauuuguauauauguaucaaaugugcauguguacauauauauguguacacauauguguguauguucuaguuaucugucgcuguguaacuuagugguuaaaacaucauuuguuaucgucaucugucuggguuccagggguagaugagcucagacaggcaguucucucuggggucucuuguguagaugcagccagucuguagcuggggcuggagugauuaacgagguuuccuugcugccaugggcggugguugaugcuggcugucagccagucuuccaugcggccagcaccagagcaccuacuuguggccucuccacguggccugggcauuuucccagcaugaugacuguauucccagugugggcaucccaagagaaaguucuaagcagaagcccuguugccuuucugaccuagcuuuggaaguugugcagcauccuucccacuacauccuguuccucagaagcuaguuacugcccuauggaaggggcagagaguuagacaagaagaaugucccacacauauuuucaugaauaacauuuuuacaaauugagauuaugcuguauauauacauuuuuuucauaaacauuuuucaaguuucuuagugucacagauagcauuuuuugauucccaaauucacuguuucuuguuuguucauaugguuuuguucuaucagguagaaacuuuugagcuaaaaccucgagauccuucagguugcggaggugcugugcuauuaaugcagcuagugagagcaaucuuaguuaagaccaugggccucguggucaaaaagaccugcguuucaguccaggcuccacuguucacuagcugugugaucuuacacagauuaaauucuccaaggcuuuauuuuuuuuuguaaaacgaaauugauaucaaugccuuccugaugggggugaugggagcauuagugagggaaagcacaggaaaugcugagcgcagugacaggucuguccuacguguuugcugguugguacguacacauguaacauacagacaugcaggacaucagguuguauuagcuuaucuuuuuuacuaaugaaggauuuuaaaguacuuuugguaaugaguuaaaguugagaaaaguuuuacacuuuuccaugucuucugugaauuucuuuuaauuucauuucuuauguuauaagcaaaauaaaacuaacuuaauuaugggaaugauauauauugcuugaauuccuaaggcacauucugucuuggguucuugcauuuucuguucucucagccugaaaugcucuauccucagugaggcucuuugauaucuuccaagucccugcucacacauccucuuuuuaguggggucuucuuuaucuaucaaauagaucuuuuuuuccacguucuguucauguaaucacucucauaucagauaaaucugcuuuauuuuaccauuaucuuguucauuuauuuauuuauuuauugucuucucuccucugcuccuaagagcagggaccuuaucuggcaccuuauccgaucucacaguaccuuagcaccuagaacagugccuggugccuuagagguaccugcuaaguauuuuuuucuuuugaaugaauuaaagagugaauggcuacauucccuaauuugccuacucacuuuguugccugucacagauuauaugcaacuguguuuagccaauuguugauuauguagaacuguguuuauuauauaaacauaauacauauccuuaauguugaauagaacuaaguguaugaaauguaaauuucauggugcugugauuuuaucuuuacaggaagaguucuuucauaauccucaagcgauagauauugagucugaggacuucagcagccugcccccugaaguaaagcaugaaaucuugacugauaugaaagaguucaccaagcgcagaagaacauuauuugaagcaaugccagaggugaaauaugcaacaguacauucaugcuuagaauuaagaacuucagcaaaacuuuuuauuagaaagaagagaaaauugauaagcaauacuuacacgauaucucaguuaacaguaaacagcauuucuacaucucagauucuaagaagcaucguauauuuauacguuugagccuauagacauuuacucuaagaaguuuuucuugacuuuugacccgagacuaggucuuuuuuccuggucuuuguucucacagcacccuguaauaucacuucauaguucuuaguuccaaaacacgcuuaucuugcucaccucuguauuuucagugucuagcucaguauuuuucacaugguauguguccaguagaugcuuacugacucaauucuuagguuaggucauaaaaguuauuguaaccuauaauauacauugucuauaaaaacuaauagucauauagaaucuaaucacaauggaaaaauaaguucuaaauugaaauuccagguauaucuuccucugcugcagcccuagagaugccauuggcucuccacauucccuugcccucuuccuggacagugcgaauggggcuucuucaccuuggaacaucuuguagcuuggcaggcccagaaagcuagaguggaggugguaugugcaguugggugcuagcaaaugugucuccugaucaugcugccauugauacuuaauucauguuacuauugaugacucccugucuuaguugccagugagugaguucuuuuucucuuucuguugcugcuaccuguuauuucuaccguaguucuccauucacccacuauaggacagaaucgaaauuuugcagcaucaucgaccuuagugcauagauggaguguuuuuuuauuuucuacaauuuuugaauauugcuuaaauugauagcagaaauaugaaaaaggaaggguaaauuucuuuucucaucacucccuguuuuuuccacaaagaaugugcaguagcacacacuaaggugcacagaagugacauucuugggucuuuggauauacaaaggacagaaguaaauugauuuuuauuucaggagaaaaauccaggcucagucugucuaucaggcauuuuauuucuugaguaugaaaggaucucuggcuggcaguugaggaaguagaauuuugguuguguaaacaauaacaggaagaaaugggagaaagagagacagucccuaaugauuuacuguucuuuauuuucuuucugcaaccaugaagucucuggaagugguggacuguagggugguguggaguagcagcuuacuggaucuguaauuuugauagagauguucuaagucauccauguugggccuuugugugaucuguaugucgugcaaauguaauauugauaauaguagugaugguagguaauaauagcaguaguaauaaucauaauaccauaguuccacuuuacucacgguuugcaguuuucagugaccugugguaaacuguggucugaaaauauuaaauggaaacuuucagaaauaaacaauucauaaguuuuaaguugcacaccauucugaguagagugaugaaaucucacacccuccugcuccaucuugccuggaacgugaauccucccuuugucuagcaucuccgugcuguagaugcuuccugccuguuaaucacugaguagcugucgcggugaucagaucaacugucgcgauauugcagugcuucuccucaagucacucuuauuugacuuaaugauggcacaacagugcaagaguaugaugcuggcaauuugaauaugccaaagagaagcuguaaagugccuccuuuaaaugaaaaggugaaaguucuugaauuaauaaggaaagaaaaaaaucguauucuggcugagguugcuuagaucugcauaaaaaugacuuuucuaucugugauauugugaagaagcgaaaagaaauuggugcuaguuuugcugccguaccauaaacugcaaaagucaugaccucagcgugugauaagugcucaguuaggauggaaaagccauuacauuuugggguggaagacaugaagagaaacauguucugauugaugacaaucagguuugguacuucugcaguuucaggcauccucugggggucuuggaacauaccccaaggaugagggggcugucuacuauguuaauagaaucaauuguaguaaauugacaugcuuuugaucccagaucuaccacuuauuagcccugugacucuagggagguuaccuaaccuauuuaagucccaauuucuucauuuauaaaauggaggugauaucuguuucauaggaugauugugagaauaaaaugagguauuauauguaaaagcacuuagaaaaaugcccuccaugggaaaugccuuauaauguuaaguauuacuguuaauaacugugauuacugugauuuauugugucuuuuaugggauaagguugugcaggacacuucacuugcauauuuaccuacauucuagaagauuguuaagccauaaucagaugucauagugacugcuaugcauuacaugcucaauacauguuuauugaauaaugauuaaaucauaaacaguauucaugauuuuuuuuuuuuuuuuuuugaggggaagucucgcucuugucccucaggcuggagugcaauggcacaaucucggcucacugcaaccucugccuccccgguucaagugauucuccugccucagucuccuggguagcugggauuacaggugccugccaucacacccggcuaauuuuuguauuuuuaguagagacaggguuucaccacguuggccaggcuggucucgaacuccugaccuccggugguccacccaucucggccucccaaagugcuaggauuacaggcaugagccaccgcaccuggccauaguauucaugauuuuuuuuugcccaacucuuucgaagauuauuuuuuuaaaaggaagcuguaguuuuucuuguuauucaccuuuuauaauaugaaacuaccaucaaugaaaaaagccaauuguucuuuguucccuguuggggaaaggguggaaauaugguaauauuaucuguauuuaauauaaaacaguaauuuuguuuguuuauuuugccuuuaggagucugaugacuuuucacaguaccaacucaaaggcuugcuuaaaaagaacuaucugaaccagcauauagaacauguccaaaaggaaaugaaucagcaacauucaggacacauccgaaggcaguaugaagaugaagggggcuuucugaaggagguagagucaaggagaguggucucugaagacacuucacauuacaucuugauaaaagguaucaggcaccaucauuuauauauuuacauuaaaaaaucaaagauauaucaugacucugaauucuauaaacuagcaccccuggauaauauuaaugaaauucuauuuauguaauaacuguauacugcuauuaauggauuaacuacuauagugccaaaccacuuuaaaauuagcuaaugaauuaacuccuaguugccgauuaaaugaaaauguauauacuuauuuaugagaaccaguguucucuuauccaucuuacuagaagcguauugucacacuguaaaacugaauggugagaaguguuuuaauucuucuuaagguauucaagcuaagacaguugcagaaguggauucagagucucuuccuucuuccagcaaaaugcacggcaugucuuuugacgugaagucaucuccaugugaaaaacugaagacagagaaagagccugaugcuaccccuccuucuccaagaacuuuacuagcuaugcaagcugcccugcugggaaguagcucagaagaggagcuggagagugaaaaucgaaggcaggcccgugggaggaacgcaccugcugcuguagacgaaggcuccauaucaccccggacucuuucagccauuaagagagcucuugacgaugacgaagauguaaaagugugugcuggggaugaugugcagacgggagggccaggagcagaagaaaugcguauaaacagcuccaccgagaacagugaugaaggacuuaaagugagagauggaaaaggaauaccguuuacugcaacacuugcgucaucuagugugaacucugcagaggagcacguagccagcacuaaugaggggagagagcccacagacucaguuccaaaagaacaaaugucacuuguucacguggggacugaagccuuuccgauaagugaugagucuaugauuaaggacagaaaagaucggcugccucuggagagugcagugguuagacauagugacgcaccugggcucccgaauggaagggaacugacaccggcaucuccaacuuguacaaauucugugucaaagaaugaaacacaugcugaagugcuugagcagcagaacgaacuuugcccauaugagaguaaauucgauucuucucuucuuucaagugaugaugaaacaaaauguaaaccgaauucugcuucugaagucauuggcccugucaguuugcaagaaacaaguagcauaguaagugucccuucagaggcaguagauaauguggaaaauguggugucauuuaaugcuaaagagcaugagaauuuucuggaaaccauccaagaacagcagaccacugaaucugcaggccaggauuuaauuuccauuccaaaggccguggaaccaauggaaauugacucggaagaaagugaaucugaugguacgugucugugcuuuuguagaaaucuggaacgguaggauuuccccucuguaggaauucagagaucgguuaguguagucccguuuuaacuuuuuacagauaaggaacgagagacguagaaagaaagaugaaaugacuuucccagggagucacagcuggucauggaaucuugaccuucccuguguugcucugcuuuuuguuaucauuuuuaaaggcaugaagugcccuauuuggggaagguaaaguugaguuucccucuaguuuuuaaaaacuuuuuauuuugaaauaauuaugaacuuuaaaaaguuggaagaauauuauaaaacacugguuccuucauccaguaccucaguggcuagcauguuaccacauuagcuuagaauuucucuuggucucucuguggcccucuauauguauaucauauaucuccaaaucuguauacauauguauaccauugauccucauuauuuguagauuccauauuugcaaaauugccugaucacuaaaauuuauuuauaacuccaaaaucaguacucaccgcaaugucuuuguggucauuuguggacauuugcagaguuggggaaaagcuugaguugccacacuguccccugcugagguuaagcaaggugacacucugccugguucccguguucugagagagaugaccagaggguggggacaguaggggauuaugcaauggagagagagcaagaagcuccggccccaggccaguuggaccagauuugaaucccuauucuggcaccuguuagcguggcagcuucacacaggucacuaauuuguuucuugaacuuuguuucuuguuuauaaaauaaauggaaucuauuaagauggugguuuuuuaggauuuaagauaauauauaugaaauguguucauauauauguuauauaugcauauguguguauaugcacauagauauguuuaggagcaaugacucgguauuggcuaauuuaguguucacagagacuucauacgugauggccacuuugaauaagagaaucaaccacacacacacacacacacacacacacacacacacacacaauuuguuccugguaucugcuaguuuucuucauucaaauguuacuauuucccuuuuguaauuaauaaguauuuuguggaaaaggaauuuuuggagcuauauaaauaugcuguuccugaacaaacuuccacccacuuguuagcauccauugauguuuaccugaauaauuuguuacuacguugguugccaaaugaugguuuuucuaacuccaucauuccuuauauauuauuacuugacauccuccuaugaggaagaucuuuuccuucuccccauuuauuuuuauuauuuuuaaucaguguagacuccuguauuccuauuuagugaguuauaauccaauacugucauaauuuacuuuguuacucaaauuaucacagcuuuggccauuggggcuccuucuaauggcuuucagcaguuuuuucauuauauuuugagcuuuuccuugcuuucuggccaagcuguuucaggcauauguuguacuuucucugcccugguccuggaaccagccauuucaccagggagcucugguuccuuucaguggagcaugggguuuagacaccacaagcuggaugugagugugcuuauggauccugagguauaacugucucaggccuuuucagcaacagugccaggaaguauauuuauguauacauauacaugcacacacacaucuauauuuauuucuaugucuaucuguacuaaaauccaugaguuuauacugacaucugcaauuccaugggguucagucuagccuccugcuucuuuauaguuucccuaacaaugagaaacauugcuccccuuauccucaauacauuuacaucugcuuauucucccuggauauguaaccaucucccccucccacuggccuccuccuuggcccugcucucuucuuugcuucagcuguguccuuggugccagcucccagucccugagagcccccuccucuguucugauugucuccuuaaacccagcuggacaggccuugccagcccucuccaccuacagggaaggaaggcaaccauuaaauauauuuuaaggagaaggaaagacaguaagacaguaagagaggagagaagggaaguggaagaggaagaacuauuucuuagucacagcuuuauucugugcuguguaaauagcauaaaaacauacugagcaacuuccaugauuguuuauauacuuugauaauccuccuuuuugaauuuuuaaaacaaugucaguuaacuuagaacauauuuauauaaagcgaauauacaaaucuuaagagaguuuccuacuuucaaagacagugccaguuuaccuaauugaaaaggcuuguuuugaaguuacaggcauuugugauuacauuuauuuauuaauaacgcuacuauuacauguauucuguuauagucauaucuuuccuuuuuaggauguagcauuuuucagguuccuccagaaagcucuugaugauugcaggaucauuuuaauguuuugauuguagaugaagugaccuuuuaauuuugguacaggaaguuucauugaagugcaaagugugauuagugaugaggaacuucaagcagaauucccugaaacuuccaaaccucccucagaacaaggcgaagaggaacugguaggaacuagggagggagaagccccugcugaguccgagagccuccugagggacaacucugagagggacgacguggauggugagccacaggaagcugagaaagaugcggaagauucgcuccaugaauggcaagauauuaauuugguaauaccguaacauuguguuucgacuucuugcugaggaagccagguuaaguagguuuugaguuuuaaggaguugguggaugaguauuuaguagcuauuugcaguacaucuugugguugcugauggcuucauuuuuguguagguuacuggcugggauagacuccguuuuccaugugguuuagugaugaaucucuaaagauauuacagagucuugguuagacauccaguggaguacuuccuaaggagaaagagcuuauugguaauuucagucagacuaaaugcaggcuuuuuguaaacaaaacucauuuggauuauuaauauaaaucuauaaaugaaaaaacauuuuauaggaggaguuggaaacucuggagagcaaccucuuagcacagcagaauucacugaaagcucaaaaacagcagcaagaacggaucgcugcuacugucaccggacagauguuccuggaaagccaggugggugcaggcagcuuggguuuccuuuaccaccuucuucagaccccugggggaaugcacugcaugaaggggguaugcacugugcccccuggugcucagggccuggugaugccguucccugggggucacugugugucccuaacucugcaggaaugaaugcauuacaugaagugguaggcacugcucccccugugcucagggccuggcggugcccuucccugggcgucacuguguaccccucacucugcaggaacuccugcgccuguucggcauucccuacauccaggcucccauggaagcagaggcgcagugcgccauccuggaccugacugaucagacuuccggaaccaucacugaugacagugauaucuggcuguuuggagcgcggcaugucuauagaaacuuuuuuaauaaaaacaaguuuguagaauauuaucaauauguggacuuucacaaucaauuggguaagacuucagagucuuuuugauuacuuucugacauuuaccuucagaguuuguccuaggaaguuuucuuuccaaggaacuaguuugaugcauugauggaaauugcaggucuaugcaaauuuuuauaugagugaucuuuggcuuauauagaggaauaggauuuuaaacauuugaauuaaggaauuaaaguccuaguauguuuagguaguuaaucaacugacuuaguuaaacuuugacuaguuacccgagaucuccacagugaacaaaaggugguggagaggggaagcaggccgcgccugggccuguauucggguuucuggcacugaucuucuucuguucauccagcaaauauauguuuggugacuccuauaugccaguuguucuuaacaagagggaaggaacagagaguaaaauaguaggagaaacagaugauaagcagauacauaaaucauaauuugacaguuggugguaagugccaaauagaaaaauauaacaguaaaggagaggagagagugaacuucaggcaucgagagugcaggugcuguuucagagaguuguugggaaaggcuuuacucguguaacuucaaggcagggaccugcaggaaauaggaagcaagcacuguagauagauaccucgggacuagugagugaaaggggcugaggcagaagcuugugggcuguguucuagggaagcaaggaggccagugugagaggaggagggaggaaauggcaaggguuaaucuuagagaauaggaagaagcugaaacccaccagggucuggugugcuaggguaugcaggcagauugaauguggggugggagaagaaugaagucgaggaggauuccagauacugagcagcuggucgaguggaccugccuucaguaagacaaggagggagcacaguggaggaggagaaacgaaguguucagguuuggauaugauaaauuggggaugcucauuggauacccaguggagguguugaguugauaguugaauauaugugacugugguucagagagacucaggcuagauagcuaacuuugggggucagcguauagaggguauuuaaagcuaugagaauggaugaaacuuuaaaaauauuaacagaaugccauugaauaaaauaauuuauuuucaaauaauaagauauuuuuggugguuggauauagauauagauauacacacguacaugauuuauauaauaaaauguuuauaaaugucauauaagaaaucuugauaaaaauuaaaaaauauuguuacucuuuaggauuggaccggaauaaguuaauaaauuuggcuuauuugcuuggaagugauuauaccgaaggaauaccaacuguggguuguguaaccgccauggaaauucucaaugaauucccugggcauggccuggaaccucuccuaaaauucucguaaggucuuuuauuucuuuaauuuggauaauuguguaaauacccaaauaagcaaauagaacuauuauuuacagcaugaacugucaugcuguaacaugugaacaaugguucacugagaaagcagcagaaaguauugguuguuuuccauuuucuagagaugaugaaaucagagucaguucuuaguggugcugggcuuauccuaguucaaggguacaaagccaguccuguggauuucacaggaauguagaaguugccuuuucauccauugacauacuuauagagcagcuaugaugugucagacacugugcuggcccuggggaaaggagagaugaguaaggcauaggccauacccucaaggacuccccccauauacuuggaggugauggagaagcaaagcaaauuguacuugucuguguguuugguguccugagagaggucagccaggaagcgacuuggaaauauaaugccaggaauguuacauccagcacuccuguccuguuucucaccaugugaaucccgugacguguucaguggugaagucuugcuccauccagaacccagagucgugcuauacucgggguacauuuaucauuuugaagauucugagaugguaggaguuaugaguaugucugggaaaguaguuuuuucuuuguccuugauggcaucuuuuuaaaaaauugaaauauagucacauaccacagaguucaccgauuuaaaguguacaguucauugguuuuuaguguauucacaagauugugguggcaucuuuuaaccgucacuaugucgugagaugcuguuuggugguggcugauuuaaugauccuugaguguucucuccaguuacauauccuguguuugaaagaugcuaggaugcucugaccugaagagucagugacuggaaucacugaaaugaacggcgaaacuguuguagugaucauggucuuccagucauagcacacucaccaauguguuguauuuuauacuuucuucauuuaucuuuuucugauuuucuuauuguugaggaaauuuauauaccgggaaugaguuaugagguagacauacgucaugguagguaaauaacuugaaaaccuacaaauaacuuuauuauacaaauaaaguaaauacaucauagaaaauuauaaauauguauuaaaaagaugauuacaguuuacaauuuguuuauguaauuuuagacuucacacauauauaugcauauacauugcauauauauguauacucauuugaguguguguaugauuuuuuuuauaagaaugggaugaugcuauauacuuuuuauuuuaccuguaacccauuugguauuagaacaagaccuauuaucaacgaugauauagauuuauaucguuuuuaauggcuacagguaguaucuuuuugcgucuaucagggcuaguuuaaucaagugucuuuuguuauuucuauuuuuagaaagguauuaacagacauugauuugaguguccuuaaucuucggguucuuaucuaaugauuauuuuagaauaagugaaauaguaucugacuuuuccauuugguuucuugauaacuauugagagugaauuuuuuauguucauagacgguuuguguuucugauuuagugaaugaccuguuuaugcuguuccacuuuucuuuguucagcaguuuuugcucguuuguugccugcugaaucauuuucauauuugagcaguuucugccuuugguccuccagcucguugaugccagauaggagcagccuucgcucugccuggcucaggacauuuaggaugaauacagaguaaagagcaggaaggauggugggaaaccaguaaaaucagaauguggccucacuuuguuuucuguucuccucuucugagggcacccuggcuggugaaucauucuuagaguggggcugcauugggccugcagguugaauugagcuguagucacauuugguuuggacuacacgguguauucuucucuugagcuuuaauuuucaauuggcuaccaacauuuaccuuugggagauuuuacacaaaauuauggauucuguugggggaaaaaggagagcugaaaauacugggccugaauuucuggauagccccaaaauagcuggcauggagcaacagcaguuccccuccccuaccccaaggccuuggacugggcaugaauccuucaguuucaucacaguugccuccacucccccagcucagcugauugacagacaccuuccuccuuucaucuuuaugugaagugccaggcccuccugcuugaaggaguaaccauagcuuuggcuugaugagcucacaagugcacugauucuaacugccagucaugauuacaguuucaaaaacgaaaaucugcaaguaaaguagaggagaauuaucgguauucucucagugcacuccuggaaagaauguuguaaaaguaaugaagaaaaauuauuuuuuccuuuuugcauuuuguuguuauaauacuuugaagaccgcaauuaguaauuuccaacgcuagauggcacuccugcaucggugaggcggacccuggcccugacagccggucugaguggguuccuaaugcugcacuagcaagcuugugaagcgggggagccugagcugcgggcguuuuuucagguuccauugaguacauagauuggugaggauuauguuaguaacuuugauggcauuuauuuuuuccuaauuguguaaauguuucuggucagucgucacugcauuacaaacuaccuucagccuuaguggcuucacacagcaguagucacugauuuugcucaugccucugaagcucgcucaggccuggugggggugucuugucucuguuccaugucggcuaggacagcucagcugggcuaggaccccuuaagauggcucgcggggcugaugagguggcuucggccucggggccuggguggacacuuggugagcuuggcuuccucauagcauguuggagccaagagcaggagguccaggggacaggaaguggcgagggccuccccuaggccuggcacggcuugagucacacuggucagccauggccgcccugcucaagaggaggccacagggacccccuucgugaugggaggaggguccaagagugugucgcugucuuuauccggccgauuuaggcuuagaauggaaaacauugaaaaaugaauaaaauauaaagaagaaaaugaauggcugugugcucacguagaauauugccuagcacacagcgaaauaauaguuguuaguguuauuuauuuuaaguaucuguuuacuuuucucauauauguguuuuuuccaaaacuggaaucauacuuuaaguagaguucuauuaucucuguuuuuguauauauuuauuuguuuuacauacauauguauuuauauauauauaaaauguuaaauuuuaaaaacagauacauguaucuguuuuuacagauuuuuuaaacaaauuuaacauuuucuuggcauauuuacauuuuauuaaauauucuucgauccauuauuguauuugauuugagguaaauaauacagauacauuacuuccauuuuacugcugagaaagagacccagagaaguuguaacuucugugguauaauuaugagugugggcucuagaggaagacuguaccaauuccagcugugaaaucuugagccaguuacuuauuuuugaguucaguucccuccucugugaggugaggguaacgauagggcauggcuugugugaugauugggcaugugaaauauuuaacacagugccaagcacagaggaagacuuccauaaauguuugccaucauuauacauuguggcuaauaguacuaaaauuaauaaaauauucuauauagcauacaauuugaguuagaacuugaguuuacauguucuaaguuuaguucuucauccauaguguaugaacuauaaugucucauugcuguguaaguaauuguuuccuuuauuuuacagagaaugguggcaugaagcucaaaaaaauccaaagauaagaccuaauccucaugacaccaaagugaaaaaaaaauuacggacauugcaacucaccccuggcuuuccuaacccagcuguugccgaggccuaccucaaacccgugguggaugacucgaagggauccuuucugugggggaaaccugaucucgacaaaauuagagaauauccuuugcuucuuaaaagagaaggaaacaccuugucaaauauguguuugguuuaaaacuuauggaagagaaacuuggaucauuuuuuucuuauaucccguuaaucccauuuucuuaauaucccgcucuccuuuucacucuuucuucccucuccucaguuguuguuuuuuguuuguuuguuuguuuuaaaggaacaguguaucacucugucacccagccuggagugcaguggugcaaucauagcucacugcagccaccacuuccugggcucaaggaauccuccugccucagccuccuaaguagcacaagccacugcaucuggccccucuccuuaguuuuaaagagggucuuuguuugaauaagcagugauaagcauucauagauauaaccacauacuuaaauauuauugauucugaaagaaggaaagaugacuaaucuuguccuuuuuauuacugguuguccuuuccguguauauuuaaguaaucauuuggauagauguuucaaaacuugcacuagaauuaauccaacuacguuugauuuuuucucuuaaugaaauaggcaagauaucugaaacuuguuuuuauuccaguuaaccuuuuuucauagucacaagucuuugauguccuaaagugagagcuaaauauguuuuauuuuauagaauugaaaagaacauagugccagaugauuaugcuggagucauuuauuuuguuaguacuuucuuuuagcacucuaaucuuuauaaauaggaaaaucuuaggagauacagggaauggaaucaagaauggguucuuuggaccuuuuuauuugucacuuguuuaaauaucuuucaaaauauuuauaagucuuaacugcaugcauauuuugucagcgguauuucggcuggaacagaacgaagacagaugaaucucuguuuccuguauuaaagcaacucgaugcccagcagguaaucaugguggacccuucuccuaaguucaggaugaaggguaggcugugguugacagcuguuaaagaccaguuaacucuuauuuuggggcauagagcagacauuuugaaauuaggauaauuuagaugagagaauagaagaaaauagaaaaagaaaaguuagacuuuggcuucauuuucuaugaucacucuuagggcugaacuuuggaguccuuucauauucauuuuuuucuuugaaaaaaccagucuaauaacugauuucacacuaagguguuucugauuaaauacauuaccccuugggauuuacuuucauuuuuuaacgaaaggaagucuucaaagcaauucugaucauuuaaguuuuuauaaguacuaauauuuuuaaauucuauaaacgaaucuugaaagguagaaguucagucauuauuguguaucaguaggagagguuuuugugggaaggagcccuuuuguaugaccuuuaguuccucuagguaccuacuucuugcuuuaucugugaguauguucugacucacacaaaacaagcuuucgcccacacuagaaacaacccacaaaacauacauacaaauaaaccacuuagcagaaaugagaauguagcuuuugugauaauauauuuaaauuaaacccauuuucauuaggcuuggauaauuuugaaaaacaugaacaaaacuaagacagcauuucuaugaguuucucuuuguuuuuuggaugacuaucuacuggaaacauuauaaaccaaccaaaaaggaaagcuauuugucuuagugucuggugauuucuuaauuucagauaaauuuuguuguaauauuuaucuccuuuuucauucuaaaacuuaauguguuuauuuuuccaaaauuagaaaaugaagaaaaugaauuaaaacuacucauuaguuaccuccucuaauacaguuguuaacauuuagguuaaaaaauuuuccugcauuuauuuguggccauacuaaauguaacuuaauagaucuaauccucccccccaacuuauuagcauauuuucuucuauguauugugugguuuucuuaauuccagaugacuagauuauauuucaugaaagauauuuaaauaauuaguucaguuuacuuguuagaccuuuaauuuucaaguuuguuauaguaaugcugugaugaacauuaggcauauagcuuuacccauauauuuuuuuuuugagacggagucucacucugucucccaggcuggagugcaguggugagaacucggcucacugcaagcuccgccucccggguucacgccauucuccugccucagccucccgaguagcugggacuacaggcgcccgccaccacgccuggcuaauguuuuguauuuuuuuaguagagacgggguuucaccguguaagccagaauggucucgaucugaccucgugauccacccaccucggccucccagagugcugggguuacaggcgugagccaccaugcccggccaaagaauaucuucuuaaaagugaauuuacugaauaaaaggcaugaauauuucuuacaguugcuaauauauacugugaacuugccucucaaagguauuguaugaugauaauguuuuuaaaagaaagauauaguaggacuuagaaacaggccccaugaagucguguugcuccugaggaagaugaaauguuuagcuacagaaaaauauuuaacgcucuuugaauaucuuaggaagagauuucucauuugagauguggacuaaagacuuaguugacagagaugguacaaguacugcuuuagguaugauuuagaaagugaaaauuacugucaguaauucacugggagagaacuggguuuugggagauaaugaauuaauauucucugacauaguaauccaaugugagugaucaagguugagcuuguugauuugguuuagaaacuugacuuacuugucugauuuauuauuauuauucuuuuguuauuuuuuuagacacagcuccgaauugauuccuucuuuagauuagcacaacaggagaaagaagaugcuaaacguauuaagagccagagacuaaacagagcugugacauguaugcuaaggaaagagaaagaagcagcagccagcgaaauagaagcaguuucuguugccauggagaaagaauuugagcuacuugauaaggcaaaaggaaaaacccagaagagaggcauaacaaauaccuuagaagagucaucaagccugaaaagaaagaggcuuucagauucuaaaggaaagaauacaugcgguggauuuuugggggagaccugccucucagaaucaucugauggaucuucaagugaagaugcugaaaguucaucuuuaaugaauguacaaaggagaacagcugcgaaagagccaaaaaccagugcuucagauucgcagaacucagugaaggaagcucccgugaagaauggaggugcgaccaccagcagcucuagugauagugaugacgauggagggaaagagaagaugguccucgugaccgccagaucuguguuugggaagaaaagaaggaaacuaagacgugcgaggggaagaaaaaggaaaaccuaauuaaaaaauauguauccucuauaauuaguuaugacagccauuuguaaugaauuugucgcaaagacguaauaaaauuaacugguggcacggucuuugua

SEQ ID NO: 191107 - RNA, 16251 nt, Homo sapiens
uuaaaacaaauauuuuaaugcauauaaaaacaaaaugacagcacaguuuagagucuucagaagugauggguuccuggguugcuaauccggaauacguacacuuucgugccuuugucuccaucagcaguucugacuucaagcagcagaauagaagccuagaaaauuaucucuuuaccauuaguaacacuuuggaaagauauuuauauucaaaacauuaccuguugcaagcuguuaaaauccugacuacaaauaacuaugacuagauaaguucuucauacaguguucuaaaacaauuguaguuuagaaaaucugauuuuaaaaauauaccuauaaucuuauucugaugucacguuacuaaaaagggcuucaugcuuuaaguuuuguugacccagaaaacauauuuuuauuucuuagaaagcauaaauuaaaacuggaaacauauuacuuuaaauauauuacuucuaccaguuauuaugaugcacacagaagcaacgugguguacaaagagaugugucagucucuugguuaaaguuucaguauuugcuuuucaaacuucaaaauaucuuacagaagcccaaacaguauauaacaagauucacagaggcacacuaugcuuuagaaaugugguaacuagcuauacaaguaguauagcaucacaauuuaggaaaaaauaauaaaauucuaagacauuuccuaugcugaagaucaugcccaauugguagugucauucuuucugacacuagcucugauaagacuuccuuuggaauacuuuuucaccauaaucuagagaggauguguugaacugcacccuuaagaaugcagacaggacuggcauauagcaguacugcuguaggaaagaaauuaaggacaguuaguaugggccugugaauucuggcauacauguuuaaaucaauuacaauuaugcaaguaaaaaaagaauaucccuacuaauucaugcaggcugaaaagucuaguauguaaaccugcagcagaaucuaauuuuaagaaacaggcaccuaauuuugauugugaaacucacucaccugaggaaagcuuccaucaggcucacuaugccccuugugcugacuugcacacuaaaauuagcaaaacagacuccaacuauuaaaaauaucaaacucuucguauacauacuuuuguuuuaacuuuaaguaugcuuagagcaaaguaggugccuuuacuaagcuauauuuagagcacuauggggggagcucuagugugagaaacaguuucucaaggguaacaauccuaaaaaucuaggauuuggaaugaaaacuuucaauaauuugaaaguauuuugagcagaaaaauacauuugauccaaguauagaaagcguacccaaaacaaaaguaaaaguaaaaccuuuaacccuuugcguuucuauggcauuggcucauuuuuuucuuguccuucuaccuggaaagaaaacuugcauuauaaagaugaagaauauggcaucugugacuucaaccacaucuauacaaaucuauaguaagggggauuuuuaaaaagaaaagcaaauucagaagcaugccaaaaaaaaucaaagggcuaaagacaacuuaauacaaauaaauuucugaauacuuauagaaaagugggaaagaauuaccaucugcaaaaggaucaagacgcucuggggaaauuaucaugguccgccuaugcuuuuuguauucaucuucccggucugcaaucuuuggaggucugugcucagcaaauggaucauacugaaaagagguaugucucacuuaauauccacuuuauuaaaauaacaaaacagaauaucauaaacaaaaaucagaacaccauaaagcacaaauguuuaauacaugccuacuaauauucuguaccguuucacagauaaauguuaaauauaaaaaaauaaggcacauggaaacaagguaauauacauauccacauuuccauaguucaaugcuucauuaaaugauuacagccaggcaugacagccuguguguauaaucucaacuacuugggagguugagacaggaggaauccuugagcccaggaguuugggaucagccugagcaagacagcaaaaccuugugucaaaaagaaaaagauuacaccuuuacaaaauaaguuauuauuuauaauuauccuuaaagcauccuaaaauuuauggauuucuaugggaacucagacauucacuuuucuuuagcugaauaaacuaugcuuuuaaaaugaaagaucaccuguucuguugacugugguauaucauuaagcaaugccacaggggcaugauauccuggcuucuucugaccaagcaaacucguagaugaugaauagucaucgucauccugcaaugaaaaccccccaaaaagccauaaacaaaauguuagaacuuaaaaauuagaaagaauaugcaaagauucaaaaugaaaucaaaagaucuauugacagugugaugucuaagcccuccuucauaaaacuuagaaacacaauuggucuucuuucacuucaaaaaucuauuaaauucaauucaguaaaguuaucuuuacuuuuaaaaugauuaagcaaggaauauuuucuauagacgucaauuaagauaaaguagguauggacuagaaaaaccugugcauuuaauuuuuucacagaagacaaaauguuuuuucaauuugauaacuacagcuuauuuuagaacuuucuacuuucuuuuuuuaacucauguuuuuuaacacaauuuaacaaccauagaaacaaauauuuaauuuuaaauuuauuugccccuaguaguauguuuaaacagaacaauguuauacuguuacuuuucuaguauaaaaaguacaacuguuugggaggccaaggugggagaauggcuugaguguaggaguuuugagacuagccuaggcaacagagacccagcugggcaagguggcucacaucuauaaucccaacacuuugggaggccgaggcaagggacuaauugagcccaggaguucaagaccagccugggcaacauggugaaacucugucucuaccaaaaaaaauacaaaaauuagccaggcgugguggugugcauacguagucccagcuacucaggaggcugaggugggaaaauugcuugaucucgggaggcgaaggcuauagugaggcaugaucuggccacugccuuuggucugggcaacagagcaagacuuugucuccaaaaaacaaaaccacauacauagugagaucucaucucuauuguaauaaaaauaaauaaaaaauaaaaagugcaacacgggguaauucuccagaucuuaacaccucacuuauuuuauuuaaagauaaagugacaauuucccccucagcuucugaaaccuauagcuaucacuuucuuuuacaauuaggguaugagacccccaaauaaagugcuaacuaguccaugacuggcuucuagaaauuucaccuuuugggauuuuuaaauuucucucaagaaaaaaaaaagaggaagagagccaacuauaaaaugugacuugaauuucuuaaaaauaaccaguuggcaccgcauguucucacuccuaggugggaacugaacaauaagaacaccuggacacaggauggggaacaucacacaccggggcuugucaugggguggggguaggggggagggauagcauugggagauauaccuaacguaaaugacaaguuaaugggugcagcacaccaguauggcacauguauacauacguaaccugcacauugugcacauggacccuagaauuuaaaguauaauaauaauaaaaaaagaaauauacaucaccuauccaaaaauuaaaaaaaaauaaaaaauaaccaggcgcgguggcucacgccuguaaucccagcacucugggaggcugaggcagguggaucacgagcucaggagaucgagaccauccuggcuaacacggugaaaccccgucucuacuaaaaauacaaaaaauuagccggacuugguggcaggcaucuguagucccagcuacucgggaggcugaggcaggagaaugcuaugaacccuggaggcggagcaugcaguaagccaagauugcaccacugcauuccagccugggcaacagagugagacgaaaaaaaaaaaccaguuugauaaucuauauacauaaaauaaaauuuaucuguaacugaaucaccaaauuuggaguuuggaauggucugauaaaauauaagcuaccuggaauacauaaaaaaugcuuugagggaacagauuucaaaaugaaaggcaguccuccuccauaggaauucaaacagacaugaaaagcucaucaauaucaguacuaagaaaaauuccaggcugggcgcaguggcucaagccuguaaucgcagcacuuugggaggccaaggcagguggaucaccugaaggcaugaguuccagaccagccuggccaacauggcaaaaccccaucucuacuaaaaauacaaaaauuagccaggcaugguagcaggcgccuguaaucccagcuauuugggaggcugaggcaggagaaucacuugaaaccgggaggcggagguugcaguccacugcacucaagccuggaugacaggugagacugucucaaaaaaaaaaaaaaaaagauaagaaaagaaaauccauucacauuaagauaccaagaggagaaaaacaguaucaaguacaagucaguaaucaaaucacaaggacagauggcuauuuacaauuaagucacuucucacacaggcuacucuagauagagcugauaaguaaugguagggauuuacuuuacucuuaacuuuauaaagguaauggcuggcaggugcuucacuggauaaacaaacuagucuuuaccauaaauucucagaacaaagcauuuccagugaaguuucugaaccuuagagaggauaccuccaguaguuuuauccucuaaaagaucccaaaaauguuucuccagauuaaaccagauggcugcaacaaaaguuauucauauuucuugcucucucaaaaaaauaacugccucuuguacauaauuuguaacuuacaucuucaaguucaguugcagcaauugaugucacguauccagcaaaucugcugucacuuccaccauaaauuuccuggucauaauaaccuguagaaucgaggcccacuccuugagcuucaucaagagcugccuucuugccuugaauuucucgaaucugugcuucaauaucuauaaaaagauaacacagacuuucuuaauuucacuuuccaaaagaacucccaacacaaugcauuucuuuacuagguaauuaucaaaauacucucuuaaauacagaaaauguacaauaauugcaccauauaagagacuaguaaucacaacagcguaagcaagcucuagaaauuaaaccaugauaggcugggcauguggcucacgccuacaaucccaacacuuugggaggaugaggugggcagaucugggugcuguggcucacgccuauaaucccaacacuuugggaggaggaggugggcgaucacuugaggucaggaguucgagaccaaccuggccaacauauagcgaaaccccgucucuacuaaaaaauacaaaaaguagcugggcgugggggcaugcaccuguagucccagguauuugggaaguugaggcaggagaaucacuuuaacccgggaggcggagguugcagaucacaccacugcacuccaaccugggugacagagcaagacucuaucucucaaaaaaaaaaaaaaaaaccgugacaaaauaucaucuaacaaacauauaaccuagcuuaaaauguccccaguugcccuaguaacagcuucuauagauucuuuuuuaacccaugauccaaucaagcaccauacacugcauuuaguugucacucuuugcucuucuuuaaauacagacuagucuuccauuuuguagucuuuccugacaccagguuaauuuugcaaaguaauguuuuguuuuaauaaucuaaauaauacauagauguauaaagaaauaguuucgauugcaaaagauuuccauggccugacaaauagcuguuuaaauucuugccagcccaugcugaauuaagcccuuugacaccaggcacuuuuaaaaagcuuacuugcuggccgggcgcggugguccacgccuauaaucccagcacuuugggaggccaaggcgggcggaucaccugaagucaggcauucgagaccagccuagccaagauggugaaaccuccucuccaguaaaaauacaaaguuagccagguguaauggcgcacgccucuagucccagcuacucaggaggcugaggcagaacugcuugaacccgggaggccaaggcugcagugagccgagaucacgugccacugcacuuuagccugggcaaagagcaaaacucaucucaaauaaauaaauaaaugaauaaaaauuaggccgggcgcaguggcucacaccugcaaucccagcacuucgggaggccgaggugggcagaucaccugaggucaggaguucaagaccagccuggccaaugugcuaaaaccccgucucuacuaaaaauacaaaaauuagccgggcaugguggcaggcgccuguaaucccagcuacucgggaggcugaggcaggagaaucacaugaacccggaagguggagguugcaguaagucgagaucacgccauugcacuccagccugggcgacaagagcgaaacuccgucucaaaaaauaaauagauaaauaaaucaaauaaaaaauaaaaaagcucaauugcuagcugcaugaaucaaaagauaaagauucaaauagcauccuguauuugcaaaaccucccacccccccagcuaagggagaaagcccucuauaguuccucaagauagaugugcaggauaacaaaauguccuuaucuagucuaaggcacggcugggucacauuuccacauaagaaaggaacaggagcacgucucacaaacuggaggcagacgcgguagcucacgcaugucauccaaacacuuuggaaggcugaggugggcggaucacuugagcccaggaguucaaaaccagccugggcgacauggcaaaacccuaucucuacaaaaaauacuaaaauuagccagguaugguggcaaaccuauaguccccugccacuuagggggcucaggugggaggacuguuugagcccaggaggucaaggcugcaguaagccacgauugcugccacugcacuccagccuggaugagagagagacugucucagaaacaaacagaaagaaagaaacucaaaaugauagaauaguuuuaaugcugaguuuagcagccccaguugugaucggaucucaaaauuauuauaguguguuguguuacacagcaccacuacaugcacagauguuacuuuguccccaaaccauuauagcagcccaggcagccagaaauauccucacaugagcagggugguucuuuuuacuaugaucucuacuuuuguuucuguuuguaguuucauauuuugaaaaauuuaaucuacauuugccccacucccacccccuucgggcaucuucuuuucuuuucuuuuuuugaggcggaguuuugcucuuguugcccaggcuggagugcaguggcuggaucucggcucacugcaaccuccgccucccagguucaagccauucuccugccucagccucccaaauaguugggauuauagaugcccaccaccacgcccagcuucaggcuuuuuuuuuaaaccacaggugcauuuaucacuuuuaccuaaauagguuuuuguaaaaggaccacaaaugcuacuuccaugaggauuuagguaagaaacaaauggaugaaucaggagaaauagucugcaaucuccucuacagcauuagucuaguauaaggaccaccuacaaagaaaugaccuggugcaccuguuacaaagguagaaccuuaggucuuggauacacuaacucugaaacuccaacucaggcugugaagcccaggauucugcaucauuaacaaacacccuaggaaacuauuuuaccuggcccuucaccccucccauuuccaaccccagcccaccccuaccaaauuuuccaauuuagagcaucauuuuauacuuuucucuaccucauacacaacuaaaaaacaggaaaggggugcuguuuuauaaaaacugcacacuacacauauugugcaacuugcuuuuucccccuuaucaggcaucucucuuauuuuccaucuaaacaacuuuuccauccugaaguuucagcaacuaguuucucauuuggauaacacuuauucuggaacuaauuucagcuacugaauuuuaacuauugauuuuauguaccugcugauuagcaucagaguuuuccaauuacaaagguucauaaaguacugaaauaguguugguaugaaaucuauguaaaucaugacuagguucuuauuaaaauuuaguaacaaaauuacccagcccaaaaucuccuggggcuaggcagcuguuuguaguuaauuaauccuaaggugaguauauuacugaacuucuuauaggcaguacaauuaaauguuuauaugcaaaucaggcauuguuuucugucugcuggaaacuauagauauaaaguccaaacagcuuaaugggcuuuguuaacacacugcaaacugcagcacauuuacacauacaccaugugauccauaaaauuaagccgucagauuccauaaaacucagcagcuuauuaugcaauucagagaacuaaaaacucagaaauuucuuaauaaacuaugugcuaaaauaccaaauauaacauacccaaauauuuaugagcaaacaaauuauuaccaugacauucauaaauaagguaacuuugugucugagguuucguuuucaaaauaaauaaaaaggugggaaaaaauacggcagaaaaugaagaacugauaaagcugagcaguggguuaguguucauuauauuuuguccuauucucuucugcauguuaaaauauuucauaaaagguaaucugggccgggcaugguggcucacgccuguaaucccagcacuuugggaggccgaggcggguggaucacgaggucaggaguucaggaucagccuggccaagauggugaaaccccaucucuacuaaaaauauaaaaauuagccaggugugguggugggugccuggaaucccagcuacucaggaggcugagucagagaauugcuugaacccaagaggcagaggaugcagugagccgagaucgcaccacugcacuccaaccuaggcgacagagcaagacuccgucucaaauuaauuaauuaauuaauuaauuaauuaaaagguaaugaggcugggcacuuugggaugcccaggcaggcagaucacuugaguucacaaguucaaggccagccuaagcaacaugaugaaacccugucucuacaaaaauuagacaaaaauacaaaaauuagucacuacaggugcacaccuguagucccagauacucaggaggcugaggucagaggauggcuugagcccaggaggcggagguugcagugagcugagaucacaccacugcacucuagccuggguguuagagccaggccuugccucuaaauaaguaaguaaauaaauaaauagguaaucuguagaaguaauuaaaaguaauuuuccaaauuuuucucuccccuauccaugccagccaagguuuguaaaauuccacuucaaauuuuuuaucucugggaauaacaauguugucucuaacuccguauuuucaaaaccaacacuaaguuacagccugguguguaaguauuccuauaauuucuuaaauauaaacugacuaaaaauaugcaaauagaucauuucugacaacaaaugaucaaugcauaaaacugcuuggcaacuggcugagcgcgguggcucacgccuguaaucccagcacuuugggaagucaagacaguugaaucacuugagaucaggaguucaaagccggccuggccaacauggugaaacccugucuucacuaaaaauacaaaaauuagccagacauggugguggcacgccuguaaucccagcuacuuggaaggcugaggcaugagaaucgcuugaaccugggagguggagguugcagugagccgagaucacagcacugcacucuggccugggcaacaagagaaucgcuugagucugggaggcagagguugcagugagccaagaucacgccacugcacuccagcccggacgacacagugaaacuccaucucaaaaaaaaaaggcggggguuggcaacuaugaaaauaaaaaaugagagaacauaccaaaaugaguaaccagaggucaaaaacaaugaagacuugaggcaaagaaacgucuaugcuaauaaucucuuccaacuucaauuaugaccaaaaugaacaaauccuguuccagccuaaucccuucccaguuuggacucauaguucaauacauucagaugugaagacaaagaaaaaagggauacugucugcuagugacugagcaagaagagacuaggacuuccuauuggccacacaaaacugccaaaagcuggcacucuuuaacccauuuaaacccuuaaauauuccaauuuccacacuguugugcacaucaauaguuucugccuuuuuauuacuggguaguauuccauuguacuacaguguguuuauccauucucuagcugaaguacaucgagcuguuugcagugauuacaaguaaggcuacuguaaacauuuguuuagagguuuuugugucaagacagguuuuaauaacacuaaggcaggccggcacgguggcucacgccuguaaucccagcacuuugggaggccgauguggauggaucaccugaggucaggaguucgagaccagucuggccaauguggugaaaccccaucucuacuaaaaauacaaaaauuagcugggugugauggcgcgcgucuguagucccagcuacucgggaggcugaggcagaaguaucgcuugaacccgggaggcggagcuugcagugagccgacauugugcgacugcacuccagccuggacaacagagcaagacucugucucaaaaaaaaaaaaaaaaauuuccuucccaugacuagcacaaucuaaaccugaaguaugauuucagaacuaugcucauacuuagagccaauaauuuucugggugcuuccauugcuuguaggcccccuaacaucuugauugcagcaguaaugggaaggagggaaccaguuuagacagccacuuuccccaauuccuccagacugugcgaaaccacaggacaaagguucugcaacaaaugaagugcaaggaaaaagaaagagacaggaggaaccuaugaacugaaaaagauuuaagagauaaaucauuaaaucacaauguacugugaaaugaaaaagauauaagagaaaccaaccaaucaaaauguuaucaguuuucuuggaagccugacugaaacugaaaaacaaaguuuaaaagaauggguaaaacagaacagugacuagauauuuuauuauuuuaauuuuagguguaaucaugguauuaucuuuuuaagucccuacacagaaauacauacugaaauauuuauggauaaagugguaugucuaagaucugcuucaaaauaaugggaagaguagaagugaccaguguacaaauuaaacaaagcuggccuaagcuuguaacuguugaagcuaggugaugaguauaugagggguucauuuuacuacucacgguaguuuuuuuuguuauuuuguuuugagacaaagucucacucuguugcccaaacugaagugcaguggcacgaucucggcucacugcaaccuccaccuccugguucaagagauucuccugccugaggcucccaagcaggugggauuacaggcacgcaccaccaaacccagcuaauuuuuuuauuuuuaguagagauaggguuucaccauguugaucaagcuggucucaaacuccugaccucuggugauccauccacaucagccucccaaagugcugggauuacaggcguaagccaccgugcccagccuacccuaguguuauuaaaaccugucuucacacacugugcccggccuguuguuuuguuuuucugagacagaguccugcucuguugcccaggcuggaguauagcgccagccgcucucuacuuuucuguauguuugcagucucaagcaauccuccugucuugacuucccaaaaugcugggauuacaugcgugagcaaccccuggccuccuguauuuuaaaacucagaccuacauaucaagcucuugagaaaaacaauucauaucacugauagcagaaggucacaucugauaaaacuauuuaacugcuccccaccaauucugucccucugauuuccccuccugugccuuuucuucuuuuuuuuuuuuuuuuuuuuuuuuuugagacagaguuucacucagucgcccaggcuggagugcaguggcguggcgugaucucagcucacugcaaccuucgccuccuggguucaagcgauucuccugcaacagccucccgaggagcugggaucacaggcucacgccaccaugcccgguuaauuuuuuuguacuuuuaguagagaggggguuucaccacguuggccaggcuggucuggaacuccuaaccuugggugaucugcccaccucagccucccaaagugcugggauuauaggugugagacaccaugcccagcccuuuucuucuuucuaagccuuagauccugcuaaacccaacuuguagcacuucuuccuccuugauuuuuauuuuucauuuuucgucugaauuauuuucaguguucuaaucacugcucauuacauguuacacagauacugcccucagauguuaaugucucaccuacaccuuucagucuggucccuaagugauaucuacucuccuucagccagauauaaccggugaacaacuauuuccaaaauacaaggcuucuaaaagacaucacagaaaaacaggaaguauauucugaaucccaacccucagcuuuuucauuaaacaaaacuccaauaggacaacuaacuauaauauaaaucauuuuacugaacacuacaaacaauacugauaaauugauuccuaaaugauuaauucuauuaaaaaaaauuucaaggccaggcaucguggcucacaccuguaauccuagcacggugggaggccaaggcaggacugcuugagcccaggaguucgagaucagccuggguaacauagcgagaccccaucucuaaaaaaaaauuguaaaaauuagccaggcaugguagcacacgccuguaguuguagcuacucaggaggcugaaaugggaggaucacuugagcccagcaguuguagguuaagugagcuaugaucacgccacugcacuccaaccugggcaacagggcaagacccggucucaaaaauaaacacaggaaaaaauauauagaucagcaagauacacaauaacaaaacuauaacuauuccagccauuuaucaagcaaagaauuagggaaaaaacuuuuucagcuuugugaugucccaaaaaaucuaauucaaaggauuaguggcaaaacaagcugauauguaggauuuuugguuaaaccauuuuccccuuacaaaacagagaauaauguguguucccuguuuguaugccaaagucagcaguaucugaagaacugcuggauggcaagauuaugcauauucauaaccauacaccugacauaauacguggaaagaucuaaaagauuuuaucugauuugaguaauuccaguucuuuuuauauuucaauccuggaaagcauaagccacauuggccaggguaaaauauaaucagauugguuaaagaggaugugaggccugauccuaauagaaauguuugaaaggguucaggcaugguggcucaugccaguaaucccagcacuuugggaggccaaggugggaggaucacuuguggucaggaguuugagaccagccuggccaacauggcgaaacccugucucuaaaaauacaaaaauuagucgggugugguggcacaugccugcgauacuaguacucaggaggcugaagcaggacaaucgcuugaaccuaaaaggcggagguugcugugagccgagauugcaccacugcacuucugccugggcaacagaaaaagacccuaucucaaaaaaaaauaaaaaauaaaaaaagaaauguuugaaaggaauaugacagcaaaauaaauaaauaguuaucaguuuaucucaaucuuggagcuaaggagaagagaaaaucuuaacacaacagacuauucuaagcaauauaacauuuauacugaguacuauagcagcacugccccaaaaagcauuaauucugcuucaguuuaucaaaaauggcuuaacaagagaaaacagugauggaccaugaagaacuagaguuccauuaggaaggaagcaacaagcuaugucaguauuauguguauuucuacuaaacauuuaucauccccugacauaucccauagggaugggcacagacagugcucaaguauugaauguucugcuauuuucuuaugguaucacuuaauucacauugauagaauaaucucaaaaauaacaaguuuggccaaugaauagcaauagaccaaaguuuuuagcuggguuucuaaaaaauucaggaaaacugaucagaauucugauuuuccugucugagggcaucuuauacugaaguuaccaauaaauaaguaucaaagcuauacuaucaauauccccaaaugaauaacauccugaaugaacaaaaacagcacaacuuuauauuuucuacuuacuuugcaaaagguuauauuugagauagucuaaagacaaaauaauaaagccuaggaauacuaagagagcauuuaaauccuaaauaccuaaaaugguauacuaauauuaaagucauugacaauucauuagcauguuugauaaauagcagaaagcuggacuucagguccucugggugacccaacuauucaaagccauucacauucugguccuaauccaaccuuuccagauucauuuauuucuucucuacuugcacccucuguuccugcuacaguggacuacuacucaaacacaccuuucacgauucaauaccuuguuacaagauguucucaggcucagauguccuucccgauuuaaaacugacugauccuuuuaaaacacggucauguaaccuccucagugaaacaacccuaaacauaaucauuccguuacccagguucccagaacaugcugcuuuuucuucuacuuaagcaugcaucuggccucaugagagaaugagaacauacacaucuguuucuccuaucagacuguaaaauuuuggauggccucagucucuuaccucucacagacuaauaccgagccaaauacccagaaagaacauaugaaacaaaagugacuuagaagucucguucucagugaaaaucucggauuccaagucagaaaucaaagaaugcaguuccaacuucucaugccucgucuuuucugaaaagugaucccauuuucugucaucucuggauacuuccuaaugaacuccagucuauucccaacguuuuccuaauuugcacacucuguauuccauaaaacgaucaacuagcuugaaagcuucggccauuaaugaaaguaauuuauguuuuccucuuccaucugcuccuccaauaaccagucuccaaagaaaaagaucaauauuauacuaaaagugacuaagggagggaaaacaacuaccagauuuuauccccaaaucguuucgugcaagaaaaauaaacaaguaacugacgcuugaagacacacaaggguaggaguaacggaaucucgguuuaaccaaauucgauucagucugccggaaaagcggcugccguauuucagugcuuuucugacccucuucugcacaaacuauggggacgacagugucgagaggcgagugagaccuucuccccacgcccgcuuccccgaucccuugcccacgaauccuacugaggaagccgcuuaaacgaggcccucuggucagagaagagaagcuacucugaaguagcaggucccaaacacugaacaaagcgccugucggggguguaagaggaggacgccauuacgcggggcaguggccugcgccgcuggcgcggaggagacgacccuuggccccgaaacgcgggcucagcuccuacgaaagaaaccauagaaaaaggcagaauccuaggaaaaaaggcuuuuauuaggcuagcaacgaagaaaacacguaagcagggaaagaccgcuuaccuucgugagucuuggcgaucuucgccauuuuguccacucgaacacacagacggaacuggcgcucccaagaacuucc

SEQ ID NO: 191108 - RNA, 16251 nt, Homo sapiens
ggaaguucuugggagcgccaguuccgucuguguguucgaguggacaaaauggcgaagaucgccaagacucacgaagguaagcggucuuucccugcuuacguguuuucuucguugcuagccuaauaaaagccuuuuuuccuaggauucugccuuuuucuaugguuucuuucguaggagcugagcccgcguuucggggccaagggucgucuccuccgcgccagcggcgcaggccacugccccgcguaauggcguccuccucuuacacccccgacaggcgcuuuguucaguguuugggaccugcuacuucagaguagcuucucuucucugaccagagggccucguuuaagcggcuuccucaguaggauucgugggcaagggaucggggaagcgggcguggggagaaggucucacucgccucucgacacugucguccccauaguuugugcagaagagggucagaaaagcacugaaauacggcagccgcuuuuccggcagacugaaucgaauuugguuaaaccgagauuccguuacuccuacccuugugugucuucaagcgucaguuacuuguuuauuuuucuugcacgaaacgauuuggggauaaaaucugguaguuguuuucccucccuuagucacuuuuaguauaauauugaucuuuuucuuuggagacugguuauuggaggagcagauggaagaggaaaacauaaauuacuuucauuaauggccgaagcuuucaagcuaguugaucguuuuauggaauacagagugugcaaauuaggaaaacguugggaauagacuggaguucauuaggaaguauccagagaugacagaaaaugggaucacuuuucagaaaagacgaggcaugagaaguuggaacugcauucuuugauuucugacuuggaauccgagauuuucacugagaacgagacuucuaagucacuuuuguuucauauguucuuucuggguauuuggcucgguauuagucugugagagguaagagacugaggccauccaaaauuuuacagucugauaggagaaacagauguguauguucucauucucucaugaggccagaugcaugcuuaaguagaagaaaaagcagcauguucugggaaccuggguaacggaaugauuauguuuaggguuguuucacugaggagguuacaugaccguguuuuaaaaggaucagucaguuuuaaaucgggaaggacaucugagccugagaacaucuuguaacaagguauugaaucgugaaagguguguuugaguaguaguccacuguagcaggaacagagggugcaaguagagaagaaauaaaugaaucuggaaagguuggauuaggaccagaaugugaauggcuuugaauaguugggucacccagaggaccugaaguccagcuuucugcuauuuaucaaacaugcuaaugaauugucaaugacuuuaauauuaguauaccauuuuagguauuuaggauuuaaaugcucucuuaguauuccuaggcuuuauuauuuugucuuuagacuaucucaaauauaaccuuuugcaaaguaaguagaaaauauaaaguugugcuguuuuuguucauucaggauguuauucauuuggggauauugauaguauagcuuugauacuuauuuauugguaacuucaguauaagaugcccucagacaggaaaaucagaauucugaucaguuuuccugaauuuuuuagaaacccagcuaaaaacuuuggucuauugcuauucauuggccaaacuuguuauuuuugagauuauucuaucaaugugaauuaagugauaccauaagaaaauagcagaacauucaauacuugagcacugucugugcccaucccuaugggauaugucaggggaugauaaauguuuaguagaaauacacauaauacugacauagcuuguugcuuccuuccuaauggaacucuaguucuucaugguccaucacuguuuucucuuguuaagccauuuuugauaaacugaagcagaauuaaugcuuuuuggggcagugcugcuauaguacucaguauaaauguuauauugcuuagaauagucuguuguguuaagauuuucucuucuccuuagcuccaagauugagauaaacugauaacuauuuauuuauuuugcugucauauuccuuucaaacauuucuuuuuuuauuuuuuauuuuuuuuugagauagggucuuuuucuguugcccaggcagaagugcaguggugcaaucucggcucacagcaaccuccgccuuuuagguucaagcgauuguccugcuucagccuccugaguacuaguaucgcaggcaugugccaccacacccgacuaauuuuuguauuuuuagagacaggguuucgccauguuggccaggcuggucucaaacuccugaccacaagugauccucccaccuuggccucccaaagugcugggauuacuggcaugagccaccaugccugaacccuuucaaacauuucuauuaggaucaggccucacauccucuuuaaccaaucugauuauauuuuacccuggccaauguggcuuaugcuuuccaggauugaaauauaaaaagaacuggaauuacucaaaucagauaaaaucuuuuagaucuuuccacguauuaugucagguguaugguuaugaauaugcauaaucuugccauccagcaguucuucagauacugcugacuuuggcauacaaacagggaacacacauuauucucuguuuuguaaggggaaaaugguuuaaccaaaaauccuacauaucagcuuguuuugccacuaauccuuugaauuagauuuuuugggacaucacaaagcugaaaaaguuuuuucccuaauucuuugcuugauaaauggcuggaauaguuauaguuuuguuauuguguaucuugcugaucuauauauuuuuuccuguguuuauuuuugagaccgggucuugcccuguugcccagguuggagugcaguggcgugaucauagcucacuuaaccuacaacugcugggcucaagugauccucccauuucagccuccugaguagcuacaacuacaggcgugugcuaccaugccuggcuaauuuuuacaauuuuuuuuuagagauggggucucgcuauguuacccaggcugaucucgaacuccugggcucaagcaguccugccuuggccucccaccgugcuaggauuacaggugugagccacgaugccuggccuugaaauuuuuuuuaauagaauuaaucauuuaggaaucaauuuaucaguauuguuuguaguguucaguaaaaugauuuauauuauaguuaguuguccuauuggaguuuuguuuaaugaaaaagcugaggguugggauucagaauauacuuccuguuuuucugugaugucuuuuagaagccuuguauuuuggaaauaguuguucaccgguuauaucuggcugaaggagaguagauaucacuuagggaccagacugaaagguguaggugagacauuaacaucugagggcaguaucuguguaacauguaaugagcagugauuagaacacugaaaauaauucagacgaaaaaugaaaaauaaaaaucaaggaggaagaagugcuacaaguuggguuuagcaggaucuaaggcuuagaaagaagaaaagggcugggcauggugucucacaccuauaaucccagcacuuugggaggcugaggugggcagaucacccaagguuaggaguuccagaccagccuggccaacguggugaaacccccucucuacuaaaaguacaaaaaaauuaaccgggcaugguggcgugagccugugaucccagcuccucgggaggcuguugcaggagaaucgcuugaacccaggaggcgaagguugcagugagcugagaucacgccacgccacugcacuccagccugggcgacugagugaaacucugucucaaaaaaaaaaaaaaaaaaaaaaaaaagaagaaaaggcacaggaggggaaaucagagggacagaauugguggggagcaguuaaauaguuuuaucagaugugaccuucugcuaucagugauaugaauuguuuuucucaagagcuugauauguaggucugaguuuuaaaauacaggaggccagggguugcucacgcauguaaucccagcauuuugggaagucaagacaggaggauugcuugagacugcaaacauacagaaaaguagagagcggcuggcgcuauacuccagccugggcaacagagcaggacucugucucagaaaaacaaaacaacaggccgggcacagugugugaagacagguuuuaauaacacuaggguaggcugggcacgguggcuuacgccuguaaucccagcacuuugggaggcugauguggauggaucaccagaggucaggaguuugagaccagcuugaucaacauggugaaacccuaucucuacuaaaaauaaaaaaauuagcuggguuugguggugcgugccuguaaucccaccugcuugggagccucaggcaggagaaucucuugaaccaggagguggagguugcagugagccgagaucgugccacugcacuucaguuugggcaacagagugagacuuugucucaaaacaaaauaacaaaaaaaacuaccgugaguaguaaaaugaaccccucauauacucaucaccuagcuucaacaguuacaagcuuaggccagcuuuguuuaauuuguacacuggucacuucuacucuucccauuauuuugaagcagaucuuagacauaccacuuuauccauaaauauuucaguauguauuucuguguagggacuuaaaaagauaauaccaugauuacaccuaaaauuaaaauaauaaaauaucuagucacuguucuguuuuacccauucuuuuaaacuuuguuuuucaguuucagucaggcuuccaagaaaacugauaacauuuugauugguugguuucucuuauaucuuuuucauuucacaguacauugugauuuaaugauuuaucucuuaaaucuuuuucaguucauagguuccuccugucucuuucuuuuuccuugcacuucauuuguugcagaaccuuuguccugugguuucgcacagucuggaggaauuggggaaaguggcugucuaaacugguucccuccuucccauuacugcugcaaucaagauguuagggggccuacaagcaauggaagcacccagaaaauuauuggcucuaaguaugagcauaguucugaaaucauacuucagguuuagauugugcuagucaugggaaggaaauuuuuuuuuuuuuuuuugagacagagucuugcucuguuguccaggcuggagugcagucgcacaaugucggcucacugcaagcuccgccucccggguucaagcgauacuucugccucagccucccgaguagcugggacuacagacgcgcgccaucacacccagcuaauuuuuguauuuuuaguagagaugggguuucaccacauuggccagacuggucucgaacuccugaccucaggugauccauccacaucggccucccaaagugcugggauuacaggcgugagccaccgugccggccugccuuaguguuauuaaaaccugucuugacacaaaaaccucuaaacaaauguuuacaguagccuuacuuguaaucacugcaaacagcucgauguacuucagcuagagaauggauaaacacacuguaguacaauggaauacuacccaguaauaaaaaggcagaaacuauugaugugcacaacaguguggaaauuggaauauuuaaggguuuaaauggguuaaagagugccagcuuuuggcaguuuuguguggccaauaggaaguccuagucucuucuugcucagucacuagcagacaguaucccuuuuuucuuugucuucacaucugaauguauugaacuaugaguccaaacugggaagggauuaggcuggaacaggauuuguucauuuuggucauaauugaaguuggaagagauuauuagcauagacguuucuuugccucaagucuucauuguuuuugaccucugguuacucauuuugguauguucucucauuuuuuauuuucauaguugccaacccccgccuuuuuuuuuugagauggaguuucacugugucguccgggcuggagugcaguggcgugaucuuggcucacugcaaccucugccucccagacucaagcgauucucuuguugcccaggccagagugcagugcugugaucucggcucacugcaaccuccaccucccagguucaagcgauucucaugccucagccuuccaaguagcugggauuacaggcgugccaccaccaugucuggcuaauuuuuguauuuuuagugaagacaggguuucaccauguuggccaggccggcuuugaacuccugaucucaagugauucaacugucuugacuucccaaagugcugggauuacaggcgugagccaccgcgcucagccaguugccaagcaguuuuaugcauugaucauuuguugucagaaaugaucuauuugcauauuuuuagucaguuuauauuuaagaaauuauaggaauacuuacacaccaggcuguaacuuaguguugguuuugaaaauacggaguuagagacaacauuguuauucccagagauaaaaaauuugaaguggaauuuuacaaaccuuggcuggcauggauaggggagagaaaaauuuggaaaauuacuuuuaauuacuucuacagauuaccuauuuauuuauuuacuuacuuauuuagaggcaaggccuggcucuaacacccaggcuagagugcaguggugugaucucagcucacugcaaccuccgccuccugggcucaagccauccucugaccucagccuccugaguaucugggacuacaggugugcaccuguagugacuaauuuuuguauuuuugucuaauuuuuguagagacaggguuucaucauguugcuuaggcuggccuugaacuugugaacucaagugaucugccugccugggcaucccaaagugcccagccucauuaccuuuuaauuaauuaauuaauuaauuaauuaauuugagacggagucuugcucugucgccuagguuggagugcaguggugcgaucucggcucacugcauccucugccucuuggguucaagcaauucucugacucagccuccugaguagcugggauuccaggcacccaccaccacaccuggcuaauuuuuauauuuuuaguagagaugggguuucaccaucuuggccaggcugauccugaacuccugaccucgugauccacccgccucggccucccaaagugcugggauuacaggcgugagccaccaugcccggcccagauuaccuuuuaugaaauauuuuaacaugcagaagagaauaggacaaaauauaaugaacacuaacccacugcucagcuuuaucaguucuucauuuucugccguauuuuuucccaccuuuuuauuuauuuugaaaacgaaaccucagacacaaaguuaccuuauuuaugaaugucaugguaauaauuuguuugcucauaaauauuuggguauguuauauuugguauuuuagcacauaguuuauuaagaaauuucugaguuuuuaguucucugaauugcauaauaagcugcugaguuuuauggaaucugacggcuuaauuuuauggaucacaugguguauguguaaaugugcugcaguuugcaguguguuaacaaagcccauuaagcuguuuggacuuuauaucuauaguuuccagcagacagaaaacaaugccugauuugcauauaaacauuuaauuguacugccuauaagaaguucaguaauauacucaccuuaggauuaauuaacuacaaacagcugccuagccccaggagauuuugggcuggguaauuuuguuacuaaauuuuaauaagaaccuagucaugauuuacauagauuucauaccaacacuauuucaguacuuuaugaaccuuuguaauuggaaaacucugaugcuaaucagcagguacauaaaaucaauaguuaaaauucaguagcugaaauuaguuccagaauaaguguuauccaaaugagaaacuaguugcugaaacuucaggauggaaaaguuguuuagauggaaaauaagagagaugccugauaagggggaaaaagcaaguugcacaauauguguagugugcaguuuuuauaaaacagcaccccuuuccuguuuuuuaguuguguaugagguagagaaaaguauaaaaugaugcucuaaauuggaaaauuugguaggggugggcugggguuggaaaugggaggggugaagggccagguaaaauaguuuccuaggguguuuguuaaugaugcagaauccugggcuucacagccugaguuggaguuucagaguuaguguauccaagaccuaagguucuaccuuuguaacaggugcaccaggucauuucuuuguaggugguccuuauacuagacuaaugcuguagaggagauugcagacuauuucuccugauucauccauuuguuucuuaccuaaauccucauggaaguagcauuugugguccuuuuacaaaaaccuauuuagguaaaagugauaaaugcaccugugguuuaaaaaaaaagccugaagcugggcgugguggugggcaucuauaaucccaacuauuugggaggcugaggcaggagaauggcuugaaccugggaggcggagguugcagugagccgagauccagccacugcacuccagccugggcaacaagagcaaaacuccgccucaaaaaaagaaaagaaaagaagaugcccgaagggggugggaguggggcaaauguagauuaaauuuuucaaaauaugaaacuacaaacagaaacaaaaguagagaucauaguaaaaagaaccacccugcucaugugaggauauuucuggcugccugggcugcuauaaugguuuggggacaaaguaacaucugugcauguaguggugcuguguaacacaacacacuauaauaauuuugagauccgaucacaacuggggcugcuaaacucagcauuaaaacuauucuaucauuuugaguuucuuucuuucuguuuguuucugagacagucucucucucauccaggcuggagugcaguggcagcaaucguggcuuacugcagccuugaccuccugggcucaaacaguccucccaccugagcccccuaaguggcaggggacuauagguuugccaccauaccuggcuaauuuuaguauuuuuuguagagauaggguuuugccaugucgcccaggcugguuuugaacuccugggcucaagugauccgcccaccucagccuuccaaaguguuuggaugacaugcgugagcuaccgcgucugccuccaguuugugagacgugcuccuguuccuuucuuauguggaaaugugacccagccgugccuuagacuagauaaggacauuuuguuauccugcacaucuaucuugaggaacuauagagggcuuucucccuuagcugggggggugggagguuuugcaaauacaggaugcuauuugaaucuuuaucuuuugauucaugcagcuagcaauugagcuuuuuuauuuuuuauuugauuuauuuaucuauuuauuuuuugagacggaguuucgcucuugucgcccaggcuggagugcaauggcgugaucucgacuuacugcaaccuccaccuuccggguucaugugauucuccugccucagccucccgaguagcugggauuacaggcgccugccaccaugcccggcuaauuuuuguauuuuuaguagagacgggguuuuagcacauuggccaggcuggucuugaacuccugaccucaggugaucugcccaccucggccucccgaagugcugggauugcaggugugagccacugcgcccggccuaauuuuuauucauuuauuuauuuauuugagaugaguuuugcucuuugcccaggcuaaagugcaguggcacgugaucucggcucacugcagccuuggccucccggguucaagcaguucugccucagccuccugaguagcugggacuagaggcgugcgccauuacaccuggcuaacuuuguauuuuuacuggagaggagguuucaccaucuuggcuaggcuggucucgaaugccugacuucaggugauccgcccgccuuggccucccaaagugcugggauuauaggcguggaccaccgcgcccggccagcaaguaagcuuuuuaaaagugccuggugucaaagggcuuaauucagcaugggcuggcaagaauuuaaacagcuauuugucaggccauggaaaucuuuugcaaucgaaacuauuucuuuauacaucuauguauuauuuagauuauuaaaacaaaacauuacuuugcaaaauuaaccuggugucaggaaagacuacaaaauggaagacuagucuguauuuaaagaagagcaaagagugacaacuaaaugcaguguauggugcuugauuggaucauggguuaaaaaagaaucuauagaagcuguuacuagggcaacuggggacauuuuaagcuagguuauauguuuguuagaugauauuuugucacgguuuuuuuuuuuuuuuuugagagauagagucuugcucugucacccagguuggagugcaguggugugaucugcaaccuccgccucccggguuaaagugauucuccugccucaacuucccaaauaccugggacuacaggugcaugcccccacgcccagcuacuuuuuguauuuuuuaguagagacgggguuucgcuauauguuggccagguuggucucgaacuccugaccucaagugaucgcccaccuccuccucccaaaguguugggauuauaggcgugagccacagcacccagaucugcccaccucauccucccaaaguguugggauuguaggcgugagccacaugcccagccuaucaugguuuaauuucuagagcuugcuuacgcuguugugauuacuagucucuuauauggugcaauuauuguacauuuucuguauuuaagagaguauuuugauaauuaccuaguaaagaaaugcauuguguugggaguucuuuuggaaagugaaauuaagaaagucuguguuaucuuuuuauagauauugaagcacagauucgagaaauucaaggcaagaaggcagcucuugaugaagcucaaggagugggccucgauucuacagguuauuaugaccaggaaauuuaugguggaagugacagcagauuugcuggauacgugacaucaauugcugcaacugaacuugaagauguaaguuacaaauuauguacaagaggcaguuauuuuuuugagagagcaagaaauaugaauaacuuuuguugcagccaucugguuuaaucuggagaaacauuuuugggaucuuuuagaggauaaaacuacuggagguauccucucuaagguucagaaacuucacuggaaaugcuuuguucugagaauuuaugguaaagacuaguuuguuuauccagugaagcaccugccagccauuaccuuuauaaaguuaagaguaaaguaaaucccuaccauuacuuaucagcucuaucuagaguagccugugugagaagugacuuaauuguaaauagccaucuguccuugugauuugauuacugacuuguacuugauacuguuuuucuccucuugguaucuuaaugugaauggauuuucuuuucuuaucuuuuuuuuuuuuuuuuugagacagucucaccugucauccaggcuugagugcaguggacugcaaccuccgccucccgguuucaagugauucuccugccucagccucccaaauagcugggauuacaggcgccugcuaccaugccuggcuaauuuuuguauuuuuaguagagaugggguuuugccauguuggccaggcuggucuggaacucaugccuucaggugauccaccugccuuggccucccaaagugcugcgauuacaggcuugagccacugcgcccagccuggaauuuuucuuaguacugauauugaugagcuuuucaugucuguuugaauuccuauggaggaggacugccuuucauuuugaaaucuguucccucaaagcauuuuuuauguauuccagguagcuuauauuuuaucagaccauuccaaacuccaaauuuggugauucaguuacagauaaauuuuauuuuauguauauagauuaucaaacugguuuuuuuuuuucgucucacucuguugcccaggcuggaaugcaguggugcaaucuuggcuuacugcaugcuccgccuccaggguucauagcauucuccugccucagccucccgaguagcugggacuacagaugccugccaccaaguccggcuaauuuuuuguauuuuuaguagagacgggguuucaccguguuagccaggauggucucgaucuccugagcucgugauccaccugccucagccucccagagugcugggauuacaggcgugagccaccgcgccugguuauuuuuuauuuuuuuuuaauuuuuggauaggugauguauauuucuuuuuuuauuauuauuauacuuuaaauucuaggguccaugugcacaaugugcagguuacguauguauacaugugccauacuggugugcugcacccauuaacuugucauuuacguuagguauaucucccaaugcuaucccuccccccuacccccaccccaugacaagccccggugugugauguuccccauccuguguccagguguucuuauuguucaguucccaccuaggagugagaacaugcggugccaacugguuauuuuuaagaaauucaagucacauuuuauaguuggcucucuuccucuuuuuuuuuucuugagagaaauuuaaaaaucccaaaaggugaaauuucuagaagccagucauggacuaguuagcacuuuauuugggggucucauacccuaauuguaaaagaaagugauagcuauagguuucagaagcugagggggaaauugucacuuuaucuuuaaauaaaauaagugagguguuaagaucuggagaauuaccccguguugcacuuuuuauuuuuuauuuauuuuuauuacaauagagaugagaucucacuauguaugugguuuuguuuuuuggagacaaagucuugcucuguugcccagaccaaaggcaguggccagaucaugccucacuauagccuucgccucccgagaucaagcaauuuucccaccucagccuccugaguagcugggacuacguaugcacaccaccacgccuggcuaauuuuuguauuuuuuuugguagagacagaguuucaccauguugcccaggcuggucuugaacuccugggcucaauuagucccuugccucggccucccaaaguguugggauuauagaugugagccaccuugcccagcugggucucuguugccuaggcuagucucaaaacuccuacacucaagccauucucccaccuuggccucccaaacaguuguacuuuuuauacuagaaaaguaacaguauaacauuguucuguuuaaacauacuacuaggggcaaauaaauuuaaaauuaaauauuuguuucuaugguuguuaaauuguguuaaaaaacaugaguuaaaaaaagaaaguagaaaguucuaaaauaagcuguaguuaucaaauugaaaaaacauuuugucuucugugaaaaaauuaaaugcacagguuuuucuaguccauaccuacuuuaucuuaauugacgucuauagaaaauauuccuugcuuaaucauuuuaaaaguaaagauaacuuuacugaauugaauuuaauagauuuuugaagugaaagaagaccaauuguguuucuaaguuuuaugaaggagggcuuagacaucacacugucaauagaucuuuugauuucauuuugaaucuuugcauauucuuucuaauuuuuaaguucuaacauuuuguuuauggcuuuuugggggguuuucauugcaggaugacgaugacuauucaucaucuacgaguuugcuuggucagaagaagccaggauaucaugccccuguggcauugcuuaaugauauaccacagucaacagaacaggugaucuuucauuuuaaaagcauaguuuauucagcuaaagaaaagugaaugucugaguucccauagaaauccauaaauuuuaggaugcuuuaaggauaauuauaaauaauaacuuauuuuguaaagguguaaucuuuuucuuuuugacacaagguuuugcugucuugcucaggcugaucccaaacuccugggcucaaggauuccuccugucucaaccucccaaguaguugagauuauacacacaggcugucaugccuggcuguaaucauuuaaugaagcauugaacuauggaaauguggauauguauauuaccuuguuuccaugugccuuauuuuuuuauauuuaacauuuaucugugaaacgguacagaauauuaguaggcauguauuaaacauuugugcuuuaugguguucugauuuuuguuuaugauauucuguuuuguuauuuuaauaaaguggauauuaagugagacauaccucuuuucaguaugauccauuugcugagcacagaccuccaaagauugcagaccgggaagaugaauacaaaaagcauaggcggaccaugauaauuuccccagagcgucuugauccuuuugcagaugguaauucuuucccacuuuucuauaaguauucagaaauuuauuuguauuaaguugucuuuagcccuuugauuuuuuuuggcaugcuucugaauuugcuuuucuuuuuaaaaaucccccuuacuauagauuuguauagaugugguugaagucacagaugccauauucuucaucuuuauaaugcaaguuuucuuuccagguagaaggacaagaaaaaaaugagccaaugccauagaaacgcaaaggguuaaagguuuuacuuuuacuuuuguuuuggguacgcuuucuauacuuggaucaaauguauuuuucugcucaaaauacuuucaaauuauugaaaguuuucauuccaaauccuagauuuuuaggauuguuacccuugagaaacuguuucucacacuagagcuccccccauagugcucuaaauauagcuuaguaaaggcaccuacuuugcucuaagcauacuuaaaguuaaaacaaaaguauguauacgaagaguuugauauuuuuaauaguuggagucuguuuugcuaauuuuagugugcaagucagcacaaggggcauagugagccugauggaagcuuuccucaggugagugaguuucacaaucaaaauuaggugccuguuucuuaaaauuagauucugcugcagguuuacauacuagacuuuucagccugcaugaauuaguagggauauucuuuuuuuacuugcauaauuguaauugauuuaaacauguaugccagaauucacaggcccauacuaacuguccuuaauuucuuuccuacagcaguacugcuauaugccaguccugucugcauucuuaagggugcaguucaacacauccucucuagauuauggugaaaaaguauuccaaaggaagucuuaucagagcuagugucagaaagaaugacacuaccaauugggcaugaucuucagcauaggaaaugucuuagaauuuuauuauuuuuuccuaaauugugaugcuauacuacuuguauagcuaguuaccacauuucuaaagcauagugugccucugugaaucuuguuauauacuguuugggcuucuguaagauauuuugaaguuugaaaagcaaauacugaaacuuuaaccaagagacugacacaucucuuuguacaccacguugcuucugugugcaucauaauaacugguagaaguaauauauuuaaaguaauauguuuccaguuuuaauuuaugcuuucuaagaaauaaaaauauguuuucugggucaacaaaacuuaaagcaugaagcccuuuuuaguaacgugacaucagaauaagauuauagguauauuuuuaaaaucagauuuucuaaacuacaauuguuuuagaacacuguaugaagaacuuaucuagucauaguuauuuguagucaggauuuuaacagcuugcaacagguaauguuuugaauauaaauaucuuuccaaaguguuacuaaugguaaagagauaauuuucuaggcuucuauucugcugcuugaagucagaacugcugauggagacaaaggcacgaaaguguacguauuccggauuagcaacccaggaacccaucacuucugaagacucuaaacugugcugucauuuuguuuuuauaugcauuaaaauauuuguuuuaa

SEQ ID NO: 191109 - RNA, 37657 nt, Homo sapiens
cccuacauccggguaccgacuccagccgccuagacgcuggcacuauggucauggcggaggggacggcagugcugaggcggaacaggccgggcaccaaggcgcagguaccaugucugcacuuuucuugucgggcaacuaggugccgagcagugcugcgcccggaagcuggccgccacugcggggagguugggccgaggcggcaggcgggcgggcuggggcacuggugcccggccugcucuuccggagcugcagccccucaauuuggcugaggcgguggcggccgccgugaggccugcggagcuccgacccagggguaggcgugaggggcggguggggucugcuggugguaccugccugccgaagcccugggcugcgagccugucagcagcaacggcuucuucucgccuugccccugagccccagcugacuagcauuggaggggcgcgaccagccugguggagacccccgggguuuccugaaggucggggccgcugaggugggaggggguguaaacacagccuaccucgacccggcguccaguuccuaccuggccugggaaguaccuacccguuuccugccauccagcuugucuagccggauccgggugccgauauucuccuccuuguuucccuuugaccaccucucccugccgcuuucccuggagcuguucucugguccagcaaguuuucaucacuaaguugugacuuguuagaugucauuccuugcuaauaugcgugaagcauagucagagaaugaacugauuauaauuuugucagcuuuuuuguagggcauuaugugugguaaauuggugcuugauuaggcauuguuucuuaggguuuggaaaagaugggaugccucacauuaaaaauaaauaaauaaaauuggcauccagacuugaacugauuaauugcuagccgaaauggcuugcuauagacuagaugcucugaaaucggaagagauguguuuauaaaauguuaaaaagugaugcaaaugaaaauugaaacaaaacaaucguggagcuaugauuguaugucugagaauagauuuuaauuucuuauacagaauuauggaaagaacaccuuucgaagggggcauacagguauugauuaccuccccagauucauguuacagauaaggaaacugaagcccaagagaauuaaguggauuugcccaaggauacauagucuccugauucuuaauucacuggugaccuguucucuuuaacaagcugcuucuagugcugaauuucagagaaaauuuuaaagucuuauuuuggagucacauuaagcugucaguuauuccuacugacaguuuuguuuucauacuacuggaaauuuauccguuacauaugcuugcuuuuuaccguuuccacacuuuucuuccucaugcucuuuucucagauaccuuuacaucuuauucuguggaaacauuguuucugauuacauuuuuauguucagaaguagacuuuucuguucauauucugagagucaucucauuuauucauaaguucuuaauuuugaaagguuagaaaauaaaauauuuaauaucguaacauacuugcuauguugcuguaagucacauagaagaaaacuuauugucuuuuuuuuucacauugucauggaucaagguuguuagauaaaauauaacagaaaaaggauaaaaaaugaaaaagacugcuuacgccguaguuuguccuaucuuguuuaucacaugaauuucguuuagugaaauggaucuguucuaaaaugauauauuuagaaccguaucuccuucccuauugggucaaaagaaaaaaaauuaaaaacuauaauagagggcugggugcgguggcucacgccuguaaucccagcacuuugggagguggaggcaggcggaucaucugaguucaggaguucaagaccagccuggccaacacggugaaaccccgucucuacuaaaaauacaaaaaauuagcugggcgugguggcgggcgccuguaaucccagccacucgguaggcugaggcaggagaaucgcuugaacccgggaggcggagguugcagugagccggaaucgcgccauugcacuccagccuggguaacaagagcaaaacucggucucaaacaaacaaacaaaaaacuauaggagaguagguggaguaucuuccuacauuaaaaaaaaaguugguuagacuggaauauaggcacauaguugguuuucuuuuuucuuuuucuuucuuucuuucuuuuuuuuguuuuuuucuugagacagaguuucucucuuguugcccccaagcuggagugcaauggugcgaucucggcucacugcaaccuccaccucccgaguucaagcgauucuucugccucagccucccgaguagcugggauuacaggcgcgugccaccacgcccagcuaauuuuuugcagaaacuggguuucaccauguuaaccaggcuggucucgaacuccugaccucaggugaucugcccgccugggccucccaaaauggugggauuacaggcgugagccauugcaccuggagguuuuuuuuuuuugugugugaggcagagucucguucugucgcccaggcuagagugcaguggcacgaucgcagcucacugcagucgcugccucccaaguucaagugauucuccugccucagccuccugaguagcugggauugcaggugccugccaccacgcccggcuaauuuuauuuuuauuuuuauuuuuauuuauuuuauuuuauuuuuugagacaagagucucacucugucgcccagccuggagugcaguggcacgaucuuggcucacugcaaguuccacgucccggguucacgcuguucuucugccucggccucccgaguagcugggacuacaggcgcuaaccaccacgucugacuaauuuuuuuuuguauuuuuaguagagaugggguuucacuguguuagccaggauggucuggaucuccugaucucgugauccgcccgucucggccucugaaagugcugggauuacaggcaugagccacugcgcccagccaauuuuuuuuguauuuuuaguagagaugggguuucagcguguuagccagguuggucucgaacuccugaccucaagugaucuucccgccucagccucccaaagugcugggauuacaggcgcaagccaccacgcugggcuucauaguugguuuucaauaaauguuuguugguugaauuagaugagaaucuuuauuaagcugaauuuuuggugucucucauaggcaucuaaaauaugucacaguuaugagaaggcgaaacauuucauucucaacaucuuuucuauauauagucaucauugguguccucuggggauuggcuccaggauaacuccguacccccaccccauaccaaaaucugaggaugcuuaaguuucuuaaguaaaauggcauaguguuugcauauaaccuaugcacauucuguuauauaguuuaaaucaacucuagauuacuuaauaauaccuaaugcaaugcguguucuguaaauaguuguuauacuguauuuagggaauaaugaccaaaaagaaagccgguacauguuuaguacauacgcaacuaucuuagaccuaacuagguacauaguacaugucagcaacaauauaacauuuucuguauuuuuuuucuccccugaaaugaauauuuucaauuccugguugauugaaucugcagauuaaaccugcagauauggagggccaacuguacauguguuuucuaauauuuuaaaaacaacauucuguaaacuuccuuaguuuuuuuaaaaaggaaagaauagacagaguauugguagaaacuuuagaucauauaggaaaaauuuuagaauugcucuuuaauagauaaugucuaagaaaaggaauccuggaaccauuucuagaagauuguuuuauuucuugauauuuuccuuuaauaaaauuaguucauuuucauccagauaggccagcuauuucaaaaaagaugaaauguuuaagacacuuaaaaagguguacucauuaccuacuguccaaacggggacauugcuacuauaguugaauccuuauggaagacauucucugucuucuacccuaucauuccuuuucuuuucuguauacuuuuacuauauaugcauuauauccauaaguaugccuugcacuuaaacuuuuuuuuuuuuuuuugagacagaaucucgcucugucucccaggcuggagugcagugcugcacucucggcucacugcaaacuccgcuuccuggguuugcgcccaccaccacgccuggcuaauuuuuuguauuuuuucauagagaugggguuucaccguguuagccaggauggucucgaucugcugaccucaugauccgccugccucggccucccaaagugcugagcgugagccaccgcgcccggccuaaacuuuauucauuuuauauacacuguguuuacuucuaauuugcuuuuuuugcucaagguuuugaagacuuaaucuuuguugauuguuuuuacagguuuauauacagguuuauagauuauugguuuacucuuaccuccuccccaccaaguuuuaccucagagacauuugagcuucaaagaugugucaggcauugugcuacccacugagguuacauagguaaacuuuucugaaaaaucagucaaauggaaagguucuuaaucacuuaggggaauaucuguuaacuguauuaucuacagagaauuccagaaccagggcaagaugcucuauaaaaauaucccccuuaagcugggcaugguggcucaugcuuguaaugccagcacuuugggaggcugaggcuggaggauuguuugugaccaggaguuugagaccaaccuggccaacaaagugagaccucgucucuuaaaaaaaaaaaaaaaaaaaaaaaagaagaagaaauaaaaauauucccuuuaacagaaagcugguuuauuugauguuuccuucucuuuuuaaaauuuuuguggguauauaguagguguauauauuuguagguuacaugagauauuuugauacaagcaugcaguguauaauaaucacaucagggggguaaaugggguauccaucaccauaaacauuuguaucggggaaccugccccgauagucacguagguucuuuucuauuuucccuaagcaucagccaguuugagaaaugaagggacagaguacaaaagagagaaauuuuaaaguugggcguccgggggagacaucacaugucgguggguaccgugaugccccacaagcugcaaaaccggcaaguuuuuauuagggacuuucaaaaggggagggaguguacaaauagggugugggucacaaagaucacguacuucacaagguaauagaauaucacaagggaaauggaggcagggcgagaucacaggaccacaggaccagagcaaaauuaaaauugcuaaugaaguuucgggcaccauugucauugauaacaucuuaucaggagacaggguuuugagagcaaccggucugaccaaaauuuauuaggugggaauuuccucuuccuaauaagccugggagcacuaugggagacugggguuuauuucaccccuacaguuucgaccauagaagacggccauacccaagggggccgucuauagacccacccccaggcguguauucucuuucccagggauguuccuugcugagaaaaagaauucagcgauauuucucccauuugcuuuugaaagaagagaaauauggcucuguuccgcccggcucaccaguggucagaguuuaagguuaucucucuuauucccugaacaauugcuguuauccuguucuuuuuccaaggugcccagauuucauauuguucaaacacacaugcucuacaguuugugcaguuaacacaauuaucacaggguccugaggugacauaccuccuccucagcugacaggauuaagagauuaaagacaggccuaggaaaucacaagguauugauuggggaagugauaaguguccaugaaaucuucacaauuuguguuuagagacugcaguaaagacaggcauaggaaauuauaaaaguauuaauuuggagaacuaauaaauguccaugaaaucuucacaauccacauucuucugccgugguuucagccggucccucaguuuggggucccugacuuccugcaacacauuuguccuuuauguugcaaaaaauuagauucuuuuaguuuuuuuuaaauguacaauuaaauugguuuuuacuauagucacccuauugugcuagcaaauacuaggucuuauucauucuuucuauuuuuuuuguacccaugggugauuaccuuuuuuuuuuuuuuuuuuuuuuuuugagauggagucuugcucugucacccaggcuggagugcaguggcgugaucuugagucaccacagcuuccgccuccuggguucaagcaauucuccugccucagccuccugaguagcugggauuacaggcgcacgccaccaugcccggcuauuuuuuguauuuuuaguagagacgggguuucaucauguuggccaggcuggucucgaacuccugaccucaagugauccuuccgccucggccucccaaagugguaggguuacugguguaagccaccaugcccagucugaugauuacuuuuuaauggugcccauauuuugauuuagaaauucaaaacucuauuuggaaugagaauaauaauuuauaauuucuuuuuaaaauaauacuuaugggucgaucaugguggcucacgccuguaaucccagcacuuugggagucugaaguaggcggaucacgagaucaagagauugagaccauccuggccaacauggugaaacccugucucuacaaaaaauacaaaaauuagcugggugugguggugcgugccuguagucccagcuacucgggaggcugaggcaggagaaucacuugaacccaggagguggagguugcagugagcugagaucgcaccacugcacuccagccuggcgacagaguggucucaaaauaauaauaauaauauuaauaauaauaauuauggagcaguaaauuagcuacuaaugcuagauauucucuuuugguaaaaaucugauuuacuuuuuggugucuggaguuuuuuuuucauuguaacuuuuugagagauauuuaaccaucauaaaaaagugauagacuugucuccccaauuaaguaauacauuaaagguuuaugggagcuguauuugaggaaucugugauuggaaaaaacguaauuuauaguucaauuaaauaaaaucuuaauauucauuuaaaaaacauuaaacagccaggcgcagugggucaggacuauaauccuaagaauaggguggcuaaggugagaggcugaggugggaugauugcuuacacccaggaguuugaggcuguagugagcuaugauugugccacugcacacaagcaugggcugcagagugagacccugucuguaaaaaagaaaaguugaauaaaauuuauuuccuuauuucacugauaauuacauugcaaaaguuuuuucuuccccucuagugugagcuuugggucuuuauuaagaauugaaguuaaucauaauaguauuuuguaugugcuuuaaccgugaauuuauuuuuauaggauuucuauaauuggccugaugaauccuuugaugaaauggacaguacacuagcuguucaacagguaauaaaaauaguuucuuuucacccugugucuuuuggaguacgauguguaagugcccauuggguggccuuugucuguuggucacugugcagcagucugcuucccaauaaagcgugcucuuucacaaaacaaaacaaaauaguuccuuuuacaacuccaauaaccuaagcauuuuaccucugacauaguuaaguauucuuauaucuuuucgcauagagaagauuccacugaauuaauggaaugccuauuuaaaaguuuagucaacccucauuuuguuuuaagauggcauauuaagcugggcacuguggcugccagcacuuugggaggccaaucacuugaggccaggaguucaagaccagccugagcgacauaacaagacccuguuucuacgaaaagauaaauuagccaggcaugguggcacacaccuguagucccaguagcuagggagucugagguggggagaucacuugauccuacuucaagggucuaaugagcuaugauugugccacuguacuucaaccugggugacagagugagaucuuguaucuuaaaaaaauaaaaauagcccaggugugguggcucacagcuguaaucccagcauuuugggaagccgaggcagguggaucacuaggucaggauaucaagaccauccuggccaacauggugaaacccugucucuacuaaaaacauaaaaaauuagccagacaugguggcaugugccuguagucccagcuacucgggagggcuaaggcaggagaaucguuuaaacccaagaggcggagguugcagugagccaagaucaugccacugcacuccagccuggccaaaagcaagacucugucucaaaaaaaaaaaaaaaaacaaaaacaaaaacaaaaauacaauuucauuaaggggcuaauaaaaagauaauauaaauuggagcguacuaguauauuggauuaggcauugguuaaauuuuuuuuguuuugaauuuuuaguagagacaggguuuugcgaugcugcccaccuugaacuccugggcucaagcaguccacccaccauggccucccaaagugcugggauugcaaguaugagucacugcaccugucuuuuuuuuuuuuagacggggucucacccuguugcccaggcuggagugcaguggcucaagcauggcaaaauguagccucaacuuccugggcucaggugauuguucuaccucagccucccaaguagcugggacuauaggcgcacacugccacaucuggcugauuuuuuguagagaugggguuucaccauguugcccuggcugaugauaacauuuuuaaagggaaaauauaccauaaaucgaggcuguuuggcuucauuuugauagccagauaauaaaaguagauagcuggccgggugcgguggcucacgccuguaaucccagcacauugggaggccaaggcgagcggaucaccaggucaggagaucgagaccauccuggcuaacauggugaaaccccaucucuuacuaaaaauauaaaaaaauuagccgggcgugguggugggugccuguagucccagcuacucgggggcugaggcaggagaaugaugugaaccugggaggcagugagccugcagugagccgagaucgugccacugcacuccagcuugggggacagagcaagacuccaucucaaaaaaaaaaaaaaguagacagcuauucggauuuguuauguuauuugaagaucuuagaaaauaaaagagacauauaguugaauuauuugagcauuaaaaaccacccaucugggugugggggcucacaccuguaaucuuaguacuuugggaggccgaggagggaggaucacuuugagguugggaguuugaaaccagccuggacaauauagugagacccugucucuguaaaaaauaaaaagguugggcuagguggcgugcaccuguaguccuagcuacuuaggaggcugaggugggaggaaaggguuuauggugagcugugauugcaccacugcacuccaggcuggugacagagacccuaucucaaaaaaaaaaaaaaaaaagaaaaagugcuguucaaucagcaaauauuuauuggcuucucacgauauagcuagcaaugaguuaggccuuguggaagauaaaggaauauaaaccuagaucuagcucuaugccuagaaauugguuaaauuuugaagaaaaauguacagaugguuaucucuuuaaaaauagggggaaguguccuguuuguugaauuuguucauuuauucucacagguuuuuuggaugugaaaucauuaggguuuucuacauacgagacccaugucauauaauuuuacuucuccaaucuagaucuguuuucuuucuuuuucuugccuaauugcucuggcuagaccuuccaguacuacuuugaauaaaaguggugaaaaagggcaucuuugucuucuuccugaucuuagaggagagcuuuuaguuuuucacuguugaguaugauguucacuauggauuuuucauauauggucuuuauuauauugaaguuguuuccuuuauucguaggucauucagugcuuuuuagaucauaaaaugguguuaaauuuugucaaaugcuuuuucugcaccuauugagaugaucauguguuucuuuuucuuacuuuuuuuauuuuuuuauuuuuuugagacagucucgcucugucaccaggcuggagugcaguggcgugaccucaacucacugcagccucugccaccuggguucaagcgauuguccugccucagccuccugaauagcugggauuacaggcgcccgccccugcgccugguuaauuuuuguaguuuuaguuagagacaggauuucaccaucuuggccaggccggucuugaacuccagaccucgugaucuaccugccuuggcuucccaaagugcugggauuacaggugugagccgucacgcccagcauuaauuuuucuuuaaauguuugguauuuucuuuaaauguuuacuagugaaguuguuaggcccaggguuuucuuugguugcucaacauugggaauauaauuaaugccacugaauuguacacuuaaaaaugguuuaaaugccuuuccuuucuuuauugaauggucucagcagccuugucgaaaucuuuuggccauguaugugacacguuauuucuggguucuuucuuuauuucuguuugucuguaugucuauccuuaugccaguaucacacaguguuugaugacuguagcuuuguaguaaguuuugaacucaagaagugugaauccuccaacuuuguuccuuauuuuauuuuucuuaauagagacagaauuuugcaauguugcccagguugguuuugaacucuuggcucaggugauccucuugccucggcugggauuacaggcaugagccaccaugcucugaccaaauuuguucuuuauuuucaagauuuuuuuuguuuauucagaaacccuugcaauuccauauaaauuugaggaucaccuuuuccguaucugcaaaaaaaaggggggcgucgauuggaauuuagauagagauugccucguaucucuagauugcuuuagguagcauugacaucuuaacgauauuaagccuucuuacucaugcacacgagaugucuuuccauuuauuuaggucuucuuuaauuacuugcagcaauguuuuguaguuuuccgucugcaaaaaauuuuaucuccuuauuuaaaucuauuucuagguauuuaaaaguuucuaggugcuauuguaaguggaauugcuuucuuccuuuuuagauucuuacagguauauagaaacaaaacugauuuuuauguguucaucuuguauucuacaacuuugcugaaucauuuuucacuuagaguaacguucuuguggauucuuugggauuuccuauauauaggaucaugucauuuguggauagagauaguuuuaccacuuccuuuccaaaugagaugcguuuuauuucuuuaucuugucuaguugcucuggcuagaacuuuuaguacaguguugaauagcgguggugaaagugagcauccuugucucauuuggguuggaaaggcuuuuaguuuuucacccuugagucugagguuagcugugagcuuuucaugaaugcccuuaaucauguuggggaaauuuccuuuuaaaccuaguuuucugagugguuuuaucacgaaaauauguuggauuuugucagauaucuuuucugcauugguaugauugugugcuuuuuuccguuuguauauuaauguaguauauugcauuguuguuguuuuuuuaaaaauguugaaccaucuuugcauuccugauaacuuucuuuugauuuauauuuguaugguauuucuuuuuucaugauuugacauaccuauauaauuacguuugaaauaaguuucuuguagacagcauaugguugagucauauuucuuaguucauuuugacagacuuucucuuuuaauugguauguucagaccauuuaacauugaugugcugaauguuuacuauuauuuagauuuagaccuaccguuuuauuacuuuuuaauuuguuccuucugggcuuuucauuuguuccuguuuccccuuuucugucuuuuuaagggugaguugaacauuuuuaguauucuguuuuaauucuaauuuugacauauuuauauacuugauuacuaaauggguaccugcgcaguuuacugaaaaucaguauucuaccacuuuacuugaaauguagaaacuuuacuaucauaugcaccccuuuugcucccccuuuauacuauaguugcuguauauuacaucaauauacauugaaaaccccaucguuaaucauuuuacuuucacuugucaaacauauuuuaaagaagucaugagaagaauggucuauuauauuuauacccagauauuuacaaugucuccugcucccugcuccugauguucccaauuuucuuuuucuuuuucuuuuucuuuuuuuuuuuuuuuuugagacggagucucacacugucucccaggcuggagugcaguggcacaaucucugcucacugcaagcuccaccuccuggguucaggccauucuccugccucagccucccgaguagcugggacuacaggcgcccgccaucacccccggcuaauuuuuuuguauuuuuaguagagaacgggguuucacuguguuagccaggauggucucaaucuccugaccucgugaucugcccgccucggcuucccaaagugcugggauuacaggcgugagccaccgcgccuggccucccaauuuucuuuguauuauuuucugucugaagaacuuccuuuaguaauuuuuuuuuuuuuuuagacagagucucgcucugucacucagacuggagugcaguggcgcgaucucggcucacugaguuuaagcaauucuccugccucagccucaugaguucaagcaguucuccugccucagccucucgaguagcugggauuacaggcaugcgccaccacccccagcuaauuuuuguguuuuuaguacagacaggguuucaccauguuggucaagcuggucuugaacucuugacuugccugccucagccucacagaguacugggauuacagacaugagccaccgcggccagcugaucuucauuucuaaauaauauuuuuguuagauauagaauucuggcuugacaacucuuucagcacauuuuuauuuuuauuuuauuuauuuauuuauuuuuuugagauagagucucgcucugucacccagacuggaguacgguggcgugaucuuggcucacugcaaccuccaccuccuggguucaaucgauucuccugccucagccuccccaguagcugggacuacaggugcaugccgccacagccgccucauuuuucuauuuuuaguagagacuggguuuugccauauugaccaggcuggucuugaacuccugaccucaagugauccauccaccucagccucccaaaguucugggauuauaggugugagccacugugcccggccuuauuuuuauuuauuuauuuugagauggaguuuugcucugucgcccaggcuggagugcaguggugcaaucucgucucacuccaaccucugccuccagauucaagccauucuccugccucagccucccgaguagcugggacuacaggcgcacaccaccgugcccagcuaauuucuguauauuuaguacagacgggguuucaccauguuggccggaauggucucgaucucuugaccuugugaucugcccgccucagccucccaaauugcugggauuacaggcgugagccaccccaccuggccuccuggccuuauuuucauuuuuauucauuuauuuuugaaauggagucucacucugucucccaggcuggagugcaguggcgcgaucucgccucacugcaauccccacccccuggguucaagcgauucuccuccgucagccucccuaguagcugggauaacaggcgccugccaccgugucuggcuaauuuuuguauuuuuaguagagacgggguuucaccuucuuggccaggcuggucuugaacuccugaccuugugauccacccuccucggccucccaaagugcuaggauuacaggugugagccaccaugccuggacucuauuuuuauuuuuuuuugagacagggucucacucuguugccaggcuggagugcagugguacaaucauagcuuacugcagccuuaaacuccuggacuuaagagauuuucucaccucaccuuucugaguagcuaugacuacaggagcacaccaccccuggcugacuuuuuuuuuuuuuguagaaauguggucucgcuauguugccuaggcuggucuugaacucuuggccucaagcaguccuccugccucagccugcuaaguuuuucagcacuuuaaaaauguuuugccauuuugcuuccaugguuucugaugagaaagaaucugucauucaaauucuccuggcuucuuuagugguguuuuuuucuuuguuuuuuuugagacagggucucacucugucauuccaggcugguguacaguggacuucuuaggcucaagcaauccuuccaacucagccucucaaguagcugggacuacaggcaugcaccaccaugccugacuaauuuuuauguuuuguagagaugggcucuuauuguguugcccaaggucucuaacuccugagcuugagugauccuccugccuuggucuuccaaagugcugggauacagaccugagcuaccacaccuggacuuaucuuuggguuuuagccauuugauuaugauguaucuggauguagauuucuuuggguuuaucuuguuugauguucacucagcuuuuuuuaaauuguggcaauauauaugagacauaaaauuuaucauuuuugcuauuuuauuuuuauuuuuauuuuuauuuuuuuuuuuugaggcagagucucgcucuuucucccaggcuggagugcaguggcgcgaucucggcucacugcaagcuccgccucccagguucacgcuacucuccugccucagccugccgaguagcugggacuacaagcgcccgccacuaugcccggcuauuuuguauuuuuaguagagacgggguuucaccguguuagccaggaugguuucgaucuccugaccucgugauccacccaccucggccucccaaagugcugggauuacaggcgugagccacugcgcccggccucauuuuugcuauuuuaaaguguacaguucuguggcaugaaguacauucccauugugcaaccaucaccaccguguccagaacuuuuucaucuuccccaacugaaauucuauacauauuaaauaauaacucccuauuccucuuuuuuuucucagccuacucagcuucuugaauuugcaagcuuauaucuuuuuacaaacuuggaaacuuuucagcauuauuucuucaaguaccuuuuuuuugagacggagucuugcucugucgcccaggcuggagugcaguggcaugaucuuggcucacugcaaccucugcuucccggguucaagugauucuacugccucagccuccaugugccaccaugcccggcuaauuuuuguguuuuuauuagagaugggguuuuacccuauuggccaggcuggucucgaacuccugaccucgugauccaccugccucggccucccaaagugcuaggauuauaggcaggagccaccucguccagccuucuuagcugauuuuuuaaaaaugauaguugcuuuuauugcauaaaaguguggaggacucauuauagaaaacaaaaugacuuuuuuuuugagauagagucucacucccagguuggagugcaguagcgugugauugcugcucagagcaaccuccaccucccagguucaagugauucucccgccucagucucccaguagcugagauuacaggcgugugcuaccaugccuggccaguuuuuguauuuuuaguagagauggugugucaccauguuggccaggcuggucuugaacucuugaccucaggugaucugcccgccucugccucccaaagugcugggauuacaggagugagccauugugacuggccaaaauggcauuuuuguuuuauuucuaaguuaaggauuucuuuuuugcuuuauauaaauugguaucaauaaaaggauucuagauuucuucaagauugacagcuuguaacuccacuuaauaacaaaauuuaguaauuauauaaguaaagucaguuucuaaauauaugguuaaauaauuaaaauuggggugggcccagugguucaugccuguaauuccaguacuuugggaggcugaggugggagaauugcuugagcccaggaguucaaaacuagcuuaaggggucuugaauuagccuaggcggucuugaauuagccuaggcagucuugaauuagccagguguugugggcgcacgccuguaaucccagcuacuugggaggcugaagcaggagaauugcuugaacccaggaagcagagguugcagugagccgagauagcgccacugcacucuagccugggcgacagaacgaaacucuaucucaaaaaaaaaauaaguaaauaaaagucucuguguucagggacucacuauaugaaggagacacaugaaaguaaguguuaguaaguugugcuauuaagugugaaauaaaugcuacuaagaguucuagccauagaagacugggugcgguggcucacgcuguaaucccagcacuuugggaagcugaggcagguggaucacuugaggucaggacuucaagaccagccugaccaacauggugaaacaccaucucuacuaaaaauacagaaauuagcugggcaugguggcgcaugucuauaaucccggcuacuuggaaggcugagacaacaggaucacuugaacccggaaggcagagguuguagugagcugagauugcgccacuacacuccagccugggcgacagagugagacucuaucucaaaaacaaaaaaaaauuucuauccauagaagguguagugggaacaggaaagacaaaaaugaauagacagauugcuaauauauacaaauuacaaauguggcaggaaauuggauggaguucugugaggauucgaauaaucagggagugcuugaguguguugggggaacgagagauuuggacagaauugugauguggaauuugagguggccuuuggagaagguauacaauuuagcuguaucuccucaaggagagagagaaucaaaacuuugaaacauuaggaugagauaaaaaaaaucagggagagugguuucaauaguaauuaaagagucauuaaaaaguguuugaggcuggguacgguggcucaugccuguaaucccagcacuucgggaggccgaggcggguggaucagcugaggucaggaguuugagaccagccuuacuaacauggcgaaacccugucucuacaaaaaauacaaaaauuagccgggcgugauggcaggugcuuguauucccagcuacucgggaggcugaggcaggagaaucgcuugaacccggcaggcggagguugcagugagccaagacugagccauugcacuccagccugggcgacaggagcaaaacuccucaaaaaaaaaaaaaaaaaaaaaaaaguauuugaucccuuucccugucaucauggugugugcgugugacucaguucuuugccaugccuucccacaagacuuuaagacuuuuagaaucaagugauuccuggccaagaaacaaaagcaaaaucgucccauuccccaguggauucagaugaaaacugaguaauaaaaucagguacaacucuaagaggagacauuggaaaagaaccaagcugggucuagaaggaauuuuacaugagauggcacacauacuuaauauugcaucaaggucacuaucaugucaccauaucaagcugaaaaugucaccaucaucuggacaguuguacaugcuguauuggaacaaugguuuuucuuuugguuucuaugcucugcaguaggcugguucaguacuaaauaugugagaccuuuuguuuggaaaaaaaaguuuuugaguaagcaagugauauucaagaaagauugucugaaguaggcaaaauugauuggcucaagaaggccuuauaguuaguaaguuuuuguaaccacccuuuuaaucuguucuaacguauuuagacuucagaauaucaaaaagauugcauaaagcauuacagagaucugaaauuuaaauuuuuauguuauuacauuuuaaaaauugaaagugacccucccuugccuuuuuuuuuaaacuuaguuuuuucuguuagucauuuaaaacaacuuuuauuggaucuaaugaacauaccauacaaaucccuauacaguuagagugauuauauucacaggguugcacagccaucacuacagucuaauuuuaaagcuuuuuuguuguuguuuuguuuuugagauggagucucacuguguugcccaggcuggagugcaguggcacgaucuugguucacugcaaccuccgccucccggguccaagcgauucucuugccucagccuccagaguagcugggacuacaggugugugccaccacgccuggcuaauuuuuuuguauuuuuaguagagauuggguuucacuauauuagccaggauggucucgauuuucugaccuugugaucugcccaccucggccucccaaagugcugggauuacaggcaugagccccgacgcccggccuuuuagaacauauuuauccuuccugaaaggaaaccucacccucauuagcagccaucuucagucucuucugccuuccucucugcccucaagcccuacaccaguacaaaucuauuuccugucucaauagauuuucuuacucuagacacuucauauaaaccaaaucacaauauguaccauaguuauauuuacauugccuauggugaaauccuguaucuacaaaauauggaaaaguuagcccggcgugauggcgugugccuguagucccagcuccucaggaggcugaggugggaggauugcuugagcccaggagguggauauugcagugaucugagauugugccacuguacuccagccugggugaugcagugagacccuguuucaaaaaaaaaaaaaaaaaaaagaaauuaugguuugcaauuuugauccaaguuccaguccugacaaauacaauaucugcauuuauguaguagauucuauccaaaugaaguugaauugaaggauaaauaaguaaggguaaccuacuuuuuuucuuaguuacugauuaugauucuauacuugguuuccuauuuaguguauaacccaaguugaaccacaagagcaguuauguauuaacaaauuauauguacuuaacauaagauuuaccaggugauauaauuuaauuaaccauaagaacuucuuuguuuuuaguauauucaacagaacauaagagcagauugcuccaauauugacaaaauucuugaaccaccugaaggccaagaugaagguguguggaaguaugaacauuuaagguaggaccuuacaucaaaauacuaauaguaccucucacaaaacuagcuuucauauuaaugauaauuaugaauuguaaaauuuacuauguaacugcagacuaagaagccaaauuuuaaagcuuuggcauuuucagugucacaagguucucagcuuucuucacugguuguuuccaggucaaauuaugcugcagagucacucauuuugaaaggugguuuauuucagaguugauaauuuggaccugccucugcaccucucuucuuuucuuuucuuuuuuuuuuuuuuuuuugagauggggucucacucucuugcccacguuggagugcagugguguaaucacugcuuacugugccucuaccucuuaggcucaagugauccucccacuucagcuuccagaguagcugggacuacaggugugugccagcaugccucacuaauuuuuuaauuuuuuguagagacaggaucugauuguguugcccaggcuagucucaaacuccuggauucaagcaauuuuccuaccuuguccucccaaaguauugagccacccuuucuacauuuauucauuugggccuuauuauccccgccuuuuuuuugaaacagggucuugaucuguugccuaggcuggaaugcaguggugcaaucuuggcgcauugcagccucugucucccaugcugaagcaauccucccaccucagccuccugaguagcugggacuacuagugcaugccucuaagccuggcuaguuuuuuguauuuuuuguagagacaagguuucaccauguugccuaggcuggucucaaacuccggggcuuaagcaauccacccaccuuggccucccacagugcugggauuaccaccaugccagccuggguuuuauucuuauuucaugauuuuccuuaauuguaucucuuaaccgcuaauauaguauuuccguuuccccauuuuugcauaacugugucaucuuuugucuuuuuuuuuuuuuuuuuuuuuuuugagacagagucuugcucuguugccuaggcuggagugcaguggugugaucccggcucaccacaaccucugccucccgaguucaagugauucuucugccucagccucccgaguagcugggacuacaggcgcagccaugcccagcuaauuuuuguauuuuuaguagagaugggguuucacuauguuggccaggcuggucucgaacuccugaccucaugaucugcccgccucagccucccaaagugcugggauuacaggugugagccaccgugccugacuugucuuuuuuuuuuccuuuguuucuguagagauggggucucacuguguugcccaagcugguccugaaauccugggcucaagugauccucccaucucagccugccaaagugcugggauuauacaggcaugagccacugcacuuggccacuuuauguuuuuguagaggauuacuuccaguuccuagucuaggcuugguaucugauaaguuaccuguaaauuauugcaaacuuccagucuucucuuugguaaauagagauuaauuguaauccugaaguaaggaguuuuggugcuuuuuauaaugcccuuugaaugaaaaaauugauaacuaguggauagguggagauaacauuaaaaguagauauauucugaaguuacuagguguuucuugaaauuauaaauuuuccagugcaaaugggagcugggaugaguugacagauuauuaauaaauauagagaaugcaguauguguucauuggggcuuauuauuuguaaguugauuuuuagauaaauagaguagaaauaugacuuuuccugaauaaauuagaccauguuuccuguguugugugccucaacuuguagacaaggcacuuuuuaaaaauauuuacuuuuugaugcugcaugcuucuuuagaaauggcuaagacauuaugucgugucauaacaguucagcaauuucaggaugcuaagacuucuuuguauccuuugccaguuuuuagacaaauuacuugacuauuuucuaacuuuuuaauauauaugaaugcacaauaauucaaaguacgagucuguagauauuuucccauuuuuacaacccaagacagagagcacuuuaguguaguacauccuuugcuuuauuuuuaucagccuugaaaauaacugcuuucuuauguuuuuuuucuugagacaagagucucgagucucgcuuugucaccaggcuggagugcaguggugugaucucggcucauugcaaccuccgccacauggguucaagcgauucuccugccucagccucccaaguagcugggacuacaggcacacgccaccaugcccagcuaauuuuuguauuuuuaguagagaugggguuucaccauguuggucaggauggucuugaucuccugaccucacgaucugcccaccuuggccucccaaagugcugggauuacaggcgugugccaccacacuuggccguuuuuuccauuacaagcauaauuccuaacaaauaggggcugauuuuaguguuacaaggguuuuuuuuuuuucagaucuaagaaaacauuuaucucccuauuuaacuuauucuaugaaacauuauauaaaacauuacauaaaacuuuacaugaaauauuucucacaaguauuucauuuguucuggugcuauuuuuacuuuuguuauuuuuuucuacuagccacuuuuuggucuggguuguauauuaacuaucguauauauucuuuuaucucuuuauuguauuguguacauuuuauuaguugaccaggaagagguuuuuuuuuuuuuuugcauacauccuuuauugauuugaggcuguauacuugccauuuuuaguuaaugcaguugauuauauaaugauguuaauuuagauugggucaugacuucagucauaucucccacuagcucauauugagucuuaaugauuaggaaaaaguacuccuuuauguccggauacaugcguggugacuggaauguaggcuggauuccagcucugguuggucucuucagcugcacaacuguguacauguuagcccuguauuaaauuaacuugaaguugugaguuuugcauuauuugccacagauuauacccacagcccugcugaaucaacuuaauuuugcuuuuggcuauaaaaggguuggguaagaaacuuaccacaaccagucuuuauuaccacuugguggaaaacaacuaaaaaacacauaacaugcagucuacuugauaggggacaguagagggugauacggugauuuagaaauaauguuauuuuuguaaucuaaggacagcauuauuaggcaucuggaaaggaaaugcaguuacaaacaacugaaaauuugacccuugccuuuuuguuuuccucuguuacaaugugcaguaaguaaguaaaugaaguuuuuccaccaaauuuguucacauauauccuguuuuuuucuuuuuuggggggauuuuuuuuugucuucugauuauauagguguuagcuuugcauuguuuugggaaccaaaaugauucaauuuuucugauggggaaacauaguauugauuuaucuaaccugauacauugaacuaaauauuaauagguaggacuuuaggagggaacacguucaguguuuugacagcuguaaaacuaccuuugugacauagaagauugucuuuuuaucaaauagcugucuaaaacugauggccucagugcaauuguaauguaauuuuuuuuuuuuuuuuuuugagauggagccuuacucuguuucccaggcuggagugcaguagugugaucuuggcucacugcaaccuccgacucccagguucaagcaguucucccuccucagccuccugaauagcugagauugcaggcacccgcuauuaugcccggcuaauuuuuguauuuuuguggcgauggaguuucaccauuuuggccaggauggucuugaacuccugaccucaagugauucaccugccucggccucccaaaguguugggauuacaggccugagccacugcgcccugcuguaauuucuuuguauguuucuauguaccaacauuuuauuacccuccaguugcugaauuuuucuacaauucagaaauuuucucauaugcauauauagcuccugugaacaucuuuauacauuuaucugcaugcagaucugauuauuucauuacaauagauucuuagaagaaugacuuagucgaaaaguauacacuuccuaaaagucuugguaaauauuuccaaauuacuucccugaaaaauuguacuaauuucuaguauauaagagaaugaucagcucacuuaacucugguauugaauguuaugaggguuauugguuuucuauuuuuaaucuguaagccuuuagaagaaaugugucauugucaguuuaggugguuuugagaaugguaaugagggaggagggaugauacugaugggauucucuuuuugcagcuaauauucuaaaaauugcugugaagaauagauaugacuuuuuauuuauguauuugcauuuucaggcaguucugccuugagcuaaauggacuugcugucaaacuucagguaauauuuucuuuaagucaaaguuauaauugaaaguucugauuuuuuuuucucuguuuuuauaacuuaaugugcuuacaaaaacguauccacauuucuaacuuucuucuagaauuuauuauggaaauauaguaaccuaaaugauaagcuuuuucauuauuauuuuacauauuaagaaauauaauuauuuuuaacagagugaaugccauccagauacuugcacucaaaugacagcaacugaacaauggauuuuucuuugugcagcucauaaaacuccaaaagaggugaggauuuaugaaauagaguaacuaauaaaauuauuauagccuaaaucucucucaagacaauguuagacaaguuuuuaggguuuuuaguucacuguucauuuugcuauuucauuuugaguugcuuguugugaaguuguuacugcagugcuauuuuaggauuucuuaugauaagcaucauuuuucauaauugggcaauuacaugggcuagaacucacuucaugauccacuggcuauuacggauuaacaucugucacauugugcugauaucuacuguguaaugauugagauacgccuguuuagguuuuuguucagauuauuucuuuugauaggaagaacuauugauuacucugaugccuaguuuaaguagaaauguuacuuuugagcuuuuaaauauucauguuguuuuucuccuuauuuaguuuuugucaagguaagacuauaggcaguagcaguuuuuuguuuugcucuuuuuuuuuuuugagauggauucuuacuccguuguccaggcuggagugcagugguaugaucucgguucgcugcaaccucugucuccggauucaggagauucucaugcaucaaccucccaaguggcugagauuacaggcaugcgcuaucaugccgggcuaauuuuuauauuuuuaguagagaugggguuuugcuauauuggcaagccuggucucaaacuccugaccucaaguaaucugcccaccucagucucccaaagugcugggauuacaggugugaaccacugugccuggccuacuguacuuuuucuuauuuaaaaaauuucuucauaucaucugauacccaguauacuuuuccuuaguugucuccaaaauggucuuuacaucuggguuguuuaugcauugcuuuucccuuaaucuguauucccauuuaaucuguuauaauuacuuuuuacuugacacugacucacuggggauauuggguuaggccaauucuguagaaucauagaccuugaaguggucauuauauugauagacuucuaaggcuugaagacaagugaggcccuaguugcaaaaucaauaucugauguuuuuuguuucaaaaaggacaaaugcuccaaaauaaggaguauuugauaccuaagagaauaguacuuauuuggaagacugguuucauucaggaugucacauuuuuauguuaauuaauugaagcaguauuaagauuguaucugucggccgggcgcgguggcucacgccuguaaucccagcacuuugggaggccgaggcgggcggaucacgaggucaggagaucgagaccaucccggcuaaaacggugaaaccccgucucuauuaaaaauacaaaaaauuagccgggcguaguggcgggcgccuguagucccagcuacuugggaggcugaggcaggagaauggcgugaacccaggaggcggagcuugcagugagccgagaucccgccacugcacuccagccugggcgacagagcgagacuccgucucaaaaaaaauaaaaaauaaaaaaaauaaaaagauuguaucugucuacaucugggaaaauccacauagugguuucauugauaauucacugaaguuggcuacuuaacguagugaaugaugugauuauugcaauuaggaaacugaaucaagaaggcugaaucaaggcuaguuuuguuuuggcaaauaguaaugauguauuauucuuucuuuagaguggaagugauauccaguuugugauguguuaugacucuuaaauauacugucauucucauauccacuucuuucuugauuaauauuaaaugacaggauagucauuagcauuaagaccuguaaauugagucuuagaauugcagcauugcuugcugaaguccagaucuguugaacuggccaugugucaagggagggugauaguaggauuuccaagugguaguuauauugaguggaguuacuguaaaaauacaaacaaaagaacaauuugaaaggacacuuucugaacuguuuuugaauaacugcuuagucaggaaacuauaggaacugacaaacuaagcuaagaaaauugcucucauggauuaaaaucacuagggagauucugaagugggagcagcagaauacuuagcaccaauaaucauuuauucaguauccuugagaauuaaagagaggcauucagcauauagaguaaauuauacaaauagugcuucuaggcgacaaacauuauaacuuacugucuacaagcccucacagucacaugcugauugugaucacuugcaguagcauuaugauuauauauuuggaaaaauauaauacauaaaaauuuguaaacaccauuacauaguauuuuguaaccugcuauauuuugccauuuuuugcuguuauaacuguuacagaguaggaauaguuaccugagaauuaacugggggaaggugaagggaaggcagcuaaaaacaaugcaaaaugucauccaaauuaaaaauucagaaaccaguuaaaggucuaaagauacagugaugugguaacccaugagccccauguagcuguguagcacuugaaauguggguagucaaaauugaaauaugcuguaaacacaaaauaaauacuggauuucgaagacaguaacgccuguaaucccagcacuuugggaggccgaggcaggugggucaccugaggucaggaguucgagaccagccuagccaacauggugaaaccccaucucuacuaaaaauacaaaaaauuagcugagugugaugggugugcacauguagucccagcuacuagggaggcugaggugggagaaucaccugagcccaaggacucaagguugaaguaagcaaagaucacaccacuacacuccagccuaugugacagagagagaccaugucucaaaaaaagauucagaaauggccaguaagcacaugaaaagaugcucaacauuaguuauuaaggcacaucucaaaaccacagacaguuggugcgaggguugugcguuauuguuaugcugauuaacauugucuccuccacaaccaugcuugauaagggaaaaaaaaaaaccaccgugagaauggagaaacaaaauguagcauggacauacaaugaaauauuauaaaaccaugaaagggaaugaaguucugauacaugcuacaacacagaugaaccuuuaaaauccaguauguauuauguggagugaaacaagucagaugcaaaaggacagauacuguagcauuccacuuaucuagagugaauaaauucauauagacauuugaagguagguagaagcugccaaaggaugggcgguaugggaaguuagugcuuaaggguaauagacuuuuuucuuuucuuuucuuuuugagacagagucuugcucuuuugcccaggcuggaguucaguggcgcaaucucggcucacugcaaccuccgcuucccagguucaggcgauucuccugucucagcuucccaaguggcugggauuuacaggcaugugccaccucgccugacuaauuuuuguauuuuuaguagugacaugguuucacccuauuggccaggcuggccucgaacuccugaccucaugugauccgcccaccucagccuccuaaagugcugggauuauagaugugagccacugcgcccagccgaguuucuuucuuuuuuuuuuuuaagagacaagaguuucgcucugucgcccaggcuggaguuucacucuguugcccaggcuggagugcaguggcacaaucuugccucacuguagcccccaccucccaguuucaagcaguucacugccucagccuucugaguagcugggacaacaggcgugcaccaccaugccaggcuaauuuuuguauuuuuaguagagacggaguuucaccauguugaccaguuuggucucaaacuccuggccucaagugauccaccugccuuggccucccagugugcugggauuauaggcaugagccaccaugccuggccauaauaguuucuguuugagaguuggaaacagugaagaugguugcacaauauuguaaauuaaugccacuaaauuguacauuuaaaaauggucaaaauagcugucugggcgcgguggcucacgccuguaauuccagcacuuggggaggccaaggcgggcggaucacgaggucaggagaucaagaccauccuggcuaacacggugaaaccccaucucugcuaaaaauacaaaaaauuacccgggcgcuguggcgugugccuguagucucagcuacuugggaggcugaggcaggagaaugacgugaacccugcagacggagcuugcacugaguggagaucacaucacugcacuccagccugggcaacagagugagacuccgucucaaaaaaaaaaaaagggucaaaauggaaaaauuugugguguauauauuuuacuacaauuuuuuaaaauguuaagaaaaaagcaucaaaaccccaaauggcauauacuuucauacccacuauaauggcuaaaauaggaaagauagacaauaacaagugcugacggggaugugaaguggaaccccuaaacauugaugaugggauuguaaaaugcuucagcuauuucaaaaaacaguuuggaaguuccuuaaaaugguaagcauagaguugcauacgacccaggaauuccacuccuugauauguaguucccccaaaaugaaaacauuuaucugcacaaagacuuguacaugaauauucacagucacauuauuuaugauagccaaaaaauggaaacaaccaaauauccaucaacugaugaauggauaagcaaaauguguugcagccaucucucaguagccucagaggauuggucccaggacccccaugaauaccaaaaccacagauaccaaagucucuuauauaaaauggcauaguauuugcauaugaccuaugcacauccuccuauauacuuuaaaucaucucuagauuacauauaauacugaauacaauauaaaugcuauauaaauaguuguuauacuguauuucuuaauuuguauuauuuuuuauuguuaugggguuuuaaaguguaguuuugaucugcaguugguugaaucugcagaugcaaagugcugacuguauguguacaauggaauaauauucagccaugaaaaggaaugaagucuuaaagggagaaacauacaguacggcauuuuguauauauuaaaaacauuaaaggcuaaaaaguuuugaauuuuaaaaaaaggaaugaaguacugauucauacuacaccauggauaagccuugaaaacauaauagaagccagacacaaaaugccacuuauuauauuauuucauuuuaaugaaauauccagaauaggcaaauccugugaaacagaaauuagguugguuguugcuuagggcugggggaaggagagaaugggaagugacugcuaauugguucaagguuucuuuuugggaugcugaaauguucugaaauuuagugguaaugguugcagaauuuugugaauauacuagaaacuacugaauuuuuaagaguaaauuuuaguuguaucaauuauaucuuaaaagucaaaaaguagcccauuaauuuuauaucaauuaccugcugaaaugguauuauuuuggauauagugggucaaacuacaauauuaaaauuaauuucaccucuuucacguuaccuuuuuauuuuuuauuuuuuaauuuuuauuuuugagacggagucucacacucuugcccaggcuggagugcaguggcgcgaucuuggcucacugcaagcuccgccucccggguucuugccauucuccugccucagccuccugaguagcugggacuacaggugccugccacugcgcacagcuaauuuuuuguauuuuuaguagagaugggguuucaucguguuagccaggauggucuugaucuccugaccuugugauccaccugccucggccucccaaaaugcuggaauuauaggcgugagccacugcgcccggccucacguuauccccuuuuuaauguaucucuuagaaaguuaauuaauuaauuuuuugagacgaaaucuuacccuguuauccaggcuggaaugcaguggccugaucuuggcuuaccucccuugaccuccugugcucaagcaauccuccugccucagccuucuugguagcugggacuacaaucauagugccaccaugucuggcuaauuuuucaaauuuuuuguagagauaggggcauuucccuguguugccuaggcuggucuugaacuccuggacucaagugaucuucccacuuuggccucccaaagugcuggaauuacaggcgugagccaccacauugggccuagaaaauuuaaaauuaaauauauggcuugcauuauacaguugacccuugaacaacuccgggauugggaucccaacccucugugcagcugaaaaucugaguaucuaacuuuugacucccccaaaacuuaauuacuaauagccuacuguugacuggaagccuuaccgauaacagucgauuaacacacauuuuguauguucuguguauuauauaguguauugcaaugaaggaagcuagagaaaauguuauucagaaaaucauaaggggcugggcgugauggcuuaugccuguaaacccagcacuuugggaggcugagaugggaggaucgcuugaggccaggaguucgagaccagccuggucaacauagugagaccuucuuucuuucuuuuuuuuaaagaaaaucguaaggaagagaaaauauauuugccauucauuaaguggaucauuguaaaggucuuccuuguuguguucaugucguugaguaggcugaggagaaagagaaagaagugggguuggucuugccguugcugggaaaaucugagcauaaguggauuuacgcaguucaaaccuguguuguucaagggucugcuguauuucuguugaugauucugguuuaaagguuguaaaacugucucaugguauacccaaaugacaaauaugagaaauacaguuacuugggauauuugcuuuugaccaacucaucuguggucauauaucuggagaaagguaguuuuuuucaauaaauauugcucaugguacuguuuuuggcaaggaguccacuaaucagaaauuccuguggauauauuguuagaaaaauacuucuuuuuuauuagguaauuuuuuagugccacggcacuaagccauauuuaguaguuacuaaaccguauuucuaagugacagcuucagucucaaacuugaaaaauaaccuaauuacuggguagagucuuugagcuacagucauuguuacuccuuccucuaguuguuuuuuccuucugguugacucccugguuuguuucuagacugcuuuccccuugauguugcucccugucugcccucaggaggacuggaugaggacaauuacuuugcaguuuuauuuuuccuuuaauaaauuuacugaguugccaugagacaguguuucauuguuucuuuuuuucauuguuucugauaaauggaacagaauaagucagauuuauuaaaauauaaggaaacuuugauauuucauguuaaaauucaaaggugaucugggagaaaguucuuuagagggcugcuagauugauaauagagugcuagggacauaauaaggaauauuguuuaggauauaagaaggcaucccuggagauaccagagauaaaucaggauucuucuugucuguaauuguuguuuucuuguagguacgauguugggaauaaaaaugggagacugguuuauguaucaucuagaauugugauaugguucaaggggauaauaaaccuuacuuauuaauauaacauuauauuuuacaagcauucggaaauuguaaggaacuuuuuucuuagaacaugcucaugucuuuggaauaagguauacccauauaaugaauauaucuaacuuaagagagagcucuuuguugaugcauuucuauauucuuucuuuuguaguguccugcuauagacuauacuagacacacacuugauggugcugcaugucuucugaauagcaauaaauauuuucccagcagguaaucgaaacuuuuaaacauaguguuaaacauuuuagaguuaauuuauaagauugguauuuuaggggggaggggggagggauaguauuaggagcuauaccuaaugcuaaaugaugaguuaaugggugcagcacaccaacauggcacauguauacauauguuacaaaccugcacguugugcacauguacccuaaaacuuaaaguauaaauaauaauaaaauaaaagauuaguauuuuaaaaguaaaauuagguugcucguuaaugcauuuuuguauuuuuuuuuuuagcuguuguauuuuggcuuguuuauucaaguuuugaaauuaggacugugguuaaacagcagaacuuggcugucaaagcucaaggccaguucagucuaaggcuaguaccuguucauauaugucauucugcagagcucucccucucaugcuuuagaguugggauauguauauacuugcucacuugaaucucuauguuaguuagacucgaccucccuuuauguaguaugccuaaagagcagacuuucuggcugggcgcaguggcucacggauguaaucccagcacuuugggaggccgaggcgugcggaucaccugagauugggaguucgagaccagccugaacaacauguagaaacuccuucucuacuaaaaauacaaaaugaucugggcauggugacgaguaccuguaaucccagccacuugggaggcugaggcaggagaaucgcuugaacccaggaggcagagguuguggugagccgagaucgcgccauugcacuccggccugggcaacaagagcgaaacugucucaaaaaaaaaagagcagacuuucuuauuuguuuuugaaggauuccuuauccuugcucauugauuuuuaagaucugagaagucuguacauguaauauauuaucggugaaguuugugacugccuuuuauuuuauuaagguauuuguuaccagguggauagauuuggagauuucccccaccaaauaugauuagcuucaaagagcucauauaaaauauguuaagaaaaauacugacuuuugaccuuaauauucuguguauacauauuuuaaaaaaggauaucagaaauaugcagaaaauuucaauuuuaaaaaaacaauuuuaauuucucucucucuguuuuucuuuuucuauauggagucuugcucaaccaggcuggagugcaguggcgcaaucucagcucacugcaaccucugccuccuggguucaagcguuucuccugccucagccucaugaguagcugggauuacaagugccugccaccacgccuggcugauuuuuguauuuucuaguagagacgggguuucaccauguuggccaggcugguuucgaacuccugaccucagaugauccaccugccuuggccucccaaagugcugggauuacaggcgugagccaccacaccuggccuuaauuucuaaaaaaaaaaaaaaaaaaaagaaaagaaaaggaaagaauaaccuaguucuguaaaauaaaacaauaauuccuuucaggaguuuucaaucgccucuaguggacaauguauuaauguuggaaauagauguuauaguaaauuuugaaaugucagggauuuauucuaacugcauuaaacuuuuacaaaguuucaaaacuauaaugcugaauuuaaguuaggcccugugauuagguagaaagaacacuggccuagaacugaggagcaggggcuccaggcauuuacucgcagugugaccuuggaguagucgcuuauuuucccuaggugucaguuucuacacuuguaagcgagaaauuggacuauauuguuccuaagauucuauccaguucuaagaaucuaugguuucuuuucuacuucuaggguuagcauaaaggaaucaucuguagcgaaacuaggaucaguaugccguaggauuuacagaauauuuucacaugcuuauuuucaucaucggcagauauuugaugaauaugaaguaaguauauuucacugauuaucuugaugcauucuuaucaguguaacaguaauauauauugauguuauuucuagucuuuuaguuugggauagugaauuaaaauaacauuuuugucuuccucucuacagaaugaaacauuuuugugucaucgguuuacuaaguuugugaugaaauacaauuugauguccaaggauaaccugauuguaccaauuuuagaagaggaaguacagaauucaguuucuggggaaagugaagcaugaagggaaucauaggaaaaauguacugaucauauaauuaacauuauguacuguauauaucauuuuagacacaucaaucauguauccauauuauagcuucuuuguuuaguauagguuuuuguaugcuggguuugccuuuuaaaaugggaaauacuuuuuaaguuauucauaagcuguauauucaccaguguggcacucaugguuuuuaaauaagauuaguauuaucuguuuauaaugccuguuaauaaaagaauuuacaguuugguaaaauugcugcuaaacaaucauuggaucacaauccucaucagacaaacccaucuguaaaaaaaaugagggagagcuugagguuucacacaagccauuuacuaaagagguagaaauguuuucuauugguuuuaccuugaguuuagauauccuaaaaaauucuguaguacguaguuuugucuuaccuguuaacuuuccccaauugagauaaaaguguuuuaaaauucuguuuauaguuuuugauaugcauauauaauuauguguauaucuaaauacaaaugcaaaugaagcauuaguaauacuuaaauaauuuuacugugcuacauaaaguauaacauacuuggaaaggauuuaccguucugcaacaacggacugguacauacaggaugaucacaaugguaaggcacauaaauuauuuucccacuggaaaccugcccuguccaccccuucucauuucccuuaaccuuaucuucaaacuacuuuagcugagaagcuuuucaccagacugaguuagugguggcuuauaccuauuuauauuuguauuaauugcuuacagauuauaccucauauuagcaauuacauuacacuacaagaaaauguauuugcauaggcucuugcuuaucuuuguuuugcaaaauuguucuacuuagaaaacaguccuuaaaauaguuugacucuuccuguuaguaauauauuaaucuuucauuuaaccagcuaggcagcauuaaauagaauugaagaaauaccauaguauuuauuuuacacccccucucccacgaaguuuauguuuggauuacaugcacgugugagauuauuugcaauaauucauagguuccaaggguguugaugaauagucauacauuuuuuuggacuuuguuauaauucauugugguaagaaugauugaaaugcagauuuaacaaucuuauaaucuauugaaugccauuuuugauaaagcacuggaggucuuauugccaaacugauuguaaugaggcaguaagggugaaaacauuguacauguugugaagaaaguauuuaaauccaacuuuugaacagauuuaacaaacaugaggaacuuuuuuauuuagaaggauaauuuugaagaugaaaauguauucaucuuaauuguuuuuucaaauuuaagggaauaauuuauaccaucuuuucagacaagaauguacagcaaaaauaaggggaacaguaguauacugagaguguguguauguauaguguaugccuuuccaagcuugccagucuuuuuggcuuugaacacugcccaucagcuacagucauuacuguuccccaacccacaacuaucuuuuaagaagucuuaguucacagugaaaggaaugaugacuuugaaauuauggauuuauauuaauggcacuauaaaccaaugguaaugguaauuuuuaaacuugcuaaauauugagaaacuaaacuacuaaguuaauaaauuauauauagcaguguagcuguucucucuagauggugucucacaauggauuucuguugcuugacuauuuucuuagugaauauuuauacuaagguagugacugagauuuggugaucuggcugaguauuuugaaacacauuuugaauaauauggcuuaguguuaacggggacuuaaauaugauuuuuuuuucuuacucauuucaccuucccuguacuguauguuuggaauugaucauaaaacaucuccaaaagaaaauaaucaguuuguagucuugcuuuuguauucauguugauaaucuuacuaauugugaaguugauucacuacuauacuagguaagaccuaagugaaacaguuccuguuuuuccuuaauacuguuuucagaauuuugaaaauguacuuauauauacauaaauacuacuaaaaaauuaaugagccuggcaaaccauugauuuauaaaaguaaguguucuaagaggggaacaagacaguucugugugauaaggaaguuaggcuccacuuuuuguuugaauuacccuauguauauccgaagguaaacuuaggcuuuucuuuccaaaagaucguauagucaauucauucuuuuucuccuaucacaucugggaaaguagcuaacuuuuaacuauuuauguucccauaaguaacccuucuuuuguguguauacauuuccuuuucucugacuugagaugucaaauuuggauuucuagaacaguuucucaguuaaauucuugaugacuuaacaacuuuuacuaucagaauacaauuagaaauccuuggucaggcacaggggcucacgccuguaaucccagcacuuugggaagccaaggcagacagaucaccugaggucaggaguucgagaccagccugaccaacauggagaaacccugucucuacuaaaaauacaaaaauuagccgggcguggugcuacucgugaggcugaggcaggagaaucgcuugaacccgggagguggagguugcggugagcugagaucgugccauugcacuccagccuggguaacgagcaaaacuccgucucaaaaacuccgucucaaaaaaaaaaaauccuugauuacauuguuaguaaggacuguguuacgauuauaaacacauuuauugguugaugucaaauucacuguaauaguagaacuaaguuuuuuaugugaguacuuugcccuacugucuauaugaugacaucuuuuuugagcagcuaaauuuuaaauuguauauacuuuauuuugugaauccuuguugaaugugcuaaagguuucuuuguguaguucuuccaugcuaugcgaauauuuuaguaaaaguaguugauuuuua

SEQ ID NO: 191110 - RNA, 11553 nt, Homo sapiens
aagacgcaggagggagcggacuaggugacagggccguuccugugagccucgcgggcgccuggcgaugcccccuuuuccugcuuguuugcugcccgccguccccggcgcgacgacugccugcucccuucacucccaggcugcacaguggcggcgcgccccucuuuccugcgcggccgagccugucgccgccggauccggccugcggggguaguuacgguguuugcuaggccggccgcccucuuggagcuucugcccuccgcugaggaagcggcgccgccugacgcgggacggucgggcgggcgccauguugugaaccgccucggcggagcuguaagauggcggcugggcggaggccggcuucggcccuguggccggaaaggcgaggcuccccguugaggggggauuugcugggguuccagaaugugcgugagccaagcagcuguggggaaacguugucuggaguaaguggagaaagagacggaacccguagggguuacaguuaaugucuaaugaugaaagugucggcguaaacaucgcgaguggcuuuguccucagugguguuaacaaaaaccagauuuaggaacccaaggaaagagaaaugcugggguguauuugaaggagcguugugacagaagucaggugaccgagaauuuuaugcgauggcguuucagccacuccucuuggguuagcaguuggagcuuuuuucuuuucuuggagucucgcucugucgcccaggcuagaguguaguggcgcgaucucgagucacugcagccuccgccucccggguucaagcgauucuccugcuucagccuccgggauagcugggauuacaggcgcccgccacgacgccgggcuaauguuuguauuuuuaguagagacagaguuucaccauauuaagcuggccucaaacuguugaccucaggugauccauccgcuucggccucccaaagugcugggauuacaggugugagccacugcgcccagccuccuuuuuuucuuuuuugagacaaggucucgccccugucgccccggccggagugcaaguggcgcaaugacggcucacugcagcuucgacaucugggcucaggugaucuucccaccucagccuccugaguaguugggacuacaggcgcgcgccaccacuccugguuaauuuuuuauuuuuuauagaggcggggucucucuauauuacccuggcuggucucgaauuccugggcucaagcagcccuccugcuucggccucccaaagugcugggguuacaggcauaagccacggcccccgacccaauuggagggcuuuaaaaauuauacucaggcugguccaaugguaguggguuaucagaacuuaauaguuauuagugucacgaaaauuaguauacaaccccuaccgcuaaauuugacuggcguuaaaaaaaaaagaauuguagcggaagacacagaggggucccgccgguaagaaagaacggcaguugaugaaguaauuucuguauaaugucuuuuucaaguuguuagguuagagauuuucgauuuugcucgaagcauuucugaaaagaagguggcuccuaccauucccaaaaagauuguguuaacauugcguuuaggauaaauuauguuguaugugcuugggagugguacuggaaagaugguguuuuguuguuuuuauauucugaugccaccguugccuucgugugugauuaaaguccuugguaguuucauuuguccguuuacggaaaugcucuguaaugaugauucugucagcaacucagauauaacucugauuacguuugcaguaaucaguaaugcgguguuggugaggaacauuuaugauugcauuugaguuggagacuaguuucugguacacguuuaaacggggagaaugacguguguuucacgugucugugaagagaccacuaaaggcaggcuuugugugagcaacauggcuguuuauuucaccugggugcaggcgggcugagucagaaaaaggagucggcaaaggguggugggauuaucauuaguucuuauagguuuugggauaggcgguggaguuaagagcaauguuuugggagcagggggcggaucucacaaaguacauucucaagggcggggagaauuacaaagaaccuucuuaagggugggggagauuauaaagaaccuuccuaagggugggggagauuacaaaguauauugaucaguuagguuggggcagaaauaaaucacaaugguggaaugucaucaguuaaggcuauuuuuacuuuuuuuguggaucuucaguugcuucaggccaucuggauguauacgugcaggucacuggggauaugauggcuuagcuugggcucagaggccugacagcguggacuucuauagugcuauauuuguacuacugggagggcagggguaaaauguaccaaaauuaguaaauugugauuccucccucuacuuuuuucacuuuuuuuuuuuuuugcauucuuccaauaaaucugggcaugauauggcuaaugcagagugccugugaaugaaguucaaacugcagaauaugggacaacacaguaauuggauuuaucagugauuucagauugggugauaaugauucuugaauuuuggucuuaaaacgaggucacgaggggaccuuuguaauuacgaauuuuaaacagcucagugugggguacaauuuaacuaggaaaaacuugccuuuuauguagaugagacacucaaagagaacuuacuguccugauugggaugacaaggauugggauuauggaaaauggaggagcagcagcagucauaaaagaaggaagagaucacauagcagugcccaggagaacaagcgcugcaaauacaaucacucuaaaaugugugauagguaaggaggauacuuaaaaugucugaauauaacaauacauuacuagacaaaacuaguaucacuuaaaauaaguaccugauuacuaccauucguuuguuuccaaugagagauuuugaugguuuguaauguuuguaaaauuaagcugcuugugggggagucuaggugcugucuugaagagaaugugaggauauuuggucuuagcauaaaacauugaaaauaauuuuuauuucucuagccauuauuuggaaagcaggucuauaaaugagaaagauuaucauagucgacgcuacauugaugaguacagaaaugacuacacucaaggaugugaaccuggacaucgccaaagagaccaugaaagccgguaucagaaccauaguagcaagucuucugguagaaguggaagaaguaguuauaaaagcaaacacaggauucaccacaguacuucacaucgucguucacaugggguaugaacguuuuuaaaacauuuuggaaauuuuauaucccauguggaacagggaaacuugaauuuuuguguuugauuauuugagaaaguuuuaagaugaaaucaucucaguuuuaaccugcaggauuuuuucuguguuugugcauuggauaggaaauuccggaaauaaaguacacauuuaguucuauaauuuaauuauugguuggcuccuaauugacauuccagugaaaugaugggaguuaauugauuuaauuuagauuaguugaaaauuauuacaaaauauucuaaaaggguuuuuugugguacuucaagaaaccugauuaguuuugaucuauugaaaucacaaaaguagaacagggcauuuuauuuuuguauaauuuaggauuagguaugcuucuuuguucuaacaagucauguuuucuaacccuucuuucacuaagcaaaccagaacagauuugaacuguuauggguuauauauuaguauggagaucagcucagaugacauuaaaaaugccguaguguuauucuuguaugccaaaucuuuuuuuccccaaaauuagcacuuuaauuuuauuuacuguuauaauauuuguuuucuuagauuagguaggaaaucuuaauuuggccaccgccuacuuugacaaguaaauauuacaucauacgauuuugcaacauuaaauuagaacacuagaaacuaaaaaauuauguuucagugaaugcuacaacuaagcauuuuuuuuuuuuaagaaaaacaauuguauuauguuuuguugccuugccacuuugaguaucuuaucugaaaaucuguuccuugccauguuuuucuccuguuaacauaaacuaugugcccugugaauuucuggggacugaauuugaaauugcuccugccaaccguuuguggccuggcguguaucugaaugccugaauaucuccccgcugaaugaauuucguauucugcccugaauucacucggguauauugauuggcuggaugaucuuggugccgcccacuugacguuuccagaagagucaccgaaggaaaagaaccaggaguguagaggaugaugaggagggucaccugaucugucagaguggagacguacuaagugcaagauguauagaauauuuuucaacacuuauuaacuuuucagauaacauaaucuauauauagauuaagcuuucagggauuuggaaaucuuuuuuucuuucucuuuuuuguuuuuguuuuauuuuuccauuucuuuuggugggggggauuguauuuuugcuuucuuuagaaauguaauguuuguuauauagaacuuccagaacaguaaucaaauuaaugaaauuagaccuaauaauuauguuuuuugaugguguugaccaauaaaauaucuagugauaaggaaauuuguagcaucaacuagaauaaucuacauugauagcauuuauugugauaaguacauuguuuccacuucuugauaugacugagauuuauuucucucuuuuagaugaaauuguugauacuuuaggugaaggagcuuuuggaaaaguuguggagugcaucgaucauaaagcguaaguuucccauguugggauuacuuuuagggaaguuggcaauacagguaauugauuuagcuuuagaaaguggucugaccaugaguuagauacauaucuuuauacccuuuuuuacuuggauguaagacacuuccaguuaagagguacuugccccuucauauuuuuuaaacagcuacuaauaguauguauaauuucuaauuuuaggcugagaacacacuuuauauuguuuugaaaguauuguuuuguuguucaacuggacacuguuguuaggccauauuuuuuucccccaccauauuagugguucucagccuugguuuuauguuaagauccuccucgagagguuugccuaccccagaccuuuucaggguaguuaccuaggaaucuauauuuuuaggaagugcuguaauucauucugauaacauagcuggagauaacuuggugucccaaguuuaauuauguauguuuaucaaacuacugauugaaauuuuuuuuuuucucgagacagagucucgcucugucacccaggguggagugcaguggcgcaaucucagcucacugcacccucugccucccggguucaggugauuguucugccucagccuccugaguagcuggaacuacagacacgcgccaccaugcccagcuauuguuuguauuaguauuguauuguuuguauuaguagagacuauguuggccaggcuggucucgaacuccugaccucaggugaccugcccaccucagccucccaaagugcugggauuacaggcaugagcgcuuggcuccagccaugaaauuucuuaagauaguauagaauuuuuuccguuacucuuuuuuuuuaguucccuguuuguuguuguuguuguuguuguuguuauuguucuuccucuuccugaauggcaaagcauuuuugagggggcuuccuacuauugauugguaaggacaugagagcuagagcucuuuuuuuguuuauuuuucuuuucccugagauggagucuuggucugucgcccaggcuggagugcaguggugcaaucuuggcucacugcaaccuccaccuuccgaguucaaguaauucuccugccucagccucccaggaagcugggauuacaggcacacaccaccgugccuggcuaauuuucauauuuuugguagaaauaggguuucaccauguuggucaggcuggucucgaacuucugaccucaagugauuuacuacccucggccucccaaagugcugggauuauaggcgugagagccacugcucccgguccuagagcucuuuacucuuuccccacuguauccuaacucuuuuggcaaccuggacuaaaagaacauuugagauaauguuugacagugacagguaccauauaggaagaaguuguuuagcugaaauaccaaaaaauaacucaugugaguggugguuugaugaaagaaauuugugucauucagcauguaauagaaucagaacugaacacuaaaccauaaauuaaaaaaauacagugggucagaguaguaguacaguuugaagacaguaauaccuggaauugagcaucaugucugucauucuuaaauuugcaugcaucuuucuaacaggggagguagacauguagcaguaaaaauaguuaaaaauguggauagauacugugaagcugcucgcucagaaauacaaguucuggaacaucugaauacaacagaccccaacaguacuuuguaaguaucagauuagaacuugggaagugguaucagguauauuuaaauuaggagcaacuauacuuagcuauuuuucauguguuuguagccgcuguguccagauguuggaaugguuugagcaucauggucacauuugcauuguuuuugaacuauugggacuuaguacuuacgacuucauuaaagaaaaugguuuucuaccauuucgacuggaucauaucagaaagauggcauaucagauaugcaagucugugaauuguaaguucuugguauaucuucguuaauuugcugguuuuauccauuccacauaucaaaaugugcauccuaaguguguacaauuuuuauuugauuaaaaauaaagggggaggaagaauagguaugaagagauuugauuacaggcuguugauccagcaguguacauuucauucagcaaguaggauauccaccauauaacaacguacuuuguugcagacuaugauuuagacuuuucugaugcgcaaaaauaguaacuucgaaugcuggguaaaaauuaaggcgugauauaucucauaaaagaaagcuucauaagagguaguaaguuuuaguuacuggugauuuucuagcagacuggaauguugaccauucuuugggaaaggaaucagagguuuuuuguuggguuuuuuuguuuuuugaaauggagucucgcuuuguuguucaggcugaagugcaguggcgcagucuucacucacugcaaacucugccuccccaguucaagugauucuccugccucagccucccgaguagcuaggacuacaggcacacgccaccacacccggccaauuuuuguaauuuugguagagacaggguuucaccauauuggucaggcuggucucgaacuccugaccucaggugauuacaggcgugagccacugcacccggccuguugugggguuuugugauuugguuugguuugguguuuucugauuacagcaacuuucucuuuauucucaguuuugcacaguaauaaguugacucacacagacuuaaagccugaaaacaucuuauuugugcagucugacuacacagaggcguauaaucccaaaauaguaagucuuccaaaauauucauaaaguaucuuaugccuuaauagcuuaugccuucuuaaccaucauuuaugauuuucagaaacgugaugaacgcaccuuaauaaauccagauauuaaaguuguagacuuugguagugcaacauaugaugacgaacaucacaguacauugguaucuacaagacauuauagagcaccugaaguuauuuuaggugaguauuaauuguccuuugagaaccuuuguauuuccuuauugagacuuaaaauuuuuuuagcaguuuuaggucuuacuuguggggcuuuaucauauucucuuuaagggauaaguaucaugaagugcauuauggauuuuaagcucucaauuguaccagauaauuagcucugggaauuugagcaaguggcuuaaccuuucuggaauuguuuucacauuuguaauaugugguaggguuuuuaaauguaauuguuuaaugccagguggggcgcgguggcucacaucuguaaucucagcacuuugggaggccaaggguggggcgcgguggcucacaucuguaaucccagcacuuugggaggccaaggcgggcagaccacauggucaggaaaucgagaccauccuggcuaauauggugaaaccccaucucuacuaaaaauacaaaaaauuagcuggguguggugguacacgucaguaguuccagcuacucaggaggcugaggcagaauugcuugaacaccgggaggcggagguugcagugagccaagauugcgccacugcacuccggccugggcgacagagcgagacuccaucucagaaaauuguuuaaugccuauuuuauuccagacuauauauaacacuauauaauuuauuuauuuuuaucauuuauuuauuuuuuagacggagacuuacucugucgcccaggcuggagugcaguggugcaaucuuggcucacugcaacuucugccuccuggguucaagcaauucuccugccucagccuccugaguagcugggauuauaggcacccaccaccacacccgguuaauuuucuuauuuuugguagagaugggguuuuuaccauguuggcaggcuggucucaaacugcugaccuggagcaaucugccugccuuggcuuugcaaagugcugggauuacaggcauaagccacugcgcccggccauauauauuguauuuaaccuuggauuaagugauugcuuuaggaucuuccagcucaaacaucacauugcauauauauguguauauauauaauuuuuuggggggggggcggagucuugcucugucacccaggcuagagugcaguggcgcgaucucggcucaccgcaagcuccgccuaugggguucacuccauugucccaccucagccuccugaguagcugggacuacaggugccugccaccaugccuggcuaauuuuguuuuuguauuuuuaguagagacggaguuucaccguguagucaggauggucuugaucuccugcccucguguuccaccugccucagccucccaaagggcugggauuaugccuguagcgugagccacugugcccggccaauucagauauauauauaucuuaauagaggugggaucucgcuguguugcccaggcuggucuugaacuccugagcucaagcaguucucccaucuuggccucccaaagugcugggauuacaggugugagccacugugcccagccuacauuacauguguuuuuuuuuuuaaaguauuaguguuaacuaacuuuuuaauuucuuuaacaaacauugaguauuuuuuuuccuuaaauuuugcuuugcuuugcagcccuaggguggucccaaccaugugaugucuggagcauaggaugcauucuuauugaauacuaucuuggguuuaccguauuuccaguaagugacaaugaucuauuucaaccuugcuuugcacaagaaaggugccuguuuauaugaauaaauacuuuugcuucccccauuauagacuauuaauuguagauaagcauaaauaaacuaauucauauuucuuucauaauuguuuuauuuaaaacaucuuucaguauauaagcaauuauccguguccauguagggaaucauuggcgaguuuguucugcaagccuuaauguuaguuuuuuugcugucagcuuuaacugugucuguuuugguggucaucuuccccaagucuguuuuuauuuuauuucuagacacacgauaguaaggagcauuuagcaaugauggaaaggauucuuggaccucuaccaaaacauaugauacagaaaaccagguacguuuuaagaguuagugacauccuuaguaucauuugaucacaucugcugauuagaacuuaauuuuuuuuuuuuuuuugagauggagucuugcucuguugcccaggcuggagugcaguggcgugaccucggcucaaugcaagcucucccuccuggguucacgccauuuuccugucucagccucccgaguagcugggacuacaggcacucgccaccacgcccgccuaauuuuuuuguauuuuuaguagagacaagguuucaccauguuagccaggauggucucgaucuccugaccuugugauccgcccaccucggccucccaaagugcugagauuacaggcgugagccaccgcaccuggccagaacuuaauuuuuuuuuuuaaauuuucacucuaccaagucucaggcgcugauuaggacuuuauaaauaaugaagucaaacuaauauuuuuucaguuaaauaguagauuaccuuggugcaaagcagguaacauuucuaucccauggcugccauuuaaaucucuagaaaagugaucugggaaagcauaguaauugauaccuuugcuagcuguuuuaaguuuucaguguuauaaacaugaauggauauugacuuauuuuuaggaaacguaaauauuuucaccacgaucgauuagacugggaugaacacaguucugccggcagauauguuucaagacgcuguaaaccucugaagguaagccuuugagacauugcucaaauagucaaaacugaguuucuucuguuugucuuuugagaccgagccuugcuucguuguccaggcuggaguagaguggcacgauguuggcccagcucacugcaaccucugcauccuaggcucaagcaggucucagccucccaaguagcugggauuacagauggaugccaccacgcuuuuuuuuuuuuuuuuuuuuuuuuuucaaguaaagacaaguuuuacuauguuggccuggcuggucuugaacuccuggccucaagugauccaccugccuuggccucccagagugcugggauuauaggcgugagcgaccaugccuggccucuuuucuguuuuuauggugguuauauauauaugguuuacuauacuguuacauaguguagucaaugguaguggaaaaggcuguugaaugaauuucuuuuuuucuuccaggaauuuaugcuuucucaagauguugaacaugagcgucucuuugaccucauucagaaaauguuggaguaugauccagccaaaagaauuacucucagagaagccuuaaagcauccuuucuuugaccuucugaagaaaaguauauagaucuguaauuggacagcucucucgaagagaucuuacagacuguaucagucuaauuuuuaaauuuuaaguuauuuuguacagcuuuguaaauucuuaacauuuuuauauugccauguuuauuuuguuuggguaauuugguucauuaaguacauagcuaagguaaugaacaucuuuuucaguaauuguaaagugauuuauucagaauaaauuuuuugugcuuaugaaguugauauguaucugaacaguuuguucuaaguaccauuuuucuuccuacuucuauuaaagaauggacauaga

SEQ ID NO: 191111 - RNA, 18171 nt, Homo sapiens
ggggaggaaggaggugaggcgguaaggggcguucucucucuugggucccgcgcccaacuuccgcuggcccaaagaaacuauaauuuugaaccaacagaccucugcuggcaucugcgauugcauuuuuccuguuuuaacaacggcugugcuagacgaaguggugaagcccaaguauggaguaacgucauuaauucuuucauucacuuauucgaaugcuugcugaguucuguguugcuacugguuuaguucuugggauacugcgagugaacagugggcggcgaggcuguuguugcaacgucagaguaaaagaaggacccugcacggcggccucccagcacuucgggaggccgaggcgggcggaucaccugaagucaggaguucgagaccagccuggccaacacggcgaaaccccgucucuacuaaaaauacaaaaauuagucgugcaugguagcgcgcgccuguagucccaccuacucgggaggcugagacacgacaaucacuugaacccgggaggcggaggcggagguugcagugagccgagauccugccgcacugcacuccagccuggcgacauagcgagacuccgucucaaaaugaaaaaaaaagagaaguucauaguauauuagugauaagugcugugguggaaaaaaaaaaguucauaguauauuaguauaagugcuguggugaaaaaaaaaaaaagcgaauuucauaguauauuagugauaagugcugugggagaaggaaauaggaauguccuagggcugaagggcuaaagcaguucuguguaggauugucaggucaguuaaacuugacauuuaagcagaaauuuggaggugaggaaauuagccguagagaugucugaguauaagaauuccaggcaaaagggacacccaaugccuggacccuaagggaagguaucuggguuauugggggacuugcaaggaggcucuugaagaagagcaagccgggcaaguaggagauugggaggcuugaaucggguaggauaucuucuauagccggguuuuuauuaccuaggggaugccauuagaggauuuuuuuuuuuuuuuuuuuugacggagucucgcgcugucacccaggcuggagugcaguggcgcgaucucagcucacugcagccuccgccuccuggguucaagugauucuccugccgcagccugcugaguagcuaggacuacaggcgccugccaccacacccggcuaauuuuuguguuuuuaguagagacgggguuucgccauguuggccaggcuggucucgaacuccugaccucaagugauccacccgccucggccucccaaaguguuaggauuauaggcgugagccaccacgcccggcgagguuuuuauuuaaaauguucaguaaagaugagcgugugugaguuaagacaggaaaaugagccuaauucuuuuuuucuuuugggacuagagacuuauuuuugagcucgcuguaagacugagaaaucacguaguccuuccugaaaccacuaagaggaaaaaugguaaguuuugagcaauuuuuaucuaaugucuuucauuauaaguaauuuuuagaaauucagucaagggcaauaaaaguucauggaaauugcaguggcaagauggagaaauuguauaauauagaagcacuuaauauggaauaauucuuuuaaaaaauacacaaaauugcuuuaaaauucuuuaauguugucacuuaaaaugcacagaauuuaccuuuuuuuuuuuuuuuuuuuuugaguuucacucuugucucccaggcuggagugcagugguguaaucucggcucacugcagccucugccccuggguucaagcgauucuccugccuuagccuccccgguagcugagauuacacgcgccugccaccacgcccagcuaauuuuuuguauuuuuaguagagaugggguuucgccauuuugggcagacuggucucgaacuccugaccucaggugaucugccugccuugaccucccaaaguguuggaauuacaggcgugagccaacucgcccagccagaauuuaccuuuuauggagaaagauugauuacaagauagauagaaauggaaagggagaguugaaggagcagaagagaauagacaggucugacaauuuuaauuggauuauuuugcucuagaucuaaagugggcaacuaggcugggcacaguggcugacaccugugaucccagcacuuugggaggcggaggugagaggacugcuugaucccaggaguucaacaccagcuugggcaacacagugaggcccccgucucuacuuuuaaaaaaacaauuaaauaaagugggcaacuagaaccugaaguagaaaaaggcaaugagaauagugcccugcuucucccacacacaucuuuaaccugcucauacucucuaacugcuaggccaggcgcgguggcucacgccuguaaucucggcacuuugggaggcagaggugggccaaucacuugaggucaggaguucgagaccagccuggccaacauggugaaacccugucucuacuaaaaauacaaaaauuaucuggguguuguggcauaucccaguaaucccagcuacuugggaggcugaggcaggagaauugcuugaacgcaggagguggagauuguagugagccgagaucacgccacugcacuccagugugggcgacagagcaagacuccaccucaaaaaaaaaaaaaaggagaaaugaaaaaggaacccuccaaauuguuuucucccucucuggaauacaguaucauaucaagggguauacagguuacagaaaaacagguacaacaaaaacaaaaagcaagcaagaaagcacugugguuaucucugcacauuuaagauuuagaaacacugacacuuguuauauuuuuguuagucgagaaaggaauuauuuuuuaacccuauuucucagaauuaaauuaccuaaggaaaaugguggaaauuauguuuugaaaaaucauuuucucaucauuuuucuauaaauaaggauguuggugaauugccauguacaucaauaauacauaacaauuguuuuuauuuuucuugauaaaaaauucaaaguuaaaauaauucuuuccaucaaaauauuuacuuccaaauuuuugucauggauacuacuuaacccuaacauuuauauucuggaguuuuuucucuacuguugggaucaauuuugagaaaaaaguacaacuuaaccucuaagagcugcuuuguggaugggucaucucugaagcaguauuucugucuguuuuuauucagauuaucaucuugaauauccacacagggaaauaaacaaugcauaaagucaccuaaauaaauuucauuuguucucacauuuucucuccuuuuuagucugugacacugcauacagauguaggugauauuaaaauugaagucuucugugagaggacacccaaaacaugugagguaaguacuauuauuuacauauucaacaucaguuaauacaacaagauaagcacuuuggaauugaauaaucuaaccuaaauaacaacaacaaaacuuucuguaaaaccauuguuagggaaaacuagccauccuaacuucuggccugauuuccacuuauuuguccaaugucaaagguggaucaaagagaacguagauaauuuuucgguaacgauagaguagccaguaucuuuuucuuuugaacuaauuuucuucaggaaacguaaucauuaggacauuauauuacuuuuuucuuucuuuuuuuuuauuuauuuauuauuauuuuuuuuugagauggagucucgcugugucccccaggcuggaguacaauggcgcgaucucggcucacugcaaccuccgccuccuggguucaagcaagucuucugccucagccucccgaguaagugggauuacaggcgugcgccaccaugccuggcuaauuuuuguauuuuuaguagagacaggguuucaccauguuggucaggcuggucucaaacuucuaaccucaggugauccaugcaccucagccucccaaagugcugggauuacaagcaugagccacugcaccuggccuuuuuuuuuuuuuuuuuuuucucaagacggagucuugcucugucacccaggcuggagugcaguggcaugaucuuggcucacugcaaccuucgccucugggguucaaacgauucuccugccucagccucccaaguaccugggauuacaggcacccaccaccaugcccagcuaauuuuuauauuuuuuuaguagagacgggguuucaccauguugaccaggcuggucucaaacuucugaccucagguaacccgccugccucagccucccaaaguguugggauuauaggcaugagccuccaugcccggcaggauauuauauuaaagaauuguuguauacuuuuuuuuuuuuugagacagggucuugcucugucgcucagacuggagugcaguggugcaaucacggcucauugcagccucaaccuccugggcucaagcaauccucccaccuuggccucccaaguagauaggacuacaggcgugugccaccaugccaggcuaauuuuuuuuaaauuuuuauggagacgagaucucacuauguugcccaacuuggucucgaacuccuggucuccagccaucgucccaucucagcuuccugaaguauuggaauuauaggcgugagccaccaugccuggccuguucuauacauuauuucgccuguuuauuuuuauuuauuuauuuauuuauuuugagacagaguuuugcucuuguugcccaggcuggagugcaguggcccaaucuugggucacugcaaccuccgccacccagguccaagggauucuccugccucagccucccaaguagcugggacuauaggcgccagccaccaugcccagcuaauuuuguauuuuuaguagagaugggguuucaccauguugaucaggcuggucucaaacuccugaccucaggugauccacccgucuuggcugcccaaagugcugcccaaagccacugcacccggccugugucaccuguuuaaaugacaaggauggaaggaagaagagucaccuguauauauucauuuauucagcaauuauuuauggcugggcaugguggcucacaucuauaauuccagcacuuugggaggcuaaggugagcucagaaguucuaggcuuaccuaggcaauauagugagacccccaucucuacaaaacaauacaaaaauuagccagauguuguggugugacccuguugucccagcuacaagggaggccaaggugggagaauugcuugagccuaggaggucaagacuguagugagcucugaucacacugcugcacuccagccuaggugacagagcaagacccugucucaaaacgaaacaagaaacccauuauucgugaaaggcuaucuugccccagagucuggagauacagugaugagcaacagacauuccuuacccucauggagccaauauuuuaguuguaaaaauaagcagggcaggaaaauuaaguaauuauauuuuuaagaaauuauuuucauuuauuuauuuuuuuuuuaaagauagagaugaggucuuacuauguugcccaggcuggucuugaacuccuggacucaagugaucuuccugccucccaaagugcugagauuacaggugugagcugcugugccuggccuaaaauuaaguaauucuaaaagaugauaaugccuugaaaaaaauuaaguguugagauagagaauaaugggaaaggaagaaggugagggcagguguagccaauaaacuaauacuuaaauuaaaugcaaagguaugagggcaucuccauggaaagagguauagaaagaauauuccagguauucagauucagaaaagguugugaaauaaaauuuuaaaaaauuccaagaccaggcacgguggcucacaccuguaauuccagcacuucggguggcugaggcaggagaaucauuugagcucaggaguucaagaccagccugggcaacauagggagacacugucucuacaaaaaaaaaaaaaaaaaaaaaagaacauuccagauauagaaaucucagguacagaguaccccagguaagaaaagcugccccuuuuggauuaauugucagaaugcugauggaguuuagguaguaagcaacaagaaagcaguucuuaguauaugugaugaggagaugagccagguacugcagggcuuguuaggcccugcugaagauuuucuuuuuguuuuugguuguuuuuuuuuuuuuuugagacggagucucugucgcccgggcuggagugcaguggugcgaucucggcucacugcaaccuccgccucccaaguucacgccauucuccucccucagccuccagaguaguuggaggcgccugccaccacacccagcuaauuuuuuguauuuuuaguagagaugggguuucaccauagccaggauggucucgaucuucugaccucgugauccacccaccucggccucccaaagugcugggauuaccggcguuagccaccaugcccggcgaaagauuuuguauuuuauuucaagaggagaaggaagcuauugaaguguuguaggcagggaaaugacauccaaaguaaugacaacagucauaguuuaaauaugcugcuaucacguuuucaguaaauaugauugguuuuuugucuuaacuggguuucugcugcaucauuucucaaucauuuuuacucccuucagaauuucuuggcucuuugugccaguaauuacuacaauggcuguauauuucauaggaauaucaaggguuucaugguucaaacaggagauccaacagguaaguuauuccauuaaccaagaucuaaggaacugaauguauaguaugaagaaguggguaaaagaagaggaauuaaauacguggaguuuuuguuuuguuuuguuuuguuuaauaaguucuguucuacaaguacagaacaugcagguuuguuacauagguauaugugugccauggugguuugcugcaccuaucagccuguccucuagguuuuaagcccagcaugcauuagcuauucguccuaaugcucucccuccccuugcccccacccacaacuagcccugcuguguguuguuccccuccuuguguccaugugaucucauuguucaacucccacuuaugagugagaauaugcgguguuugguuuucuguuccuguguuaguuugcugagaaugauggcuuccagccauccaugucccugcaaaggacaugaucucauccuuuuuauggcugcauaguauuacauggugcaauuuuaaagcagaaauuauuagcaccuaccccuaaaaugugaacaauauugugcucacuuuggcagcacauauacuaaaauuugaacaauacagagaagauuaguguggccccugcacaaggaugagacacaaauuugugaagcuuuucauacuuaaauauauaugaacaauauuuauaaggaggguuauucuuuuuuguuuuuuguaggucuguuuuaaucuucaggucugugaaguuaaauuuggggaauuaggaaaggccauaucaaauuuuaucuauauuuaagcagucaaacuauaaaguauuccuuaaguuuugggaaaugaacuuguuuucaauuuaauuaaauacuucuuuugauuugcuucacuuguaauguaggaacuggaagaggaggcaacaguauuuggggcaagaaguuugaggaugaauacagugaauaucuuaagguaaauccucaaugcuuuaaaaaucuauuucucaugccuugguuaugcauggaaacuuugauacaugugucauagugauacaaguuaacaucauugcaaaaugaacauacuuuuuuauaguuuuuguacauuugacaaaugaugucggggagacuugagaaauggugauccuagccugacauguguacuggaaucccaccaccacguggcucuugauaguaagugaguucaucuuugaaucuaaccugaaauguuuaacuaguaguguaccaaagagacuuaauaucucaccauaaaauucauguugaaugacaugaaacaguggccuuuuuugagaguggggaggaaagacuaucaaacuuccugguugcaauguugcccauuaucaguacccagcuuuuaucaucuucuguuagauguuugaacaucccuguauuaauaugacuuaauaccuaugguagaucacaacuagguuaaagaguaguacauauaaauagucuuuaacaugguaaaauuagggauuuuuaauuuucuuuguuauauuuuucuguguuuuucaaaccucuguggagucauuuuuuuuuuuugucuaaaauuaaaaauuagugcaugccuaguuuuaaaaaucaaucccacuucccagagauaacuucaguugaugacuuauuauguggucuuucaaacuuuguaucuccauagaaugauaacuuuaugauuagaaaaagagcaaugaaguauccucaaccagggccggguacaguaaucccagcacuuugagaagcccaguaaggaggauugcuugaggccaagaguuugaaaccagccugggcaacauagugagacccccaucuccacaaaaaaauacaaauauuagccuguuauaguggcgugugccuguagucccagcuacucaagaggcugaagugggaggauugcuugagcccaggagaucaaggcugcagugagccaagaucaugcacagaacgagaccccacucaaaaaaaaaaaaaagucuacucaaucaaaauaugcaguuuaaguguauuauuauauuuccauuacauuaaaauguacccacaaaaauucugaaaaaaauucauugcaguguuuaucucuggaugaugagacuaggaguaauuucuuuucuuuuugcuuuuuuuaaaaccuuuuuuuagagacagggucuuguucuguccccugggcuggagugcagugaugcauucuuggcucacugcagacuaaauuuucugggcucaggugauccucccaccucagccuccagaguagcugggacuacaggugcaugucaccaugccuggcuaauguuuguauuuuuuguacagauggugucucacuauguugcccaagcugguucauuuuacuuuucuauuguaaggaaauguauuaguuuuguuacaggaguugaggcugggaggugauaaacuuuuugaaaagucaacuuuuuccugaaugaauaacuaaacaauuuuuuagguauuaauuauuacauuaaugacugcuuccauauaccagcugaaaaccagagacuggcuaugacagaaucaccuguggaacuuuguuguuuguuuuugagacugggucucacucuguugccuaagcugagugcaguggccugaucacgguucacugcagccuugaccugagcucaagcaguuucuccugccucagccucucaaguggcuggaccacaggagugcaccaccgugcccagcuaauuucugauuuuuuguagagacgaggucuugcucuguugcccagucuggucugaaacuccuggacuaagaugauccuccugucuuggccucccaaaguguugggauuauaggagugagccacugcacuuggcuggaaguuuuaaaacuauaacagaucauggccuugcccuccuaaaaauaaagucaguagggcugguuaggacuuagacuauauuuuaagguuccuagaugauucuuuugcaggcagaguuaagaaccauuauauaggccgggcgcgguggcucacaccuguaaucccagcacuuugggaggccgaggcgggcggaucacgagggcaggagaucaagaccaugcuggcuaacacagugaaaccccgucucugccaaaaaauacaaaaaauuagccaggugugguggugggugccuguagucccagcuacuugggaggcugaggcaggagaauggccugaacccgggaggcagugcuugcagugagccgagaucgugcugcugcacuccagucugggcgacagagcgagacuccgucuaaaaaaaaaaaagaaccauuauauuauacaccuuauacaccaagauuguggauauguauugacucuucauauauucuggcccaggaauuccauucccaaauguuuacucaagagaaacuuguaaguuugcaccaagagacauguacaggaguguucugauguacuguuuguaauagcaaaagucuagaaacaacccaaauguccacugauuguagaugaaucacuauguagauuguggauaaauuguaguauauucaguagugaaauaucacauaguaguaaaaaaauaguaauaaacuauggcuauauguacauguauaaccuuagaaauguaacaauguuauuuguagaaagcauuucccagaagacuaaaauguuacgauguaauuauauucagaaggaaaaggaaagaauguguuguuuaggcauguguaaauguguuagggcugggcacaguggcucacucuuauaaucccagcacuuuagggggccgaggugagaggaacaaguacuugaggccaggaguuugagaucagccugagcaacauauugagcccucaucucuacuaaaaguuaaaaaauuagccagguauggagguguacaucuguagucucagcuacucaggaggccaagguggaaggauugcucaagccuaggaggucaaggcuacagugagcuaugauugcaccacugcacucuaaccugggugacagagugagacccugucucuaaaaaaaaaaaaaaaugaaaaaaugaaaaaaaaaagguauuagaauagugguuaccucuuguagaggcugagguaauaaauggagaggagcacauggauauauguaauuaauugguaacuuuuauuuuuucuugagcucccauuauucaaugaauugguaaauuuuaacucugaaagcugggaaauauguuaaugggugcuuauuuuauuaacuuacauuuuuauuaacuauauuuuuguguauguauuaaauauuguguauguauuaaauauuacauguguauuuaauauuacauuugauugguggacaccuuuuagggagacaagcauuaauauuuugauauaggugcuucucuaugacuuauuagcgucacccaaugaauagcuaaagcuagaguaauugguggaguuguaguguauuacaggcaccucccuguaacauaguucacaguuacaucuucauucuuaucaguaagguccuuuuaauuucuauacacugucucuuguaaacaaauacuaucaugauaguagagcuaggugagaccuuucuuagaucguucaguccugggguuauaaacugacugcccaugaguggaacacccacagaugcauuaucuguggcccuuaguuaaaaaauauauauuuaaugucauuaaucaagagauagccuauucauuuugccagacuucaucucucucuaauguuuacauucugcccaauugucaguuuaucugcuugacccuugugagcaucugaguuauaaauagacccuugaacuaguccagccucccuuguuuuacagauaaagaaacuagcaagaguccauuguaugugagaagagauugugggcauuuugguuuuguugccugccugaucauuucauuccagcacacuauuccuuaauauaaauguaaggauuauuucuauuauuuguugguauugcaaaaaguguccauggcuguauuucuucaaagugaaaaugaaauuaauugagaaauauuauuugauauauuaaccuuuuacauacaaguuuucaaagguacagaaaaggcagaaacugaacauuuggauuaucccuaauagagagaaguugguuaaauguuuucuugcucccuuaaauauugugaagguaaagauugaaugucuuggcugggugugcugauucacaccuguaaucccaacacuuuggaagcuaaggcaggaggaucacuugagccuaggaguuagagaccagccugagcaacauagugagaccccaaucucaaaauauuuuuaaaaaagaaaacaaaggugugccugucuuguuucaauacuauauuugggaugguuauauaaaaacacaguuaauacuuugaugugucuuuuucagcacaauguuagagguguuguaucuauggcuaauaauggcccgaacaccaauggaucucaguucuucaucaccuauggcaaacagccacauuuggacaugaaauacaccguauuuggaaagugaguauucugguuaugguuuucuuuuagcauuucaaugcaaguggugcauaugcuuagcugugacaguagcauaacuaauauugaaaagagugaggccgagcgcagugccucacaccuguaaucccagcacuuugggaggccaaggugggcagauugucugaggucaggaguucgagaccagccuggccaauguggcagaaccccugucucuacuaaaaauauuuuaaaaaauuaguuggaugugguggcacacaccuguagucccagcuacucaggaggcugaagcaggagaauugcuugaaccugggaggcggaaguuacagugagccgugaucaugccauugcacuccagccugggcgacagagugagacucugccucaaaaaaaaaaaaaaaaaaugaaaagaaaagaaagaaaagaagaguggugugagagcuaaacguaccuggaguuuaagucuaccacuuagcaacccugugaccuugggaaaguuauaaucucccugagcuuuauuuuccuuauuuuguaaaagaggccaguaauuuuucaauauuguuaugcaaauuaacauaguauaucuauuuucuuuuucuuuuucuuuuuuugagacgaaaggcucugucgccaggcuggaguauggugcaguagcacagucauggcucauugcagccucaaccuccuggucucaagugaucuucucaccucagccucuugaguaacuggaaccacaaauguguaccaucaugcgcagcuacuuuaaaaaaaaaaaaaacaaaaaaaacacuuuuuuuuuagagacauggucucacuauguugcccaggcugguccauuuucauuaaugauagcauuucacagcaacuaacagaucugaaaaauaguggcuuaaacaagauggacuggcauggugguuccauuuuguuaccaguguucuaggcgccucugucauaauauuggcagcacagcucuuaucaaaacuucuguguaucagggaggaaaggggaggaaagacaaaaggugcuugccagcugauucaccuuuuuuaauuaacagaacuuucccaggccuguaaucccagugcuuugggaggcugagacaggaggaucacuugaggccaggaguucaagaccagccuguggaacauagcagaacccaucucuauaaaaaaaauuuaaaaauuagccaaguguggugacacacaccuguaaucccaacuacucaggaggcugaggugggagaaucacuugagcccaggaguuccaggcugcaugagcugagaucacacuucuguacuccagccugggcaacaaugauacccuaucucuaaaaaaaaaaagauagaaaaaaagaaaagccgggugcgguggcucacaccuguaaucccagcacuuugggaggccaaggagggcagaucaugaggucaggagaucaagaccauccaggccaacauggugaaaccccaucucuacuaaaaauacaaaaauuagcugggugcgguggugcgugccuguaauuccagcuacucaggaagcugaggcaggagaauggcuugaacccuggagguggagauugcagugagccaagauugcgccacugcacuccagccuggugacaaagcgagacuccgucucaaaaaaaaaaaacuuucccagaagacccagaacuuaguaaugugaccacuccuuaccuacaauggaggguagaaaauguauuucagccacauugccacccuuacuaaaauuagauuucuccgaguaagaagaauggcuccuaggaagguauuucacaguuucugccaggguaucuauuaagaguacuaugucugggaguugcuuuuauaaaucagugggaagucaauuugucuguucguucaacaaauaauuaucaugcuuaauaaaccaaggcacaauucuagaguuuguucuauuuaauaguuuggaugccaaauuagguuaauuaaaaauagaggacucccagucuagguaacauagugaaaccccgucucuacaaaaaaauuuaaaaauuauccaggugugguggcucacaccuauggucccagcuacuugggaggcugaagugagaggauugcugggcucagggugucaaggcugcagugagaucuagacagaucuuuucuuuuucauuccauauacauguaucuaauuuacacauuaauaauaaucaaggagaaaagaaauauuacaacaucuaguaguuuuuuuauguuuguaaauaacccaguuucccucuuauuuucucccuuaaccaacaucauucaaaauuauuguucaguuauuaccaggacucauuuuacuggauuugcgacaaaacuguagaguuuagaacaaagauuaaccuuagguucauuaauuccuuguuuguuguauacagaugcacacacauuuuucugggaagaugauccaguaacuuuccucuaguucuccaagggguccguuucccauauacuugacucuacuuaacugccucaguucuaccugcuggguuuuuuuaacuuuuuaccugagaccuauguuuucuaccuccucuguuucucuuacugaccuagaaggugggauagccuuuaagacuuauaauuuaaagacuuaaaugucuauauuuagggguaaaaucaaaauguuuugguugaaguacccauuuugugaaaaugcaaaauaaaaugcaaaucugcuaauuuuuuuuuuuuuuuuuuuuugagacagagucucacucugucgcccaggcuggaaugcaguggcgccaucucagcucacugcaagcucacccuccuggguucacgccauucuccugccucagccucccaaguagcugggacuacaggcgcccgccaccgcgcccggcuaauuuuuuguauuuuuaguagagacgggguuucaccauguuagccaggauggucucaaucucccgaccucgugauccgcccgccuuggccucccaaagugcugagauuacaggcgugagccacugcgccaggccuacaaaucuguuaauuuuuuaaaguacauaccagugguugagaaucccuaaucugaaaauuaaaaauuaggaacuuuuugagcacugacaugaugccacaaguagaaaauuccacaucugaccucaugugacggguugcagucaaaaugcagucagaugaccaggugcagugacucacgcuuguaauccuagcacuuugggaggccaaggcgggcagaucacgaggucaagagaucaaaagccacucuuucuuagcaaauguuuuagacugaaauuuccaaaacuuguauuugaagaauagcucucaauauauuuuuucuuggugguaacaugaagugggauugcuggaggcuguuaacugucagucuucucuucuccuauuuuuauuacuucuuguuguuauccagaagcaaaaaguagaaaugccauaauuaggccagacgugguggcucaugccuauaaccccagcacuuugggaggcugacgugggcagaucacuugaggucaagaguuugagaccagccuggccaauguggugaaaucccaucucuacuaaaaacacaaaaauuagcugggcaugggggcaugugccuguagucccagcugcuugggaggcugaugcagaauugcuugaaccugaaggaagaggcuacaaugagucgagauagugcuacugcacuccaaccugggcaauggaagugagacuccaucucaaaaaaaaaaaaaaagaaagaaauacuauaauuaaacaauuaacugcugggcuugguggcucaugccugaaucccaacacuuugggaggccaaggcgggcggaucaccugaggucaggccagaccagccuggccaacaugcugaaacuccgucucuacuaaaaauacaaaaauuagccaggcguggugguaggcuccuauaaucccagcuacuugggaggcugaggcaggagaauugcuugaacccaggaggagagguugcagugagccgagaucacaccauugcacuccagucugggggaccagagcgagacuucaucucaaaaaaaaaaaaaacaaguacaaaguggaguggucaccuacuuuaggacucucauuguagggcaguauugcuaauagugucaucuacauacuuucuccauguauuuccuguagcaaagaaaucuuuaugacuaguguguuguaauaagacauacauauuuggacuucauccgugguuuccagcauaguucuuuuaaaaaccuugcaauuuccugagugacaggagugaaaggaauauuuuauuguucauaauaaaccccauucaaccauaccugaguuuaugcuaaugaggugacucuuggugggguucuagauagcuucaguauggagggcugguugccagaggaaucagccauguauuuuuagagggguggaacauucagugaccuccuauucuugaccucugggaaggagagaagggcuggagauugaguuccagucacuaguggccagugauuuaauuaaucgugccuaccuaaugugcccuccguaaaaacccuaaacaggguuugagagcuuccagguuggugaacacaaguagauacuaagaggguaacacaccccgagaagagcauggaagcgcugugccccucucucagacuuugcccuaugcaucuccuccauuugguuguuccugaguuguaaccuuuauaauagcccauaguaauaaauaaagugcuuuccuaaguucuaugagccauuuuugaaaauuauugaacagagcuggggggcaugaaaaaucccaaauuauaucaugguuagucagauaguacagaucacaaucgggacuuggaacuggcauccgaagugguaggggcugucuugugggauuaaccggggucucuguucacuccuuguaguuagugucacaauuaaauuauagggccaggugugggggcaugcauuuguagucccagugagauccugucuuuaaaaaauuaaauaaaauuuugaaaaaauaaucaaguugugggauacccagagaauuggagaacugggaaaacccacacauuugguguuggaaguaugaaaguguagaaaaacaguuuguuuucccuuuaacugguuauauuagucccauuuguagcuguucucugucacuguaugaaugggguagaauauaauuuuagguacuaugguggaaauauuccuacccuuuguauuguugacuaagggcauaaaaguaaauuauuucugaauuuugauccauaucuaugauggaaaaucaacauuuuguuguacauucaacuagagaacucagagaucuguaagacuugauuauuuuuuaaggagacuguaauugucauagauauggauaucauguuucaauuuaaggaaauuuucauauguuauguuguuucucuuucaggguaauagauggucuggaaacucuagaugaguuggagaaguugccaguaaaugagaagacauaccgaccucuuaaugauguacacauuaaggacauaacuauucaugccaacccauuugcucaguagcuaugauagaccuggacaaauaacuugacaaauugcuggaacacacuuauugugguuuacccgguuuuaauuaugucagagauugcaucauccuucugcuuguuuacaacuaugaucuucuaugaaauggugguaccaaggggcgcccaacagcuuuuauccccauucuuagagcauauucuuuauuauaaugauuauccaacauauuucuuuaauuuuaauacaaaaaauacaucauuuaauuuuuguuacauaugaacauucauuuuuaaaugcucagccucaagugcaggcauuuuugaguggccugauuacauauuccucccacagcaaguccguauccuggaaguguuauuuuauaauaaaauuuaaaaaguuuuaaagaauuaaaucguaggacaaauuaauuaaaauauuguguaaaauuaccuucaggcua

SEQ ID NO: 191112 - RNA, 37870 nt, Homo sapiens
uuaaaauacaaagaaaauuuuauuuguauaucaaagacucuaagaaaugaugacauaagguuaacagaguugaugucaagacaaauagguuugaaguuauagaugauaaaucacuuugucuuacugaaccuucccuugauuacguuagagagcaucccugguaugcucccaguugaaucuuaagcaugauguguguccgggugauauaaucguaauuccuuucuguuaauccucguucucucucuuuuuuuucuuuuucuucuuuuucucuggacucugaaaauagccaacaagaaugcuuugaaagagcugaaauuguaugggugaguaaucacauugaaaauauaaaaaccccaccuauaaaaaaaguaagcuugagcaaaucauacuccuccccucaaugcaaacuugauuuuuaguaauaaauucuagauuugggaaauggccuuuuauaauauaaauacaacaaagccauuucacuuuuaccucuccaucaaugaaaaccauuuuuuaaaaugccugcucauuucugauauagaaaauagauugaaauauagagaacuggccccuccaagugaaaaccgauaauuaaaaacaaacauacagcaauugcugugcugguacaugguucuuccucagaaagugguucuuccuuaauguguuucuuuuuaccccuuuucuucuucuucuucacagauguuucuucuucuucugccacuuuuucuucuuccucuucuucaacugaauaggguaaguguaaaggcacaacaaauuaacacuguaucagaucucauuccuuccaaaaacguuugaguccuaguuuuuuucugucauucucaucaacuacccaauguuuguuuuguuuauuuuauaauugggaagguucuccaaggccuaccacuaacuuuaacgaaugauauagauagagcucagagcaaucuucucacgaucaugaagucauguauaaaaaucaggauuaaaacaaaggucaucugaucuccaaucauuauugggaagaaagucaauuauauuagaaaugguuaagagcuugcacucugaagucagacggccuggguuuaaucuaccugcugcaacccugaaaaauuguauuuacccuuggugaagcucccuaucuauaaaacuuaagaaugucuuaucuuacuggacuguuacugauuuaaaaagaugaugcauagaaagcacuaaguauaaugcuuagcacacauuacaauaaggacucaacacauagcuaucauuagacauucagugaccagcugggugcaguggcucacgccuguaaucucagcacuuugggaggcugaggcgggaggaucacuugaggucaggauaucaagaccagccuggccaacauggugaaauccuguaucuaauaaaaauacaaaaaaguuagcuaggcaugguggugcaugccuguaaucccaguuauucaggaggcugaagcacgagaauugcuugaacccaggaggcggaggcugcagucagccaagaucacgccacugcacuucagccugggcgacagagggagacucugucucaaaaaaaaaaaaaaaaaaaaaagaaaaaaaaaagaaaaagaaaagagagagaaauucagcaauucagcaaccaaauaauauucaugucagacucuguacuaaacaauucgagcaaggcacaagaggcaaaaauauucguuucccuaugaaucuuuuuuauuuuaguggcagaguggagacauaaaugauacauuacauaauagauauuaaagugguaagaauaaaaauaaagcaggaaggggaauguuggaaaagggcaguauauauggccauuuuaggcagaauggucggcaaacaccuagaagaggugagggagugaaugaaugauacauguaucuugagggaaaauaguccagguagaguagagcagaugcuuaagucguaaggcguuuuggagggcagaugggauaaguggauggauaguagguucaggaaauagcaagcaggccaguauggcuggaacaaauuuagauuuaaaaagcuaguggugguuccacuguggcuacuacauacuuucaaguggaacugagaggauuugcugucagacuagauugaguuaugagaaaaaagucaagguugauggccaaagcaacuggaauugucacauauagaaaaugggagaggacugggcgugguggcucaugccuguaaucccagcaguuugggaggccggaguggguggaucacaaggucaggaguuugagaccaggcuggccaacauggugaaacccugucucuacuaaaaauaaaaaaauuagcugggcgugguggugcgugccuguaaucacagcuacucaagaggcugaggcaggaaaauugcuugaaccugggagguggagguugcagugagccaagaucaugccacugcacuccagcaugggugacagagcaagauucugucuuggggguaaaaaaagaggggggaaauugugggaugaaaaauugacaaauaaauuggaaaagcuuauuggauacacaauugaggauacaaaggacagaguuuggugccucaaaugcuacuaguggguuuagggaucuccuuacuuuucaauaaaaagaagcauaaaaguuaaauaaauuguuuguuuucucuaucaaguauacuauccacauuuguagaucauauacuuuugaccacuaagcuacuuagaaaccaaguuaaagcaaucauuguguuaaugcuuuacucuucugcuagacuugcuaguagguguucaauaaacccagguguaacuaauaauggggcgccugcuuaucaacuucacaagacagccuaguuaacuggugagcaccuguuagauauuguaacuaugacggcaggcuaccaguauguauuccuuccaguccgcuccguguaagagaaacaaugaagaaaaucacuguuccaucaauucuguauucauucuuaacuauaaaacaaaaaauuuucaacaaccaauuuagaaaacacguuccuuuuuucucuuaauucuccaaauaguucauguaggagaaaugaaguuuuggaacucuuaguaaaauaccuaauuugacuaaacuucucacauuuccucugugcagucugauaaauuuaacaauaucauauucccagagaacauaauggcauuauuaaaacaccauuagcguucaaugagcaguuuuauaauaaagugggauggcauguacuuuuaagacucacaaaauccacaguucuaaagaagugaguauaaguuguguuaaaaaaaaaauucaaacuaaccuuuaacuuuaaucuuggcuuuuuuggcuuucuuuucaguaauuucauccucuuuaucuaccuguucuauuuugcguuuuuuagaacagguuggaaguguggagucaccagaaggaucguaagucuucacuucacugaaagacccaaaaaguuuuagaaaaucucuaacaaguaucuggaauugaaauaauucucaagagauaaagaaaaugccauuagauaauacuuacauaagcacacaauguuguuucauuuuaguggcuuugggguaguuuaugaagacuaauaguuuccaaaaguuaaagguauuaauauuuuucaaguaggucaaucacauucaagagauguggugagcuaaaugaauucugauuuaguaaucaauguaguuacuaugguacaggaaaacacucaaucagcaugggggaaaugaaaggagaaaacgucuucacaccuaacuagaaagugaaaacugaaccauccaacuuucagaacacugcucaaugggggaaaaaaaaaaaaaaaaaagcagaacaaaaaaucuaaaccaagcuuaguauagaagucuucaucacaagaucacaagaacaagaaaggauacaaauacaugcacauggaaaagauuccauagaacccaacauuugcuuuuguucuaauguaagcagaaagaaaauacugaaaugagugccuaaaaugugaauggaugcuuuaagugcauauguuuaaaguaaaaaguacuaauugcacaggaacauuaaaaaaauugguucaaaacaagcuaaaaaauguucuguuuuuuaagcagaccuguaagcugaaugacuauuuaauuuuuuuagguuaaagacauuuauaauuuaagaaacaaagaaccauguuugucaacuagagauaauaaguuauagacuauaaauauugcagaauguauggcuauuguagaaagcuuggaaaauucacaaaaaagaaaaugugaaugcccacagaaacacauuugauuucuuuccagaaaacacuaaauuauacuuaaauauguauuuauaauugguaauguucuauauauuaauuacucuccucauccacuuauaagauuuuacuauuaaaauucuugaaggaggccgggugcuguggcucacgccuguaaucccagcacuuugggaggccaaggcgggcggaucacgaggucaggagaucaagaccauccuggccaacaugaugaaaccccgacucuacuaaaaauacaaaaauuagcuggauguggugguguaugccuguaauccuagcuacucgggaggcugaggcaggagcauaacuugaaccggggagucagagguugcagugagccgcaaucgugccacugcacuccagccuggcaacagagacagacugucucaaaaaaaaaaaaaaaaaaaaaaaaaaaaucuugaaggauuaugacuccugaaaguauaauuuauuggguuaaugacuaggaacauuuugaagaaucuugauacauacugugaaauggcuuccuagaacagcugugccacauucuaccugcaucaucacaaccucaccagcauugagcauugccucaaauaauaacccaaauaccccuccacauacaaaucuuuuguuaaucugauaguuaaguuugaaugcuuugucaugccucagccaucuuuagacuuguuuucugucuuuauacuuuuuacaaaauagguuucuguagggauuaacucugaaugaacuuuuuuugagacggaguuuugcucuuguugcccaggcuggagugcaggggcgcgaucucagcucacugcacccuccgccucccggguuucaagcaauucuccugccucagccaggugcccgccaccacacccaguuaauuuuuuguauuuuuaguagagaugggguuucaccauguuggccaggccuguguugaacuccugaccucaggugaucugccugccucagccucccaaagugcugggauuacaggcaugagccacugugcccggcugagugaacuuuuugauaaagaacauauuauagaggaacuuuagauuaaaaaaauuuacuaucaauaucuggaaaugaauaaauuaaauauguauaugaaugaaaacuaguagaaguuaaugcggaaaacuaaauggcauggaaaaaaauuaggggugcacaacaugguuaacuacagcuaacaauguauuauauucuugaaaauugcuaaguagauuuuaagguguccucaccacaaaaaaaguacauaagacaaugcauguuaaugagcuugacuuaaucauuccucaaugugcacauuuuccaaaacaacauacacacaauaaacauacacaauuuuggucaaauaaauaaauuugaaaaaacuaugggcacaucaaggugaaguuuacaauaaaaaauuacugucaauaauuaacauuuaaaaaaacuauucaccccauccucacuuaaauguacucaccuuuuguguucauauuuuucuguuuuugcuaaugcuuuuccuguuccacuuauuuuucuuaucuaagaagaaaacgaaaaauuacaaauacacuucuaagucauaaucucuuuauaauacacuauacagucuagugaaucagugggccagcaaacagcaauuucugcuauuuuuuguuuuguuauuuugaauagcauauccuaauggcaaaugcaguuggauacaucaauucuugguaaauaauagcaauuguuaacaguaggcacaaaaagaauacuuuagacauacuaauaaguaucauaaaacuguuuagcagaugaaguuaauaaauuuacucaguuuauuaacuuuugacaaguaauacuucuggaauaggcaugauguaguucuuaccccucugucuuccaaaguucucaaccuggccucuaauuuggcucuguucucaacucccauugcagaacuugaauccucaccaaaagcaucauaacggauagccaaaacgguuuuggcugccagcauucgagaaaucuaauagaaaaacaugaagaacuauauuccauguucagauguaaaauccucaauaacuuggauguuuuaaaaucaggaguuauaaaacuauuaugaaucauacaauucaaaucauccaucguauuucaaccuuugccacaaucuaauggccauauaucaccaccaacacuucuguggcugaaaagauuuuacagcaauucaugucaaauauuagcucaaacuagguuuuuuuaaaaaauauuuuuaaacuuuaguuucuacucagugacauuaguucugugcuaugaggucacugaaaagaagugcaucuuuuuccucguaacaaucuuaaauaugugcggguucuggccgagcgcgguggcucacgccuguaaucccagcacuuugggaggccgaggcgaguggaucacgaggucaggagaucgagaccauccuggcuaacacggugaaacccugucucuacuaaaaauacaaaaaauuagccagguguggugccgggcgccuguagucccagcuacacuggaggcugaggcaggagaauggcgugaaccugggaggcagagcuugcagugagccgggauggcaccacugcacuccagucugggcgacagagugagacuccaucucaaaaaacaaacaaacaaacaaacaaacaaacaaaaaaaagcguggguucuuuuucaaucuaauuaacauuuuauuuuauugaacgcuuuauuuuccuccaccacucugcucuaaauuuuaucaauuuucaguuuagaucuguuaaacgacacaucuuucaaaaacauugaaaguacuuaacuugucuaagccucaguuucaucaucugcaagauagagauaccuacaucucauaaggcuacugaagauuuaggacaggcacaggugcucacaccuguaaucccagcacucugggaagccgagguggguggaucaggaggucaggaguuugagaccagccuggccaacauggugaaacuggucuuuacuuaaaauacaaaaauuagccgggcgugguggcacgugcauguaaucccagcuacucagaaggcugaggcagggaggcaggagaaucguuugaaccagggagcuggagguugcagugagccgagaucaagccacugcacucuagccuggcgacagagcgggacuccaucucaaaaaaaaaaaguuuagugacuucucucaaaguguuuuagcauaaugcauaugcuauuuuuuaugauucguaaauguuagauuuuuuuuuugcugccagagauaguauuuucagugugccaaccacagggagauucuaggggggaaaaaaauacuaacacaauggaagaaacuggcuuuaauccaaccaauaacaguuucuucuaaccuuauccuucaguguacacaaagcacuuuuuauuuaaauaacucaccauucccuauuuaacaagaaagagacaauagaagauuuaauguguacuacagaguagaagaaaaauggguuguaaaaaaugaaaaagucuaaccucaaaaacaaagcaaaacccuauaacacaccuuuccuuuguguuugggacuugucuggcccacgagugaagcaugauaaaugagaccauacuuagggguaucccgucuagauuugagggcucugaaaagugccuuuucagcuccaagaaucugaacgguagaagcugcaugcuuggccaaauuuaaaagagaaccuacaaaagaaaaaaguuacaaagaaugcaccuccaaauauaugaauguuccacguacugaaacaaaagaccuauagaauuauuacagccaccauaauaaauaaaaaucacauauaauauagaauucuauaauccagaauucccuaaaaaucuugauguuucauuuguaauuccuucauuagcacaagcagguuugcaaugaaugccuaggacaaacugaaggcuaagcuuauuaaguucaauguuucuauucaccugagagauggcaguacuauucuaaauuccauuaguauacuacaggagugacauaaaugucacacacacgaacacuaaucuggucccugcuuucugagauuguaucaaauauucuauugcuuuagauaugaaaaagccuacaaauaaacacauuuauuaggaagagauauuccuacaaguaucuauuaauaguccccuaccugugcuuucacuuugugugguaaauuaccugugguuaacugcagucugaaaauauuaaaaaggaaauuccagaaauaaauaguuccuaaguuuuaaaucucuugcuaucccacucagcuccccccaggacaugaaucaucucuaucuacccauuagucacuuucguagcccucuccguugugcaguacugcagugcuuauauucaaguaaccaaugcacaaaaauaguuaugcuugcauuuuuuuuuuuuuuugagauagaguuucgcucuguugcgcaggcuggagugcaguggcgcgaucuuggcucacugcauccuccgccucccggguuuaagcaauucucugccucagccuccgaguagcugggauuacaggcacccaccacuacacccagcuaauuuuuuuuuguauuuuuaguagagaugggguuucaccaucuuggccaggcugaucuugaacuccugaccucgugauccacccuccucagcuucccaaagugcugggauuacaggcguaagccaccacacccggcccugcuggcauaguguuauaacuguuauauuaugacuguuguugauauccuacuguaccuaauuuauaagcuaagcuuuauuauagauauguauguuuaggaaaaaacagcauauacaguauaggauucaguacuauccucuguuucaaacauucuuggaggggggagcuuagaauacaucuccauaaauagcuggggacuauuguuaucaacaugcugcuuaguuggauaugcuguauagaauauuuccugucagaaaacagacucuauuaauacuaugaacuuaagcacuagacauaguuuuaaaaguguaacaaauacauaguucuuuuuuuuuuuuuuuuuuugagauggaguuucacucuugucacccaggcaagcaaugucaccacugcugugugcaaugucacaaucuuggcucacugcaaccuccaccucccggguucaagcaauucuccugccucagcaucccgaguagcugggauuacaggcucaugccaccaagguuggguaauuuuuguguuguuaauagagaugggguuuuauuuaccauguuggccaggcuggucucgaacuccugaccucaggugacccacccaccucagcuucucaaagugcugggauuacaggcgugagccaccacgccuggccaacaaauacauacuucuauuaaccccugccauugcuuacugcuacaaguuuagcuauaccuaugaaaauggguagagacaaugaaaucaucugaucuuauagcugagggcauuugaaugaaaccuuugauuaaugaugcagcuaaaggaguuacgccaggccgggcgcaguggcucacgccuguaaucccaacacuuugggaggcugaggugcgcagaucaccugaggucaggaguuugagaccagccuggccaacauggcaaaaacccugucucaacuaaaaauauaaaaauuagccaggcaugguggcagcacaugccuguaaucccagcaacuugggagccugaggcaggagaauugcuugaaccugggaggcagagguugcagugagccacugcacuccagccagugcaacagagugaaacucugucucaaacaaaaaaaaaggaguuaugccauuuuaaacacucugaugcagaugauauaaucuuuuuugaugaauuauaacaaugucuccaaguaacauaaaaaugaugaaucaguacuucauuguauuuguagguauucaauuacauagcauuuuaauuauagcauaucauccuuauaauacugccauacacauauacaaaguuuuauuauaaaucaguuguugaaaauauuuuugaaagucaaauauauuacauccucacacucaauagugaaacuaagguaaucaaucaagggcacaaauccucuacagugauuucuuuuuuuuuucuuucucuacagugauuucuuaaaacuguauucaaaucuaggucuagugaguuuuuauuaugaaaauguuaacuguuuuauccuccugcauucauccgauuguucuaauuaacccuaacaaacuucuaacaauggaccacaagugucucagaagagguagugacuaaagaugccuucauuauccaaaaggaaaucaggcaaacaaauagaaaucaucauugaacacuuggcccuuagugaucucccacauaucaucuacuuuuguguuaucagcuaaaauuucuuuaacagcuguaguuuaaagauguaaacaaaauccuaaccagaaaauacuucaaacacucauauuuacaaauuacauuaaaaccaucaccugcaugagcaauaagccgugcuccaacuaauuccccaaccaugacuguaacauugggugcaauggccaucauucgauuuuguagauauucauagagcuggguucgauauucagagauuucaaucaccuaguauaaggaauaaaguuaagucacaaauaucauaugaguaaaaacaguaaaaauuccugucuaaaacacuggagcccucaauuaugaaagagcagcuacacaacccuggguacuggguacaucaccuaugccuaacaucaguuuucuuuuuuuuuuuucccaggcuggagcgcaguggcgcaaucucagcucacagcaaucuccgccucccgggcucaagugauucuccugccucagccucuggaguagcugggacuacaggggcccgccaccacgcccagcuaauuuuuuguauuuuuaguagagacaggguuucaccauguuggccaguauggucucuaucucuugaccucaugauccuaacaucaguuuucuauaagauggcuguaaugaggacuucguuauauaauguauguaaacuacuugguccacugccugaaaaucuuagucagcguaacuguauuuuuaaaagauucuaagcagcccaggcacagugacucacaccuguaauuccagcacuuugggaggucgaggcagguggaucaugaggucaggaguucaagaccauccuggccaacauggugaaaccccgucucuaugaaaaauacaaaaauuagcugggcaugguggcacgugcuuguaaucccagcuacucgggaggcugaggcaggagaaccgcuugaacugggaccugggaggcagagguagcagugagccugagaacgugccacugcacuccagccugggcuacagggugagacucugucucaaaaaaaaaaaaaaaaaaaaaaaaaaaaaaaaaaaagauucugagcaauaaacauuuguaucaugcucuuuuuaauuccuauauggcuaccuucaaaucugaaagaaaaaaaaaucacaagauauagacauaagacucagaauuaaaaggcucaauccauaauugucugccauccuuuuuuuuuuuuuuuuuuuuuuugagauggaguuuugcucuuguugcccaggcuggaugcaauggugccaucucggcucacugcaaccucccccucccugguucaagcgauucuccugucucagccucccgaguagcugggauuacagguguacgccaccacgcgcagcuaauuuuugcauuuuuaguagagauggggguuucaucauauuggucaggcuggucucgaacuccugaccucaggucaaucccugacucggccuuccaaagugcggggauuacaggcgugagccaacgcgccuggccuucucugccaucuuaauugauuuuugguuaauucauuauucagacgaugauuguaaauuacuuccuuuuaauauguauuucccccuuuuaaguauacaaaucaugauggcaucagaugagguagugacugaacacccucauauuuauguuaucaggugaacaacaauaaguguaaaaaucaucauugccaucagaaaaauuaguacuauagagcugguaacaccacaacuagauucuccaggaguaaaauuuaccugggugcaaagaugcagaauauugcaaauaucuucuucugaaaccucuguucccauugauaucucugcagcugcuuucacuucugcuucaacuucuucuggcagcaacucagaaagcuuggcagaggcauaguucuuccuaucgccuauggaauguuugcagaggaugagggagaaucacucuucaacaaauuauauaaaauccagcaaauagucaaaagaaaaaguagaaagccaaugaaaaggaugccuaaacaaaacaaaaaaaaugaagaaguuugaccuaguauaacaguuuuccucauuuaaggguuuaaguuuagacauuaaaugucuccccaccaccuucuuccaaaaaauaaucagaguaaaaagaggacaaaauaugccacaacacuuauuacagaauauaaguggcaaaaauuuaaaaaagacaggacuaauaauaaugucacagacaauuuuauacugaagcuggggccaguaauucguaaggcaaguaaaccaucaaucaaucaaguuccucuguacguuaacgacaaucaacaaucaaguuccucuguauauuaacaguacagacggcaauacugcuauuuagcauuagguacuaauaucauguuauaggccaucaaaaucuaaguuaaaauucauuuuguuucuuaaauuuaagacacuaaacugcuacacuucccaaauacacagaaauugcaaaaacccugggaaucuugcuuaacaaaaugcuauacgucauguuuuaggaugcaaucaaauucauuuacuuucaaugccuuaaaggaugaacaaauuacucaccaacuuucuguaaacacuugcaguauguuaaauuaucugaaauaauuuuuccuaauucagggaaaugccagccauaccauucucuacaucgcauaauguaguuguuuaguucuuuauccaagucaucuaacaaggcuguaguagauuaaaaacaaacaaacaaaacuuaaagggauuuauugugguaaaacauacacaacauaaaauuuaacacuucaggcugggcacgguggcucaugucuguaaucccagcagacaggcauaucacgaagucagaaguucaagaccagccuggccaacauggugaaaccccaucucuauuaaaaauacaaaaauuagccaggcaugguggugcacaccuguagucccagcuacucuggagggcugaggcagaagaaucacuugaacacaggagguggagguuguagugagccgagaucgugcuacugcauuccagccugggugacagagcaagauuccgucgcaaaaaauuuaaaaaaaaaagaauaaaaaauaacacuucaaccauuuucaaguguacuauucaguagcauuaaguauucuuaugauguuaugcaaccauuaccaggaucuauugccagagcaauuuuaucaucagaaacugaaaaauucuguacccauuaaacaguaacucauucccaccuuccccccaaccucuaguuaucuuuauacuucugucucugaguucaccuauuuuagguacuucauauaagcagaaucaugcaguauuuugugacuauuucacuuagcauauuuucaagguuuaucauguugaaauauguaucagaauuucauuucuuuuuaaggcugacuaacauuccacugugugaaguggcuggguguacguuacccaaaaugcuugggaccagaaguauuucagaguauuugcaaacacguaugaggcugaggauggaacucgaagucuaaauaggaaaugcaucuacauuucacauauaccuuauauacaaaaccuugaagguaauuuuacacaauauuuuaaauaauuuugugcauaaaacaaaguuuugacguguggucagguguggaguuuuccacuuguggauuugugugguaccacaaaaaguuuuagauuucagagcauuuugaauuucagauuagggacauucaagcugcauccacaaugcaguuuauccauucaucuguuaaaagguaucuggguuguuuccacuguuugguuuuguaaauaacacuguuaugaacauagguguacaagcaacucaguucuguuuuuaauucuuuuggguauaaaucuaggaaaggaaucgcugguugagcgcuuuuuuuuuucuuuuuuuggagacagagucuaacuccaucacccaggauggagugcaguggugcgaucucagcucacugcaaccucugcuuccuggguucaagugauucuccuuccucagccuccuaaguggcugggacuauaggcacacgccaccucgacuggcuacuuuuuuguauuuuuaguaaagacaggguuucgccauguuagccaggcugcucucaaacucccgagcucaggcaauucacccgccuuggccucccaaugugcuaggauuacaggugugagccacugcgcccagccgaauacuuuguuuuuuuuuuugagacggaguguugcucauguuguccaagcuagagugaaauggugcgaucucggcccacugcaaccuccgccucucagguucaagugauucuccugccucagccuccugaauagcugagauuacaggcgccuaccaucaugcucagauaauuuuuuuauuuuuuacuaaagaucggguuucaccauguuggccugaucucgaacuccugaccucaggugauccaccagccucugccucccaaaguguugggauuacaggcgugagccacggccgaaugcauuucuaaaauagaaaaacgauuaagauuuugauuuuuuuuuuuuuuuuuuagugagauggagauuugcucuuguugcccaggcuggagugcaauggcacgaucaacucacuacaaccucugccuccaggguucaagugauucuccugccucagccucccgaguagcugagauuacaggcaugcaccaccaugccugguuaauuuuguauuuuuaguagagacgggauuucuccauguuggucaggcuggucucaaauucccgaccucaggugauccucccgccucagccucucaaagugcugggauuacaggcaugagccacugugccuggcagcuuuugagcuuucuaaaaaccauuuaaugacacagcagaauacacaacuacaaagauugcacuuauguuuuuaacauuuucauggaaaaauacaaaugaauuaauuaacguaauguuaauucugugauucauauaaucuccaaauagucaaccuccgccuccuggguucaagcaauuauccugccucagccuccugaguagcugggauuauagguacacgccaccaugcacauuuaauuuuuuuuguauuuuuaguaaagacagaguuuugucauguuggccaagcuggucuugaacuccugaccucaggugauccgccugccucagccucccaagugcugggauuaaaggcuugagccaccacaccuggccuccuuucucuuucucaacagacagaaucauaaaagauaguuucaacaguaugaaaacgcaugaaggacagagcaacaaaucggacuuugcauguacuauacuuacaaauugccugaacaaucauugugucuacuuuaucagcgcuaaacuucaaucuauaucgagacaggcugggaagaaaggggaaaauaaauuagcaagauagcaucuaggaaaagcauuuaaauuaacaccuuaaaguuuuuuuuuguuuuuguuuuuacucaaaucagccuguagucagagcuguaauugguuuuucuaagaagaaaaaucagcuaaguagaaaugcaccauacgagaacagaaaauacacauuaaaaaaaaaaacuauaugugcugcuacgaccuuuauuucuguaacaugaaugaguuuauguaugaaugacaaauaggauaagcuguguaauacaaaagucauauuggacugggcgugguggcucacgcuuguaauccuagcacuuugggaggccgaggugggcagaucaccuguuaggaguucgagaccaaccuggccaacauggcgaaacccugucucuacuaaaaauauaaaaauuagccaggcaugguggggcacgccugaaucucagcuacucuggaggcugaggcaggagaaucgcuugaaccggggaggcagagguugcagugagccgagaucacgugccacuguacuccagccugggcaacaaagcaagacuccgccucaaaaaaaaaaaaaaaaaaaaagccauauugguucaugcaauuuuuaauagcacauauuaagcuuuauacuaccaguuaggaacuuugcaggacucuuaacaucugaaaacagaaagcuguggaguaacaauauugucuguauaaaaauguuuuuucaucucagcacaauuaauauuuugggccuaauuccuuguuguacaggcugcccugugcauuauaggaccuuuagcaguaucccuaacuuuuauccaccagauacucauggcagaccccaacccaccuccaauugugacaaccaaaaaugucuauggacauagacaaaugccuacuggggggacaucugauugcccuugauagggaaccacugcuauacacaaugcagauuuacccagguuuggauuuuugacucaguuucacuauuuguucucucuuagaaaugcuuauuacaaagcucucccuaaccuuugugcauuuuugcucuuaacucuagcuuagcagcuucaacccuuucaaucuaugcccaccuuuuaauuuuaaaauagaccuuuuuaaauuguaguguuucuuuuuuguuuuguuuugagacggagucuuacucugucacccaggcuggagugcaguggagcaaucuccacucacugcaagcuccaccucccggguucacgccauucuccugccucagccucccgaguagcugggacuacaggcgcccgccaccaugccuggcuaauuuuuuuguauuuuuaguagagacgggguuucacuguguuaaccaggauggucucgaucuccugaccucaugauucaccugccucagccucgcaaagugcugggauguauuacaggcgugagccacugcgccuggccuauaguguuucuuucucccuuuuuuuuuuuuuuuuuugagauggagucucacucugucacccaggcuggacugcaguggagcgaucuccacucacugcaagcucugccucccggguucacgccauucuccugccucagccucccaaguagcugggacuacaggcgcccgccacugugcccggcuaauuuuuuguauuuuuaguagagacgagguuucaccguggucucgaucuccugaccuugugaucugccugccuuggccucccaaaguguugggauuacaggcgugagccaccgugcccagccuguaguguuucuuuuaauauuagcuuaaaaugucuuuugaacugugguaauaauuuuauuaggauuacuauuugacaguacugauuacaaaguugcacagguuuugagcaacuaccuaccauuauuuucuucacaacccuguuaacuguagugcaauuccaaaguauuaagcuuuucaugaacagauguaucacaacauagcaauaaugccuauucuaagggacuucuaaugaaauaugauaggguuaacaugcaauuaaaaauagggagaagacugggcaugguggcucaccccugcagucgcggcacuuugggaggcuaaggcaaguggaucacuugagccugggaguuccagccugggcagcauggcaaaaccccgucucuacaaaaaguuaaaaaaucagccagggaugguggcgcacacuugcagucccagcuacuugggaggcugagguggcauuguuugaguccaggauguccagguugcagugagccaagaucgcaccacugcaccccagccugagcaacagagugagacccugacucaaaaaaaaaaaaaaaaaaaaaaaaaugccgggugugguggcucaugccuauaaucccagcacuuuggaaggccaaggcggauggaucauuugaggucaggaguucaagaucagccaggccaacauggugaaagcccgucucuacuaaaaauacaaaaauuaguugggcaguaguggugcacgcuuguaauccuagcuacucggaggcugaggcaagaaaaucacuugagccugggaggcaggggcugcagugagcagagaucacgccacugcacuccagucugggcgacagagugagaaucugccucaaaaaaaacaaaacaaaaacaaaacaaacaaaaaaacacagagagagacauauuucuugcuauguugcucaggcuagucucaaacuccuggucucccaaagaguugggauuacaggggugagccacugcaccuaguccucuuugccuuauuaaaaaucagaguaaagcaaugaaaacacaaauacacaccuaucccauaagaccauagcagaugagagaauuugggggaauacuaaguagauggaggaguggcaugacuuagcagagauaaaggagggaaagcccaagaaacagggcauccaagaucagaguaguagagaauuccuuugaugagguuuuaagguuuuaagaauccagacaauagagccagacugccuggguucaaauccuggcuuuaccacuuaccagcuguauugaccuugggcuucaguuucaucuguaaaugaggauauuacuaucaucuucuucauaagguucugaugugguucaaaugagcauuuguaacauucuuagaacagaucuauguuaagcgcuuaucaaauaaaaguaaguugacuuuauuuuccaguaauucucaccugugagccaauccaagacacauagcugccauuucacgugguucuaccccagggauuaauccauccauuugugaacgaauuccucucauaaguucauuaacaacaggacuauggauacaacugagauucagcuuuuccuacaagaacaugaacaucuauauuaaauuaaaaaaaaaaagacuuuccugaaguuguuauuauuauuuuuugagacacaguaucacucugucgcccaggcuggagugcaguggcgcaaucuuggcucacuacaaccuccgccuccuggguucaagagauucuccugucucggccugggauuauugcaggcaugagccaccaugcccagcuaauuuuguauuuuuaguagagacgggguuucaccauguuguacaggcuggucucaaacuccugaccucaagugauccgcccgccucaucuucccaaagugcugggauuacaggcaugagccaccgcgcccagccugaaauuauuuccuaaauauuaaaguggcacuaauuuaaauauacgcauuucucaguuggacaagaagcauaauuuccaguguguuuguagaauacuugacuguaucacugguggaaguaaaaacugauacaagcuuccagaagacagcuuggcuauauaaauuaaaagcuauaaaaagauuaauauaauuugaccaaguaguugguuuaaggagaucuuuuacuaccuguuauuuagcuucuuuuuaaaauuacagguuaugccaggcgcgguggcucacgccuguaaucccagcacuuugggaggccgaggcggguggaucacaaggucaauagaucgagaccaucuuggccaacaugaugaaaccccgucucuacuaaaaauacaaaaauuagccgggugugguggcaggugccuauagucccagcuacucgggaggcugaggcaggagaaucacuucaacccaggaggcggagguugcagugagccaagacugagccaaugcacuucagccuagcgacagagugagacuccgucuuaaaaaaaaaaaaaaauuacagguugggcgugguggcacaugccuguaauccuagcacuuugggaggccagggcguguuggcgggcgucuguaaucccagcuacuuggaaggcuaaggcaggggaaucccuugaacccgggaggcagagguugcagugagccgagaucaugccacugcacucuagccagggcaacagagugagacucugucucaaauaaaugaaauaaaauaaaauaaaauaauuagccagcaugguggcaugugccuguagucccagcuacugaagagggaggauugcuugagaacaggaggucaagucugcagugagcugugagacugcgccacugcacucccaauuagcugggacuacaggcgccugccaccacacccgguuaauuuucuguauuuucaguagagacaggguuucacuguguuagccaggauggucucgaucugcugaccucgugauacuccuaccuuggccucccaaaaugcugggauuauuauaggugugagccaccgcgccccgcccgaauuguucugcuuucuguauuugggaggcuauuuuccuagucuuucuuuccacucucacauuuuauuucaucuccagcaauacaccccuacuaaaaguuuucuaauaaauauauuucuaaaaaauauaaggaccccauuuucguuggaaaaaaauguggcuagacaaaaauauggcaugauauacauagaacauuaacauuauauauggguagcagauuuguuaaagucaauuuuuaucauuuuuuguucuucuauaucuucuagaacaaauagguauuacuuauuugcucaguucagcugauguuaggggaaauccauuaucauguagcuuagagaaaagaaaaaaauguauugagaauuuaugauaagcaacuuauugcaaaggcuaggcuuuguaguugguaugcugugagaucugacuagcaggcaugaccaaaaauaucgugacuuuaccuuuaugaccccuccuaguuuagcaucagcuacugccagcgguucaugggcuucuuuuacuauuuucuucagaacuuuuuucagcugcuuauugauuuugcccuccaucagagcugugaaugcuuuucaagaaaaagaaaaacaaaagcauuaacucucaaauuuuuaacuuugagaccuugcccuaguugacacuuaaaaaaauaaaauaggccuuucaaagggcuugaauuuaauguuacuucugaaaugaaaugauauauguuuuauaaguuacauguuucacaauuucauuugaucuucccacccucauuuuugcuacagagccagggguaaaaucagguccaggguuucuuuccuucucacaagaaucuucucaugaacucaagggagaaucaugaaaucuuagaaacaaucuuuuugggaagacaaaacagacucacuuuccuuugucauuucaaauagacuguccugaaauauccuaaaaucacaucaaaacuaguaaaaaugaguguaaucauuuucaaaguucugccauaauauaaacauguuugagugaaggccuuagcuuugcuuguaucuccacuuguacaccuccagcaauguaaaacuuaguagcaaaggcugccuauucuauuuugagaccgcugguauuucuggcaaguucuaaaucagcugcuuuauauuucucacccuuccuuagaccuauauucccuuuuucuggacccacacgaacuaauaccucuucugaaauuuaucugacauuugacugagguaaaaguaugcuuggguuacccaggcauggugguguguaccaccagccuggccaacacggcgaaacccugucucuacuaaaaauacaaaaauuagcugggugugguggcaugugccuguaguccagcuacuggggaggcugagcugggacaaucaccugagcccagggaguucaaggcugcagugagucaugaucaugccgcuguacuccagcagccuggugacagacccugucucaacaaaacaaaaacaaaaaacauaaaaaguaugcuugggcugcgcgugguggcucaagucuguaaucccagcacuuugggaggcugaggcuggcagaucaccuaaggucaggaguucgagagaccagccuggcuaacaugacgaaacacucuacuaaaaauacaaaaauuagcuggcccugguggcucacgccuguaauccuagcuacucgggaggcugagguaggagaaucgcuugaacccagagguggagguuaaagugauaccgugacauugcacuccagccuaagugacaagagcaaaacuccaucuaaaaaaaaaaaaagaaaaagaaaaagaaaagaaaaaugcuuggcaggaaugaaggucuaucaacaauuuccaaggucaggcaguuugugcuuaauaagucaggucuugcucuucccuccugaucguauauccauucgaauuaugaucaaauggauaaucccagcacuucaggaggcugaggugagcgggucacgaggucaggagaugcgaccauccuaggcaacauggugaaaccccaucucugcuaaaaauacaaaaauuaggugagcgugguggcaugagccuguaaucccagcuacucaggaggcagagacuacagugagcugggaucgcgccccuguacuccagccgaagaucaguaucaaaaaaaaaaaaaaaaagacuugcaaguugaaaacacaaucaagaauaaaaauaaaccacuucaugcaaauagcauauaugaaugucugagaccaauacaaauucaacaucacaccccaacagacccuauuucuuuauuuaaaaaaaaaaaaugauggccaggcacgguggcucaugcuuguaaucccagcacuuugggaggccaaggcggguggaucaccugaggucaggaguuccagagcagccuggccaacaggcaaaaccccgucucuacuaaaaaauacaaaaauuagcuggacauggugguaucaccuguaaucucagcuacuuuggaggcugaacccagccuccugggagaauuacuugaacucaggagguggagacugcagugagccgagaucaugccacugcacuccagccugggugacaaaaugaaacuccaucuccaaaaaaaaaaaaaucuuuuuugagagggggucuugcuauauugcccaggcugaucuuaaauuccugcccaucuuagccccucaaaguguugggauuacagguguuagucacugugccuggucucaucaaacucuaaggcuaugagguuuaaaauguacacugugacauuuacagccauuuaguugugguucugucaugucaaaacugccuuauaauaggcagugagaacugaauucccaggggaaggauucugcuuucuuaauuagcugauguucauuuaacuuucuggugaaaacagauaggaaaaggcauuguaaauguuucuaugacagcauuccugauaaaauucacuauuuucauucauuuuccccaaaauauuuauuauaaaccuucuauagcuguauacuuugcuagcgucuaggaauuugacaguacagaacagucucugcccucauggagcuuagacuggggggaauugacuuuaaauucucaacuacuauggcauuuuguccauuuacuguacacuacuuaauuuuauguuauuuuccagaaggagucucgcucuguugcccaggcuggagugcaguggugcaaucuuggcucagugcuaucucugccuaccagguucaaguguuucuccugccucagccucccgaguagcugggacuaaggugugugccaccacacccggcuaauuuuuguaauuucaguagagacgagguuucaccauguuggccaggcugaucuugaacugaccucaggugauccgccugucuuggccucccaaagugcugggauuccuggcaugagccaccgcacccagccuuauuguacauuauuuuaaauaauacaaagaagcuagguaaaugaaucuggaaauacugcuuaaauuucaaguuuuaucaucuguaacauagagaugaugguuaucugccucacaggauucaagaauuaaauaacaauuaugaaaucauaagcauaaaucugacaaucaguaugugcucaauauauuagguauuaauaguaaaaaccugcuuguuugagcaaaagcuuggcuuguccauuuaauacaguuuaauaaggacuggccagauauaucccaagcagauuaaagaucguaugcaaaaaggaauucagaagaggcuacuugagaucaggacuaggaacuguucauaucccagucuaugucaacaacacccccuagaguuugaauacagcuaacacaaucuugcuuggaaucuuaccaaauguuuacccauacuuaaaagcugugaugaacaggcuaucuuuuuaaaaauucuccaaguuaauauuaccacaguuuuuuuuauggcuguauauaacucuaauuacugaagaguuggugaagcagcccuagaacuauguuuauaaaacaaagaaacuggcccuaugggucuuccuucagccuaccccucugccaagguuaggguggucuguuauguuccagcauguuuaguuggauuccaaauuuucagacaaaaacuguaccuuucuccugugguuauuuaacaaaauuuuuugcaucugucauauucuugcccagcuuuaagccauauucuuccucacgguccuucauuuucaaacuacaccgccaaauaguuggcugauuugugauaaagaauucaggcaguugaaaauuuaaugauuugggcuuuauaucugcucuuccuguuuucccuaacacuuaaaaaaacaaaacuguaagaccuacugcagucaauuacaguaaauaaacccgaucacucuguugucccgugaugaaaucuaguugaagaguaugagucauccauucuucugaaucuuuuaaaaauaacaccucugucaguuucuguauaacucugaauauugauauguuuuuuugaacuaaaaaucuauacccccagaagagcuuuuuaaauuauuuuucaacugugaauccuggcuguucucaggauuacaacucuacccuuggauuaaaaugaggagagagcuguauacuugaccacauuaccuuggucccuuguagaacaccuuuuacugaauugugcuucagcauuauguugcugguuuccacagggagaucaacuuaaccacuucucaccucuccucacacauggggaaaaccagcccuauggugaaaaaagcuaacucaauguugucucagugguagugacgaaugagucagaucacuuaaauucaguuccaauaagaaugcaucauugacaacauugaauaagguuaacacaggcaacugaagcaaacaaccuuuuaaacaagaaaaacaaacggcuaagacuuaauuuuuucaaaaaagcaagcuucuaauuuuuuacuuuaccugcuaaugcuucugcuguauccugaaauuucucaaaauguuuuagcuuuacucuagaauuaaaaaaaaaagagauaaacauguuauugggggcagugcguugauucaaaagccacauaacuuggaaagaagugcuugacuguuuccaaagcacacaccaauaaaacaugccuaccauuguguaucagggugugaaguuagauauucuucauacaauuacuaguuuuucuaaauguuaggcuaguaaugcuuggauuauuaaaagaaaguuguaggcuuuggaggaaauuuuggccaagaguaaagauguugaagcuuuaauacaaaccccuguugcauaaagcuguacagagaugacuuuauuauacagcauagaauugacucaagaaaacguacgugaguccuuuuuaggaaucucaugauauucauuugucuauccuguacaaaugccauuaaaaaaaauagcuuauugucaggucucauucuuguuacauccuaacccuuuaugguuuuuuguuuuuuuuuuugagacagaaucucacugucacccacgcuggagugcaguggugcgaucucggcucacugcaaccucugccucccggauucaagcaauucuccugccucagacucccaaguagcugggauuacaggcaugugccugugccaccaugccuggcuaguuuuuguuuuuuuuuuuugagacagagucucacucugucgcccaggcuggagugcaguggcgcaaucucggcucacugcaaacuccaccucccagguucaugccauucuccugccucaugccauucuccugccucagccucccaaguagcugggacuacaggcacccgccaccacaccuggcuaauuuuuuguauuuuucguagagacgggguuucaccguguuagccaggauggucuccaucuccugaccucaucauccgcccgccuuggccucccaaagugcugggauuacaggcgugagccaccgugcccagcccccauggcuggcuaauuuuuuuguauuuuuuaguagagaagagguuucaccauauuggccaggcuggucucaaacuccugaccuugugauccacccaccucgaccucccaaagugcugggauuacaagcgugagccaccgugcccggcccccuuuauguuuuugagacagggucucacuucacucugucacccaggcuggaaugcaguggugcaaucacagcucacugcagcccugacuucccgagcucaaaggaucuuccagccucagucucccaagcagcuaggacuauaggugugcaccaccacacccagcuaauuuuuguuuuugguagagaugggguuuuccuauauugcccaggcuggucuugaacuccugggcucaacugauccgccugccuuggccucccaaaaugcugggauuacaggugugagccaucacgcccagccucaggguaguauuuuauccagaaagaaacauauaguugauucaucguugucucagugguagugacgaauauugagucagaucacuuagauucaguuccaagaagaauacaucauugacaacaacgaaucagauuaacccaacaaagcauauaacccuuuaagaaggaaaacuagucuucuaguugccuaaaacagugucaucuuuuuuuuuuuuuuuggagacagggucucacucugacacccagacuggagugcaguggcgcaaucucggcucacugcaacuuccgccucccaggcucaagggauuuuccugccucagcuuccucccaguagcugggauuacaggcaugugccaccacgcccggcuaauuuuguguuuuuaggagagaggggguuucaccauguuggccaggcuggucucgagcuccugaccucaaaugauccacccaccuugguaucccaaaguacuaggauuacagacaugagccaccacaccaggcaacagugucaucuuaagcaagguuuucuuaucugguaagggaacauacuaguguggucccuuaaauauacauacaaauacgaagauuuaggccaggugugguggcucacgccuguacucccagcacuuugugaggccgaggcaggcggaucgccugaggucaggaguuugagaccugccugaccaacauggcgaaacccugucucuacuaaaaauacaaaaauuagcugggcaugguggugggcaccuguaaucccaacuacuugggggacugaggcagaagaauagcuugaacccaggaggcggagguugcagugagcagagauugcgccauuguacuccagccuaggugacagaacaagacucugucucaaaaaacaaacaaaaaaaccaaagauuuaacaucuacacuaagaaugaaucuuccaugaaauugugaugaaagaaaaaguaguucaugcuaguuuugauguugcaaaacucaaaaagcagguuacaaccccugugugcgguaagugcuuaguuaagauaaaaaagguauuacauuuguguguggaagacacgaagacaaauguguuccuacugacagcaaucacauuugguacuauccgagguuuaaaguauccacagggucuucuggaacauaaucccuguggguaagggggagacuacugccuucaaauuaauugagauggccuauauuccaaguaaaacauuuguaauaauuagguucauaccaaaauuauuccugaaacagauuucaaaacagaaaacuacgaauguaacauuauauaaaucagggaaaaauguaaaaaauaaaacaagcccuaaauguuaacugcuaaauuauugauuucaagaguacuuacauuuuguuugcuuucucuggaguuucaaauucuuuccauaaacuaucaaccucuugaaguuucuucucauuuagaaccuguaauaaaauguuuaaauaguuuuauuuaaaugguacaggugaggcauauacagcugcauucuucaaauacaauuuuacauguaaaaugaagguguagaagcuauuucuuucacuaagauaaugaacuaguuuucuuacccugcauguaauuuuggucaaauuacuaguucgaauugcccauuuaacagcuaaauggaauucagaucuaguccagucagcuguaguacaguggcuauucagucuagaaucuaccuggccucaagagauauuccugccccagccuugggccguagcuggagcuaugggguccuaggggguagggcagggaaccuuucuuuuuauuuuuuugagauggagucucgcucuguagcccagccuggagugcaguggagcaauccuggcucacugcaaccuucaccuccuggguuuaugagauucuagugccucggccuccugaguagcugggauuacaggugugcaccacugcaccuggccgagaaccuuucuuuuaaaagagccauuaaucccuuuacaguaaaguauuguaaucauuaaaaacuuuaauuugcgccaagcaugguggcucacaucuguaaucccagcacuuugggaggcugaggcaggcggaucaccugaggucaggaguucaagaccagccugaucaacauggagaaaccccgucucuacaaaaaaaaaaaaaaaaaaaaaauacaaaauuagcugggcgugguggcacaugccuguaauccccgccacucgggaggcugaggcaggagaauugcuugaacccggaggcagagguugcagugagccgagauugcgcgacugcacuccaaccugggcaacaagagcaaaaaacuccaucucaaaaaaauaaaacaaaaaacaaaaaaaacuuuugucuacuuucaauagauuauauucguuauuuacugcuaugaucauccuaacaugaaaguauuauggauuucucuaaaacuaucgucaauugugagacacaucuagaugugagaaauuuuuuaaaugcaaaagaaacauaggguacuuuaaucaacaauauacuuaucaacauuuagguauauauucuccaagacuuugaaugucugugcaacacauguucaugcauacuuuuaggaaucacaguaaauggcuuuuuuuuuuuuuuucugagauggagucucacucugucgccaggcuggagugcaguggcgcaaucucggcacacugcagccuccgccucccggguucaagcgauucuccugccucagucuccugaauagcugggauuacaggcacgcaccacaacacccaacuaguuuuuguauuuuuaguagagacuggguuucaccaaguuggccaggcuggucuugaacuccugacaucaggugauccaccugccucggccucccaaagcguugggauuacaggcgugagccaacacacccagccgccuuguauuguuuugaagcaagaccuagacauuuaauuuuuaccuguuaauauuucaguuuguaucuauaaaauauaaagacuuguuuuaaaacuaguacuguuguaacaacaaugcuaaagauugcaaugguaauaguuguauacuauuucuacuuagaaauggaaauuaucuuaaaaugauaaaacuuaaaauggauuucuguauacaaauauuuaucauuacccuggcugaaaagaaaugauuaaaaauuugagacaaauaaaaacuuugagacaaauguaauacagaaaauguagcaauaucucuaacuuucuuauuuagauggucuuuauuagcaauguuuucuucaagauguugcaguugggaacacaaugguuuuauuugucauaguaaugguuuuggcugacauaacauagucuuugaagaccuuugugugcucaugaauugcccugauuuuaucacauuuccuuuguuauuuuaacuucaguuuuagaauggugauaguauuuuuuaauuaauuuauuuauuuauugagacggagucucgcucugucgcccaggcuggagugcaauggcaggaucucggcucacugcaagcuccaccuccuggguucacgucauucuccugccucagccuccaggacuacaggcgccugccaccacaccuggcuaauuuuuuguauuuuuaguagagaugggguuucaccguguuagccaggauagucucgaucuccugaccucaugaugcacccaccucggccucccaaaguguugggauuacaggcgugagccaccccgccaggccgaaaguaucuuuuaaauauggcaauuuuguuacccaaauguuaucuucaaauauacuugcuuuucagcuagaaaaaaugugaauuuuacucaugagucauauccccuauuugauacauguccucuuaaaaauagugaacuucaguuaugguuagcugcauucucugaacaauuucaaaaaauuuuaaucaguguuuucaguauagucaugagacuuggugaggugucucuggauucuaaaacuucaugauauacaaaguuagagcuauuaguuuauaaauuguuaauaccaacucuaggcuuuguaguuguuuauugcuuugugugacucuaaguuuuucuaguuuggguuauuuuuaccaacauaucuaauucaaccaugugugauuaaauuuauacaggcugggcacgguggcucaugccuguaaucccagcacucugggaggcugaggcgggcgaaucacgaggucaggagaucgagaccauccuagcuaacacggugaaaccccgccucuaacuaaaaauacaaaaaaauuagcugggcgagguggaaggcgccuguaguuccagcuacucgggaggcugaggcaacagaauggcgugaaccccagggggcggagccugcagugagcugagaucgcgccacugcacuccagccugggcgacagcaagacuccgucucaaaaaaaaaaaaaaaaaaaaaauuauacaucagaacaaaccccuaaaaucaucuugucacucaucuaaguuuuauacaacuugcaacauuguguuucucuuacugaaaauaauauauaaccagacuagaacugcgucuuaauguguagaugugcuauauuauggacuugauaaauaaugcuuauuagcaaaguauaguuuuaaauuuacuagcuguguuguuuuuccagagacagggucucgcuuuguuguccaggcuggaguggaguggugugguccuaugucacuacagcuucaaacuccuggccucaagcgauucuucugccucggccucccaaguagcuaggacuauaggugcacacugcgacaucuagcucuuuuaaaaaucuuuuuguagagacaggggcuugcuuuguugcccaggcugaucucuaacuucuggacucaagugauccucuugccuuggccucucaaagugcugggagugcaggaaggaaccauggcgccugauccagcugguuuuuuaaauaaaaauauaugcauaauaucugugcauacucuauuucacaaaauuuaacaugcuauucuuuuuuuuuuuauuuuugagacggagucuugcgcucugucggccaggcuggaccgcaguggcgugaucucagcucacuacaaccuccaccucccugguuaaagcaacucuccugccucagccucccaaguagcugggauuacaggcacaugcugccaugccuggcuaauuuuuuuuuuuuuuuuuguauuuuaguaaagucgggguugcacccuguugcccaggcuggucucgaacuccugaggucuggcaaucuaccugccucagccucccaaaguacugggaugacaggcgugagccaccacacccagcuuauguuauucuuuuacacucccaauugaccugucaucaauuguaagacaucccaauuuuagggauguuaaauauggggguugugccuuuuaggauugagcccauccuaucuaauacuugggcagcugauacagaauauuggugaggguauauggaauuaagaauuuuaaucacuuuuuuuguuuuuuuuugagacagugucucgcccugucacgcaggcuggggagugcagaggcgcggucuucucacugcaaccuccaccucccugguucaagcgauccuccugccucagcugggacuacagauuuggcgacacacaccaccaugcccggcuaauuuuuguauuuuuaguagagacgggguuucacuauguuggccaggcugguuucaaacuccugaccucaugaucugcccaccccagccuuccaaagugcugggauuacaggugugagccaccauguccagccuccucauuuucauuuuuaauugauugcuugagacuuugugugguuuuuguuuuguuuugagaugaggucucacucuguuguccaggcuaaagugcagaggcucaaucacagcucacugcagccgugaccucccucccaccucagccuccugcagcagcugggacuacaggcaagcaccacugugcccagcuaauuuuuuuuccgccauguugcccaggcuggucugcaacuccugggcucaaacaauccuccugcuucacccucccaaaguguuagggugacaggcgugagccacugcacccaaccucuauguuuuguguaaauuauuugaugcuaacuuuuaaguuucacuuccacagacaauaugagcaaguuaauauuuuaugaaacuuguuuaaauacaggauaaaacugauaauuaguuuaaaaugugcacugcucaaaaagaaacaaauccauacacgcaacaaaugugaaaaagcucuucgguuagcuucagaagcauuacacuaagugaaaaaagccaaacacaaaagacuaaaauacuacuccacuuacaugaaacuucuagaaaaaauuaugcaaaaagaaagcugaacagugguugucuagagcaggacuaacuugaaaaugggcaugagaacuuuuugcaacaaaguguacuauaaaacuggauuguaacuaaaaccuauaggugaguuauacaguauguaaaguacacccaauaaaguuagaaaaaauauauugcucaguacuuagguuuuauauagacauuugguauguacaucaaaaaucuuucuccaaaccuugagaaaaugaagugacacaaaaugcuaugcuacacagcuacacuguacaauauaaccauuaaaauucaaguaaguuaaaauucacuuccucaguccuaucaguuacaucucaugugaaaugguuauacguacuaauggcuaccacauggaagagcagcugaaggaagucugguaugagcaagacuaaaaucuuaugcugugugccacgugacacaaggacacagguggaauuucuuuuuuucuuuuuuucuuuuuuuugagacggagucuugcccugucgcccaggcugcacugcaguggcgcgaccgcagcucauugcaaccucugcuccuagguucaacugauuguccugccucagccuuccaaguagcugggguuacaggcgugagccacugcucucggccacaggcugaauuuuuauaauauccuagaauuaaucacaacaguuccuuuacacaaugucuuuacauuuauauauauauaacccuguuaaugagcaauaacuuuuuggaaguguuuuccuuuugaaucgcucuaaacacauaagugggcagaacaccguaccucauggcuguaaucccagcaccuugaggccaggaguuugagaccagccuaggcaacauagugagacucugccucuuaaaaaaaaaaaaaaaaauuuaggccaggcaugguggcucacgccuguaaucccagcuacuugggaggcugaggcaggaaaaucguuugaacccaggaggcggagguugcagugagccgagaucacaccacugcacuccagccugggcaacagagugagacuccaucucaaaaaauaaauaaauacaaauacaaauaaauaaauaauuagccaggcaugguggcuugagccuguagucccagcuacucgggaggaggugggaggaucacuugacccaggaggccaaggcugcaaugagccaugauccugccacugcaccccagccugggugacagagcaagacccugccucaaaauaaauuuuaaauacauaaacaugaauuuguauguguacauggguuauacauaaaauguuuuccucacuguaaauggaaguuuaaaaaaaacuucaaggccaggugcaguggcucacgccuguaaucccagcacuuugggaggcugaggcgggcagaucaccugaggucaggaguucgagaccagccucaacauggagaaacccugucacuacuaaacauacaaaauuagcugggcgugguggugcaugcugguaaucccagcuacucgggaggcugaggcaggagaauugcuugauccugggaggcagagguuguggugagccaagaucgcgccauugcacuccagccugggcaacaagagugaaacuccgucucaaaaaaaacaaaaaaacaaaaaacuucaaaaaacuuccuaaagcauucucaucaaagcaugaauuauaugcauccaauauaauuuuuuuuuuugagacggaguugugcucuuauugcccaggcuggagugcaauggcacgaucucagcucaccacaaccuccgccucccggguucaagcaaugcucccgccucagccucccaaguagcugagauuacaggcgcacaccaccacgcccagcuaauuuuucuauuuuuuuaguagagacgggguuucaccauguugguuaggcuggucucaaacuccugaccuugugauccgccggccucggccucccaaagugcugggauuacaggcaugagccaccaugccuggcaaccaacauaauuuuauacccuagcauuuugaaagauuaugggaaaggaaacuaauaacuuugaaccguaugucuacuuuuuuaggagauaaaauucaccauauaucauauuaauuuuacauguaucuuaauauuugcccuuuuaaaguguacaauucacuuuuuaguagugcauuuucacaaaaaugugcagccaucacuaguuccagaacguuuguaugucuuuuauacucagaaacgaucaauguuaauuccaauaauuacaaacuaaucaaugucaacauauucgagcuuaacuaguuauuucuuuaguacuagguuacauaaaccacaauuuaaucauuuugaacaguaacuugcagauaaauagcacugcaaacuccaacggaauacucaaagacauuuucauggaggaggacacuuuucauuaauagaaaucaguaauucaucgagacacgguugaguauuuuaggacccaggucuagaaauccgaccauugauaagccaauuccuuccuaccaugggagacaaccagugcacugugcagaguugcuccucuucacauccgguacaggacaguauacuacggcaauuaacggugaaauucaucgauagacacuuacagaccacauuggcuaagagaauuugaagcuaugcagaacucuacaugguaauuuagauaagauuccaaaaagcuggagaaaaguaaaauugacauguuucguagcucuaaaggggacuaaggagcuuacuuacaaguuccuuaaaacacuaauacggcaauugcagauaacuccaacuaagguaaaaacaagcaaaacugccuuuucgguuuuaaugauuuuauugguuuucuuaaaaauaacauuugacguaucaaaugcaaacugcguauuuucaaaugucagaagugaaacauggagaacucugcacccauccagacuuucuugcauccacaccacaaaugguuuuuugguucauagcuaaaauuguauuacauuuauuuuuaccuagcguuuuugcuuucuaccaacauauauauauguagaauauacauaaaaacuuuauuuuucauugcuauauucacagaccucagaagaguugcaccgcacaagaaaaggcacucaaucucacucauucuuccuaacaucucaacagcaucuugcgauacgaaugucuuaccauucaaccauuucagugcugacgaacuugucaaacuuuccccacgaaaacaaccaaaccucaaacugacaucaccagcccagauguuuuccccuaagcuucaaaucugaaauacugaacugcccgaucuacacaacugcauuaucaggucuaauagacaacgcaagcuucgcacagcccaaaccggaaaucuuuaguccuuccccaagaaacuuucuuaacaucuuauuuaaaccaaaaccccacauucaaucuauuagccaguccuuccuguucuaccuucacaauuucuaucgauauuuguuucucuccauaccaggcaauuucaucuuguccaaaugaaugcaaaaguauucuugcugccguucuuaucuccucgagucuaaucuccacacagcagaguaaccguauuaagacaaauuagcaggucauuccucugcuuaaauccuuucgauuggccgagcacgguggcucacgccuguaaucccagcacuuugggaggccgaggcagguggaucgcuugaggucaggaguucaagaccagccuggccaacauggugaaaccccgucucuacuaaaagcaaacaaacaaacaaaaacaacuagccaggcguggugguggauggaggccuguaaucccagcuacucgggaggccaaggcaggagaaucgcuugaacccgggagacggagguugcagugagccaagauugcgccacugcacuccagcaugggcaacaagagcgaaacuccaucucaaaaaaaaaaaaaaucuuucgaucauuccucaaaacaucuagaauaaaguccgaauucccuauaaucuguuaaauucuaacacgccuccugcccaccccuucaacgggaggaaauaaaauccucuaaugcagaacgggucuccccaaacggcggggccacguguuacacguaacauggcucucagguguaaaggccuucucccuccucccagagcccgggcuauaacaggcacccacgcuacucugaguaguuccgugcuuaagucuuucccucuccucgucuguccagcauccgccuucccccuuuaacggcucgcucucccaccuaccuuaaagauggcguaacccacagacguuucaaacagcaccaacauggugaggccgggucagggcgccgcacggccugccagaagcuguagagucaguucaaaaacaccgacuacgcggccucaaaaggccuccuaggccgcggcgggcaaagcacaaaugcgcucgccgucccgcaaagaaucagaacacgcugc

SEQ ID NO: 191113 - RNA, 191425 nt, Homo sapiens
gacuccccccuuugugucuggucugcucggagccacuggaagugccucccggagggacgcagggugucucgccgccucccugcccacccccuuccccggcuaccuucauccgcccucccgccgccccccgcccucgguccgcgacgcccgaguuccgucaggagcccagagcugcgggagaacgaggcggcggcggcggcggcggcggcggcggcggcggcagcagcagcggcuuccucgggggguugugauucgcucacaggagccauugacgggagaagaggaggcuuucuugguggaauuuaccucaggcaagaucgagccgcaggaauaaaaagcgaggaagggaagggagcgccgccgggaggacuagaaggggcagccucucacacccacuccgccugccgucucggggagcccggaccggggccgcgaccgcgaccccuccccucccccgcuccuaccucuccucagccuucgccagggccuccccaacccucucacgguuguucugcgaaggcguggggacugugagcuuguccauggaggcaggcaccuuuuuugauccagucaaggaagaggauuuguuguuuucgaaaucagagugaaggaagcaccgaagcgaaacuuaaggaauccugccuucccggagccgcgggcgaugcgacuagggcugccgggcgccgccgccgcccguccggcuucguccuucccggcagucgggaacuaguucugacccucgccccccgaccccggaucgaauccccgcccuccgcacccuggauauguuuucucccagaccuggauauuuuuuugauaucgugaaacuacgagggaaauaauuugggggauuucuucuuggcucccugcuuuccccacagacaugccuuccguuuggagggccgcggcaccccguccgaggcgaaggaacccccccagccgcgagggagagaaaugaagggaauuucugcagcggcaugaaagcucugcagcuagguccucucaucagccauuuguccuuucaaacuguauugugauacgggcaggaucaguccacgggagagaagacgagccucccggcuguuucuccgccggucuacuucccauauuucuuuucuuugcccuccugauucuuggcuggcccagggaugacuuccucgcugcagcggcccuggcgggugcccuggcuaccauggaccauccugcuggucagcacugcggcuggugaguagcuccggccggcacgucccggccacugccccugcggguggcgagggagggagcccgcagaggccgaggccugugcuugcccuucgccaugcguccccccgaucgcggugcagcggagcugcgacccggugccugcgcgccugccccaugccuuccagggaaaucgccuuuaauauucuuguguauuuuccuauccccacuuccauauucccaccccaccccccuuuacggggugaaaaagacauauugggugugguaucuugacauuuuuagcugugagguaaugcaacgauuaaaaauaauauuuuaaucaccagugaacagugcuuauuaugagaucucuggaaacagaccuguagauuuuuaaaauuauuauuauaaagaagcgguuuuggcuuauaguaaaaagaacaucaacuagagaacacacacuugaaccuuauuuugaaauuuagaucacucugggaauccauguuccuuucauuauucagaaauguuaccgaaugaauagaauaaauguugaggaagccagaacugugagauucuugauauauuguauuauacgguuugauaacuuuacuguuagucaucuggcaucuaucuauuggcuuugcugucgagacaacuuugaccugacauuagacuucuaggagauuugacuccgaaaguucuuugacauuucacuaaagucuaaagggugguagucauccuuuccuuuggauauuuucauuucaguucucagaaaccuuaggaaaaagaccuuaucuucuauuugcaacuauuuuuucaagcagccuuuuggugauuugcuuuuagaaauuuucaggagugaauucuacauauaacucguacacuugguuuaugaugggcaaauggauugugcuuuuaaaacgaguaaaggaccaaaugacccuuucgaauuacuuuuuuucuuuugauaaguguguuucacauuaaacaaauuucucauugcuauguuagauacagagguuacuugcuuauuuucauuuugaaagucugaucuaggaaaaugccgaagaaaauuugaaguuuccuuuuaugcuuuugcuauuguugaauaaugucuacuguugauuaaugucuguuaaauugaugauaaaucuauaugguucuguuaaaauaauuugaacuucugaguuuacuuuaaaacugauauuuuaauauuuuuaauaauuguaguugcuuucagaguaaaaaugauuuuucucuaaauuucuuuauauuguguuagcuauuuaaauucucuagccauaagccaugugguuccuguaaaauauggaguaaaaggccuuaaacguuccaugagcagaaaucucagaacauaggcuuuucaauguuauuuguuauucuuaaccuuuuuagaauauagauucucauuuaugaugacgugcucauaauauugugaucagaacugauaaaaguaagagaaaaagcauuuauuuaaaaauaaacuuaauuuuuguuugguaauacaaucaucuuagaauagugucucuuaaaagggagagaguaaaagaaucacugcuuaaaagugguuguagucuuuuuuuucuuugguauugcauagcaccagaugacaaaauuugugaagcuggauuucagaccuguaacaguaaugauaauagcuaguauuuauuaagugccugccaugcaccaucagcuauucaaauaacuuuacauauauuuuuucauuucgucuucaugacaauucuauguuguagguuauuaucauuccccuuuuccauagagggagaguaaaguacagagaauuugaauaacucaccacacagucaguaaauuauggagccaggauuauagugugcgcccucacauaccacauuaaugguaacagcagcacuagcagcaacaacuucucaucuuauuggauauaugagauggaguaauuagccuucaccagaucaaccuuuguaaagaagcagggacacuuacaagguguuagugcagcagugguuaugcaaaugucguaguucugaacauguaaaacuuugcuuggccuaauauugaaguggcuagugcagcuucauuaagugcaagcugauuagagagggccuguguggauuuggguuacacagaugcagugauguuaacucgacaggcgcaaauggugcagcugaacaggaaaauaaauccuagaagacugauugauagcacauccuuuuucggggucauggauaaaucauuucuuuugauucccucuuucucacuuauugaguucuuggacuccuuaauucuuagaacauuuucuuucuuucuuucuuucuuucuuucuuuuuuguucagacagaguaucacucugucgcccaggcuggagugcaguggcacgacccuggcucaccacaacuuccgccucccaggcgcaagugguucuccugccucagccuccagacuagcugagauuacgggagcccaccaccaugcccagcuaauuuauuuuuauuuuuuguauuuuuaguggagacgggguuucaccauuuuggcagggugguuucgaacuccugaccucgugauccaccugccucggccucccaaagugcugggauuacaggcaugagccaccacaccccgccuaauucuuagaacauuuucuaugccccccccaaaaaaaaaaacaacuuaugaaaaauaagaugugcuggcuugguuuaugaaugaauucuuaauaaaagaauacaacacagcuauuauuuaaaggucaacuucuguaaugcguuuuaaauaauucacuugauuagauugcaauuuuacauacaucucuugaggaacacacacauuauauaaaguaagauuaaucuaauguuagugaauauuacugaguaacugaaguuuaguaaucuucauuuuaguuuuucucaaaguguggguacugcaacagaauuaccugggguucuugauaaaaaugcauauuuuuggcccuauaguccagauguacugaaugaaucucucugggagaacccccgcaaagucucacucaagcaggugcuugagaagcacugcuuuauaucaucaguccugauuguuuggauuucuuucuuuuuuuuuuuuuuuuugaguuuugcucuuguugcccaggcuggagugcaauggugugaucucggcucacugcaaccuccaccucccggguucaagcaauucugccucagccucucggguagcugggauuacaggcaugugccaccacuccuggcuaauuuuguauuguuaguagagacaggguuucuccauguuggucaggcuggucuugaacuccugaucucaggugaucugcccgccucggccucccaaaaugcugggauuauaggugugggccacugugccuggcccuggcccuggcccuggcccuggcccuggcccuggauuucuuucuuucuuuuuuuuuuuuuuuuuuuuuuuuuuugagacagagucuggcucggucacccagacuggagugcaguggcgccaucucagcucacugcaaccucugccucccggguucaagugauucuucugccucagccucccaaguagcugggacuacaggugugcaccaccacacccggcuaauuuuuguauuuuuaguagagacgugguuuuaccauauuggccaggcugaucucaaacuccugaccucgugaucugccugccucugccuccgaaagugcugggauuauaggcaugagccaccacgccugggcuggauuucuuaaauauggugauucagugacauuuugcuguguaauuauuggcaaccacaaaaucuuaguggcaugcaacaauaggcauuuauucugcuccaugugucucuuucugggguccaggcuagagggagaaguaacaucuaucugggggaggcuugugucauggcauuggcagaagugcaagaggccaagcccaacccuaccagcacauuuccagacucugcucuccuaacaucccauuggcugaccgagucauauggcuaggcuaagcucagaaacaagagguaucaaaguacacuuugccugugaugaggcuaauguaauauuuggauauauaguacuauugcagaagaacgaagaauugaaauucucaguagaccacauauaaccaguaagaugguccagaagggaggcuuuucuuacccuuugaagagggccaaccucuuaauuaguuuuuugcauuaaaaugauauaaacuuuggucucuacaaaagcuauucuggcaugugggaugaugugauaguagugguauugauguggaugaguagugaggugagagauaacuguucacacaagacaaaaccuuuccuucauuaaaggccaguuuuuuuuuuaacaaaaagagaagaaauugaauauugaucucuaauggguaaauucuaaccauuaaaaaaauacugaguggaaucugugugaaucaguuaauuuuauaauuggccacaccacuuauuuuggcaccuacucauagauugcugugcugcuggauaucaguuuuuguuuuuguuuuuuuuuuuuuuuuuuugagauggagucuugcucugucacacagccuggaguggaguggcacgaucucgacucauuacaaccuccaccucccagguucaagccauucuccugccucagccucccgaguagcugggauuauaggugugcaccaucaugccugguuaauuuuuguauuuuuaguagagaugggguuucacuaugcuagccaggccggucucgaacuccugaucuugugauccaccugcccuggccucccaaagugcugggauuacaggugugagccaccacacccgaaauuuuuuuauuuuuaguagagaugggguuucaccauguuggccaggcuggucucaaacuccuuaccucagcugauccacccaccuuggccucccaaaguguugggauuacaggugugagcuaccgcaccugaccagguaucaguuuuauguauuugccuuguccuuccuacugauaauugcuuccagaggacaguauucaugucugauuaguuuuauaauuuaguagacauuuaagaaauacuuagugaaugaauaauaaauaggaauuucaaccaggaauauucuaggguuguuuauugacucaaauaacacaccaauaacuuuuucuuuguccuaguuccuucaacuauaaaguauguaguuuaagagguauagugggaagaccacuguugggaguuaaugagaccuagauucuauaugauuccgggcaaauagguuacuuaacauaguuuucuuacuuguaauaauaugggguuguacuugaucauuuugaaauacagauucauggguaccccacuagaccuacugaauccaaaucucuggacaacgagccugggaaucugccuuugaugcccucaucagccaguaaauuuuagguaccuuugagaacuacuggaucuaagauucuuucuaacucucaaguucuauaacuuuauuucuacuuuuugugguaauuacuacuuaaucuauaucuuuuauugcuuaaucugguaaacauuaggaacaaacauuucuuaauuugugcauuaagcaauuacccaaaaucuuuuccuuuuaaaaauuugcaguguggccugggcgaaguggcuuacucuguaauccuggcacuuggggaggccaaggcaggcggaucacuugaggucaggauuucgagaccagcccugcuguacaaaaaauacaaaaauuuggcugggagcuguggcucacaccuauaaucccagcacuuugggaagccaaggcgggcugauaaccugaggucaggaguuugagaccagccugacuaacguggugaaaccccgucucuacuaaaauacaaaauuaggccaguugccauggcucacgcuuguaaucccagcacuuugggaggccaaggugggcugaucaccugaagucaggaguucgagaccaacccggccaacguggugaaacccugucucuacuaaaaauacaaaauuagccgggugugguggcacaugccuguaaucccagcuacucgggaggcugaggcaucgcuugaaccugggaagcggagguuguggugagccgagguugugccuuugcacuccagccugggcaacaagagcgaaacucugucaaaaaaaaaaaaaaaagaaaaaaacaaaauuagccacgcgugguggugcaugccuguaauccuagcuacucaggaagcugagguaggagaaucacuugaaccugggaggcggagguugcagugagccgagaucguaccacugcacuccagccugggugacagggcgagacuccaucucaaaaaaaaaaaaauuacuauuuucaaaagcacuaauauuggcugggccugguggcucauaccuguaauccuagcacuuugggaggccgaggcugguggaucaacugacguuaggaguuugagaccagccuggccaacauggugaaaccccaucucuacuaaaaauacaaaaauuacccgggcgugguggcgggcgccuauaaucccagcuacuugggaggcugaggcaggagaaucacuugaacccaguaggcagagguugcagugagccaagauugugccacuuuacuccagccuuggcaaaagagugaaacuccaucucaaaaaacaaaacaaaacaaaaaaacacugauaugaaagauuauaugcaugccuagaaucacaaugcccaacacuguaccuuaacccugccuugugcaucaguaacguuuaaaauacauuacccaaauuaucaagauauagugcaaaaugugugcaaucauucacgucuuaaaugugucgacgguggacuugguggaaaaauuaugagacaugauaaaguauugugccagaggcauuggccuaagaauuuuagauggaguuagguauuugggacaguuagguauuugauccacaucucuuucuggaagguuagaugcaaauggagguugagaaauuucaguuucuuucuuucuuucuuucucuuucuuucuuucuuucuuucuuucuuucuuucuuucuuuuucuuucuuuucuuucuuuucuuucuuucuuucuuucuuucgacggaguuuugcucuuguugcccaggcuggaguucaauggcaagaucucugcucacugcaaccuucaccucccggguacaagugauucuugugccucagccuccugaguagcugggauuacaggcaugcacuaccacacccagcuaauuuuguauuuguaguagagacgggguuucuccaugcuggucaggcuggucucgaacucccgaccucagguaaucugccugccucagccucccagagugcugggauuacagacgugagccaccgcaccuggccaagaaauuucaguuucuuaaaaccagaucucacuuccccuuucuccuucaagacaguaguuugcccuuauaauuggugucaaaaauguacaugaucauguacuuucauucugccccaguaaguuuagugcaaaauaggaaaauuuagaacaaaauguguuaaugauaagugugaagggauguauaaauauuuggccaguaauccaaauucuucaguuuuuuguuucauuuagaugaggaaauaguuaagacuuucuauuauuauuaaucuguguucagucuuugcuuuuguaaauaagaauagucugugagcaaaucuauguaauuguaguagacacaccaggcuaaccuuuuagggcaagcuuuuuuuuuuguuuucauuugaaaaauuaagagaaaaaauauuaaucuucacacaacccuaacacuuuuuguuuugguauguuuucuucuaauuaaaaaaaagaugcuuuuuuuuuuuuuuuuuuuuuugagacggagucucgcuuuguugcccaggugggaguacaguggcgugaucucggcucacgacaaccuccaccuccuggguucaagcgauucuccugccucagccgcccgaguagcugggacuacaggugugcgccaccauguccggcuaguuuuuguauuuuuaguagacacggaguuucacuguguuggccaggcuggucucgaacuccugaccucgugaucugcccgccucagccucccaaagugcugggauuacaggcgugagccaccacgccuggcaaaaaaaaaaaaaaaagcauguauuuuuauaugguugugauuuuauaauaucuauuaauuauaucuguuuuuuuuacauagaauaauauagucauguauaugugaucuuaauaacuaucauuuuuucauaauugugugauauuccauugaguguauuuguuauuuacuuaauucauauugggagauguuuagguuguuuccgauuuucuucucuaauaaacaaugccauauuuaauacuucugugcguauguccugcuuguuguuugauuuauuuccaaguucuuguuuugaccuaucuguagcaugagccaauuuaauccuuuuuuuucauccuucaaguacuuucuucauuuggcuuuuaagauacuauucucucuugauuuuucuccuaccucaccagcaacuuugauaguuccuccuuaugucccugauggcuaaauguuguguuucaggauucagucuuuagaccuuuucucugucugcacccacccucuuggugaucucauccaguuuuauggcuuuaaauagcaucuaaaggcguacaaguuucaaauuuauuucuaucucagacuucuuuccuugaaauucuguugcauguagccaacuguguaucugucguaucuacuuggaugucugauauucaucacaaacuuaaccuguccaaaacugaacuucugaagcugcuucaccagaccuguuccuccuaugucuuagccuauucagcaaaugucaguucuauccuuccaguuguucaggccccaaauuagagauaucuuugucucuucucuuucuuuuuuucacauucuuauccaaucugauagcaaaaacucuuggcuuuaccuucaaaauauaucuagaaucuuauugcuucuuaccaccuccacugugcuacuaccuuaaucuaaaagccacuaucuucucuuacuuguacuuuuuuacuagacucuguuuccucuguuaacgucuuugcuuuauuacagucuccuuucaacauaguagccugagugacccuuuucuuuucuuuuuuuuuuuugccagacagagucuugcucugucgucuaggcuggaguacaguggcgcgaucucggcucacugcaaccucuaccucccggauucaagugauucuccugccucagccucccgaguagaugggauuacaggcgcgugccaccacgcccggcuaaauuuuuuuuguauuuuuaguagagacgggauuucacuguguuagccaggauggucucaaucuccugaccucgugaucugcccaccucggccucccaaagugcuaggauuacaggugugagccacugcgcccgggcagacccuuuucauacauaaguuagauaagacauuucuuugcuuaaaacuauugucuucccaucucauucagaauaauagucacagucauuuaaaauauuguacacaaucuggcuucugcaauuuaugaccucaugugccagccugucuugcucaacuuucauugggcuuuuaacuuuacaaacuaggaaagauucugaaaauuaaauauuuuagaagagauuagguuuaagauaccuuauucuaucuaauuugacaguggcuacaauuaguuaaucuauauuggggaagugaagagacacaugagcauuucucaucuuuaguauaguuacuaauacuaagggccuuacauauuuacuguguuaucucauuauccucuaaacagacugaucaguacuauuauuuuucuuuauucugcagaugaguaaacugaguaagugggacacuugggaaucaaggucaggccccuauggcuccaaagcaaaacauucauauaauacauaaaguguuagucuaaagguauaaaauacuuggaaucuuuuaggcaucugaaaaucuuacugguauuuugaucaugccagaauaauuguccagauugaacuaugucuuagauauagucucuucuuuugcuguaaaugacagcaaauaucuuagguuuuguuuuauguguagcauucaaaugucaguggauaauaaaaaaauucauugaagauucaaagcuucaguuuuggaaaagaacaccaguuagauuagaagagugaugaugacauauuuaguugagguuacauuuuuaauguuuccauguguucuuagugauuaaaaccccauggggccagucuagugugaagaaaaacuuuuauuuaguuacuucacaaacgacuguauuguagugauaagaaaggcaagauuaaaaacagucaaaugauaugaagagaugaauuuauucauguuacuuauucaaacagaguuuuaugugggauauaacuuuucugagauacuuaaucguuuuuuccuuuggcuaaaccaauguguuagcuugaugaaacguuaucaagaaugcuaaucuauaaauucaguuuagucuuucacaccaacuuguuccauuuguacagcuguuucuuaagaaucauuguuuggcugucacgguggcucaugucuguaaucccagcacuuugggaggccgagguggguggauuaacugagaucaggaguuugagaacagccuggccaacgugaugaaacccugucucuacugaaaauacaaaaauuagcugggugugguggugcaugccuguagucccagcuacuugggaggcugagguaggacaaucgcuugaacccgggagauggagguugcagugagccgagauugugucacugcacucuagccugggugacagagcgagacuccaucucaaaaaaaaaaaaaaaaaaaaaaaacauuguuuguccauauacuuagguuuguaagaaauugaguuauucugauuccuugcuaaggccuucuuuuaaaagcaagauacgccgggugcaguggcucacaccuuuaaucccagcacuuugggaggccgaagcgggcagaucacgaggucaggauaucgagacuagccuggcuaacacggugaaaccccgucucuacaacaaaauacaaaaaagaauuaguugggcaugguggugggugccuguagucccagcuacucaggaggcugaggcagaagaaucccuugaaccugagagguggagguugcagugagccgagauugcgccacugcacuccagccugggcgacacagugagauucagucucaaaaaaaaaaaaaaagcaagauuuuagucuuagguuuuuacuguguucuacucuaagcaucuaauaggcuuuauauuucacauuacccuuuuaaugaaaauagauuaaauucaguaacugacauucuuuaauagauuaaauucuaguuauuugcaauuaaaagugugggcugggugcaguggcucgcgccuguaaucuuugggaggcugaggcaggaggauugcuugaggccuagaguucgagaccagccugggcaauauaaugagaacccugucucuacaaacaauuuuuaaaaaucagcugagugugagucuguaguaccagcuacuugggaggcugaggugggaggcucacugaagcccaggaauuggagacugcaaugagcugugaucaugccacugcacuucagcuugggugacagguugagacccugucucuuaaauuuaaaaaacaaaaaaggcugggugugguggcucagggcuguaaucccagcacuuugggaggccagggcgggcagaucaugaggucaggagauugagaccauccuggcuaacauggugaaaccccgucucuacuaaaaauacaaaaaauuagcuuggcgugguggcaugcgcuuguagucccagcuacucgggaggcugaggcaggagaaucgcuugaacccgagaggcagaguuugcagugagacgagauugcgccacugcccuccagccugggcgacagaguaagauuccaucucaaaaaaaaaaaaaaaaaaagacuuguuuuugcuuuugauuuuaucauuucuuuuaaaaaacuuuuuguuauuuaagauucuaaaauuauacaaagucauuguaaaaggguuuuauaaauuuauuuuuuuuuuuuugagacugaguuuugcucuuguccaggcuggagugccauggcucgaucuuggcucaccgcaaccuccgccuccuggguucaagugauucuccugccucagccucccgaguagcugggauuacagucaugugccaccacguccggcuaauuuuguguuuuuaguagagauggguuuuuccauguuggucaggcuggucucgaacuccugaccucaggugauccgcccgccucagccucccaaagugcugggauuacaggcgugagccacugcaccuggcccauuaaaaaggguuuuuaaacgaugaugauggugaaguguagaaaugauaaugaaguauacaaaaaaaaaaaaaaaucgucucguguuuccuuaaucccauuuccuggauguaaccaguguuaauaguugguguauaaucuuuaaugcuuuuuuauaugugcuauaaauaaauaucuguauaauuagaauuugcuucuaaacaagguggaauaauauugcguauauuguacauaaaguuuugugauuauugaucugggacaguucuagaaguaagaucaugugguuagaaauuuguacauuuaaaaucuugaaaugaacugcuagaauuucuucaaaauagguuguacugucauuucuaccaguaguguaugagaaccucccuuuucuuucguguuuuuuuuuuuuuuuuugagacagagucuugcgcuguugcccaagcuggagugcaguggcacgaucuuggcucacugcaaccucugccucccagguucaagccauccuccugccucagccccccaguagcuggaauuacaggcacgugccaccaugccuggcuaauuuuuguauuuuuaguagagacaggguuucaccauguuggcugggcuggucucgaaccccugaccucaggugauacacaugccucggccucccaaagugcugagauuacaggugugagccaccgugcuuggccgagaaucucccauuuucuuauaccuuuucaaauacuacguaauaucauucuuuucaauuuuugccagagcaaaauaaaugauaucuuguugguuuagaguccuuuaauuauuaguggagccaagcuuuucaugcuugucagccaguuguauuucucugaauugccuauucuaaugauuuguuuguuuuucuuacugauuuaaagguguuacaugauauaaauauaugauauaaaugacuuuaugcaauuacaacugcuuuuuuuuuccuuuaugacaucugguuuuguguuaucuuaggaaagccucuaccuuauguacaacuaccaaaaaugcuuuuaguaaguagucuuuuuuuuuuuuuuuuuuuuuuuuuuugggagauggaguuucacucuuguugcccaggcuggggugcaauggcgcaaccucugccucccggguucaagugauucuucugccucaggcucccgagcagcugggauuacaggcaugugccaccacccccagcuaauuuuguauuuuuaguagagacaggguuucuccauguuggucaggcuggucucgaacuccugaccucaggugauccgcccgccucagccucccaaagugcugagauuacaggugugagccacugcgccuuaguaaguagucuuauaguuuuguuguuguuguuguuguuguuuuucaauaaaauagggccuugcucugccacccaggcuggagugcagugguaugaucacaguucacuguaaccucaaucucccggaagcucaagugauccucccaccucagccucccaguagcugggacuacaaguguguaccaccaugcccggcuaauuuuuuuauuuuuuguagagaugggggcuaggcugcucuugaacuccugggcucaagcgacccuuuugccuuggcgucccaaaguccuggaauuauaggcaugcaccaacacaccugaccaguguacacucuuuuuuuuuggagacaggcugucacccaggcuggagugcagugguucaaucucaguucacugcagcgucugccucccaacucaggccauccucucaccucagccccccgaguagcugggauuauagaugcaugccaccaugcccggcuacagucuacacuuuuuucuuuuuuuuuuuugagauggagucgcacucugucgccaggcuggagugcaguggcgcaaucuuggcucacugcaaccuccgccucccggguucaagcgauucuccuaccucaaccuccugaguagcugggacuacaggcgcgcgccaccacgcccagcuaauuuuuguauuuuuaguagagaugagguuucaccauauugcccgggauggucucguucucuugaccucgugaucugcccaccuuggccucccaaagugcugagauuaaagaugugaaccaccgcacccagccuacagucuacacucuuuuuuuuuuuuuuugaaagaagucucgcucucgucccccaggcuugaguacaauggcucaaucuuggcucacugcgaccuccgccugccggguucaaacgauucuccugccucugccucccaaguagcugggauuaaagcgccugccaucacgccuggcugguuuuuguauuuuuuaguagggaugggguuucaccauguuguccaggcuggucuggaacuccugaccucaggugauccaccugccucagccucccaaagugcugagauuacaggcgugagccacugugccugacccagucuacacucuuaacugcuggacuguacugucucuuacauagucaaguugucuucucaucacugaauuccaaauaaagaaaguguuacauuugaguugaaaguaucauuuagggacagguuauuugauacguguaaaauauacuucugcggacaugucacaguauauuuuaugugugucaugguaaguaggugaccaauaucaauuggguaaaaugccugaucauuggaacccagacauuucuggcucucauuguagagccuuacuuauuuucauuuaaaaaugucuaagagcuguaguuguuugaguuucuagcuuuaaaaaguuaagggagcaucuggccgggcgcgguggcucacgccuguaaucucagcauuuugggaggccgaggcgggcagaucaucugaggucgggaguucgagaccagccugaccaacauggagaaaccccgucucuacuaaaaauacaaaauuagccgggcgugguggcacaugccuguaaucccaacuacuuggaaggcugaggcaggagaauugcaugaacccaggaggcggagguugcggugagccgagaucgugccauugacuccagccugggcaacaagagcgaaacuccgucucaaaaaaaaaaaaaaaaaaaguuaagggagcaucaaauagguaaauaaaugacuaguaucaaugacuuaaaauggcucagcauguaccuauauuuaauacauucagaacaacuuugaguuagaaccuagucucugcaguugguguauggaaauacauagcauaaacuggaauuaaacuggaauucuuugucacccuaguaguccauucuaguaguccuauuucacaggaugugauacacuuaagguuagaauaaugguagcaagagauaaacagacagaguuuggggagucugggagaggaaggagacaaaauauuuuacuaaguuucucucauacugucuuucuaucuccacccaaacugccccagcuugguguagccuuauugcccuugccuuugcuuugaucuauacuggaguaggcuccaaaacgguguacgauucuuugacugugaccucugguaguaauuuaaaaauauauauauuuuuuuguagggacaggucucgccauguugcccaggcuggugucaaacuccuaggcacaagcgauccuccugacucagccucccaaaguguuggggcuacagcugagagcuacugugcccagucuagacaguaguuuuaauguuagaaagccuugaggguacuacuugaagcaaagaauuauauuugaaaacagaauucuaaacagugaaauaaaugacaguaccagaagaaaguuaacagauaggaauauuaaaauuacuaagagaauauacucuguggguugcauuuaucaccuguaaguuaggugagcugauucuugaaaucuuuucaagcccauuuuacuuauuuaggucacuaauuauagaguuuguuguuuagaagauggcaucuaauuaagguaaugagagagcgagagagagagagagagagagagagagagagagagagagagagagagagagauuccugugagauucagcugagucauaucaucaguaauuaucuugagaacuguguuggaggagcagugaauuucuguugcuaaugaauauuucauuauuguuugaaggaaccgguuguauaaaagauuacuccuggccgggcgugguggcucaugccuguaaucccagcacuuugggaggaugaggcagguggaucaccugagaucaggaguucaagaccagccuggccaacauggugaaacccuuucucuacugaaaauacaaaaaaguuagaugggcauggcggcaggaaccuguaaucccagcuacuuggaggcugaggcaggagaauugcuugaacccggaaggcggagguugcagugagccaagaucgugccauugcacuccagccuaggcaacaagagugaaacaacgucucaaaaaaaaaaaaguaauaauaauaauaauaauauuucccccaaaauaacugacauucauaaaauauacagagaaccauauuagaugcuuacuagaaguaacagauuaaguaaaauagcuacuguuuaacaaaaguaacuucucccuuuaugagugccugcuaugugucaagugaaaugcaguguuuuuacauacauuuuccuuagauccucagaguagcugaaagguagauauuuuuccuguuuuagaguuagggaaacagacuaacagaauaaguacuuugucuaaugauauguaaaaauaauuauugaauuauucaucgaguaccuccuuguggcagguauuauacuacgugcuuuauuuaaccugauucuuauaucagcuuucuuuuucauauauuuaugaaaaauauagauuuuuucauaaauaaagauauugaggcacagagagguuaaauaaaucauccagagucuagaaagugacagaacuguauuucaaaccaguaucuucuugauuucuaaaagucuuuacuuuuuuuuauuuuuuuuuuuuugagacagagucucacucuguuucccaggcuggagugcaguggcgcaaucucggcucacugcaaccuccgccucccgggcaagcgguucuccugccucaaccuccugaguagcugggacuacaggugcccgccaccacgccuggcuaauuuuuguauuuuuagcagagacaggauuucaccauauuggccaggcuggucuugaacuccugaucucgugguucacccgccucggccucccaaagugcugggauuacaggcaugcgccaccacgccuggcaagucuuuacucuuaaccauguuuccucucaugacuucuucauguuguaagauacaauuuaucacauugacuugccuuucaacuuuuaaauucugugaauuuuucucucuguaaacuaagcaagguaggacaagucgauuaauaucuuuacaccaauuguguauaaggaaugugugauucauuaccagaaagauuacuauucuugaucaauucuguuuccaaauuagaauguauucacugaauauauacuauguuuaacuguguuaugauacagaagugugaaucuuggucccagaacugaagcuauuauaggauaagaacauaaacaugaugguuuaugcucaacuacuaaauuguaaguuuaaaaauccagauuuggaguaagauauacagaaugcacauagauaguaauaauuugggcaauggauaagucacuguggcugaacagguagggauaaaagcuuacaguuccuagcugaaugcgguggcccaugccuguaaucccagcacuuugggaggcugaggcggguggaucaccugagguugggaguucgagaccauccuggccaacaugacaaaaccccggcucuacuaaaaauacaaaaauuagccaggcaugggggcgggagccuauaaucccagccacucgggaggcugaggcaggaggaucgacuugaaccugggaggcggagguugcagugagcugagauugcaccauugcacuccagccugggcaacaagagugaaacuccaucucaaaacaaaaaacaaacaaaaaacaaaaaaaaaagcuuacaauuccuuugaggcugggcuaaggaaauuggccugaugauggagauguucuuuggaagagcagccagguggcaaaggcacagugaucaaauaugugauuaauaggagugauccaguccuaaacagggauagaggcugagaggccuagucaaguggucuaaacugcacaugaaaaggaagggaaaaaucgguaacuugagcaauccuuuaucaucccuacagccacucaguuuuaggucugaucagcaguuauuccacugagcugcuggaugagcugaggguggugaugaaggcugaguuauuugguauauauguagucuaccuuauuuaauauuggcucaguugcuguacucagcucugaagacuugaaaucuggcugauggguuaucauucuaugugaagaaaguauuguaaggggaguauagaugguuaaggagguagcaguaaaagcagugcagaagaacagagaugugcauguaagagcucaaugauacuguuuaggguugcauuuaccagguagauucuucucacuauuuuuauucuugauagcuggggucuuugggacaucuaggcuuaucuauuuuguuuggcugcaaaaaagucagguaagaggaaacacuuggaaagcaaaaaauaaaugaaggcagagaacaucauaaagagauauaugaaaagaagccccauuuaaauuauuugguaaaaugugauauacaugguacaucagagauauugcaugcuuggauuuuuuggauuuuacagauacagcaacaauguauuucauugaugugaaugccuuagaguuaucuugagcaagaaacuauuuuuuuuuuugaaacggaguuucggaguuucgcucuucuugcccaggcuggagugcaguggcgcgaucucggcucaaggcaaccucugccucccggguucaagcaauucuccugccucagccucccaaguagcugggauuacagucaugcgccaccacgccugguuaauuuuguauuuuuaguagagucgggguuucuccauguuagucaugcuggucucgaacucccagccucaggugauccacccgccucggccucccaaagugcugggauuacaggcaugagccaccgugcccagccugagcaagaaacuuuuuauugauaucuugaaucuccaguauaauaaaguugggagcagggucaauaaauauaaauaaauaauacuuuuuccucaaaaauaucauauuuuuuuaaaccuaagacaucaucaaucauaggagacaccacuaggaaaaaaacacugccaaguaaauuaugaaacuauagugauuguaaaacuaaccccaauuucagaaauguugcgaugugcaguacauacauuauacagaaguuaacuaucaauuaauaucuccuugaaccuuuagaacuugaucuauagucucacuuaaguagauuacaguaauaagaaagucagucucugguuucaauauuuugugacuggauaucuauagggaaaaguaaauguagguaaguguagguuuuuuuuuguuuuuuuuuuuugagucagggucucucucugucacccaggcuggagugcaguggcacaaacauggcucccuggggccuccacuuucugggcucaaacaauucugcugccuuagccuuaccugaguagcugggacuacaggcaugccaccacgcccaccuaauuuaaaaaauuuuuuuuagagacagggucucaccauguugcccaggcuagcuucgaacuucuaagcucaagcaauccucccaccucagccucccaaagugcugggauuauagacgugagccaccaugccuggccaaaaaugcuuccuuauauugucaucuuuaaagauuuucuggccaagcaugguggcucccgccuguaaucccagcacuuugggaggcugaggugggcggaucaccugaggucaggaguuugagaccagccuggccaacauggugaaacccggucucuacugaaaauauaaaaaauuagccaggcacgguggcaggcaccuauaaucacagcuacucaggagcuaaggcaugcuccugagauuggagauugcggugagccaaaauugcaccacugcccuccacucugggcaacagagcaagacccugucucaaaaaaaaaaaaaaaaaucuauacuuaccuguacuuacuuuucuuuauagacauuuaaucauaaaauauugaaaccagagacucauuuuuucuuauuacugugaucuacuuaaaugagacuguagaucaaguucuaaagguucaaugagauaucaauugauaguuaacuucuguauaauguaagcugucucaaaacaaaauaauauaaagauuuccuuuuguuuuuagggaaauuucucauucagcucuuuucuaauugcaggugaaaacaacuggcuuuuuuuuuaaaaaaagcuauaugugaagcaaaucgugugcuguuaugcaccuaauuuugccauguaugcuuaaugaaggaggcaggaggccauuuagccaucaagggagauaacuuggccuagugcuuuucugcagggaagcaguuaaaauaaguuugaagaaauuauauauuuaaggagaaggcaaguuuguaacacacuaagacaaaauauuaacugcugaguuuugaauauucuugugguuuucccaugucuacugacauuugaacauuguuuaguaauacuauaaggagauauugagcaaaauaaguuggaacccugccuucuguaaucuagcuuuuacauguuuauguagauuagguuagguuaagagaaaauaccguaguauuuuguagcuauacaaagcaucuggaucccugacuucaauggcacuuauguacuuguuaagaagacagaucauagccgggugcgguggcucacgccuguaaucccagcacuuugggaggccgaggugggcagaucaccugaaguugggaguucgagaucagugugaucaacauugagaaaccccgucucuacuaaaaauacaaaauuagcuggccaugguggcgcaugccuguaacccuagcuacucgggaggcugaggcaggagaauugcuugaaccugggaggcggagguuauggugagccgagaucgugccauugcaauccagccugggcaacaagagugaaacugucucaagagaaaaaaaaaagacagaucauaaauaaguagauacauaaaggaacaagaucauuagagauugugauaaaugccacagggcuauauuagaggguaauuggggaaggccacucacauuagauaaagggggucagugaagcuuuccuuaugaggugagaccugaggaauaaucagccagauaugugaauaauugcaggaaaaacauuccagguagaagaacagaaaguguaaaggcuaggagguaagaaagagcucgauauuucacaggaucggaaaggagcuuguuguggcucgaauguugugaacuaggaagagagaugcacaacaagggguuagacaggcaggcaggagccaaaucauuuggggauuuguaggccauaguaaagaugaaguuugaauuuuauuuugagaaaauaagaaaugcuuuagaaagaguuuaagcagaguaauuucauaaucuaauuuucauuuuucaaagaccacucugguuuaucgguagagaagaauuagaggggaggcauaggaaaaacaagaagacugguuaggcagaugugcuagucaagauggccaaggguaguggcagguuggauuuuuuccucuaguacugucaaguagcauuuugguaucauugcaagccuacuucucuaauauacuguuuuuuaaauagcagagacucuuuggauuuagaguguauaguugagugcugggcuugauggccaaugccuauaaucccagcacuuugggaggccgaggcaggaggauuacuugaucccaggaguuccagaccaauccggggagcauagugagauccugucuguacaaaaaauaaaaaauuagcagggugugauggcacucaccuguauucacagcugcucaggagccugaggugggagaaucacuugagaccaggaggaguucaaaucugcauugagcacagaugaugccacugcccuccagccugggugacggagcgagacccugucuuaaaaaaaaaagaauacauaguugaauuaguuuauuauuauuauggagaugagaucuugcucugucacucucaggcuggaguacagugguacaaucauaguucacugcaaccuuuaaauccugggcucaagccauccuccuacuucagccuccugaguagcuaggacuacagguguauaccaccaugccaagcuaauuuuuuuuuuuuuuuuuuuuugguagagacaacgucucgcuauguugcccaggcuggucuugaacuccuggcuucaagaggaucuuccugccuuggccuccaaaaguucugggaguacagggugagccaucaugccacccuuaauguaguauucuuugacugcagaauuagauuugaauugaauaauacaaaagcugauuuuuaacuaugccuugacugaaaacuaaauucuuuuaaaaguacugguagaggaaguagucuuagaguuuaguagaugauaaugauaauagcacacauugcuguuuuuucauaguuaaugagcauaaugguuauauuuaaugagaguuuuaaaauuuauguuuuuauuucuacuuggugauuuucauaacaaauuauacuuaggcucaggucucaauauaauuaucugauuagugcauaguuuuaaaucuuuaacuuugccacuagaaauacacuuaauuuuuaauuuagcuacuaauugugaaacauuuuuguuuaguauuuuguuguuuuauucauguaaaucaauuuaagccuuuucuuauuuaaauuacuuaauucuacuucuauaaucuauucuaauacugaauuccgaacucuccuaaauuauucuugauuuagauaaaaugguuuuaagcugguaacuuuaaaaaauacaauuacuucaaaauaauacacauacaugacagaaaaaauucaaauugugaaagggcauaaaauggaaagaauauuuuauaacauucuuauuaucuaagccaggcaaagguuggcagcuuucuuucaguuggaugucacucagccuauugaguaugcaaaugucuuuuguuugcaugccacccaacucagcaguagugagugaaggagaacugaugaagauugccaacaguaccucacaucucaucuccccuuuuauauaagaguaaaauuagauggcaugugguggcaauaccugaaaggaacaugguucuaagagugaauuuaaauaguuuaucauuuguauuaauagauguuuuuuacuccaguaggugcacauuuuucugguaguggauacagacaauuacaguguacuaagaacuuugcugaagcauuucaaggcaaagguauuaaaauaaaaauagauaaaagugguuuguuuugcuaaugaauuuuggagauaaugaucaguagaccgcauuuaccaaguguggcacgccaacugaaauaucuucaucuucuguauagguuguuaauccuuaauacauauguaauacuuagucuuuuacuugguauaagucaaugagaugguuaaucuucauuauauaacauuuuaaguugauauaaaugagcaguauuuuggggguuuuauuuuuaaagcaaaaggugagccaaaauauuaaucuuuaacaaauauaguggacaaaaauuuguugagaaaguuucagauuaaggaaucaugcagcaucaaccaaggagccucaacauaauaauuaacccagcuucuuaacaaagauaugauuuaauuuuuguuguugaaugauuucaagacuacauuuuccuuuugggauuguucuguaugaugcaguaaaauguuggaaaucacagugauugcuuaaaaugaacaugcugcaaaaagggcucaaaagugcuuuuuguaaagagcucuauuguuaguacaauuuugcucguggguccucugucuuuuaggggaaggcuguaaugccuaaaaguugccagugcuucauuaagcuaaugcugaauuauagccagacauucagugauccagaccccagacuucccugccauccaagaggagcaguuggggaagggaaugagguggaggugggagguggaauaggccuuuuuuacguaguaacuuuauguauuuauugugucaaaugaguuuagcauacuuguguuauuagaaucaauuuggccgggugugguggcucacaccuguaaucccagcaguuugggaggccaagguggguggaucacaaggucaggaguucaagaccagccugaccaacauggugaaacccugucucuacuaaaaauauaaaaaguuagccgggugugguggcacacgccuguaucccagcuacucaggaggcugaggcaggagaaucgcuugaacccaggaggcggagguugcagugagcugagaucacaccacuguacuccagccugggcaacagaguaagacuccgucucaaaaaacaaaaaacaaacaaacaaaagaaagaauuaauuuaagccuugaaugcucucuaacuuuuucucccauuagccuuuccauuuuuuuuuucaguuaauaagaaacaauacugauagcaaaacuugcauuguguguguguguguguguguguguguauuuuuuuugagacagagucuugcucugucacucaugcuggagugcgguggcaugaucuuggcuugcugcaaccuccgccuccuggguucaagcuauucuuaugccucagccucccuagcugggacuacaggugcaugccacccuguguugcuaauuuuuuuuuuuuuuugagauggaguuucgcuuuugucgucuaggcuggagugcaauggcgcgaucucagcucacagcaaauuccgccucccggguacaagccauucuccugccucagccuccggaguagaugggauuacaggcaugcgccaccacgcccggcuaauuuuguauuuuuaguagagaugggauuucuccauguuggucaggcuggucucaaacuccggaccucagguaauccacccuccucggccucccaaagugccgggauuacaggcaugagccaccgcgccuggcuguccugcuaauuuuuguauuuuuaguagagaugaacccucucccuccccuuccccuccccuccccuccccuccccuccccuccucuuuucgagacagagucuugcucuguugcccaggcugaagugcaguggcgucaucuuggcucacugcagccuccgccucccggguucaagcaauucuccugccucagccucccgaguagcugggacuacaguugcgcacugccacgccuggcuaauuuuuguauuuuuuguagagaugggguuucaccauguuggccaggauggucuuauucucuugaccucgugauccuccugccuucuccuuccaaagugcugggauuacaggcaugagccuuuuuuucucguauaauuuugaacaaaauaauacuuaguuuuucauucaaauuagaaauuuaaguaaaagugauaccucuagaaaguuaacguuugacucauuuuaagaaagcaagauuauaauagggucaucuuauuuguucagauucuuuagauuucauauuuuuauauuuuaaaaaguuucaaaccuacugaacauuuuacuuuauguggauguacacucacuuaagagugagauauugcagggcgugguggcucacgccuauaaucccagcacuuuuggaguccaaggcgggugaucacaugaggucgggaguucaagaccagccugaccaacauagagacucccugucucuacuaaaaauacaaaaguagcugggugugguggcacaugccuguaaucccagcugcuugggaggcugagggaggagaauuguuugaaccugggaggcggagguuguggugagccgagauugugcuauugcacuauagccuggacaacaacagcaaaacuccgucucaaaaaaaaaaaaaaaagugagauauuaagggcuuuuacuuucuauauuuuauauuucuaugauacuugaauaucauuuuaccaaauuuguaagucuuauaauuacugugauuagaaauauaauuuuaagcccuaauaaaaugacuuauugucauuuuagagcuaaaauuugucuuguuucuuuggguuguuuuuuuuuuuuuuugagauggagucuuacucugucacccaggcuggaguacaguggcaugaucucggcucacugcaaccuccaccucccugguucaagcaauucuccugccucagccucccaaguaacugggauuacaggcaugcaccacugcacccggcuaauuuuuauauauuuuuuuaguagagacaggguuucaccauguuggccaggcuggucucgagcuccuggccucaggugauucgcccgccuuggccucccaaaaugcugggauuacaggcgugagccacugagccuggccuaaaauuugucuuuugcuagguauauggauuuguagaugagugugcaguagcaaugaucauaguuuauuuuaugaauuaauaguuaaugaacaucagauauuggugauacagcaauaaacgagauaaauauauuuccuuuuggaguucauaguuaagguuuguuacauggguuggguauauuagguuggguauauuggguggugcuaaaguuugggcuucuacuaaucccaucacccaaauaguaaacauaguacccaauaggugguuuuucaacccgugcccucuucccucccugcuuuuggaguccccagugucuaucguuccaaucuuuauguggguggagacuuuuuuuuuaagacaggaucuugcucugccaggcuggagugccagguuggaggcucacuggcaccucaaccuuccaggcucaagcaauccucccaccucagccucccaaguugcugggaguacaggcgugugcaccauguccagguacuuuuuaaauuuuuuguagagacagggucucgcuauguugcccaggaugguaucaaacuucuggacucaagugauccucccaucucagccucccaaagugcugggauuacgggcacgagccaucucaccuagcccugugcacuuuuuaaacuccauuuacaacauuggucagcuuuuucuuauuguacuauaaauuggacauuaaugaaguuuugugguccugaagccugaaaaaaaagucagauacaguaauuagaacuguuuaacuguuccaucauuuccucugcuaucuuauuuuuauucauucuguagaaguccagacaggaaaagguugauuguugguagggugacuauauaauuugcaagucccagggcaaaauaaaaaugggggcucccuuauucaaaaagcaggaaaaggggcagggcgugguggcucaugccuguaaucccagcacuuuggagggcugaggcgggcggaucacgaggucaggagaucgagaccaucuuggcuaacacggugaaaccccgucuguacuaaaaauacaaaaaauuagaugggugugguggcgggcacccauagucccagcuacucaggaggcugaggcaggagaagggcaugaacuugggaggcggaacuugcagugagccaagaucaagccauugcacuccagccugagcaacagagcgagacuccgccucaaaaaaaaaaaaaaaaaaaaaaaagcagggaaaaugugcugcuaaagguacuaaaauauauaccuuuuuucuuucuuuguagugucuccuucaacuugucauauuuuaaaaaaauuuaucaucuaaugucagucuaagcaaagaaaaauuagaauuuuaaaucauuagccuguauuuuacuguucaucccuauauguuguguaguguccauuuaaaaugcaaauauaagaauauuuaccucauuuguggaaacugaaauuauacagucauuuuguaguugcacuugcauguguaguuuguuuuugcuagaacaguagaaacucuguacaaacgaacucagugguuuguauuucacuucuugaugaauacauauucuaccaacauucuaccuucugcuuacugaugaguagggaaggacugagaagaaaaggaauuauggguggcccuaucucuaccuuuacuuuuauguuauuauauccagcauaagugguugauuaauauaggcaaguaauaggagaaauaaaggauauaauaggguuccuucauuguuaguuucauaaaacaccauugccuucuuucuguguuccgaguaaguuguagccccuuggggcugugagcaacccccuccagugagaauuaauacaauuuucuuuguacucuauggcagagaagaugcucuuacuuuguuuuguuuugagaacccuggcuaguccuugucaggaggaugcuaggcuuuauggguuuaaggaaauugguuauaugcuguuaaccauuuauacaguaauaaauuguuuaauaggaauuuaaggcccaggccauaacaggaguccuacuguuuuauuuucuggaaagugaauguaguuucaugaguguggaauauuuguagcauauuaaaauugcucucuagguacaguuagcuuaucccuuaugguuuuacccugcuguaaggggaaaccauacagaauugagcaucaaugaauaaauaaaccucugccagagauuggcaggcuuuuuggaucauggugucauuccaaguuaggguuaggcacacacuagaggcugugacuugguaauucaaguguuucacuugguugcuacugugcccuggcugcuaugcaaggauggcaagaauggcguaauaaacuuaaagcuguaguaaugcuauaauugucugauaguagugauuaaggucuggguuaguauacccgaggaguccuguucagguguuauucuuuuuucuuuuuuacuuuuucuuuuucuuuuuuuuuugagacagaguuucaaacuuacucgauugucacccaggcuggagugcaguggugugaucucggcucacugcaaccucugcuuccuaggcucaagugauucuccugcauuagccucccaaguaguuugaacuacaggcaugugcuaauuuuuguauuuuuuuuuuuugaguagagacaggguuucaccauguuggccaggcugguuucgaacuccugaccucaaaugauccgccuaccuuggccucccaaagugcugggauuacaggugugagccacugcaccuggccuaauuuuuguauuuuuauuagagacgggacuuugccauguugcucaggcuggucuuaaacuccugacuucaaacuccugauccauccuucuuggccucccaaagugcugggauuacaagugucagccacugugccuggccucagcuguuauucuucaugcguauauuuguuuuguucauuuggggcaccuuguugguuaucauaaauuuuggugugaucagguacugcuccuuaauaauacuguauuuggcugggcguggucgcucacgccuguaaucccagcacuuugggaggccgagacggguggaucacgagaucaggagaucgagaccauccugacauggugaaaccccgucucuacuaaaaauacaaaaaaaucagccaggcgugguggcgggcgccuguagucccagcuacucgggaggcugaggcaggagaauggagugaacccgggaggcggagcuugcagugagccaagauccagccugggcgacggaguuccgucucaaaacaaaaacaaaaacaaaaaaaaaacuguauuuauacuuuauucugcauaacuucuuuuaacucaggauuucuuuuucuuuuucuuuucuuuuuuuuuuggagacggagucucgcuuuguagcccaggcugaagugcaguggcgugaucucggcucacugcaagcuccgccucccagguucacuccauucuccugccucagccucccgaguagcugggacuacaggugcccaccaccacgccuggcuauuuuuuuguaguuuuaguagagacgggguuucaccguguuagccaggauggucucgaucucuugaccucgugaucugcccgccucugccucccaaagugcugggauuacaggcgugagccaccgugccugggcuuuaacucaggauuucauaaagaaaacaagauugagaaaaaccaaaucuguuuguuguauaaaauaauguauagcucugaauagucaugucugauuuuggguaaaaugcuaaaagacuauucuucuaugaagugcuuuuuacuuuugcaguuuuagguggcaaaauaauuucauauucuuauuuccucacagaaaccauaugucugugguugcuucuuagcucuaucaaauauccaccuaagugcaccaguagguuaaauuguuucucauaaaagguuaguuuugacaaauuuuugcuguuagcuuuucauuaucaccagaucuugacuguacuggcacaaugguguauaaaaucuagagaggaaacaaaucaaugugaaccauagcauaguuaaugggucuucuccaaagcacuuauuugguuagauaaaaguacauaaagcacuucucacugugucugguacagaggggaggcaugcaacaaauguuuuuagaauaaauaaaaauucaguucuuguaagcauuaguauuaauuacaugaaggacuuccaggcacuguaaucagucuucuaucuuugagauuugaaagaagcaggaaauagggcguaggaccuacaaggaaacaggaagauuauccauguuuuuauuucgcauuccacuugaacuaucuuggaaacacaggguauaacaucaaacaauggucauauaaguauuuuuuaaaauuuguuuuuaucuguugcuuuaucugcuuugugguauauuauuguauucuaugucuggacaugucuggacguuuucaguugauucauuaauaucaggaguagugugaguguuuccuugucaaggagauacugcauuuucuuccuagucccauaauuagccaaaggaacaaacuacucuucuuaaauguucaucaaaacagguauaugagucugggcgcaguggcucacgccuguaauuccaacacuuugagaggccgaggugggugaaucacuugaggccaggaguuugagaccagccugggcaagacggcgaaaccuugucucuauaaaaaauacaaaaauuaaucaggugugguggugcacaccuguaaucacagcuauuuggguggcuauggcaugagaaucacuugaacccagaaggcggggaaguugcagugagcugagaucgcgccacuucauuccagccuucaugcagagcaagacucugucucaaaauauauauauaagauuacacauauauuucaaaaaaauuauauuuuccaaaaccaaaaaccccacagguauaugaucuguaaaacaggcuggacaugguggcucaugacuguaauccuagcacuuugggaggcugaggcaaggaggaucacuugaacccaggaauuugagacuugccugggcaaaauaguaagacucugucucuauuaauuaaaacaaaaacaaaaacaaaaaugacagacauaugaucuccgaaacaaacgaaucaugcaggucaaccaggauguggggagaacucaaaaagguauauaaacaauaacacacaaaccuaauuguauuauaaauggauaauacacugaagggguuggggaagaaaauaacuugucuaagauacuuuggaaaauuauaaggcuaaagacaaaaagaauuauaugcaaauauuguggugucauuaguaaguuucuuucucauaggggcagggguuagcaauucuacuuuauauauauacuuaacaguaaacaaauuagaaaauauuguggauaauaagaccuagguuccuaacucucuccacugagaggaccuagaauuaggaauaccacaguagcagugaccacaauagugccccagaucuugauuucuuuucuuuuucuuuuuuuuugacagugucucacccugucgcccaggcuggagugcaguggcacggucuuggcuuacugcacucuccaccuccuagguucaagugauucuccugccucagccucccuaguagcuaggacuauaggcaucugccaccacgccuggcuaauuuuuguauuuucuguagagaugggauuuggucauguuguccagguuggucucaaacuccugaccucaagugauccgcccgccucggcuucccaagaugcugggauuacaggugugagucaccaugcccggccccagaucuugguuucuaaauaacauucuccacuaauaagaacccuugagaaaugacugauuccaggacugaggcagggaaaaucaaaaugaaccugaaacauuuaaugguaucagaaaguaacuaaaaaaugauaggggcauaugaaaggaucuaaccaacuugaagagauaguuccauuggucaaagcuaagacaaaauaaauaaucauaguauuggauucgaauccauagaauauaauaaauaucagugaguccauacuaauauaaacaagggagaaaggacagccuaucuaucuagcuagcuagcuaucugagacagucucuugcucugucacccaggcuggagugcaguggcacgaucugggcucacugcaaguuccaccucccggguucacaacauucuccuuccucagccacccgagcagcugggacuacaggcgcccgcugccacgcccggcuaauuuuuaguauuuuuaguagagaugggguuucacuguguuagccaggauggucucaaucuccugacaucguaauccgcccgccucggccucccaaagugcuaggauuacagacgugagccacugcgcccagucuuuuuauuuuuaaaaauaauaauaaaaaauaguaaacuuuauuuuuagagcaauuuuauguucacaguaaaauugagaggcagcucuuuuuuuguuuuuacaguagaauuucaguuaauaaauagaaggagugauggaaauagaaaaucaucauuaggcgaucuccauggcagguucuuguugcaggcaagaaucaaccaauggaugcuaaaauuagugggugaaagugugguaagaaacacgguauuuaaauaggcucuaaguaucugcccuacaaaauacuuauucauuacaaaggggaaccuuuguaauguaacacuggagaaaucuggauauaccacucuaaccuggugacacauugacaucugucagaagacaaaaauuuugacaaaccaaguuuaaagauuaauuggcuuuuauuagcaauucaugaaucaggcagcaucccaucuaaagauuuacaaaggcacuccaaugagcugagcaguggaggcaggcuuuauugguagaaaaaagcugaagaaggcagaaacaaggaaaaagagugauugcucauuacaaaauuacuuuccuuguaggguuaaaacagaggaacuucauuaucuugcuagcacaaauaaacugggccccuucugauugguugcugugaauggccuguuuguuggaaaacuggcccauuuuauuguucaguuugauuauguggugccuagcaggagugacuccauucagguuuugugugcucuguuggagucuaguguagaaacucagcccaaaacaguggcuuucuauacguuuauuuaacacgucagaugcuuccugaugcagugcacugagaaggacauagcaucgccucugugguauuuuuugccaggaaagguaauuuuugucuaaucaugagaaaacagagauaaacccaaauugaggaacauucuacaagauaacuucccaguacuuuaaaaaagucucaaagucauaaacaagaaagaacugagggacuauugcauauuggagcgaucuaaagaaguauuacaauuuguggaauucuugauuaaauccuggaccagcaaaaggacauuagugggaaaauugaugaaauucaaaugagaucuuauauugaaguuaauugugucaguguacauuuccugguuuucauaauugcaagugauuauguaagguuuguuaauauuaggagcagcuggguaaagguuauacaaaaacucuauacuauuuuugcauuuuuucuguaaguuuaaaacauuuuccaacuaaaaaguugaaaacacauguauuagagacacaugcguaugugucucuaauaaucuuaaauauauuuaagaugauagaaggaauucuugagauaguaaaaugaagucaccaaaaaacaaacaaagaaacaaaacgaaaucaccaaaaucuaucaauaaauuucagguaauacuuuuggcagauucauucuuugagauggagucucacucugucgcccaggcuggagugcaguggcgcaaucucggcucacugcaagcuccgccuucuggauucacgccauucuccugccucagccucccgaguagcugggacuacaggugcccgccaccaugcccugcuaauuuuuuuguauuuuuaguagagaugggguuucacuguguuagucaggauggucuugaucuccugaccucgugauccgcccgccucggccuccgaaagugcugggauuacaggcgugagccaccgugcccggccguuucuguuauacuuuaaaaaauauaauuuauauuuggcaccuauauuucucaauaaaaauauaagcaggaauuuuuaguuuuguaaauuuuauaaucugggucuaauaaaucuuaaagggauacuagaguuuauguaaucauuaaccacauuauuuuagacauuuuuuugugcaaacugauuuucuuauguuuauaccuauggucuucaguaauuacuauuucacugauaguuguaagaauaugaaauuaaggcaggaagaggagaaguauuaguuuaauguguacuauaugcuguguguguguguguguguacacacuuacaugcuguugauucucauuguucuuggauuccauauuuguaaauguuccuacucacugaaauuuauuuguaacccccaaauuaauaugcauaguguuuuuguagucauauaaggauaucuauagagcugugaaaaauguaagucaccugaugcacacguucucagcugaggucaaacaaggccacauucugacuucuuguuucaggucucaugccauaaacaaauguccuguucguggcccauuuagugccauauuuuucucauuuuugugcuuuuugcuggugauuucacuguucaaaauggcccacaaauauagugcuaaaguguugucugguguucuaagugcaagaaagcucuuuuccuuagggagaaaauaccuauguuagauaaucuucagucagucaugaguuauacaggcaugaauuauagugcugguagccaggaguugagugucagugcaucaacaaaauauauuaaagugacuuuaaacaaucacacgcacacaaaacaacauuauauauugaucuguuaaugcaaauguggugagcacaggcuuauagcaaucuaaccuuguauuucuccuagaagcaaugguucauuguucacuaauucaguguuugcaauaacuauauagaacauacaagaaucauuuguaugugugugauacccaucuaucuaauauauauuacauauuguucauuauauauuaaaaauguuauuaauuauauuacuuuuuuuuuuugagauagggucucacucuguugcccaggcuggaguacaguaguguuauuuuggcucacugcaaccuccaccucccguguucaaaugauccucccaccucagucucuugaauagcugggaccacaggcgugcacugccacgccgccaaauuuuuuguauuuuuaguagagaugagguuucaccauguugccuaggcgguguggaauuccugagcucaagugaucugcccaccuuagccucccaaagugcugggauuacaggcaugagccaccacgcccaaccuuauauuauuaauauauguuucauauauacauauacauacacaggcauaccuuguuuauugugcuucacuauugcacuucacagauaacuguguuuugaacaaauugaggguuugggguaacucugcaucaagcaagucacucaacaccauuuuuccaacagcaugugcucuuuucaugucugugucauauuuugguaauucuugcaauguugcaaacauuuuaauuauuacauuuguuauagugauuugugaucagugaucuuugauguuacuauuguaauuguuuuggggcaccaggaaccacacccauauaaaauggcaaacuuaauaaauguuuguguucugacuguucuaucagcuguuguuccccugucucccuguuuucaggccuccccguuuccugagacacaaauauugaauuuaggccaauuaauaacccugcaauggccuuuaaguguucaagugaaugacagaguugcacguuuuucacuuuaaaucaaaagcuaaaaaugauuaggcuuagggaagaaggcaugcugaaagccaagacaggcugaaagcuaggccuuuugcuccaguuagccaaguugugaaugcaaaggaaaaguucuugaagaaaauuaaaaguguuacuccagugaauacaggaaugauaagaaaauuaaacagcuuuauugcugauagagaaaaaguuuaaguggucuggauagauuaaacuaacuacaacauucccuuaggucaaaaccuaaucucagagcaacacccuaacccucagucuuguuuuuuucuuuuggagacagagucucccucugucgcccaggcuggagugcagugguucaaucuuggcucacugcagccuccacuuccuggguucaagcaauucuccugccucagccuccugaguagcugggacuacaggugugcaccaccaugcccggcuaauuuuuguauuuuuaguagagaugggguuucgccacauuguccaggcuggucuugaacucaggugauccgcuucccuuggccucccaaaguguugauauuacaggugugagccaccgugcccagcccccucagucuucugugaaaacugagagagguaaggaagcuacagaagaaaaguuuaaaguuaguagaggcugaaucucaacagauuuucaauguagaugacacauuuuuauguuggaagaauauaccaucuaggacuuuuauaacuggagagaaauuguugggcucaguggcucacaccuguaaucccagcacuuugggaggccgaggcgggcagaucaccugagguugggaguuugagaccagccugaccaacauggagaaacccugucucuacuaaaaauacaaaaaauuagcugaguguguugcugcaugccuguaaucccagcuaccugggaggcugaggcaggagaauugcuugagccugggaggcggagguugcggugagccaaguuugcgccauugcacuccagccugggcaacaagagcggaacugcaucucaaaagaaaaauaaauaaauaaauaaacguaacuggagagaaaucaaugccuggcuucaaagcuucaaaggacaagucagcucucuuguuaggggcuaauacagcuggugacuuuaaguugaagccgaugguuauuuaccauuuugaaaauccuagagcccuuaagaauuauacuaaauaugcucugccugugcucuaugaauggaacaacaaagccugaaugacagcacaucugcuuacagcaugacuuacugaauauuuuaagcccaccauugagaacuacugcucagaaaaaaagauugcuuucaaaauauuacugaucauugacaaugcacccgaucacccaagagcucugauguagauguauaaggagaugaauguuguuuucaugccugguaagacaacauccauucugcagccuauggauccaggaguaauuuuaacuuuaaaaucuuauuuaagaaauaauauuucauaggcuauagcugccauagauagugauuccucugaaucugagcaaaguaaaugcaaaacauucuggaaggaauucaccauucaagaugccuuuaagagaaucagugauucaugggaggagguuaaaauaucaguacuaacaggaauuuggaagaaguugauuccaaccuuuauggaugacuuugauagguuaaagacuucaguggaggaaguuacugcagaugugguggaauagcaagagaacuagaauuagaaguugaaccugaagaugugacugaauuggugcagucucaugagaaaauuugaauggaggaagaguugcuuuuuuuuuuuucuuuuucagaaagggucucacucuugcccaggcuggagugcaauggcguggucacagcucacugcagcaucaaccuccugggcuuuaucaacccaccucggccuuccaaguagcuggaacuacaggugugcacuaccacaccuggauaauuuuuuuuuuuuuuuuugagauggagucuugcucugucgcuaggcuggagugcaguggugcgaucucggcucacugcaacuucugcuuccuggguucaagcgauucuccugccucagccucccaaguagcugggacuacaggcacgugccaccacgcccagcuaauuuuuguauuuuuaguagagacgggguuucaccguguuggccgagauggucucuaugucuugaccucgugauccgcccgccucagccucccuaaaugcuggcauuacaggcaugagccacugugcccuguuuaaaaguugcuucuuauggaugagcaaagaaaguuguuucuugagguggaaucuacuugugcagacgcuguaaacauuguuuaaaugacaacaaaggacuuuuuucuuuuucuuuuucuuuuuuuuuuuuugagacagagucuugcgcuguuggccaggcuggagugcaguggugugaucuuggcucacugcaagcucugccuccuggguucacacgauucuccugucucagccucccgaguaguugggacuacaggcacccgccaccacgcccggcuaauuuuuuguguuuuuaguagagacgggauuucacuguguuagccaggauggucugaauuuccugaccucaugauccacccgccuuggccucccaaaaugcugggauuacaggcgugagccguggcgcccagccuagcacauuuuucuuuuuugaaauggagucucccucugucgcccaggcuggagugcaguggcacgaucuuggcucacugcaaccucugcaucccagguucaagcuauucuccugccucagccuccugaguaacugagauuacagggaccugccaccaugcccggcuaauuuauuuuuuuugagacggaguuucacuuuuuuugcccaggcuggauggagugcaauggcacgaucucggcucaccgcagccuccgccuuccggguucgagcgauucuccugccucagccuccugaguagcugggauuacaggcaugcgccaccaugcccgucuaauuuuguauuuuuuaguagagacaggguuucuccauguugguuaggcuggucucaaacucccgaccucaggugauacgcccgccuuggccucccagagugcugggauuacagacaugagccacugcgcccagccuuccaugaaguauuuuuaaauuaaggaauguacauuacguuuuuuguuuuguuuuuuugagacggagucccaaggcaggagugcaggggccugaucauggcuuuuucuauauuccuuuuuuuuuuuucuuuuuugagacagcgucucacucugucacccaggcuggagugcagugcugccaucucggcucacugcaaccucugccuucuggguucaugccauucuuccgccucagccuccccaguggcuggaacuacagguggccgccaccacgcccggcuaauuuuuuguuuuuuuaguagagauaggguuucaccguguuagccaggguggucuugaucucaugaccuccugaucugcccaccuuggccucccaaagugcugggauuacaggugugagccaccgugccuggcccgucauguuuuuuuuuagaccuaaugccauugcccacuuaacagacuacaguauaaacauaacuuauauauguacugagaaaccaaagaauucaugugauuugccguacugugauauuugcuuuauugcaguguucuggaacuaagccugcaauaucacugagguaugcuuguauuucuuaucuaaucuuucuaaagcauccaggcccuucuacaugaggagugagaacagacaaaauuaagugauuugcccaauauaauagccagaacucagggucugguuccaaagucugcagauuaaaaaucucuuuuuagaugacauuaucuguuuugccuaagacauacaguaaaggcaucuguaaauuuaucuugacauuuaauuagauguguugacaaaaagacucaaacucuguaaaauauuugaagagauuuauucugagccaaauaugagugaccaagggcccaugacacagcccucaggcaauccugagaacauguguccaaggugcuuggguuacagcuugauuuuauacauuuuaggguggcagaaguuauagauaccagucaacacauguaaggugaacauuguuucaguucagaaaggggggacuuccaggucauaggcagauucaaagauuuuguaguuaaguuacccucugaagaccuggaaucaauagaaggaaaugucuggguuaagauaaggggugggggagaccaagguucuuaugcaaaugaagcuuccuuguagcaggcuucacagagaauagauuguaaauguaucuuaucagucuuuaaaaggugccagacuguuaguggauucucuucuggaucagggaaaagaccuggaaagggaaggggauucucugcagaauguggauuuucccaagagacagcuuuguaggcuauuucaagauauggcaaauaaacauauuugggguuaaaauauucugauuucuuuccuuaucugucaugugauguuaugucagagucagguaagccacauuauguaggguuaaauaaaaccccucugaugagacuaugguuuguaaggcgugacuccccaggucccucagauagaaauuugaggagaagaaaaaggucagaguuuaguccucagauggcaagaauaguaagauuucccucauaucuuucuauuugaaaauuaaauugccuucauuuuaaagucaaauuuaacauuauguauuuuuguuuuaacaauuuacuuuuuuauucagcgauucacuuauuuaaaaugccauguacuaauuagcguaacauuuucuagguaguuuuuaaaaauuucuuuugggauuuauguuuauuuuuguucauuuauuuauuuuuauuuucuauuuuuugagauagagucuugcucugucacucaggcuggagugcaguggcaagaucucagcucacugcaaccucugcugcccagguuuaagcgauucucuugccuuagccuccugaguagcugggauuacaggcgcgugccaccaugcuuggcuacuuuuuguauuuuuaguagagaugggguuucagcaucuuggccaggcuggucuugaacuccugaccuuguaauccacccgucucggccucacaaagugcugggauuacaggcaugagccacugcaccugguguauguuuuuuuuaaaugaagucuuaacugggaaaugugaaacagugaaguauuucaguuuccauaaguaagaucuuaaauguuuagagugucaaaugucucuagaagaaaacagcgucuuguugauucuuuagcuuuucacuacucuuuacaaugcuuuuccccgaaaagcaauaugagaaauuagaaaaaagguuauuaaaaacccaagggggccagacacagcgauucaugccuguaauacgcgcacuuuggguggccaacgcaggaggauggcuuuaggccaggaguuugagaccagucuggccaacauagugagaccucguaucuauuuuacauauuuuaaaaauuauauuaaaaaauuaaaaaaaucccaaagggaauggaaugauagucauuugcuguaaagaaaucagaagauuuucauaauaaugcuuuuaucccuuccauuuuuccucuagaguuauaauugaauaauuaauugccuuauguugcuuauugcuuauaauaauuagggaaauuaggauguaucuaacaaaaaauaaaagacuaagaaaaaaauacaaaagacucuugaccaucaaaagguagcuuuauaaacaucuauucaaaauacauuuauucaaagaaauaaugagcaauuacaaaauuaaacuugagaauauccuuauuaaauaagauaguauaguuaauuaaaauaauuuauacagagaaacugugaauuuuauugcuuugucuuaaaacauucagacuccuuucuaacauuguuuacaguuaagguuuuuggguuuaaguugaaggaugaggccugcuaacauuacuaaauaugcguuuauaacccuauacguccugucuggaguaugcaaacaucuguagaagcaugauuuuuuuuuuuuuuuuuuuuuuuuuuuuugagacagagucuugcugucguccaggcuggaguacaguggcaugaucuuagcucacugcaaccuccaccucccgaguucaagugauucucuugccucagccuccugaguagcugggaccacaggugcaugccaccaugccuggcuaauuuuuguaguuuuaguagagaugggguuucaccauguuggccaggcuggucaugaacuccugaccucaggucauccaccugccuuggccucccaaagugguggaauuacaggcaugagccaccacgcccagccaggaugaggaguuuuuaaggcaauauaaugcaauauuuaguaauugauuccuuuaaucuaugagguccaacuuagaaggaacaaaaauguuaccaggcuucauuuaaaaaagagaaauugaggccagccaugguggcucacaccuguaaucccagcacuuugggaggccgaggcggguggaucacuugaggucaggaguucaacaccagccuggccaacauggugaaaccccgucucuacaaaaauacaaaaaaauuagccgagcaugguggcacacgacuauaaucccagguacccgggaggcugagacaggagaaucgcuugaacccaggaggcggagguugcagugagcugagauagugccauugcacaccagcaugggcgacagagugagacuucaucucaaaaaaagggagaaauuauauugaggccagccuggacaauaagaccacaucuccaaaaggaaaaaaaaaaaaaaaaaaguuuaaaaccaggucaggaccuauuugcagauguacaguuaucaucacagaaggcuuucuucuccagaaauuuaacuuuguaacuaguauucuuagcacuauaguauuugauagcaaagcuacccgcccccaccuuuuuuuuuuuuuuuaaaacaaguuuugcauuauacaagacugaauggugcuuggcagagaggaauuuuaagaauuuggaagggcaggagaauggcgugaaccugggaggcagagcuugcagugagcggacauugugccacugcacuccagccugggcgacagagugagacuccgucucaaaaaaaaaaaaaaaagaauuuggaaguagggaggugaauggaacuagacuuuaacuguagacuagaagcuucccuuucccagucucugcccauuaaaaaaaaaaaaaagucacuuccacuagaagauucauagauguugggaaaacacaacugggggaacuuuugauuuucuuuuuuaaugugggauggguugagcaggaguacucaagaaauugauagguaacuguagaguaaauaacauguaaugucauuuuaaaguuuguauuuuguuguggugguuguuuugagauggagucucgcucuauugccaggcuggagugcaguggugcgaucucggcucagugcaaccuccgccugccagguucaagcgguucuccugccucagccucccaaguagcugggauaacaggcacaaaccaccacacccagcuaauuuuuguauuuuuaguagagacaggguuucaccguguuggccaggcuggucucgaucuccugacuucgugaucugcccgcgucggccucccagagugcugggauuacaggcgugagccacugcacccggccguuaaagcuugcuuuaguaagcagaaaacacuuucaaagauacaugugaaugacagcugcuauuugucuuguagcugauucaaaguacucaucauaaaguuguuuuuuuguuuuuuuugagacggagucuugcucugucgcccaggcuggagugcaguggggcgaucugggcucacugcaaacuccgccucccggguucccaccauucuccugccucagccucccgaguagcugggacuacagguguccgccaccaugcccggcuaauuuuuuauauuuuuaauagagacgggguuucaccguguuagccaggauggucucgaucucgugaccucaugacccgccugccucagccucccaaaguucugggauuacaggcgugagccaucgugcccggccauaaaguuuuuuaaguuagccauuuccagugucugaucuucagugaaguuuguaaauuguuuuuguuuuguuuuguuuugcuuuguuuugagauagagucucccucugucuccuaggcuggagugcaguggcaugaucucagcucacugcagacucugccucguggguucaagcgauucuccugccucagccuccugaauagcugggauuacagguacaugucaccacacccaguuaauuuuucuguuuuucguagagaugggguuucaccauuguuggccagacuggucucaaacugcugaccucaggugauccaccugccucagccucccaaagugcugggauuacaggcaugagccacugcacccggccuguauauucuuuuaaaauaauaaagauagggagcuagauauuaguaaaaaguagcaacaaagauguaaggaucagaugaugacccaaggacuguuaguggaggguuuugccauguuggccaggcuggucuugaacuccaaaccucaagugauccacccuccucgcccacccagagugcugggauuacaggugugagccaccaugcccagcugacaggugaaauacuaaaaaauaacauggcuaggcucaaaaaugaagcuuaacaccuccuuggaauagaaaagcaaaguguucuaccuaacugaacucuggggccagaaguuggcaguuuuucccaugauuucuugccaggcugacaggguccaaaagugaccaugugagaaggagaucagaacuuggcucccacuucagacacgggggcugugucuccuugaaaggaugccagaaagagaacagcaucuugcuucuugguguuaaaaacuuuuuucauuggccaggcacuguggcacacaccuguaaucccagcaguugaggaggauggggugggaggauugcuugagcccaggaguucaagaucagccuaggcacaguggcaagacccuuuucugucucuacaaaaauuuuaaaaauuucucgggauguuggcgugcgccuguggucccagcuacucaggacgcugaggcagggguaucguuucagccaggaauucgagucugcagugagcuaugauggcgccacuguacucuggccugggcaauagcauaagaccuccucucuaaaagagaaaugauaaaaggccagguacaguggcucauggcuguagucccagcacuuucggaggccggggugguuggauugcuugaggccaggaguucaagaccagccugaccaacauggcgaaacccugucucuacuaaauauacaaaaauuauauuuguuuaauuacauaccacggaugugguggcccgugcagacgucccaacuacaugggaggcugaggcgugagaauugcuugaaccuuagaggcggagguugcagugagacaagaucaugucacugcccuccagccugggugacagagcaagacugucucaaaaaaaaaaaaaaaaaaaaaggccaggcacaguggcucaccccugugaucccagcacuuugagaggccgaggcgggcagaucacuugaagucaggaauuugagaccagccuggccaacauggugacacccugucucuaaugaaaaugcaaacguuagcugggcauaguggcaugugccuguaaucccugccacuugggaagcugaggcaagagaauugcuugaacccaggagguggagguugcagugagccaagauugugccacugcacuucagccugggcgacagagcaggacuucgucugaagaaaaaaaaaaaaacacguuuuuuauaagcuguggcccuaggucuggcgugguggcucacgcuuguaaucccagcacuuuuggaggcugaggcggguggaucacgaggccaggaguucgagaccagccuggccaacacagugaaaccccgucucuacuaaaaguacaaaaauuagcugggcgugguggcaggcgccuguaaucccagcuacucuggaggcugaggcaggagcauugcuugaaccugggagguggagguugcagugagcugagaucgcuccacugcacuccagccugggcgacagagcgacacuccgucucaaaaaauaaaauaaaaauaagcuguggaccuaaggaauaugagaauuaagagauacccuuaguaccagaaauuuagccaauauacucacuugcucuauaaaggcaucugcaauauccccaaugucuuuacaagguuggcaucucaaaauaccauuauaagaccuaguuuuggacugagagcaagagauagauauguuaaaauaacuuuuaagauaaauuuaagacaacuucaagacaaauuuuaagagauuaauugagcaaacauuuuuuuuuuuuccccagagauggagucucgcucugucgcccgggcuggagugcaguggugcaaucucggcucacugcaaccuccaccuccuggguucaagcaguuguccugucucagccuuccuaguagcugggacuacaggcacaugccaccauauuggucaggcuagucucgaacucuugaccucaggugauccaccugccucacccucccaaagugcuaggauuacaggugugagucaccaugcccagccgagcaaguaauuuuuuaugagucaggacuaccccuaucuucaccccuugccccagccagaauagauucagucugccgcuagugcugcugcaugguuggagaggauuuauggacagaaaaaggaaaguaauguacaggaaacagaagcgagguacagaaauagccgauugguuacagcuuggcauuugucuuauuugaacaugguuugaagauuuggcaacaugugauuggccaaaacuuugugauugauacaagaguauguuauaaucuguuuacacauugaguuggguuacaguucacuauauagaaaaaucucugggccgagauuaaaggauaugaggagacagcuuuaggcuaaacuuuauuuaacagauauagaggggaagcaccuggaaagaugcuguggaggaguuggugagugggaguuggaagauagagaaacaaaccaaaaauccaaguuggcaaaaucacauuuugaaacaucugaaaaaauaaaucuuauuuaaaaaaucuuuaugugaaaaauuuaaagcuuuuagaagaaaaaauauauccuuuugaccuuggucuaaaaaagaauuuauuuaaaagggcacaaaaaccaaaaauaauaaaaggaagauuaauacauugaauugcauuuuaaaauucuauacagcaggaugcauuacaaagugaaaaaacagcuacagauugaguaagauauuuguaacauauguaaucaaguaagaauuauccaaaauaugaaaaauauuuuuuaaaaagguaacaauccaaaagggaaaugugaaaggauuugaauaggcaauucacaaaauaggaaaccuguaugguugauacauacuugaaaagaugcauccuuaaacaaagaaaugcuugaaagaaggauaaaaaauguuuuggauggucuuacauuagcaauuaaaugcuguggccagaaguaacacuuuacuuaggcccugagugauuaggaugaucagagcuugccuggugacccauaggaaauagaacacgagcaagaaauaaacuucuguuauuuaaagccacugagauuuugggauuguuauugcauauaauuuaguuuauggccggguacgguggcucacgccuguaaucccagcacuuugggaggucauagugggcugaucaccugaggucaggaguuugaaaccagccuggccaacauggugaaaccccauuucuacuaaaaauacaaaaauuaggcaggcgugguggcgggugcuuguaaucccagguacucaggaggaaucgcuugaaccugggagguggagguugcagugagccaagauuguaucacugcacuccagccugggcgacagagcaagucuccgucucaaaaaaaaaaaaaaaaaaaaaaguaaauuuuggcugggugugguggcucaugucuguaacuccagcacuuugggaggcugagguaggaggaucacucgaggucaggaauuugagacccaccugggcaacauaguaagaucccgucucuucaaauauuuaaaaacuagcugggcguggguggcaugcacuugcaguccuagcuacucaggagggugaggcagaaggagugacugagcgugggaguuugaggcuucagugagcuaugacagugccacugcacacuagccuggguaccaaguuagacccugucucuuuaaaaguaaaauaaaauaaauugcucugguuaccauguagagauuggauuauaagaggauguugagaaaccacuaaggaagucauuaaaguuauucaggcgagauaugaugauacucaagacuaggauggugcauuggauaggacgugguauauuuagauggaaucuagugauaauauugaaggcgggcuuggcgagguguuucacaccuauaaugccaaaacuuuaggaggccgaggcgggaggaucacuugagcccuagaguucgagacaaaccugccaacauagugagacccccgucucuacagaaaauacaaaaauuagccaggugugccaaguggugaugugugccugguacuucccagcuacucaggaagcugaggugagaggauugcuuaggcccgggagauugagaccucagugagcugagaucgcgccacugcacuucagcuugggcaucaagcaagacccuggcucaaaaaaaaaaaaaaaaaaaaaagggcagguauauuggauuuagugaacaauuggauguguuauguauuucugcaacaaaauuuuuacaguaagcaaacagugcuuuuguggaccaaaaaucaaauuaaguaaaaagaaaaaaaaaaaacaagaagcaagcccuuaacaaggcuuuguuuuccucugaaccuuaaaacuuuuucguuccuauacuaucauuucucugagguaguuugauuucuucacuucauuuacauuuuuuuccauucucacaguauuucucuaguuaagaauuguauuaugccucuacugcaccauuauaggaaauacuuuuuaugguuggacauuguggcucacgccuguaaucucagcacuuugggaggccgagguggguggauugcuugagcucaggaguuugagaccagcuugggcaacauggccaaaccccaucucuacaaaaaacacaaaaauuagccaggcaugguggcacgcagcuauagucccagcuauucaggaggcgaggggugggaggaucacuugagccugggaggugguaguugcagugagcugagaucaugccagugugcuccagccugggugacagagugagauccugucuucacaaaaauaaacaaacaaacaaauaaaauaaauaauaccuuuuauuauuuaccucugaucuauuccuauuacaguuccgcauucaguguaauuuccccuagggguaacugcaauuucauuuuuuuaauauacccaacaaagagcuguagcucccuccugucugcagaucaguguuuauaggacagaauauaauauucuacuaugcuaacuuuaccuuuuacccuuuucuuagcacgugcacacacaugugugcacauacugucagagucccuauuucucucucucuacacacugccagucucucucccuugucauacugucagagucccuauuucucucucucuacacacugccagucucucucccuuguccccgcagucgagucugucucucuccuucuguuucucucucucucuuucucucucucuuuuuuuuuuaagagacgggcuuacuccaucugccaggcuggagcgcaauggugcggucauagcucacugcauccucaaacuccuaggcucaaucaguccuuccacuuuagccuccagaguagcuaggaccacaggugcaugccaccacacccuggcuaauuuuaaaaaaguuuuuuuuuugguagagauggguccucgcuguguugccagacugguccugaacuccugggcugaagcgauccugccugcucagccucccaaaguguugggauuccaggugugagccacugccuccagccuuucucuuacacauguguacacacgcauacugucuuauaguccaugaaaauggaaagauuuauuccaaugguucuguucuuaauauucucaaaugccuuuauaucucuugauaucuuggcauuuucagguucaucacaaauucuccaucuuuccacauauaucuaacuguaagccuuugcaugugcccauaguguuacuggaaaggggucuugauccagaccccaagagaggguucuugcaccuuguaagaaagauuuugggguggguccacagaguaaagcaaaagcaaguuuaagaaaguaaaguauuuugugugacuucagggccuauacuaguuccauuuggccccauaaauaucucuagaaucuauuccuuucuuguuuuccucugcuccugccuuuaucaguucucuccuuguauuauugcaguagguuucuagaugguaaaugucccucuuuucuucuucccccaaucucuuuuucauacuccgccagaguacuuuucuaaaauacaaaucuauucauuuuauuccccugcuuaaaauucuucagugguuccuuguggccuacaaaaugaaguucaaacuccuuaucauggcacauccaucaucugguuccugcuuacauuuucagcaucauuuccuacuacuacucccccuuucccacucugcauuccaguaacacugaacuauuuaugguuacuggaacuuaacacguucuugcuaagcuuuugcuuaugauacgucccuugcuuggaauuuccuucucuccuggucugcuuuuugaaucuuuacuuaucuaugacaguuuagcucaaguuauauuucugugaugcugauauuuuaaaauauuccuugauauucccuagagagauugggcaguauauuagucugcuugggcuguguauuaguccauuuucacacugcuauaaagaacuuccuugagacugaguaauuuauaaaggaaagagguuuaauugacucacaguuccacaugacuggggaggccucaggaaacuuacaaucguggcagaaggggaagcaggugccuucuucacaaggcagcaggagagagaagcaugaagugggaacuuccaaacacuuguaaaaccaucagaucucuugugaacccacucacugucaugagaacagcaugggggaaacugcaccaugauccagucaccucccucccuugacacguggggauuauggggauuacgauuugagaugagauuuggguggggacacagagccaauccauaucagguugcaguaacaaaauacuguagaauauguggcuuaaacauauuuucagaaacuuacuuucuuccaauguggaggcuagaaguccaagauagggugccagcagucagguucuggugagagcucuggguugccuuccacugugaaauuagagagaaagaaaucucucucuuauaaggccaucaaugcauuuggauuaggaccccauccuuaucaucucauuuaaccuaaauuaguaccuaaaagcccuaucuccaaauauagucacacugaggggggauagggcuucauuauaugaauuuugggggaacacaguucaguuguagcaguaugcaguauuuguugaaagaagugcuacagucuuuuuguuuuaugauucacuguuuacaugauugucuuucccauuagauuacacauuucuugagaguugggauuguuuacuuuuuaaaauauucuucagacuuugaauauguggaauuguugaauauguggaguuguugaaugggcuaaguuaauugcauuauaggaugggauuaaugauguauauuuaaguaagguagacgccuagaguaggucuucuggacugcuaacuuugacugacauuacugaugaaucauuuugacccauucuuuuugccuagcuugccaacuggauggguccuuugguuauauauacuuucauucaaagcauuuuauaacauuaacaacuuggacaggcgcgguggaucacaccuguaaucccagcacuuugggaagcugaggcagguggaucaccugaggucaggaguucaagaccagccugaccaacauggagaaacccuaucucuacuaaaaauacaaaauuagccaggugugguggcacaugccuguaaucccagcuacucaggaggcugagacaggagaauugcuugaacccgggaggcggagguugcagugagcugagaucacgccauugcacuccagucugggcaacaagagcgaaacucugucuccaaaaaaaaaaaaaacuugaugaacuuaaucuauauuuuaagaacucuaaaugauuaaaaacuuuagaaagaauugggauuuuucacgauuagaggagaccaagauauauuuccucagcuguuaaacaacuucaaucugcuaaaauaugcuacuucauuaagauuuugggaaagaaauuuuaaguaacaguuuaauguuuugguguccaucaugucuccuuugcuggagcaauaauagauuuugcauauauuuuauugucuuuuguguagaaagcaugguauaaagauaaauacauuagaauacaaaaauugcucccucuggaugauguuaaaaauaagacacauguuuuucaagguauucuguugcuguugaugaguuuugagaguaauacaaacauagguaugaauuuuguuaauacugcuuuucagugagccuggucaauuaaaccucuuugagucucaguuuucuaaucuguaaagugauacauuuauauuacaauuugguuuauuuaaaugcauuuuaaaauugaaaauguaaaacauucauuuauagucaugcaccacuuaaugauguuuuuuggucaacagcagaccuaaugaauauaugauggugguuuguaagauuguaauauuguauauuuacuguacuuuuucuguguuuagauacauaaauacuuaacauuguguuauguuaguauugccuacaauauucaguaguauaguaacauagaguacagguuuguaaccuaggagcaauagacuuuauaaccuagguguguaguaggcuauaccauguagguuuguguaagaacacucuaugauguucauacaauaacaaaaucuccuaacaaggcauuucucagaacuuauucccauuguuaagccacaaugacuguuuuaaaauucuaacaguacaaaagaguagccaaugaaaaacucuuuuuuucuacucuagaucucuaauucuuuuucuucaucuuuaaagugaccauuguuaaguuucuuacguuuuuccagaaauauucuuuuuauauauaaauauagguacuuauauauuaaguauagguaugugugugcauauguacaaauguguguuugggguugccauuaaaaacaauaaguuauguagaauaacuaguaugaagcaaaacaguacagcagauuuuaaaugaugaauguuauuaacucucuucccuuucuuucaucaaggcuucuuaagggcuuaugcagucagaaaauuccuuuaagauuuguuuucauuuuguaauuugaaauguuaauuuucagaucacaaagguuguccauguucacauauaagcagaaaaguaauuaauaucuaacaccagguaaugauuuauuccuugccgguuauuugagauuuuucuuuaccaugcuguuucauuccauuagcacagugguauuuaaguagaggugauuuugcacucaaggacauuuggcaauauguggagacauuuuuugguuguaacaucuaggagauacuguuaacauuuacuggauggaaucuagggaugcuguaacacgucuuaccauaugugggacagccuccacaacaaagaaucaucuggcacaaaaugcaaguauuacuaagguuaaaaaaaccguaaguuagcauaaauaauaaugaauuaaguauaaguugcagccucgcucauucuuuaauuauaguuuguguugacuguuuauuuugugauuuuauuauuuuauuauuuuaaaacuaaaaugauccuagauuagauguuaucuaauaugcaacagauagguacaucuguucuguuucucagauucugaucuuaaagucauuuuaucauauagcauuggcauuuguuuugcaaguuuuuaccuuaauuaaaaauaaaucaaaggcagcagaaaucuguguguuuuguugucguuguuguuaacuaaaaugauaaagggauccucagcuguuaaaucuacuuuguuguuuugagguuugaccuggccuuauuccauauauagccaucugccagcugguaaggugguaucuaguaaggauauuuaagaguguugccuugccagaucuagccguaagcaaguccuauaucuaaauuaaccuuugaggcugaaaaucauauagccaucugccagcugguaagguagcaucugucuaggauguucaagaauguuacuuugcuagaucuagaggcaagcaugcucucugcuaaauuucaucuuuacuggaccuccaggaucuuuaggacuuguauuagucaggauucuccagauaaacagaaccaauaggaguaaguagauagguagguagguagguagguagauagauauauguauagauagauacacaaggggaccucagaaaguucauggaaaaugcauauuaugaaaaaacucugcauguuuuucaaaaauuuuuugugccaaaauaaacuugaacaggaucuaguuugaggcacuaaggaaggcuaagacaucaguuugaaaaaagcuccuaucaaagcaacaugaauucuacuaaaauugaagcaagaacaaacauaaaauuuauagugaaacuuugguagaagaauggugaaaucauugaugcuuuacaaaaaguuuauggggacaaugccccaaagaaaucagcaguuuuacaaauggauaacucguuuuaaaaaaggacaggacaggccgggcaugauggcucaugccuguaaucccagcacuuugggaggcugaggcgggcggaucacgaggucaagagaucaagaccauccuggccaacaugguguaaccccgucucuacuaaaaauacaaaaauuagcugggugugguggcgugcgccuguagucccagcugcucgggaggcugagccaggagaauugcuugaacccgggaggcaaagauugcagugagccaagaucgcacgacuacacuccagccuggcgacagagcgagacucugucucaaaaaauaaauaaauaaaaaaggacaggacaguguuaaagaugaagcuugcaguggcagacugcaaggaaauuugcaaggaaaaaauuaaccuuguuugugccuuauuugaaggggacaaaugauuaacagcaaaaacaauagcgaacaucacagacaucucaagugauucagcuuacacaauucuggcugaaaaauuaaacuugggcaaacuuucaucucauugggggccaaaaccauugcacccaaaucagcuauagacgagcagugcuuucaauggaauuuuuaaacaaaugggaucaagauccugaagcauuucuugaaaaaauuaaaacagaugaaacaugucuuuaccaauauauccugaagacagggcauaauuaaagcaauggcuaccaagagguggaagugguccagucaaagcaaaauggacuggucauggcaacaguuuuuugggaugcucaagguauuuugcuuguugguuuucuggagggccaaagaaugauaacaucugcuuauuaugagaauguuuugagaaaaccaaagcuuuagcagaaaaacacuagggagaaauuuguuaaagaguccuucuccaccaugacaaugcuccugcucauuccugucaucaaacaagggcaauuuuuaaagaguuucaauggaaaaucaauauaguccugauuuggcuccuucugacuucuuuuuguuuccuaaucuuuuuguuuguuuguuuuugagauagugucuugcucugucacacaggcuggagugcaguggcuggcacaaucuuggcucacugcaaccuugaccucuggggcucaagcgagcauccuaccucagccucccaaguagcuaggacuacaaggugugccaccaugccuggcuaauuuuguuuauuuuuuguagagaugagaucucaguauguugcccagucugggcucaaacucaugccuggugacacagugagacucugucucaaaaaaaaaaaaaaaaaaaaaaaaaaaaaauauauauauauauauauauauauauauuuauuuauuuauuuacgucuauaaucccagcaauuugggagacugaggugggcagcucacuugagcuuaggaguugcagacccgccugggcaacauggugagaccccuucucuucaaaaaaauucaaaaauaagcuggauaggcuggguguggugguuccugccuguaaucacagcacuuugggaggccaaggcaggcagaucaccugaggucaggaguuugagaucagccuggccaagauggugaaaccccgucucuacugaaaaaagacaaaaaaauuagccaggugugguugugggcaucuguagucccagcuacuccggaggcuaaggcuggagaauugcuugaacccaugaggcagagguugcagugagcugagaucaugccacugcacuccagccugggcgacagagccagauccugucucaaaaaaaaaauacauauauauauauauauauauauauauauauauguuuuuguacaguuauacaguauguucguguuuuaagcuaaguguuuuauuauaagaguaaaaauguuaaaaacaguuaaaccacagguuaaaaaguuuaugaaguaaaguuagaguaaucuaagguuaauuuauuaucaaggaaauaaaaaacaaaaguaauguugucuaaguauaguguuuaugaagucuacaguaggguacaguaauguccuaggccuucacauucacuuaccgcucacacacugaccuagagcaaguucuaguccuacaagcuccauucaugguaagugcccuauacagguauaccauauuuuaucuuucauacuguauuuuugcucuacuuuuucuguguuuagauacacagauacuauuguguugcagcaaccuacaguauucaguggaauagcuauacaacuauccuauagucuagaaguaauaggcuauaucauauagccuagguauguaauaggcuaugucauccagguuucucuaaguacacucuaugauauucauacgaugaagucaccuaacaacaaauuucucagaacauauuucugucauuaagccacacaugacugccuuaaguauuguuccaugaaauuuuuauuuuaguuuuauguuuaccuuugcauuuggucaugauucaaaaaagcauuucuuauacuauguuucuuucuauacuaaguuaacuauaaaaugguacaucacugguaauagugauaauaaaccggccauuuucaugaaaacuuaguuuuaucuuggcuaggcacaguggcuuacgccuauaaucccagcacuuugggaggcugaggcgggugaaucccuugagcccagaguuagagaccagccugggcaacauggugaaaccccgucucuacaaaaaaauuaguugggcaugauagccugcgccuguggucccagcuacuugggggccugaggugggaggaucaccugagccuaggugauugaggcugcagugagcccugauugugcuaccgcacuccagccugauggauagagugagacccugucucaagaaaaaaaaacaacaacagcagcaacaaaaaaacccacaaaaacaaaagccgaaaagaaaaggaaacuuaguuuuaucuugacaaagauaucuaauuugcuucuaagcuuuuuaaauugaaacaaugcauggccuaucuuuugaauuugugaguuugccaccccugaaaacaucuaaguagaucaucugucagagauguuacagguaggaugaauuccugcuuuauuauggaaaauuugacuucuaguucuuuccaaguaauauuuuauaauucuaacuuauauaugugguccuauuccuagaaaaugauguauucuuuucauacaguuuuuccagugguacugaaaauaaccucagcccgaauuggcuuuguuaaacuuggaaguuuuucaagaaacaugacucuagaauucuuuacuaggucuucgcaaaauauuucgccuugcaguaagaauuguguuccucucauaucucuuuuuuuccuuauuuccaugcuuucccauuuuauucacauggacaauuuuuagucaauuagcauuuauuuuggggcuuccucaaaaacucuaaauuuuuuuuuugagauggagucucgcuugguccgaggcuggagugcaguggcgugaucucggcucacugcaaccucugucucccagguucaagcgauucuucugccucagccuccagaguagcugggauuacaggcgggcgccaccacgcccagcuaauuuuuauauuuuuaguagagaugggguuucaccauuuuggccaggcuggucuuaaacuccugaccucaugauccacccgccucugccuuccaaagugcugggauuacaggcgugagccacugcgcccagccaaaaaacucuaaauuuaccucuuuaggaauuucaaccugaccauuuguaucucuucuuauauuuucaguuguugcaauaaauuuuaacuuuuuuuauguuauuuuauaaaauuguuuccauucauauauacauuuucuuuuuuauaacagcuuuauugggauauaaucuacauagcauauaauucacccauuaaaaugcagaauucagugcuuuuuagcguauccacagaguugugcaacugucaccacugucaauuuuagaacauuuuucuuacaccacuaagaagucccauguccauuagcaguaauucuucauucacucccuccccaagccucuggcaaccacuaaucuacuuucugucucaaauuugccuguucuagacauauccuguaaguugagucguaucauauaauauauagucuuuggugacuggcuucuuucacucagcauaauguuuucaggguccauccauguuguaacauauauccagcacuucauuuccuuuuauugcccaauaacauucuauuacggauauacugcauuuccuuuauccuuucaucaauugauggacaugcgguuguuuccacuuuuuaguuauugugaauaaugccauuaugaguauuaacguacaaauuuuuuuuuguggacauauguuuuuauaucucuugcauauacccaagagugaaauugcugggucaggugguuaaggcguaagaguucuuuuuauggccaggcacaguggcucaugccuauaaucccagcacuuugggaggugaaggugggcggaucaccugagguugggaguucgagaccacccugaccaacauggagaaacccugccucuacuaaaaauacaaaauuagccaggcaugguggcgcaugccuguaauuccagcuacucaggaggcugaggcaggagaaucgcuugaacccgggagguggagguugcggugagccaagaucacgccauugcacuccagccugggcaacaagagcgaaacuccgucucaaauaaauaaauaaauaaauaaauaaaaguucuuuuuauauucuggauacuaguacuuuguuaguuauaugacuuguaaauuuuucccccauucugugaguugucuucacuuucuuuaugguguguuuugaagcacagaaguuuuaaauuuuguugacauucuaucuauuuuuccuuuuguugugcuuuuugguaucacagcuaagaagcuauuaccuaauccaggaucauaaaggaucuacaccuauguuuuauucugagauauuuauagauuuacuuauuacguuuugcguuucugauccauuuucaguuaauuuuugcuuaugauacaagguuaggggauccaacuuuauucuuuuauacauggauaucuaguuaucacagcaucauuuauugaaaagggcaauuuuuuccccauugaauugucuuggcacccuugucaaaaaucaguucaccauauauauaaggguuuaucucugaacucucaauuccauuccauugaugugcaugucugucuuuauuucaguaccacacugugcuacagucuuuauuuguugcuuuguauuacguuuugaaaucaggaaaugugaauccucugacuuuguucuucuguuucaagauuguuuuggcuauucuggguccuuugcauuuccauauaaagcagcagcuugucaauuucuacucgaaaggcagcugguguuugaaagagauugcauugaauauguagauaaauuuggggaguauugacaucuuaauaaauauuaagucuuauaaucagugagcaugggaugucucuucauuuguuuagauaagauuacuuuuuuucagugauguuuugccauuuucauuguguaaaucuugcacuucuucuguuacauuuauuccuaauaauuuuguucuuuugaugcuauuaugaaugggcucauuuucuuaauuucgcauuuggauugcucauugcuaguguacagaaauacaauugauuuuuauauauugauguauucugcaauguuguugaacuuuuauuagcucuaguaauuuuuuuguagguuccuuaggauuugcuuauauacaagcaaauuuggauuuuguagauuccuuaggauuuguuuauaugcaaauccuaaggaaccuacaaaaaauuacuagagcuaauaaaaguucaacaacauugcagaauacaagaccaugccaucuucaaacagagaugacuugacuucuuccuuucuaaucuguaugucuuuuuauuucauuguucuuuuucuuucuucuuuauuuuuacuuuuugucuccuuucccuggcuaggggaaucuccaguacaaguuuggauagguuuggggaagccaacauuuuugucucguuccugaucuucgaaggaaaguuuuuaguuuuucaccauuaaguaugcuguuaguuguggguuuuucuuuuuucuuuuuucuuuuuuuuuaguauuuauugauaauucuuggguguuucucggagagggggauuuggcagggucauaggacaauaguggagggaaggucagcagauaaacaugugaacaagggucucugguuuuccuaggcagaggacccugcggccuuccgcaguguuugugucccuggguacuugagauuagggaguucaagcaucuguuuaacaaagcacaucuugcaccgcccuuaauccauuuaacccugaguggacacagcacauguuucagagagcagcggguuggggguaagauuauagauuaacagcaucccaaggcagaagaauuuuucuuaguacagaacaaaauggagucucccaugucuacuucuuucuacacagacacaguaacaaucugaucucucuuucuuuuccccacauuucccccuuuccuauucgacaaaaccgccauccucaucguggcccguucucaaugagcuguuggguacaccucccagacgggguggcggccgggcagaggggcuccucaccucccagacgggguggugguagggcagacacacuccucaguucccagacggggucgcggccgggcacaggcgcuccucacaucccagacggggcggcggggcagaggcgcuccccacaucucagacgaugggcagccgggcagagacgcuccucacuuccuagacgggauggcugccgggaagaggcgcuccucacuucccagacugggcggccaggcagaggggcuccucacaucccagaugaugggcggccaggcagagacgcuccucacuucccagacgggguggcggccgggcagaggcugcaaucucggcacuuugggaggccaaggcaggcggcugggaggugguggagguuguagcgagccgagaucacgccacugcacuccagccugcaaucccaggcacucggcaggcugaggcaggagaauucaggcagggagguugcagugagccgagaugguggcaguacaguccagccuuggcuuggcaucagagggagaccggggagaccggggagaccggggagacuggggagagggagagggagagcaguuguggguuuuucauagaugccuuuaucacauugagaaugauccuuucuauuccuaaucaugaaaugguguuguauauuuauuaagacauuaaauacacauugacuaguauuuauuugcuuucccacauagaaaauauuauuauuauuguuauuauuuuucuuggagacggagucuugcucuggucacccaggcuggagugcaguggcacaaucuuggcucacugcaacgucucccuccuggguucaagcaaaucaccuuccucagccucccgaguagcugggacuacaggcgcaugcugccacaccugguuaauuuuuuguauuuuaguggagaugggguuucacuguguugcccaggguggucucgaacuccugagcucaggcaauccacccaccucggccucccaaagugcuaggauuaagaaaauauucuuaauacuagucuuucaaaguuuucuucucuuauuuucucucuucuacuuugaagggaaagcagggaucaacguaagagugcaauaaauaucuuuuuugaaauucuaaacacuaagguugaauugucacuaauuuacuuuauuuaaaaaucauaaaggcugggugcgguggcucacgccuguaaucccagcacuuugggaggccgaggcggguggaucacgaggucagcagauggagaccauccuggcuaacacggugaaaccccgucucuacuaaaaaaaaaaaacaacaaaaaacaaaaauuagccgggcgugguggcgggugccuguagucccaacuacucaagaggcugaagcaggagaauggcgugaacccgggagguggagcuugcagugagccgagauugcgccacugcacuccagccugggcgacagagcaagacuccgucucaaaaaaaaaaaaaaaaaaaaaaauuauaaaauguggccaggcgugguggcucacgccuguaaucccagcacuuugggaggccgaggugggcgaucaccugaggucaggaguucgagaccagucuggccaacauggugaaaccccaucucuaccaaaaauacaaaaauuaucugggcaugguggcaggugccaguaaucccagcuacucgggaggcugaggcaggagaaucgcuugaacccaggaggcggagguugcagugagccgagaucacgccauugcacuccagccugggggacaagagcgagacuuugucucucaaaaaaaaaaaaauuauaaaaugcauugaaagugggauaauggaaauguuuucuugggggagucacguacuucaucuggguuaaccuguuacagagggaguuagucuaagugaaucuuaaaauuguuauccucaaauuucagugaucuuuuacuuuauagcuuguaugcuucuauggucccccagcaagaaaucuuguacucauuagcaguuauucccaguucuuuuccacacacacuccccuaucccagcuguagguaaguacuaguuuacuuucuguuucaguaucuucaccuauuuugggugucuuauauaaauugaaaucuauaaauuguagucuuuugugauuaacuucaugguucauccauguuuuagcguauaucgguacuuccuuucuuuuuuuuuaaacuauggcaaaucauauaauaaaauucacuuucccaacaauuuucaaguauauaguacaauauugccaacaacaugcacauuguuaugcaacagaugcccaggaucccccuauccugcauggcugaaagucuacauccaccaaacacaacuuccuacuucacccucccucuagcuccuggcaacaaaccaccauuugacuuucuguuucugugaguuucacugcuuuagaugcuuuauauaaguaugcauuauuucaucuuuugugacugguacacuucucuuagcauaauguccucaagguucauccuuguuguagcauaugacaggauuuacuucuuuuuaaaagacugaauaauauucucuuguauguauauaccauauuuuguuuaucuguucaucuguugauguacauuuaaguugcuuccaccucuugccuauugugaauaauaaugcagugaacauguguacuguggacugaauuguguucuccucaaauucauauauugaaacccuaacucccagugugacuggguuuguagauaaggccuguaaggaggugaugauaaagguuaaauaagauaagguuggggccuaauccaauagggcugguuccuuuauaagaagaggaagacaccagaucuuuuuucuacacugugggaagacacagcaacaacauggccaucuguaagccacgaagagagcucucaccaggaacugauggauagcaccuggaucuuggacugcucagauagguuuauacgaucuagucugugguauucaguagcccaagcugacuaauauaauggcuguguguguacaaauagcuuuucaagauuuuuuacaauucuuuuauacagugggaaaacuguauucuauuuauacccagaaauagaauugcuagaacauguaguaguucuauuuuuaauuuuuugaggaacuuccauauuguuuuccauagcggcugcaccauuuuucauucccaccaacaguguacaagggucaaggauuccaauuucuuuauauauucaccaacacuuacuuucugccucugucucucuuucucucucucucuuucuuuccuuucuuucucucucucuuucugucucucucuuucucucuuucuuucuucuuuuuuuuucaagacggagucuuggucugucacccaggcuggagugcaguggcgcgaucucggcugacuacaaccuccaccucccugguucaagcgauucuccugcaucagccucccaaguagcugggauuacaggcaugugccacaaugcccagcuaauuguuuuauuuuuauuuuuauuuuugguagagacuauuggucuuugcccacuaaauuggaagauauauuaccuuguaauugccuucagagcaggguuuuccuccuuuagcucauugacaucuuguaccagauaauuuuuuuuccagauaauuucuguguguguauauggaggagccauaugugcauuguaagauuuugccagcauccuugacaaauguuggugguacuaccgacuaauaacauagugguacaaauguuagugguacuaccgacaaauguuagugguacuaccaccgguuguagugacaaccaaaaaugucuccagacaucuccaaauauccccuggggcguaaaacugcauaucauugagaacuuuauggcccuaaagaaagagauacaguuuuauucucugcucgcuuucuuuucuguuagucuugauuauuugucauuuacaauauuuaaccuugcucagcaaaauuuuaaccuuucaaauaaaagaaguagguuacugcuuuaaauuauugcuaaauaauucucagggcagguuuuucuaagugaauuugaacuuagaaacauagaauagagauggaugaaaguauccucauuuuauuuguuuuuuuauaagaaaauuuauuuuugaaauaauuuggggcacaugugcuugugaagaaauccguagauauugagagagaugaaguguuaaagauaguuuaauucaacaaauuucuaaaaaaauaacaaaaccuagagaaauuauguaauuuguuuuuuguguugguguugguguauauaguuacaucaaaaauuuuaaagacuuuaguuagauguguucuacauguggaacacuuuuguguugaaauguuuuguggaggucacuagugauuuuuagaacacuauacauguacuaaaauguucuauguaauauuggauggaaugauccauuguuuuauuuacccuucuuuuucucuagaacuuaacucuacauuuggaaguaguguaucuuacauuuuuuaauuuuuaauaacaaagccaaauaaucuucucagugaauuagaaacuuauuuauuuauuuuuugagauggaguuucacccuuguuucccaggcugaagugcaauggcacgaucugagcucacugcauccuccgccucccggguucaagcaauucucgugccucagccucccaaguagcugggauuacaggcaugcgccaccaugccuggcuaauuuuguauuuuuaguagagguggcguuucaccauauuggucaggcuggucucgaacucccgacaucaggugauccaccugccuuggccucccaaagugcucggauuacgggugugagccaacacaccuggccuagacauuuuuuaaaguguaguaaauaugugacauacuggcaauguugcaucaccauauacuugaaaaugcuauccagaugcuuuuuuguauaggagucccacaagauaugcaaacauuuuuauuuauuuauuuauauuuguauuuauuuauauauuuaagacagagucucccccaucacccaggcuggagugcaguugggugaucacagcucacuguagccucaaccucccagucucaagccauccuccugucucagcuucccaaguaccugagacuacagaugugugccaacaugccuggcuaauuuuuuaauauuuuguagagacaggguuucaccauguugcccaagcugaucucaaacuccugggcucaagcaguccaaccaucucagccucccaaagugcugggauuacaggggugagccacugcaccuggccuauuuuuaguuuuuugaggaaccuccaaaccauucucuguaguaguuuuauuaauuuacauucccaccaacaguguauaaggguucccuuuucuccagacccuugcagcauuuguuauugccugucuuuugccauguugccaggguuggucucaaacuccugggcucaagugauccucccgccuuggccuccuaaaguguugcaauugcaggcauaagccaccaugccuagcccuacaaacauaauuuuuuuuuuuuuuuuuuuugagacgggagucuugcucugucgcccaggcuggagugcaguggcacaaucucggcucacugcaacuuccgccuccuagguucaugccauucuccugccucagccucccgaguagcugagacuacaggcgcccgccaacacaccuggcuaauuuuuuguauuuuuaguagagaugggguuucaccguguuagccaggauggucuugaucucccgaccucgugaucugcccaucuuggccucccaaagugcuaggauuacaggcauaagucacugcgcccggccacaaacaauuuuauacaaagaauuugaaauuugaaaauuaacacaggcugggcgugguggcucacgccuguaaucccggcacuuugggaggcugaggugggcggauccccugagguugggaguucaagaccagccugacaacauggagaaacccugucucuacuaaaaacacaaaauuagcugggcaugguggcgcaugccuguaaucccagcuacuugggaggcugaggcaggagaaugcuugaaccugggaggcagaaguuguggugagccaagauugcgccauugcacuccagcuggggcaacaagagcgaaacuccgucucaaaaaaaaaagaaagaaaauuauacauuguugaaauaauuuuauuucauuagauaugcauaauaauuuuuagcucuacaauuuuauguucgcuuguguuuuugagucuguaaaucauaaugaugggccuauugggcauucauuucaauauaguauuaguguaacagagcaaagaguauaugaauacucaugauccuaccacauuuggggauauagucuguagacccuuuuugugcccaugugcacacacucacauacauuuuuuuuuuuuugaaacagagucuugcucuguugcucaggcuggagugcaguggugccaucucagcucacugagccucuaccucccagguucaagugauucuuccgccucagccuccugaguaucugggaucacaggcauguaccuaccacgcccugcuaauuuguguauuuuuaguagagacaggguuucaccacguuggccaggcuggucucaaacucccgaccucaggauccacucacugcgaccucccaaagugcugggauuacaggugugaaccacugcaccuagccauaaauuuuuaaaaaugcaguuacauuaugcugguguuuaauacggucuuuccccucuaaaaauagauuguagauuggcuggaugugguggcucacaccuguaaucccagcacuuugggaggccgaggugggcggaucaugaggucaagaguuugagaccagccuggccaacauagugaaacccugucucuauuaaaaauacaaaaaaauuagcuggacaugguggcagaugccuguaaucccagcuacuugggaggcugaugcaaggagaaucacuugaaccugggagguggagguugcagugauccaagauuucgccacuacccuugagccugggcgaugcugugagacucugucaacaaaucacaucuaaacaauuuuucaugacugcauaguauuuuauuuugggguauaguaugauuuugacaaccuaaauauaucuauagagaacugauuacuggccgggugcaguggcucacgccuguaaaucccaacacugugggagccugaggugggaggaauccuugaacuagcuugugcaagagggcgagaccccaucucuacaaaauguguuuuaaaauacuagacaggcauggcggcaugugccuauaguccagcuacucgggaggcugagcugggaggaucccuugagcccaugaguuugaagcugcagugagcugugauugcaccauugcacuccagcuugggugacagagcaagacccugucucacauacacaagaagagagaaaugauuaccaguguuugcuauuacaaauaauguucuaguaaguaaguacacuuauacauauuuguauuuuuuuaauauaaaaauuugaaagggaauguggagucuuaggaagauccauauuuaaaauuguuauuuuaugaugcucuccaggcagguuauagaaaauuauguagguuaagaauguuucuaggauauucaaaauuuaguccucuuuuaagaguagguaaugaggauggccacccauugcaacauggguugaaaaaauagagucauccaaaaccaucucauggaauucuuauuuauuuguuuauggguuuaugacuuauauuuacaccauuagaauauaacaccuuaaggguaggugggcacugucuuauucccagcauuuuuccugguuuagaauacugccgggcacauaacccacaccuaauaauaaguauuugacuuuuuuuuuugagacagaguguuggccaggcgcgguggcucaagccucuaaucccagcacuuugggaggccgaggcgggcggaucaugaggucaggauaucaagaccauccuggcuaacauggugaaaccccgucucuucuacaaauacaaaaaaaauuagccgggcaugguggcuggcguagucccagcuacucgggaggcugaggcaggagaauggcgugaacccgggaggcggagcuugcagugagccgagauugugccacugcacuccagccugggcgacagaaggagacuccgucucaaaaaaaaaauaaaaauaaaaaauaaaaaaaaaaaaguguugcucugucgcccaggcuggagugcaaugacuuggucuuggcucacugcagccuccuccucccggguucaagcaguucuccugcaucagcuucccgaguagcuggaacuacaggcacgugccaccaugccuggcuaauuuuuuguauuuuuauuagagacgggguuucgacauguuagccaggauggucucgaucuccugaccccaugauccgccugccucggccucccaaagugcugagauuacaggcaugagccaccgcgcccggccucuuuaaugacugauuuuuguguagacuccaggauauauaagccucuuagagguuuaagcguggcuuaugugcuuuucugugguuuagcuguuggcucugaauuaggagagaacaauauaucuuauugcuguuugggaaagcuuggauuauuuugucaguuuagaauugguguguguguguguguguguguguguguguguguguguauuuuuuguuuuaaucagcuuuugcuugucuuucucuuuagguguacagaaaagaguuaaaauagcaggccugggguggggguggcagcucacaccuguaaucccagcacuuugggaggccaaggcaggcgaggucgggaguucgagaccagccugaccaacauggagaaacccugucucuacuaaaaauacagaauuagccgggcaugguggcacaugccuguaaucucgguuacucaggaggcugaggcaggagaaucgcuugaaaccgggagguggagguugcagugagccaagauugcgcuguuacacuccagccuggucaacaagagcgaaacuccaucucaaauaaauaaauaaauaaauaaauaaauaaauaaauaaauaauaaaaaaauaacagaccugagacugcuaucuuuagaauggccugcuugcaacuuggcccuuagcuggcauuuaggaauuuagauuuugggaguguucccaccauccccaaaccgauaugagugguuuacuaugccuaaaguguuugugcaaacaguguggaaauaugcuuuauauugaaugccucccuuucuucugggaauuuggauaccugcuaggcuaaguaugccucugugacccaugacccaauaaaaacuuuggacacugagucucuaaugagcuuccuugguuaaacaacauuucacacguuuugucacaauucacugcuagaggaauuaaaugcacccuauguaacuccacggaacugauggaaguuuacaccugguuuucuccugacuuugauucaugucuuuuccuguugcugaguuugguuuguauuauuuugcuguaauauauuauagccuugaggcugggugcgguggcucacgccuguaaucccaacacuuugggauuacacccagaugagguggguggauugccugaggucaggaguucgagaccagucuggcccacguggugaauccccaucucuacuaaaaauacaaaaaaaaaauagccaggcuugauggcaugcacgugugaucccagcaaucuggggggcugaggcaggggaauugcuugaccuagggagguggagguugcagugagccaagauggcaccacugcacuccagccugggcaacagagcgagacuccgucucaaaaaacaacaacaagaacaacaacaaaaaaagcauuauagccuugaguacgacuuugugcugaauucugugggucucagggauccccaacacaacaucaaauuugagaacauccugagcagguagguaccuuaugaagauuuugaucucuuuccuacuaugaucuuucucugacaucaugagaaugcucagcaaaaugauaauuuaaucuguuguauucuagauacagaaauauguaaauuaagggaugaauauuuuauuuuugaaaggauuauuugcuuuacaaaagauuucaccaugggcugggcgagguggcucaugcuuguaaucccagcacuuugggaggccgaggcagguggaucaccugagguugggagguugagaccagccugaccaacauggagaaacccugucucuacuaaaaauacaaaauuagccgggcaugguggcgcaugccuauaaucccagcuacuugggaggcugaggcaggagaaucguuugaaccugggaggcggagguugcagugagcccagaucaugccauugcacuucagccugggcaacaaaagugaaacuccaucucaaaaaaaaaaaaaaaaaaaaagauuucaccauaagauugggaaaauagaggacucuugcuugauuuauauacuuaaauuuagaaauuugaguuuacacuaaauuuuauagggacaauuauguuagauuaagauacucuguuuuucauauauuucauaacagaauuugugauacucugaaaucccaguuguauuugucuugagaaguuuguguucugggaaaggaauacuguugcuucagcuauuuaguuauuugccccauuacugcaagguuccuguguuguuuauuuuagauaguucauuuugacauuuagauaaaccaaagccaaacacacaagcaugcccagaauuagucccugaacuucauuccaggguaaagauaagacauuuagacuucuccaguacagauaaauauauuacaacuacugaaaaauggguguuaugugacucuuguauuuuuagauacagaaugacagugaaggucuuaaaaaauuucuaucaguuaaacuuaugggaaaauuuauauucacuuauagauccuacuuuucaauuauagguuaugccuaggauucugugacucaauaacaccuuuuaauaacacgaaugaaaaauauuuaaauuccccugaacuauauguuguccuauucagcucuauauugugucuugccuuugaaaaaauggacuucauugagguauaaacugcaucuauuuaaaacuguacaauuccagccggacacaguggcccacgccuguaaucccagcacuuugggaggccgagacgggaggaucaccugagguuaggaguucgagaccagccuggccaacauggcaaaaccccgucucuacuaaaaauacaaaaauuagccgggugugguggcaggugccuguaaucccagcuacucggguggcugaggcaggagaauugcaugaacccaggaggcagagguugcagugagccgagaucgugccauugcacuccagccugggggacaagaacgagacucugucucaaaacaacaacaaaaaacuacaauuugaugaguuuuuguuuuguuuuuuguuguuguuguuguuuuugagacagaguuucacccuuguugcccaggcuggagugcaauggcaugaucucagcucaccacaaccaccaucucccagguucaagcgauucuccugucucagccuccugaguagcugggauuacagucaugagccaccacuccuggcuaaauuuuuuguguguuuuuaguagagaugcgguuucuccauguuggucaggcuagucucaaccucccgaccuuaggugauccgccugccucagucuccccaagugcugggauuacagucgugagccacugcgccuggccaauucggugaguuuuuauaauuguauaauagucaugaaacuccccaccauacucaacauacaguacauuuuuaucaucccccaaagauuccuuaugccccuuuguauucuguuugccccuugcccuuagcaccaggcaaugacugaucugcuuuagauuacuuuguauucucuaggauuucauaugaauggaaucuauaugcacuugugugugaugucuuuugcucugaacaauguuuuugauauuuauccauauuguuacauaaucuauuccuuuuauugcugaguaguaacuuauauggauguaucacauuuuguugaucaccaauuuaugaacaguuguuuacguauuguaaauaaauugcuauuguaugaguuuuugugugauauaugauuucauuuuccuguuuuguuuuugguuuucauuaauaaaaaagauugguucuaguagucaggcauuguggcuugugccuauagucccaacuauccagagaccaaggcaggaggaucacuugagcccaggaguucaaguccagccugggcaacauagcaagacccugucucuuaaaauaauugguucuaauaguucuuguuaguggcaaaaauuaggggaaagaaguacaucaauaauuuacuuauucaauaaauacuuguugaaugccaaguauaaugccaugugcuuaaaacacaauggugaacaaggacucagccccugcucuuauuuuagcuuauacuuuaaugaacaagcuaagcacauuuacaaguaguaagaauuauggggauugugugcauaaguauagaauguuauggaaguaugugauaggggaucccgccucaguggucugggguaauuagaguaggagucuucagagaaauguuuaagaggaacagaaaguaaauaaaugaggcacuccagguaaagagaacagaaugcaugaaggccuugaugugaaaaagagaaugguacuuuaugugugcuaucuggaugaagcuggagggauuuggaguuucuagauuauguagguccuuguacaacaucuuaaggauuuuggaaauuuuccugaagaugguaggaaaucacuaaaauguuucaagcaaggacgugacgugaucaaauuguggaucuuaucauugcaguuuaauauauacugucuuuuuuuuuuuugaguaaauuauuuauagucccuucauuaucagaaauucugcccauuauuuaaaauucuauuacuuuuaauaauaauuuuuaguaauacuaaguauauacccaaaaggaaggaaaucaguauaucaaagagauguuugcacuccccuguuuacuucaccauuguucacaauagccaagauuuggaagcaaccuaaguggccaucaacaggugaaugaauaaagaaaaugugguacauauacacaauggaguacuauucaaccauaaaaaagaaugagauucuguuauuugcaacaacauggauuggaggacauuauguuaagugaaauaagcuaggcacagaaagacaaauuuugcauguucuuacuuguuugugggagcucaaaauuaaaacaauugaacucauggagauacagaguagaaagaugguuaucagaggcugagaagaauaguggcagaggggguaaggacagggcagaaguggggaugguuaauggguacaaaaguauaauuagauggaaugaauaagaucuaauauuugauagcacaaggugacuacagucaacaauaauuuauuguacauuaaaaauaacuaauagaguauaauuggauuguuuguaauacaaagaauaaaugcuuaaggggaugcauaugccauuuacccugaugugauuguuaacucauugcaugucuguaucagaauauuucauuuaccucauauauaccuacuauguacccacaaaaauaaaaaaauuuuuuguaagagaugcuaucaagaaggugaguaaaauauugcaguaagacuaggaccacuccccauuuuauuauuuuauuucugaauaaguaaaaaaauuuauuuuuaauuuuuguuuuugagacagggucucacugucacccaagcuggagugcaguggcgugaacuuggguuacugcaaucaccaccucccgggcucaagugauccucccaccccagccucccaaguagcugggacuacaggcacacaccaccacaccuggcuaauuuuuuguauuuuugguagagauaggguuuugccacguugcccaggcuggucucaaacucuugagcucaagcgauccgcccaccuuggccucccaaagugcugagauuacuggggugagccacugcacccagcccugaauauguagaauuuaaauaugcagaugcuacuggaauacuaaaguuuuaaauucccauuuauguaagagaaggcuacuugcuggaaguaaaucggggauaaagccaagaggccugguauuugauuuucgguaacagucuauaaccaaguaacuuaccuacuaacuuaucuaguuacuuguuacuuguuaucuaguaacuuguuacguuauugagcacucauuuauaguacuugcucugagucugugaggaggaagucuuuaggagaagcagggauuaucagaacaauuuacaguugugcuuuaauggacaaaaccaaaacaugauuacaauuugacaauuuuguuuauauauagugcuuaguauauuuauauaaacucucuagagcugcacuaucuaaaauagcacuagagacacgugguuauauuaguuggcuuggacugccacaacaaaauacaauagacucgaugucuugaaacaacagcaauuuauuuuuucacagcucuggaagcugggaaguccaagaucaaggugcuagaugacuuggaucccugguaagggcucuauuccuggcuugcagauggccaccuucucucuguguccucacauagcacagagagaggaagcaagcucugcagugucuguuccuauaggguacuaauccuaucucaugacguccuugaaaccuaguuaccuccagaggcuccauguccaaauaacaucacauuguggguuaggguuucaguaagugaauuugagggggacacaauuuuaagucuuacagcaguggcuauuuaaauuuacauugcaauuaauugaaauuaaaacaauacuaaaaauucaguuccucagucacacuaaccguauuucaagugcuuaauauccaaauaaggugacugagagugaugguucacaccuguaaucccagcacuuugggaggccaaguuaggaggauugguugagcccaggaaauugagaccagacugggcaacauagccagaccccaucucuaucuaaaaaauaaaaauaaaaaaauaugacuacugguuacuguauuagacaauguagauuauagaauauuuccauuuucacagaaaauuauauuggauggugcugauauauaguauauggaagucugucaugauagcuauugauacacaaaagacguuagucuuauuuugagugagauacaaugcugugauugugucuuacuugaagucugcuuuccucaguaaaaauccauuauaaugaacuccuuuaagaaguggagaguuuuuuguuuguggggagugauuaguuuuauuuuaaaguguuuuuuggcccaaaaugguuaguuuuauuuuaaaguguuuuuggauuauuuucaugguauguucuuuuguguacuuuuuaucuuaaaauuaaaguaguauugccaggggcgguggcucacgccuguaaucccagcacuuugggaggccaaggugggcagaucaugaggucaggagaucgagaccauucuggcuaacacagugaaaccccgucucuacuaaaaauacaaaaaauuaucugggugugguggugggcgccuguagucccagcuacuugggaggcugaggcaggagaauggugugaaccggggaggcagagcuugcagugagccgagauugcgccacuguacuccaaacugggcaacagggugagacccgucucaaaaaaaaaaaaaaaaaaaaaaaaaaaaaaaaaaaaaaaguuaaguaguauugcuaauuaccuguuucagaucucaucacaaaggacacuauguuuuuuuguuuguuuguuuguuuuuguuuuuuugagaugaagucuugccgugucgcccaggcuggagugcaauggcucaaucucggcucacugcaaccuccgccucccgaguucaaaugauucgccugccucagccucccaacuugcugggauuacaggcgcccaccaccacgcccagcugcccagcuaaguuuuguacuuuuaguagcgaugggguuucaccauguuggucaggcuggucuuaaacuccugaccucaugauccgcccaucucgaccuuccaaacugcugggauuacaggcgcgaaucacugcgcccgaccgauugguucuauuuauguagcacuuuucuuucuuucuuucuuuuuuuuuuuuuuccagagggagucucgcucugucgccuaggcuggaguacaguggcacgaucucagcucacugcaaccucugccuccugaguucaagcaauucuucugccucagccucccaaguagcugggacuauaggcgugugccaccacacccggcuaauuuuuguauuuuuagaagagacgggguuucaccauauuggucaggcuggucuugaacuccugaccucagguaauucaccagccucggccuccuaaagugcugggauuacagguaugagccacuguguccagacuguauagcacuuuucaaagcccuuucauauaucucugcuacucacagugaacccgaguguggagauugcauguaaacuauacaguauacauggcuucauaugugggugucucuuagaagacacacaauagugugaacucuccuaauaacuguauauaaauguguaaguugaaccuguauucuuuccuuuuuucacuccuuucuuuuuuuuaaagugccuugggauuuuuagaaggggauauaccuuuccaauaacccauauacuauugucugccaaauugaccauauuuucaaaacagauuuauuaucuaucuaccuaccuaccuaccuaucaaucaucugucucucuauugagagacacuaguauuagcaucugauccaaaacaaugaaugagauuaaaccucauguaauaagauuuugaguuagaauaauaaauagccuuauauguguuuggguuuugcauacuguagcugucauaucauguuucaguuauucauugcuucagaugauuaaggguuuuuuuuuugugcucagccuuaauauagcucauuuaucaugaacaugauauaauaauuuuucaugacuauuaucuauuucuagugauuucuucaucaauauagauuuauaaugacuuuuuuuagaaugaaagaagaaacagaaaaaugacauaaagaucaauuauuuuuagcaagcaauaauauaaagauauauuauuuuuagcaauauuuuauauauauauauauauauagagagagagagagagagagagagagagagaguauuauagauaagccauuaaaaucuuuggaaaccuaugcuaauuuuucugugucauacuuucaucuuuuucccccaacaucauauaguagaaugagacacuucuacucaaaggacaagacauagauugcaaguuugacuuuuuugguuuuuuuugaaauggaguuuugcucugucacccacacuggagugcaauggugugaucuuggcucacugcagccuccgccucugggguucaagcgauucuccugccucagccucccaaguagcugagaugacaggcacacgccaccacgcucggguaauucuuguaguuuuuaguagagaugggguuucuccauuuuggccaagcuggucuugaacuccugacuucaggugaucugcccacuuuggcgucccaaagugcugggauuacaggugugagccaccaugcccagacuuuacuuguuuuucaaguaaaugauuggacaccuucaguuuaaaugauaugguaacacauggacaauucuguauagugauacuuuuuguuuaaagcauuuauuugccauauauauaauauuuaaaaaauuuuugagccagguacuguggcucacuccugcaaucccagcacuuccggaggccaaggcaggaggaucacuugaguccaggaguuugugaccagccugggcaacauagcaagaccuugucucugcaaaaaaaaaaaaaaaaaaaaaaaaacgcacacaaaaauuagccgggcuugguggcaugugcuuguggucccagcuacucaggagacuuaggugggaggaucccuugagccugaaagccggagguugcagugagccaagguugugccacugcacucaagcugggcaauauuacugagacccugucucaaaaaaaauuuuuuuuuuuaaauuaaaugcuuaauucucuuauagucuaucuuuguuagugugcucaguuagaauuuggccucugcuguauucugucaaauuguccucuuuauccuuucuauagcucugaguuuaacagaucuuuagaauagaugauaaccaguggugauuguuucuuuaaugugcacauuuuucuuuauucaaaaagauggcuuucuuuuuauuugacguguauuuuuugcauucucuaacccaauuuucuuauacauuugggacuucaauuuguaucugccuauaagcaaacuuacuuauaauuacaauuuuuaucccugccaaaucuucccuguguauaaauugguuaucauuagguucuaaaaaguuuuuauagaguuaguuugaaaagcuguucuucauaauuguguacaguuucuagaguuuuacauuuauggaccuaccuugcaugcaauaucuugaagacagaaaaaguguaggcuguucucaaaacguuggagugagaaaguaagauguccugcugccaaauauaaaguuguuuuuauacugucucucugcugaaaauccuuuuuauuuuucuccuuuaagccuuccucuuugauugagugcacucucuucuuuucuaagguuuucguuuuuuggauacuuguuuaacaaacuuuuugucagcuaccauuuggcagcucacuuucacaacccucacacuccucuuuuuaccuacuuuuaguuguuuggcaaacaucuauauuuuuguacaacuuuggcaaaaaugauuuaucaauguagcuccauaccuguugaauaaaaauaguagaaauuauacaucacaagaaauagaaccuuauuaagaauuuucuuuacauuuaacuuuuaaguucagggguacaugugcagguuuguuauauauguaaacuugugucauggggguuuguuguacagauuguuucaucacccagguauuaagcuuaguauuucauuaguuauuuuuccugauccucucccuccucccacccuccacccuuugcuggccccagugugugggguuccccucuauguguccauguguuuucaucauuuaucucccacuuauaauugagaaccugugguguuugguuuucuguuccuguauuaguuugcuaaggauaauggccccaaaaccauacaaauucuggaagacagccuaggcaauaccauucuggacauaggaacaggcaaaguuuucaugacgaugccaaaagcaauugcaacaaaagcaaaagcaaaacaaaaaacaaaagcaaaacgagauuuaauuaaacauaagagcuucugcauggcaaaagaaacuaucaacaggguaaacagacaaccuacagaaugggaguaaauuuuugcaaacuaugcaacugacaaagguguaauaaccagcaucuauaaggagcuuaaacaaauuuacaagaagaaagcaaccucguuaaaaagugggcaaaggaaauagauaguuuucaaaagaagacaugcauauggccaacaauuauaugaaaaaacggcucaguaucacugaucauuagagaaaugcaaaucaaagucacaacgauauaucaucucacacuggucaaaauggcuauuaucaaaaagucaaaaaauaacauaugccaggaagguuguggagaaaaaggaacacuuauacacuguuggugggagucuaaauuaauucagccauuuuggacacaugcacguguauguuuguugcagcacuguucacaauaacaaagacguagaaucaaucuaaaugccuaucagugcuaaucuggauaaagaaaaugugguaaauauacaccauggaauacuaugcagccauaaaaaagaauucuuaaagguugauucuacaucugaaaauuacuugaaauuaaacuaaaaaagcccaguguuuaaauuuuuuggcauuugacauuagaauauccaugcuauggagaaaaagaaaacuuuaagaauauuuuuuaaacagagaagaagaacauacuguacugauaucuugaaggauuucaagcuaaacuaaaaauucaauagaaaaaauaaaauuagugcuaaaggaaguaaagaacagacauuguaguacaaaauugaauaagaggauuggaagaacaccuugagaaacucucacagaagcagaggaaacaaugagaacgauaaaagagaaugugcugauuuuggagaccauggauccauaaucauauauccauaauauaauauggauccaugucaucauuuccaaaaaaagacauaagaaaaaugaaugaaaacaguuaacagagcauacauuaauauuauuuuccugaccugagaaaagaccaaacuuuuuuuuuuuuuuuuuuuaagagauaggguaucacucuguuacccaggauaggcuacaguauugcccuaguaacccagacucuagggugcaguggugcgauaguucaccauagcccugaacuccugggcuccagcuauccaucugccucagccucccaaguagcugggacugcaggcaugcacuaccauauuuaaaaauuuuuuaauuccuugugguuaccuuacuguguugcccgggcuggugcaaacuccuggccucaagcaguccuucugccucagccucccaaaguguugggauuacaggcacaagacgcugcacucggccacaccaaacuuuuuauauugaaaguauugauuaucaaaaacacauauaauaaaaagagaacaggccaagugcaguggcucaugccuguaaucccagcacuuugggaggccaagguggguggaucaccugaggucaggaguuugagaccagcuuggccaacaugaaaccucgucucuacuaaaaauacaaaauuagccgggcguggugaugcaugccuguaaucccagcuacuugggaggcugaggcaggagaauggcuugaacccgggagacggagguugcagugagucgagaucaugccacugcacuccagccugggcagcagagcaagacuccgucucaaaaaaaaagaacaauacuuagauacaugcuaguauguuuguugaauaaaagaacaucaauaagcauguguaauuagucuaaccuuccuagguuguugaaaaggaacuaaaaucaagcuucaccuccaaaaauauaaugcuuauaaugaccugugcaaacaguuuugaacaaaaaugauaauuccaggaagaaggggaagcuagaaaauugagaguuuuaaaucagaagcagcaguucaauugagaauaagaauugacuggauucaguuguuuagcuaaugauaagaaaaaaagaaaaaaugacaucccuuugacauuuucuuaguuauuccacaaacauaucugcauaauuuauauuuuauuguauuuuucuuaucuuuuuaaagguaagaaaucguaauauacuuuuuucuuuuuuuaucauucaauuucuuuuuuuauuauuauuauaccuuaaguucuaggguacugugcacaacgugcagguuuguuacauauguguguaguauacauuuucuuuguuguuucccguaugugguugggguagcauuuugaagagauggucuuuccaccugcaaagcuauuuguauauuagaauauuuaauucuccuggggacuggacuaaaagccagugaaaaugcuucaggcauuuugacagguaaaccaaaacaaaguaaaauaccacuuccacacauuuccaaauucuucucccuugcaugcaguccugccaaaauuaggaaccacuauuuuuuuuuuuuuuuuuugagaugaagucuugcucugucgcccaggcuggagugcaguggcguggucucagcucacugccucccggauucaacugauucuccugccucagccuucugaguagcugggauuacaggcaugcgccugcaugcccagcuaauuuuuguauuucuaguggagacgggguuucaccauguuggcccggcuggucucaaacuccugaccucgugaucugccagccucugccucccaaagugcugggauuacaggcgugagccaccgugcccaggcuaguaaccacuguuuaucuauuaauuuguacucaggguguuaauagagcacguuaauugauuuuuugaauauugaaccaggcuugcauaucugggauaaaccaccccguaccuuuuuuuuuuuuuaacuauacuuuuuuuuuaaaugcugaacuauccacaggcccuuaugguuuuguuuuuuguuguuguuguuguuguuuuuguuuuuugagauggagcuuugcucuuuuugcccaaacuggagugcaguggugcgaucucagcucacugcaaccuacaccucccagguucaugugauucucuugccucagcuccugaauagcugggauuacaggcguacaccaccaugcccggcuaauuuuuuguauuuuuaguagaaacaggguuucaccauguuagccaggcuggucucgaaugcugacaucaguugaucugccugccuuggccucccaaagugccugggauuacaggugugagccacugugccuggccaacauuggauuuuucaguuguauuaccaguuuuauguucaaaacuccuuuaagagguucuauuuuuaugcauugucuuuacuuaacccaaucucuucauuuauaaauauguaaauauuauguauuuagaaaauauauaaugguaaaguuugaaaggaugccugaguaaccaagaacagugguuuccugggguggaaggagggcaacaucggaauagacaaaugggaacaaggguaugagugaagcuuuucacuauauaaucauuuauaaaauggacagauugaucggcugacacuaaaguucuuuucaguguucuaauccuaugaaucaugucuagaauauuuaaacuauugauaaaagaccagcaucuacaaaauuuuuaaguuuucuuauuauuguugguuaauuucaucuccagaauuuaguuauuaguuuuguucagaaacauuauuuaaauaaaucagccucagugcuauggugcguaugaauuaagccauacuaaagguacacauccaaaauaaagaaacaagucagaagcccccaaggaauauauuggccaaguguauuagacuauuauuuuagcuaaucaaacacauuaggaaagccuacuguaagaaaugaaauuaaagaucagauauugcuuucgauaaccuuuuacuuuaguauucucagcaauguugguaaauauuuauuagcugauaaauuauguggcaaauguucuacaaaaauuaguuaaaucggauuauguguguggagaaagauuggcauuaaaaguacauuagguuguccuuuuaggauaagucuauugagcauuucuuuuucugguuauuauauugauaauuugaauaacagaaaguaauuuuuuuggucgugcaugguggcucacgccuguaaucccagcacuuuuggaggccuaguuggguggaucaucugaagucgagaguucgggaccagccugaccaacauggagaaaccccaucucuacuaaaaauacaaaauuagccgggcgugguggcacaugccuguaaugccagcuacucaggaggcugaggcaagagaaucgcuugaacccaggaggcagagguugcggugaggcgagauugugccauugcacuccagccugggcaucaagagcgaaacucugucucaaaaaaaaaaaaaaaaaaaaaagaauuuuuuuuuauugaaguauaauuuauaccugaaguucacucaauuuaagugaacaauucaguuauuuuuuuugcaaauguacacacuugugcaaugguuaccaguuuaauuuuagaacauauauauacccuaaaaagaaaccauguacccauucauaguuacucuuuguaucauuaguuuaccauaccuaauuauguauguaacuuuguauaacugacuauaaaauaugauaaaaguaaguacuaugcaauuuccagaauuauucagccuucuagguuuguuuugaagacuugguaauuuugaacauggacauuuucuuugaugauauuuuuuauuuggacaccaaaauuauuuaauagaagcaagaguggugagaauaauuugaguacgaggggauugcuuuugggaaaugagaauuuuaaaauuuccuucuuguuuggaguuuacaaaugaauucaugaacagaagaacgucauugaauguaaaauuagaaauuuauguaaagauuucaguucaaauaauuuaguagggaaauuuaugaagucauucggauaagacaaagauuuuauauaauauuuugaaaacauuaaauaauuugucauuccuuuauuuccuuuauuuuagcuucgcagaaucaagaacggcuaugugcguuuaaagauccguaucagcaagaccuugggauaggugagaguagaaucucucaugaaaaugggacaauauuaugcucgaaagguagcaccugcuauggccuuugggagaaaucaaaaggggacauaaaucuuguaaaacaaggcaagugauacuuuccuuaccugaaaugacuguguuuuauacaauugauauuuaucuaaaaaggacaugggaguauguuaaaauccuguucagaaaaacagugaauuuaaaaguguauauauaaagccaggugugguggcucaugccuguaauuccagcacuuuucgaggcugaggugggcggaucacuugaggccaggaguuugagaccagccuggguaauaacauggugaaaccccgucucuacuaaaaauacaaaaauuagucggguaugguggugugcgccuguggucccagcuacucaguaggcugaggcaggagaaucacugaaccuggaaggcagagguuguagugagcugagaugucaccagugcacuccagucugggcaacagagcaagacuccaucucaaagaaaaaaaaaguguguguauaucuccacaagccccaaauuuauaaaaggcuauuuauuuuuagauuauuuuuaaaacaucuuucuuauaauguuauacaugcccguucuaugaauuuuggaauauauagagaacuacaaagaaaacaaaagucuacaauaauauacucuuuaaaaauauuuuuacuggccgggcgugguggcucacgccuguaaucccagcacuuugggaggccgaggcggguggaucacuaggucaggagguggagaccagccuggcuaacacagugaaaccccgucucuacuaaaaauacagaaaauuagccgggcgugguggcgggcgccuguagucccagcuacaggcugaggcaggagaauggcaugaagcugggaggcggagcuugcagugagccgagaucgcaccacugcacuccagccugggcgacagagcgagacuccgucucaaaaaaaaaaaaauuaggaacauacuguauaaacaauuucauauccaguuuucuccaccuuaauuauaagcauuuuuccaugucuuuaaagaaucucugaaaaccuuuuuaacuuuugcacaacauaucauuguauauauguaucauaguuuacuuacagauuauucuauugguagacauuauguuauuuucauguuuucacuguaaugcauagugaaacacaguuguucagugaacaacuuuaaacauaauuuuuugauuguaugugauuguuucuugaaauagaucccuugauguagaauuauuagguuauaagauauaucaauauuuuaaagacuguauaaaaauuuccauguggcuuucuaaaaguacuguucauuuauauucucuccaacacuguaugaacgugucuguguuacugaaucauuuuucuuuuuuuauuuuuauuuuuugagauggagucucgcucuguuacccaggcuggagugcaauggugggaucucggcucacugcaaccuccgccucccggguucaagcgauucuccugccucagccugccaaguagcugggacuacaggugcgcaccaccacgcccagcuaauuuuuguauucuuaguggagauagaguuuugccauguuggccaggguggucucgaucuccugacccucaugauccgcccacuucggccucccaaagugcugggauuacacgugugagccaccgugcccagccauuuuucugauauauauuauuuauuuauuuguuauuguauuuuugagacagaaugucacucugucgcucaggauagagugcaguggcacauucauggcucacugcaaccuugaccuccugggcucaagcaauccccccaagucaguaggaccacaacuaggcaccaccauucccagcuaauuuuuaaguguuuguagagaugugguauggcugcguugcccaggcaggucucaaauuccugggcucaagugauccuccugcuuuggcuucccaacgugcugggauucuaggcgugagccaccgugcccagccauauuauuuuuuaaaccuaaaacaauauauuugguauagacaaaaaugaaaccuuacucuugcuuuaauaauucuucgauuagcugggugcaguggcucacaccuguaaucccagcacuuugggaggccgaggcaggcagaucaccugagcucaggaguuugagaccggccugaccaacauggagaaaccccaucucuacuaaaaauacaaaauuagccgggcauggugguggcacaugccuguaaucccagcuacucgggaggcuaagguaggagaaucgcuugaacccgggagguggagauugcagugagcugagaucgugccauugcacucuagccugggcaacaagagugaaacuccgccucaauaaauaaauaaauaauucuuagauuaaucaugcaguuaaaccuuuuuugguggccuuuucccccccaugaaaugucuuugguauccuuuaccauuuuucuguuucuuaaaaauauguuuccuguugauuugcaaaacuguuucauagcuuacacguacucucacauuuauugaaauuacugcuuaguuuguuguuuuucucuuaguuuucuuuaucauauugucuccuuuuuuguauucauauugauuuauaggauguuggucucacauuggagauccccaagagugucacuaugaagaauguguaguaacuaccacuccucccucaauucagaauggaacauaccguuucugcuguuguagcacagauuuauguaaugucaacuuuacugagaauuuuccaccuccugacacaacaccacucaguaaguaaaguaaccaacuuuucuuuguauuuccuuucuccaaagauuugcaaaauauaaaaaaacuuaaaaaacauucaagguugaagccaggcgugauggcucaugccuguaaugccagcacuuugggaggccgagguggauggaucaccugaggucagaguuugagaccagccuggugaaaucccgucucugccaaaaguaaaaaauuagccgggcguagugguaggcgccuguaaucccgcuacucaggaggcugagacaggagaauugauugaacccgggaggcagagguugcagugagccaagauugcaccauugcacuccagccugggcaacaagagugaaccuaaaagaaaaaaaaaauucaaaguuguugggagugagagguagaguuccagcaucauaagauuacaucuggcaaacaccugaaauccgaaagcgaugcaccaggacuuccaaggcaucaauauauuacuaaauaacuuugguaaaauauaguacuggccaggcacaguggcucaugccuguaauuucagcacuuuaggaggccagagcaggaggagcacuugagcccaggaacugaagaccagccugggcaacauagugagaucccaucucuaccaaaacaauaaauaaauuagccaggcgugguggugcgcauguguaguucagcuauuugggaggcugagguuggagauuugcuugagccuaggaaguugaagcugcagcuauugugccacugcccucuaaccuaggugacacagcgagacucugucucaaaauaaaauaaaauguaguacuuuacaaccuguauggagggaaauuugguuaagacaacuacaugugugcuuacucuuucaccuagcuuucauauuucuuggaauuuaucuggaagauacaucuucaauaguacgaauauacauagacauugaguuguuuacugcaguguuauuuguaacugcacaauauuaggaaguaaauguccaagaauaggagauuaguugaaauauacuaugguacauacauguaauggaguaccaacuauacagcuauaagaaaaaaauaagaucucuaugaacuagcacagagugauuuucaccgguaauauuagaugcaaaaaguacauauaguaggcugucuuguauaggacuggaaggaaaauaaaaaagccuaucuauuauugacuuaccuuuaaaaaaagaaacaaagaauaaauagaaaauaaugaacuugguuauuuauaagggauccaaggaaugagacagaaagaauauggaagggagugaauguucucugaguguagcuuuuuuuuugguuuuuguuuauuuuuugguuuuguuuuguuuuguuuuuuugagauggaguuucgcucuuguugccgaggcuggagugcaauggcacgaucucggcucaccacaaccucugccucccagguucaagcgauucuccugccucagccucccuaguagcugggaucaggcaugugccaccacgcccggcuaauuuuguauuuuuaguagagacgggguuucuccauguuggucaggcuggucucgaagucccgaccucaggugauccaccugccucagccucccaaagugcugggauuacaggugugagccaccguacucggccugaguguagcuuuuuguauguaguuuuuacuguuggcaucgugucacuauucuacguaagcaaacaaaauuaaguaccuaacaauggaaaggagaaaaauucuucacaguauacgcaaacugaaauaaaugaacccaauuuuauuuuuauuuuauuuauuuauuuuuuugagacagaaucuugcuuuugucacccuggcuagaguacaguggcacgaucccggcucacugcaacguccaccucccagguucaagugaucuccugucucagccucccaaguagccaggauaacaggugucugccaccacacccagcuaauuguuguauauuuaguagagaugggguuucgcuauguuggccaggcuggucucaaauucccgaccucagauggaugauccgcccaccucggccucccaaagugcugagacuacaggccugagccaccgcgcccggccccaauuguauuucauauuacuauaauaacuacccugauaccaaaguuauugaaagauaagggggggaaaaaaagcccugaagagaaaaagaacuaauucaagugauuuauaagcacaguauuugacuauauacacucuugugcaagacgugauauaaaggauggaggagaauugcaaacaaauacugaacucuuuugagaagauuugucuuuuaguagugugggcaaagcaauucugaaaccaucguagaugcauuauaggauuaagaaaauaaguugaggcugggugcaggggcucauaccuguaaucccagcacuuugggagacugaggcgggcagaucacgagguaaagagaucaagaccauccuggccaacauggugaaaccccaucucuacuaaaaauacaaaaauuagcugggugugcuggugcaugccuguaaucccaucuacccaggaggcugagacaggagaaucacuugaaccugggaggcggagguugcagugagccgagaucaugccauugcacuccagccugggcagcaagagugaaacgcugucucaaaagauaaaaauaaaaaaaaggaacgaagccuucuuagaaaaaugauuuaucccaagacuggagcaggauagauacaagauaagccugggacaucuuguaauguuuuaauaauuuuuguaagaaaguaaggaaagaggccgggcgcgguggcucacgccuguaaucccagcacuuugggaggccgaggcagcuggaucaugaggucaggagaucgagaccauccuggcuaacaaggugaaaccccgucucuacuaaaaauacaaaaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaagaaaguaaggaaagagccuguaaucccagcacuuuggcaggccaaggcaagaggacugcuugaucccagaauuucacaaccagccugggcaacauagaccuuaucucaaaaaaaaauuaaaaaguagccagguguggcacacgccuguagucccagcuacuugagaggcugaggugggaggaucacuugaacuugggaagucaaggcugcauugagcugugaucaggccccuguacuccagccugggugacagugagacccugucucaaaaacaaaacaaagcaaaaaaaggaaggaaaaguaccuaaaaauaucauggagacuugucauaaggacacaggagccagcuggaaggaacucccacuggcuaaaucugggucaauuugagugcuaaacaaguacauuaaugaacugugaaccacuggaaggaaaaugaaucaugaguagaaugucaagugccaacugguaaauguaggauugcuggaguuggcagcuuaucauucugcaaccauuguguuaaggauuggaucaggcaagaaucaucaaaggauccuaaaucuaggggcaguuucaaugaggagccaggauauuugcaugccuuccacauaucucaagggaaaaguuaguaauuauaaaaugggaaaaauggacaccuugaccagguaauaaaaguuaacauuauuaaagaaggacacauggaaauccaugauaccuagagaaggacacauaacuaauauaguacuauauuccagucaagaaugcauaaccugaauuuaaucaugagguaauaucacacaaaccccaaauuaggaauguucuguuacaaaaagggggaucgcauuuuucaaaaaugcgaaugucauauaaaacagacugugggaaaggucuaggucaaaggaagcaaaaaagacuggacgacuaggcagugccugucuuuuacuggaugagaagaaugugauaaaggacaugaugauuagagaaaaauguuguuucaauguuaaaugugcugaagcugauaauacugugguuuuauaagagaauaaccauauucuuaggaaauaaucuaagaaguguuuaagaauaaaggaccaugauucuacuguguauugguucaaaaaaagauuguguguguguguguguguguguguguagaaagagguaauaaaagcaaacaguaaaaugguaucaguaggugaauagguaaaucuggguaaaaguauaugguguauucuuuguacuauucuugugacuguuguguaagguuuaaauuauuuccaaauaaaaauuuuaaacaauuuuuaaaguuuaaaaaguuaaaauauagcacaucucaagaauuuucuuagucaaccaauuauaacagaccauacucuaggaucaucaguuuuggauuauuuccuuugauuuguugaugaagcacuaaacugaaagcaauaggaaauuuucuuuauagcuguaguuucuaccuauugaaggccauuagcuucuauuaggagauuguauugaauuggauacauuuauuuuucacaaacaaaacaaagucucuaauuuucacuuguacuucuagcuagaugaaagagagaaaguggccaugugcgguggcucacaccuguaaucccagcacuuugggaggccaagguggguggaucaccugagguccggaguuccaugccagccuggcuaccaaggugaaaccccaucucuacuaaaaauacaaaaauuagccgggcaugguggcgcaugccuguaaucccagcuacuugggaggcugaggcagaagaaucacuugaacccaggaagcagagauugcagugagccgagauugcaccacugcccucuagccugggcaacagagacuccgucucaaaaagaaaaagaaagagagaaagugaauuuguucauacauauccucaaagaucuuuacagcugccuuacauuucagauuguuaccuaggucuuaguuuaguuuacuauaaccuuuugacccaaaaguaggaauauugccagcuaggaaucaguaaugcuauugcaauaaaaagggaaaguguuuuaaguaaagcgcucuaauuuggaagcauuaacucaauuuauauauuuuguucuugagacaaaaaaauugagugaaguuaaaguuggcaaacaagaucaguuuuggcuuuugcacuaaccucaagaaaaauaacuacuguaauaucaaaugucagacauuuagucugcaauugcuagguguuuaaccaaaauaaaaauaauuuuauuuguugaaguuuaaagaaagaaaauauaaaaaucagaaacagaacuuuugcucauggccauauaacaauaaauagaaaguuuggugauggugaguuuuuucuccuuuaaaauuuuucauuauggcagggcacaguggcucaugccuguaaucccagcacuuugggaucgcuugaucccaggaguuugagaccagucugggcaacauggagaaaccccaucuguaccaaaaauacaaaaauuagcugggcauaguggcgcacaccugugaucccugcuacuugggaggcugagaugggaggaucacuugaguaugggaggaucacuugaguuugggaggcggaaguugcuguaauccaagauugcgccagugcacuccagccuaggcuacagagugagaaccugucuuaaaaaaaaaugaacauaaaaauuuuaacaaaaacacauuuuaaaauuacaaaaaacuggccaggcgcgguggcuuacgccacuaaucucagcaguuugagaggccaaggcgggcggcucacuugaggucaggaguuugagacauccuggccaacauggaaaaacccugucucuacuaaaaauagaaaaaauuagcugggugugguagugggcgccuguaaucccaccuauucgggaggcugaggcacgagaaucgcuugaacccaggaggcggagguugcagugagcagagauugugccauugcacuccagccugggcgacagagugagacacugucucaaaauaaauaaaauaaaauaaaauaaaauaaaauagccaggcgcaguggcucaugccuguaaucccagcacguugggaggccgaggcaggcggaucaugaggucaggaguucaagaucagcuuggccaauauggugaaaccccaucucuacuaaaaauacaaaaauuagcugggcaugguggcacaccccuguagucccagcuguucgggaggcugaggcagaagaauuccuugaacccaggaggcagagguugcagugagccgagaucaugccacugcacuccagccugggcgacagagcgagacucugucucaccaaaaauaauaaaauaaaaaauaaaauuacuaaaaacugugcaaacuuagcaaagaaauaaguggaucgccgggcacgguggcucacaucuauaauuccagcacuuuggaaggccgaggcagguggaucaugaggucaggaguucgagaccagccuggccuauaugacgaaaccccaucucuacuaaaaauacaaaaaguauagccaggugugguggcaugugccugcagucccagcuacucaggaggcugaggcagaauaaucucuugaaccugggaagugaagcggagguugcaguaagcugagaucgugccacugcacuccagccugggcaacagaaagagauuccgucucaaaaaaaaccaaaaacaaaacaaaacaaaaaaguggguagugugggaagacuguggaaagguuauuuuuuauuuuuuugaggcggagucucgcucugucgcccaggcuggaguacgguggcucacucggcucacugcaagcuccgccucccggguucacgccauucuccugccucagccuccugaguagcugggacuacaggcgccugccaccacgccuggcuaauuuguuuuuguauuuuuaauagagacgggguuucaccguguuagccaggauggucucgaucuccugaccucaugauccgcccgccucggccucccaaagugcugggauuacaggcgugagccaccgcgccugcuggaaaggucacuuauuauuccuauaguuuuguauuguuugaaucuuuaauuuaaaaugagaauauauucauguauuauuuguguaaccaauaaccugcuuguuuauuuggaaaaagagaaaaaugacauaaguagcaaggaaaaaaauaaucuccaauagucucuacacccauauacaaccauuguuaauauuuagaauguuucuuuccagucuuuucucuuuuauuuuugcguagcuguauuuguaauauacauccauuuuagauccugccuuuuuguuuaacauaaauauuuuccagguuacuauauauguuucauaguugucagguuuuuguuuuguguuguuguuuuuugauucggucucguucuguugcccaggugggagugcagguuuuuuguauuuguauuuuuaguaguuuggccaagcuggucucgaacuccugaccucaggugauccaccugccucggcuucccaaaguguuggaauuacaggcgugagucaccacgcccggccacauuuuuauacuuuuucaaaauacuaguguaacaucucacguaccccauaaauauauauaccuacuauguacccacaaaaauaaaaaauuaaaaaauauauauuaauguagaaggcacaggauaagagaaauauaagguugcauccuuuaggaaaauauuaauucuuuaaugcaguaguaacaaaauuccauuuacacauuauuuauuguucaucagacaguuuucauucugaaguuuugcuagcucugcacuucugaaugccagccucuaucccguaucuacccuaccuaccuaccuugcuccucuucucucaaaaaguaauccuuuuucauguugggguuuuuaaaauuuuacauuacuuauuugccugaugaacaaagcaaaaccuguuaacugaccuggcuuuuacugauaaacucaguggaagcuuuucgucuguaaaaucuaagucccggccgggugcaguggcucacgccuguaaucccagcccuuugggaggccaaagugggcagaucaccuaaggucaggaguuugagaccagacugaucaacauggagaaaccccgucucuacuaaaaaaaaaugcaaaauuagccgggcgugguggcacaugccuguaaucucagccacuugggaggccaaggcaggagaaucgcuugaaccugggaggcggagguugcagugagccaagauugcagcauugcacuccagccugggcaacaagagugaaacucugucucaagguuaaaaaaaaaaaaaaaaaaaaaaaaaaaucuaagucccaagcauguaugguggaauugaccaguguuuaauaaauaucuucugaaauacuagacagaauugguugcagacuaugaaauaauuuccaugucuuuauuucaacaacugcaauuuuuauugucuuuuuaggauuuccaauuccaugugucccucucuuccugccuuaacugugucucauuuccuuauaaugugcucucugauuacugagcauuuucugcguauuuucauaugcaaaaacuaauuacccaucuaauaauuauuuagugguuucagauacagacguacuauaauagagucauagauacauggaaacauuuaaaauacauucaaaaccaagaugagacuagccaugauuugaguaacaagcaucuuuaaaauaauguuaaauaggcugggugcgguggcucaugccuguaauccuagcacuuggggaggccgaggcggguggauugccugaguucaggaguuggagaccagccuugguaacacaaugaaacccgucucuacuaaaauacaaaauaauuagcugggugugguggcaugcgccuguaaucccgguuacuugggaggcugaggcaggagaauugcuggaacccgggaggcggaaguugcagugagcugagauugcgccauugcacuccagccugggaugcagagcgagacucaaaaaaaauaaauaaaauaaguuaaauaauaguugaacagacacaacuuugacuaagaauacacggacaacuucaauauacuguuuugagcacuucucaaaaugucucauuaaaaacaacacauuuuguauuagcuguaauaugaaauuagcuuaaucaacugccaaaaaaaaaaaaaaaaggauaauuugagggagagaagcauaagguuucacuugauuguuuggaauguuauauaguguaaugauuaagagcauaggucaucagucguagugccuggguuaaaaaccuugcuguuaaacuugcuaaacauaaccuugagcagauuauuuagccucugugcaucaauuacuucauaugcaaaauaauaguauccaauuuauguggguguuuagauuaaacaagauaauacacuaaagugcccacauagagaagacauucaauaaauaacaguuacuuucuuaggaaauaacugucuuuaagucauuuuagaaacuauuacaaacauccucccccauaucauuuuccuuuuaccauaaaggauacuuuucugcuaauuuuuauuuauuauguaugaaagccuauauucugugauuuuuuuuuuaauuugaaggauuguuauugaguuuccuaugauauuuguuguuuccuauguccuuauacuugagaaacagaacacauacuauuuccugcaucuuucauacacagaaaaaaaauaaaagcuaagccgggagcgguggcucacaccuguaaucccagcacuuugggaggccaaggcgggcggaucacaaggucaggaguuugagaccagccuggccaauaugaugaaacccaccucuacugaaaauacaaaaauuagcugggcaugguggcaggugacuguagucccagcuacuugggagacugaggcaagagaauagcuugaaccuaagaggcggagguugcagugagcugaauucaccccacugcacuccagccugggcgacagagugagacuccaucuccaaaauaaauaaauaaauaaauaauaaaagcuauaggaaguuguuccugaaaaaccagauauucugccuuuuuuccuccaauuguauauuuguaaaaguguuuagcaauaaguaagaggcaguggauccucauuguuccugaauuccguuuugccccccuuuuacuugcuaaaauguauuuguaaccccaaaaccaauauucacagugcuuucaugguuauuccuagacaugcacagaguggcaaaaaauucaagucacccaaggugcacguuccuagcuuagguugaagaaggcuaugcucugccuucuuguuucaguugucauacuguaaacaaguaucuuuuucagucuauuuagugguauucuuuugcauuuuuaugcuuuuuguugcuuuugugguuugaaauggccugcaagaguggugccaaagugcugucuaguauuccaaagaacaagaaggcugugauacaccuucaggagaaauacgugugugagguaaaauucauucaggcaugaguuauagugcuguuggccaugaguuaagugucaaugagucaaccauauacaaccauauacaguauguuaaauaaguugucuuuaaacagaaaaacauaaaagaaggcuauguauuuggaauggguugacagaacguugugacuugaggcucuuuuuaaguuaacagggcaugguggcaugugcccguacuuccaaaguagucccaacuguuuggaaggcugaggugggaggaucauuugagcccaggaguuuaaggcuacacugagcuaugaucacucuacugcacuccagguggggcaacaaagcaagaccgcucuaagaagggccaggcauggcagcucacaccuguaaucccagcauuuugagagccugaaguugguggaucacuugagcccagcaguuucaauaguaacuugggcaacauagcaaaaccccgucucuacaaaaacaaaacgaaaugaaagaacaaaaagauuagccaguugugguggugcauguuguagucucagcuauuugagaggcugagaugggagaauuaccugagcccaggaagucgaggcugcagugagccaugauuacaccacugcacuccagccugggugacagaccgagacccugucucaaaccauaaauaaaaauaaaaaagaagaaaaaaaucaaaaguguauauauugugguaggcagcuucugacaugguucccaaugaucccugccuccugguauucucacccuuguguaauccuguccuucugaaugugagcuagacuuaauaacuugauuuuaacaaauuagacaaaagugaugguauaucacuucuguaauuagguuuuaaaagaccaugacuguuauuuugcugauguguucucucuggcucuucuuuugugcuugcucuguugaagagggccacuugacaaagaacugaggucagcuaacuugccaauacccagcaaggaacugaggcccauaguccaacaauuugugaacccugccaacagcuauugagugagcucagcgauagauacugucuuaguugagucuugagaugacuauggcaccagccuacacccugauuacagucuuguaaaagauccuggcagagcacuuauauaaacaguauguagauucccauagaaacugugagauaauaaaauuuuuuuaauaaaaaaaaguagagcaguuuagguugauagcaaaauugagaggaaagaagagaauucccguuaucuccccucugcucccacacaugcauagccucccccauuaucaacauucccaccagaguggcacauaauacaguuaaguauuuguauuuacacauuaaaaccuccaaacacaugcuugagauggggugugcaguaauaagcacuacuguguuuuaaccuuuggcagcuuuuauucuuuccucccaacuuucaauuauuuucuuuucauuuccaauuuuuuaaccuuucucuacuugaaaauagugaccaguuucuuuuugguuauagucauccuaauguguaugauguaauaucucauuaugguuuugguuuucauuuccguaaugaauaauggugaugagcaucuuuuccugugcuucuuaaacauuguauauuuuauuugguaaaauguuaauucaaacccauugcccauauaaaaauugugcauauuugucuuuuuauuguugaguuguaaaaguucuuuuuacauaguagauacaagucucauucuuuggcuugucauuuuacuuaguuggugguauucuuugagguacauaguuuugacauuuuuaaugaagucuaauuuaucuuuuuuuauuuugucacucugaaaccauuuucuuuuucuuuuucuuuuuuuucuuuuaaauggagccucacucugucgcccaggcuggagugcaguggugcgaugucagcucacugcaaccuccaccucuuggguucacgcuauucuccugucucagccucccgaguagcugggauuacagguguuugccaccaugccuagcauuuguauuuuuaguagagaugggguuuugccauguugggcaggcuggucucaaacuccugaccucaggugaucugccugccucggccucccaaaguccugggaauacaggugugagccaccacgcccaaccugaaaccauuuucuaauacacagucacaaagguuugcuguuguguuuuuuucuugggguuuuauaguuuuagcucuuacauuuaggucugugauccauuuugaguuaauuuuuguauauggcaugagguagggaguccaacuucauucuuuuguuugauauccaguuuuccaguaucuuuuguggaaaauauuauuuuucccaauugaaaagucuugguauccuugucaaaaaucaauugacaggccgggcacgguggcucaugccuguaaucccagcacuuugggaggccgaggcggguggaucaugaggucaggagaucaagaccauccuggcugacacggugaaaccccaucucuacuaaaagauacaaaaaaauuagccaggcgugguggcaugugccuauaguccuagcuacucaggaggcugaggcaggagaauggcaugaaucugggagguggagguugcagugagccgagaucgugccacugcacuccagccugggcgacagaccgagacuccgucuaaaaaaaaaaaaaaaaaaaaaaaaaaaucaauugaccguaagugcaaagguguauuucugaacucuuaauucuauuccauucaucaauaugucaaggauccauugauccuuaugccaggaccacacugucuugauaacuauugcuuuguaauuaguuuuaaaauagagaaagcugaguucuccaacuuuguucuucuuuuucuuucucuucucuuuucucuucucuucucuucucuucucuugagauggaguuucacucuuguugcccacacuggaguccaauggugugaucucagcucacugcaaccuccgccucccagguucaagcaauucuccugccucagccucccgaguagcugggauuacaggcuugcacuaccaugcccagcuaauuuuuguauuuuuaguagagacaggguuucaccauguuggccauggcuggucucgaacuccugacucagcugauccgccugccucagccucccaaagugcugggauuacaggcgagagacaccgugccuggccuguuuuucuuuuucaagauuauuauggcuguuuuggguuccuugcauuuccauaugaauugugaucaguuuuccauaucugaaaaaagacaacugggauuuugauaggcaguuuggggaguauugcuauauuaacaauagaaagucucuuaauucaugaacacgauaucuuuccauuuauuuagaccuuauuucauuuauuucaacaauguuuuauaguuuacucaguguacaagccuuacaguucuuuuguuaaauuuauuccuaauuauuuuucagagcaguguuuucugucuuagucaagacagcugcauguaguguauguacguuacaauaaauuauuuuguaaaaauuuuagcugugguaaaauacacaaaaugugaaauuuaucgucuuaccauuuuuaaguguacaguucaguauaguuccuauugucguacgaccaaucuccagaacucuucaccuucaaguacugaaacucuauacccauuaaauaacaacucacuauuaccccuucuucucaggcccuccagccacccucuacuuucugucucuaugaauuugacuacucuaaguauaucauauaaguagaaucauaucauauuugucuuuuugcaacuagcucauuucacuuagcauagugucaugaagguucauccaucuuguagcauguguuagaauuuuuuugaaggcugaauaauauuccauuuuacguaaauacuacauuuauucauccauucauccaucguggacacuugaguuacuucuaccucuuggcuauuaugaauaaagcuccaaugaauguagguauacaaauaucucuuugagacccugcuuucaauucuuuuggauguauaccaagaaauagaauugcagaaucaugugauaaaaaugcuauuuuuaauuuuuuuuaagagacagggucuugcuuuguugccuagacuggagugcaguggcacgaucauagcucacuguaaccuugaacuccugggcucaaaugauccuccugccucagccucccggguagcuaggauuacaggcacaugaccccaugccugucuaauuuuuuuuuuuuuuuugagacggagucucacugugucgcccaggcuggaguacaguggcacgaucucggcucacugcaaccuccgccucccagguucaagcgauucuccugccucagccuacugaguagcuaggauuacaggcacccgccacuauguccagcuaauuuuuuuguauuuuuaguagagacaggguaucaccauguuagccaggcugguugcaaacuccugaccuugugauucaccugccucggccucucaaagugcugggauuacaggcaugagccaccacacccggcugcuaccuggcuaauuuuuaaauuuuauuuuagagauaggaucuuacuauguugucaggcuggucgugaacauucagcuucaaguaauccucccaccucagccucccaaagugcggcgugaaccacuacgccuggccuaguuuuaauuuuuugagaaccuacaaggguuccaguuucuucaccuucuugccgucacuuguuauuuuuuuuaaauagucgcuguccuaaugggugugagguggaaugucauugugguuuuguuuuauauuucccuaaugauuggagauauugagcaucuuuuuaugugcuuguuggccauuuggaaaaauaccuauucagguccuuugcccauuuuuuaauugggucauuuguuuuauguuguuaaguuguaggaguucuuuauauauuuuggauauuaaccacuuaucagauauaugauuugcaaauauuuucucccauagcuugccguuucacucuuuugauuguauccauaaugugcaaguuuuuauuuuuguuuuuguuuguugguugguuuuuguuuuuuuguuuuuguuuuuuuuuugagauggagucucacucuguugcccaggcuggagugcaauggugucaucucagcucacugcaaucuccgccccccaccccgccuacccgcccagguucaagccauucuccugccucagccucccaaguagcugggauuacaggugugugcuaccacaucuggcuaauuuuuguauuuuugguagcgaugggguuuugccauguuggcuaggcugguauggaacucccugaccucagugauccgcccaccuaggccucccaaagugcugggaucuauuauaggcaugagccaccacgcccagcccaaaguuuuuacuuuggauguaguucaauuuaucuauucuuuugcugccugcaagagguaauucuuuauuugguauuggaacuuguuacucaggaauguguucuuuugaccggguacaguggcucaugccuguaaucccaauacuucaggaggcugaggugggaaaaucauuugaugccaggaacuugagaccagccuggguaauauagugagaccuugucucugaaaaauaaaaagaaaaguuagcugggcauaguggugcacaccuauaguccuagcuacuccagaagcugaggcaguuggaucacuuaagccuaggaguuugaggcugcagugaggugugacugcacucaggcaucaugagagaguaucuuacucuauauaacuaacccagaagaugauaaaaauuugaaguaagauuucuauacauugcuuuuaagcuaugguaaagucaaaaaauuuuaagucgggaagcaucuguauuucucauuuucaacuguuacaggaacuacuuuaaacagcacagauauucuaaacacaucacuuugguuguucccccaauacuugucuguuguuuaaaaaucaaggcuuuguguuauaauaugcuguucagugucagugucuaauauuuccuuccuuccuucccucccucccucccuuccuucuuuccuuccuuccgaaaaaaaauaaggccgggcgcgguggcuuacgccuguaaucccagcacuuugggaggccgaggcggguggaucaugaggucaggagaucgagaccauccuggcuaacacagugaaacgcugucucuacuaaaaauacaaaaaauuagcgggcuugguggcaggcgccuguagucccagcugcuggggaggcugaggcaggagaauggcgugaaccugggaggcggagguugcagugagccgagaucgcgccacugcacuccagccugggcgacacagcgagacucugucucaaaaaagaaaaaggcugggcgcgguggcucacgccuguaaucccagcacuuugggaggccgaggcagguggaucacgaggucuggagaucgagaccguccuggcuaacacggugaaaccccgucucuacuaaaaaaaaugcaaaaaauuagccaggcgugguggcgguugccuguagucccagcuacucgggaggcugaggcagaagaacggcaugaaccugggagguggagcuugcagugagccgaaaucgugccacugcacuccagccugggcgacagagugagacuccgucucaaaaaaaaaaaaaaaaaaaagaaagaaagaagaaaaaaaauagagaugaggucucacucuuucacccaggcuuguuucgaacuccugggcucaagcaauccucccgacucggccucccaaagugcugggauuacagacaugagccacugcgcccagccaaugcccuaauaguuucuaauuauuuuugaauaauauaaaugguaauuaaugccucuguuuuuuaauuauagaacuuuaagauguguuuagugauccuaaguaugacugguuuuuaccugaaacuuuuuuuuguaggguugccauaauaaauuaucacaaauagggugacuaaaaauaacagaaauuuguucuuggacagcuuuggaggccagcagucuaaagccaagguauuggcugaguugguuccuucuggaggcuguaaaggagaaucuguuacaugccuugagaucuccuagcuuugacagguuucaguaaaucauugguguuccucgguuuguagcugcguaauucuaaucucugcuucugccuucacauggccuucaucucuaugugucucaaaucucccuuugccuuuaucuuuuuuuuuuuuuuuuuuugagacagagucucacucugucacccaggcuggaguguaguggugugaucucagcucacuacagccucugccucccggguucaacggauucuucugccucagccuccugaguagcugggacuacaguugcacacgaccaugccugcuuauuuuguauuuuugguagaguugggcuuucaccauguugaccaggcuggucucaaacuccugaccucaagugauucgcccgccugggccucccaaagugcugagauuacgggcaugagccagggcacccagccccuuugccuuuaucuuauaaggacaucuguccuugaauucaggaaccaccauaugcaggaugaucucaagauccuuaauugcuaagugagggcuuagugccuagggugagggcaagggcaguucucuaaagaacugccauuggccuuuaggauaaaacaucaguuguaccagaccaucccaagcauugaaggauuuuaaaguuccuggucuacacucauuaaugccaauagcccucuaacccuaauaugacaauuaaaaaaaaugcccccauacacuuucacaucccuuucccagcaggaggaggaaugcuugucuuaagaaagaaaggauauuuagaacauauauugccuuacuucuccaugcuaauggaaggcauaaugucauacagaaaaguagaaaacagacacagaauuagugucucucuuuugaaauugucuacuuaccuaucaacaugaguucugaaauauuuguauuauuuugaaauagcaaaauaaugagacaggccgggcaggguggcucacgcuuguaaucccagcacuuugguggggcaaggcaagcggaucacuugaggccaggaguuugagaccagccuggccaacauggcgaaaccccaucccuacuaaaaaauacaaaaaaacuuagccugccugguggugcacgccuguagucccagcuacucaggcggcuacagcacaagaauugcuugaacuugggagguggaguuggcagugagccgagaucgcaucacugcaccugggcaauagagcaagacugucuccaaaaaaaaaaaaaaagacacauuaaaggcuuauugcacauguucguagucuuauuucaauuuuuauucaucuucagaaugaauuauauggaccauucuacuuagaauaaagaacuuuaagacugggcauggugguuuacaccuauaaucccagcacuuuggcaagccaaggcaggagaauugcuugaguccaggaguucaggaucagccuaggcaauauagugagacccugccucuacaagaaauuuuuaaaaaaauuagcugggugugguggugcacgccuguagugccagccacucaggagucugaggugggaggaucaccugagccccagggagauggaggcuacagugagcuguguauucucaugggucuuauauuuugaaagaaauuaugcuguacaaauuauacuuauuauaauugauuuccccauuuuuauuaauaaaaaaaugccugccuaauagagcuuuuuauccgcaugauagcaaacuauuuuuuaauuauguucugaaaauaaaauuuuacuuaagcaaagacaccuggcauauguaagccuaugaagcuuuauuaugcauaaauaaguuugauuuucaagagguuuuuuuuucuaacacugaaaguaacuuagucuguuuuauaauagucaucuaggaacuuaauggcuaaagaagaccccagguugggcacuucuaaugaauuuguagacugaaaauugagaauucuguauaaugaaucagauucauacaucagaguuaauacuaacaagaauuugaacauaauaauuuuccuggaauaguaaguaguuugucuuuauaucacuaauaaauaaugaucagauuuccaugaaacuugaauuacaguuaaaaaaucaauaagauaaaaacguagaggauaauauuugaggcugcuucucuaucacaaaucaaugcaaacgccagaacacugcuauaaagucaaguguucuauucugaaggguuuacuuugccuguauugcaccacaaucaaguuauacuuuuuguauuuuucugaacuggucuggguucaguuuccucgaagaaaauaccaccuagcuaguuuauguaagaaaggacagcaaauuauuaaaaugauugcagaauuguugagagcacuugaauaaugauccucaaacuuuagcauuaaucaguaucaguuuggaggcccuugaaaacagauuguuggccccacccucaagauuuuuuuacuauaggggugcaccaccaacacccggccaauuuuuguaauuuuaggagagauuggguuucgcuauuuuggccaggcuggucuugaacuuuugaccucaggugauuagcaugccucacccuuccaaagugcugggauugcaggcgugagccuccgcaugccacugcgcccagccuauuuccaguauaaucuugucauuagugcuccccaucauguauuuauucauguauccauucauucauucaacagguauugaauacacacuaugcaugcaagccacuuucaaauauuggcaauaaagaggugaauacgauuuuguuucucauucucuuuauuaucccuauccgugaacuccuguugaggguauaaaggugaauaugucaggaaggaauauggguagauuggaauauuguaauuaugccaauaauuacaauauuaugacauaagugcugacaguauuauaaagcauuuuauaaauacugaaaauugugugaguucagguguuuauauguauauucuuaauauuuuaaaaauaaaacaucuuuugaaaaaggugagaaccacccuuagacuguuuuuuaaaaugugaaauuuacugucuuaaccuuuuuaaacaaaaaaacaaaaaaacagagucagguucucacucugucucccaggcuggagugcgguggcaugaucauagcucacagcagccucaaacuccugggcucaagugauccucccacuucagccucccuaguagcuagaaucuuuuuuuuaauguuuuguagagacagggucuugcuguguuccucaggauggucucaagcuccuggcuucaagcaauccuccugccucggccucccaaagugcuagaauuacaggugugagccagcaugcacagaguuuaaccauuuuuaaaaauauaaaauuuacucucauaguaauuuuuaagugcacaguuuaguagcauuaagcacauucacauuauuguguaaccaaccuccagaacucuuuuugucuugcaaaacugaaacucuauacccauuaaacaacucaccaaucuccccugcucccaacccuuggcaauuaccauuccacuuugugucugaugaauuuuacuacuugagauaccucauauaaguggaaucauaagguaucugucuuuuuguuacuuuuuuuuuuuuuuuuugagguggaguuuugcucuugucgcccaggcuggaaugcaacggcacaaucucagcucacugcaaccucugccuccuggguucaagugauucuccugccucagccucccgaguagcugguauuacagguggcugccauuacacccagcuaauuuuuuguauuuuaaguagagaugggguuucaccauauugaccaggcuggucucaaacuccugacaucaggcgauccacccuccuuggcuucccaaagugcugggauuacaggcgugagccaccacgcccggccuuuguuguucuuuuguaccauuuuguguacuguuuuucagauuuuaaaguaaauggagauaugaaaaaagaaaaacaaaguuaagggaacgaaaagcaaggaauaagacaauuauaaaaguaaagacaguggugauuaauuuaagucacaauagauggaauuccuauauaaccuagagagaaaguuagaauauaauuggacuaagaagaaggugcugaagauagaaguagauuuaaaguuguaguuuaagguuuauacaucucacaagugguaaauaaauguugaucuuuaggaauauuacauaucuuaccccacaaaacaacugaagugcuguguuuuaaauaaacaaacaugauuaauuuuaacaguguuaaaaauucauuuuauaguuaguagugggauucugggcauuacuuacagacuccuuuguuuggauaaaauuuugucuacaauugugagaaaaacauggacagaauuuuuagaaaauugaaaguuuuauauguugacacacaccuacguaagauguuacaugggcaguaguaggcauacuaauauaucagucagcuguugcugauaauacuucaucagcaagccaccccuaagcucaguggcuuuaacaacaagcauuuauucucauaaucauagguuuguagaacagcuggauuuuggcugaucuaggcaggacucagcuucaggcuucaggaucaauucauaucuuuuugucugggacccacgaucaaggggcaacauuuacucaagcuucuaucaauaguggauugccugcucauaagaagugcaaacgcagcuacccaagcauauuuuagauuucugcucgccuuauauuugucagcuucucauuggucugaucaaguuauguggccagauucaaagucaaggggcaaggagguacacuccaucuaucacgaggccguggcagaagguggauauauuuucauuauagggaagugacaauuuuaggaaguaaagagaguuaccuucuaaagucaaaagguauguacacacacacacacacacgagguuguacuaaauauauagcuacucaaagauauguauauauacacaaaugcacacacacaaguauguauuggaaccuauacauuuaguaccacuuauuuuuuguguaugguauacauucauuuccuugaaaaugaaaauaaguucuuugcauguaagaauggacauccaaaauguacccacaaugauauaaauaaaaaauacuuuucucacucugcuagcuuuuacuuuugucuguuuuuguuuuauuuuguuuuaaaaccaagauagaguuggauuaaaaauagaacuuccugcauaugccagaauuucuccagugcuucuaagcaggacaugugaaugccucugagacagguuugcagacagaaauauguacagggagaaagaagagaacauaaaagaauaggaaggguaaagaguaggauuagggaaaagaagugucuguuuuagagaucaaguaccagcaacaauuaaucuaaacuccccuuagggucaucagugcccuugauauuguuacuuccuuacucucacuauauaaggaguaugguuuguaggaucugagcaauguuuuuuuguuuuuguuuuuuguuuuguuuuuuguuuuuuguuuuuggagacagagucuucuucuugcccaggcuggagugcaguggcacaauuuugacucacugcaaccucagcuucccagguucaauugauucuccuacccgaguagcugggauuacaggcaugcaccacuaugcccggcuaauuuuuguauuuuugguagagauggggucucgccauguugcccaggcuggucuggaacuccugggcucaagcaguccucccaccucagccugcugaguagcugggacuacacagaugcgccacuacacccggcuaaucuuuuaauuguuuguagagauggggucuuggcagguugucuaggcuggucuugaacugcugggcuuaagugauccucccgccuugggcucccaaaguacugagauugcggucaugagccacugcuccgagcccacccuaccucuuuauucccaagcuuuucugucuauucuguuccuucccuaaguacgucucuuuuuuuauuuuuuauuuuuuuuugagauggaguuucacucugucccccaggcugaaguacaguggcacgaucucggcucacugcaaccuccgccucccggguucaagcaauucucuugucucagccuccagaguagcugggauuacaggcacccaccacuacacccagcuaauuuuuguauuuuuagcggagaccagguuucaugauauuggucaggucaggagauccacccgccucagccucucaaagugcuggaauuacaggcaugaggcaccacgccuggccaggugcaucuuuuacuaacucuggccugccuuauugcugacuacugccucuagugccaaaagagaaacaacuagaggauguacagccuauuugucugcuucauuuaaaauucuucucuuagcaacaaaauuaaaguccuaaauauaacuaaaaaaucaaauguauacauuuguggaauguaaaaggaauuacacacaauguucuuuuuauugucauuauaguccccaggcuccuuacaaggaaaaguagcuacauuuguuacauagaaaaacagcccugaauuauuuucagcuacauacaaacaccaugguuaaaucuucaaaacauauuacugaacugaagaagcaaggcacaaaaauuccauuuauauaaaauucagaaauaggcaaaaaaacucagcauucagugauaguaauacuauuaagaaaagcaaggaaaugauuaccacagaagucagaauagugacuauuucuggggcagaggaaggauguuaggaacagguaggagcagguaggagacuuuugggacccuugguguuguauuuuguggccuuggugcuaguuacauaaguguuugcuucaucaugauucaccaagcucugcauuuuguauuauaaacauuuucguguauaaugcuuauacauuauacacgaaaauguauauaauuuuguggguuauauuuuguaagguuuaaaaaauggaagucaggaugggcgguuacaaguggugacucacgcuuguaaucccagcacuuugguaggccuacgcaggcagaucacuugagaccaggaguucgagaccagccuggccaacauagcaaaaccccuucucuacuaaaaguacaaaaauuagccaggugugguggcaggcaccucuaaucccagcuacuugggaggcugaggcaggagaaucacuugaacccaggaggcagagguugcaguaaacagagaucccgccauugcacucuagccugggcgacaauagcgaagcucugucucaaaaaaaaaaaaaaaaaaaaaaaccaaaaaaaaaaacaaaaaggaaaucagugugcgaagugggaaagcuagagcaagggaaacaacuaggaaacagaccaggagaaauuuaauggggaaaaaaaguuauuuguuuuucuccaaauaucuaucuuguuuuccuuauaagagagcaaagguuacuaugauaauuaaaauaacauaaaaugaauugagggaguugccugcugaugugauucauauuuuguuguucaaucaguaaauaacuggaagauacagcuuucacuuugauagucaaauuaguucauggucauuuucugaaaacaguucuugaguauggauucugaauuuagaacugucauuuuguagagcaguuaggaaaauugacgagggaucuuugagugacauagucuuugguuuaguucuauauugugagucucgugaauuuucuguauugugaauuuuauuuuuaauuuguuuuguuuuaaauaaugacuauuauagugacuagguuuccauuuuucuagugguaacuuuaggcuuaaauggacauuucuuacucaauuagguuauugguguuuucuaagaaucauuaaauacuuuuuuuuuaaaguuguauagaguaacagacucuguucuaucauaucuaaaaaguacaaucuuaguacaauagagguaauuaaaguagaauuauaccaaaaauacuuugagagcauauuuaaugguguuuucuuuauucuucgaugaaauguuuugauguacaauggucugcaaauuaauucuucuauuuuucuuguauuuuuaaaauuccuagucuguuuacuuaaaugugaucuuuccauuuuuuauuuaaugauuuuauuccaaucaaauauaauuaacuguuuuaauucauucuuuaauaaaauaaacaaauugcugaaauugucucuccuaaucauaaaauagcuauuuaaaauacacucuaaagaaauuaaaauuguaaauacuuauggagcuaaaaguuaaggaggaggggcacugaauguuuuucccauuuuuucaugucuuuucuaaccuuuuggcggggguggaauuuaacuuuagacuguuauuucucucucuucuucaguuuuucacuguuucuuucauaauucacucaucgaaugccuugauucaauuagccaaguaugggcuauuuuuuuuguuguuauuuuuugcuuuuucuuccaagcuagaucuauucaaaaugauuaacaaguuaaauuuaaaccagucuuucauauucaguauuaacuacuuguuugaaaaaacaagaaaucugcccccucucaauuuuuuagggcauuaaauguaaacauuagucugauuaugauuacugccauuccaaacauauuaauuaaaagcaacguuuauuuccuauaaaaacauuuguucaaaacauugagcuccacaauaaaucauaguacagaaacaauaucauaacaauuuggauuauuuugcuaaugaauucacuuaacugaucacaucguuuuggauuuaaauguuuuucucuacuuguaugaaagcuacauugcuugaaaacuacaaaaacuaauccccaauuugccuuucuacacagugguaaaagauuaaggagcugacauaaccacuaguguguuauauuuaagcuucccuuugcugcuugcugcacauguuacaauguuguucuuucuuugacacagacccagacaaaagcugaguguagcaaggaaacagacagaacgccuccaguaguggcccccgccuggcuccaggauuuguaaacagaaacaucccaggcuccaaugagacagacagagguucccugucuguucugcauucaggaaguguuugcuuguauaagcccaacuauugcacaggcauacauaguaguguuuacauuuggcugaguauuuaacugagaaaacuuaauagggaagaaaaagaggguuuauuagagguaggagaacaagacaauucagguauaacauagauguagcauauguuauguaaaaagguuuuuuuauuuugaagaaauagacaacaaaaaauaggaguuuucuaguuaaaggccucuuuugcacguacacgugaauacacauauugaaauauuuuuccuggcaguuuuucagggaucucauauuuuuagaccaugugacagaggcuuggaaaguuuuuauuugaaauuuaaccaaucauaugguuuauaaugaaaugggaaaaguucccuuguccugacagggugcgugaugcgggguguggcucacuucuuaagugccccgcugcucagaccucuaggggaccauacagacagguaggcuguggggcuccgaccucacaacagugucuaggagugaauguuuacagcuccugaauccgcagugggcguguguuacagggugcucuuuuaguuugccaucuauaggcggcuuguguuagcucaauuagacccccuuccuuaucacaaggacagagggauuucuguaucccaggguuuccugccuugguguacgggaagagucggcucacaccugggcuuggagaaugagugcaagguuuauuaguagaaguagcucucagcagaugggggaaccagaagggagaugguuuucuccuggaguugggccgcuugguggccagggcucuccuccgucugccccagccaaacuccgcgucguugucguucugucgacggccugccggcgugcgggugccuaucguugugcucuucugcuggcgugcuccucucgacgaccagccacuuucuuccgccgaugugcuccucuuuacgucuggccgccugugugucugccugcuagggucucggguuuuuauaggcccaggauggggacauggcggguccggguggucuuggaaaugcaacauuuggacgggaaagcaggagugccuguccucaccuaggucuguugggguggagcccuagucagggacgcaccuuucucuacccauuacuuaccuccccacuuccgugucauuuaaggagggcacacuguucccuucccagcacuauaacauguuuaaaauguuuuaaaacuuuuuucauucucuccaauauaugaauuaauaauccauuucagauuuugaauuaaugaauguuuaauguaaaaguuuuguuaaauuuucuuuuauaaauuugagaauaaaagcaaagaaugcugagccuucaaaaaacuguaugagaagacucauuauacagaguuuuggaaguaggaggaccuuaaaagucacuuacaagaucacuuauuuuuauuuuauaguuuaauguauuuuaguaacaaacaggaacagcaaaaagacagcguuaaaaacgugcuugaauguaggacaacucaaaaaaguagagugaacagauggaaccuacucuaugauuaaaaugcugcaaacaucauuuaguugcugucaauaagaaauuuacuuauuuuccaaaaauccaaaugcaggcauuauccagaaaaauuuaacagguuuauuuauaauuguuauggccaggcauggugguuuaugcuuguaauuccagcacuuugggaggccaggacaggcagauugcuugagcccgggaguuugagaccauccugagcaacauggcaaaacccugucucuacaaaaaauaaaaauuagccagacaugguggcaugagaccagaugcuugggaggcugaggugauaggaucgcuugagccugggaggcugaggcuguagugagccauggucauaccauugcacuccagccugagcgacaaagugagacccugucucaaaaacaaaaacaaaaaaaaaucaaaagaacaaauuaaauaauuguuaugaaguugaacuucuaaaacuuguucacugaaauguuuugacccgcauuaaugcuuuaugucccacauuuauauugaaaauccacaugcaaauaaaaauggaaaaaccaccaauaccucauuucuguuccuuauuuuuucacuuacaaucuuauacuuaggugccuuuugacccuauggggaaaaaauaauguucagaacuacugagaggugacagcgugcuggcaguccuuaccgcccucgcucgcucucagcgccuccucugccugggcucccacuuuggcagcacuugaggagcccuucagcccaccacugcacugugggagccacuuucugggcuggccgaggccggagcccacuccuucagcuugcagggagguguggagggagaggcgcgagcaggaaccagggcugcgugccacgcuugcgggccagcuggaguuccgggugggcaugggcuuggcgggccccgcacucggagcagccggccagcccugccggccccaggcaaugaggggcuuagcacccgggccagcggcugcggggggugcacugggucccccagcagugccagccaaccggcacugcucuugauuucucaccgggucuuagcugccuucccgcggggcagggcucgggccugcagcccgccaugccugagccucccacccccuccaugggccccugugcggcccgagccuccccgaugagugccgcccccugcuccacggcgcccagucccauugccaagcggugagacaaucgcugagcggugagagcaucaccuauccgcaagcagugaguaccaucggaccccuuucgcuugcuauucuguccugucuuuccuuagaauucgggggcuaaauaccgggcaccuuauuggccaguuaaaagugacuagcgcagcugccagaguaaagacacgggugucaggcuuucugggaaagggcucucuaacaacccccgacucuucggaguugggaccauugguuugccuagaaccagcuuccgcuuuuccuguacuucuggacugagucaagggucgacaaagaggaaagccaugcagcuccggggucccaacaacaaguugguugacccugcggccaugggcagaacucucaaaggcaugucacccaagugagacuugcccaucuaucguaucuauccugacccuugcccccuggguccuaaugccugccagacaaacuuccucucaccucuuuucucugaggcuaauuagacccacuucuaaaaauugcuaccugucucuggugcuuuucuaguuucuccuauaagaaugauuucuaguauaaacuccaggacucuguuaccuucuuuaggcaccugggcucaccaaucagaaagacauaauuuuugcccaaagcccugucacaguggggacuaccuggaauuuuaggaucccuccucagacuaacaggccuaacaaaagcuauuccugaagcuaggauauggggagccuuagaaauuguauccuuccuauucauauaagugaggacaaaaggugucacucuuccaacccuggagaucccuucccucccucaggguguggcccuccacuucauuuuuggggcauaacaucuuuauaggacagggguaaagucccaagacuaacaggagaaugcuuaggacucuuaacagguuuuugaggaugcguugguaagggccacuaaaucugauuuuucucagucgguccuccuuguggucuaggaggacaggcaagggugcagguuuucaagaaugcgucgguaaggaccacuaaauccgaccuuccuccguccuccauguggucugggaggaaaacuaguguuucugcugcugcgucagugagcgcaacuauuccgaucagcaggguccagggaccguugcagguucuugggcagggguuguuucugcugcugcauuggugagcgcaacuauuccgaucagcaggguccagggacaguugcauguucuugggcagggguuguuucugcugcugcgucggugagcacaacuauuccgaucagcaggguccagggaccguugcgaguucuugggcagggggagaaacaaaacaaaccaaaaccacgggcgguuuugucuuucagaugggaaacacucaggcaucaacaggcucacccuugaaaugcauccuaagccauugggaccaauuugacccacaaacccugaaaaagaggcggcucauuuuuuucugcacuacggcuuggccccaauauucucuuucugauggggaaaaauggccaccugagggcaguacaaauuacaauacuauccugcagcuugaccuuuucucuaagagggaaggcaaauggagugucuuaccuuauguucgagcuuucuuuucauugagggagaauauacaacuaugcaaagcuugcaauuuacaucccacaggaggaccucucagcuuaccaccauauccuagccucccuauagcuccccuuccuauuaaugauaauccuccucuaaucuccccugcccagaaggaaauaagcaaagaaaucuccaaaggaccacaaaaacccccgggcuaucgguuauguccccuucaagcuguagggggaggggaauuuggcccaaccuggguacguguccccuucucccucucugauuuaaagcagaucaaggcacaccuggggaaguuuucagaugauccugauagguacauagauguccuacagggucuagggcaaaccuuugaccucccuuggagagaugucaugcuacuguuagaucaaacccuggccuuuaaugaaaagaaugcggcuuuagcugcagcccgagaguuuggagauaccugguaucuuaguaaaguaaaugauagaaugacagcugaagaaagggacaaauucccuacuggucagcaagccauccccauuauggauccccacugggaccuugacucagaucauggggacuggagucguaaacaucuguugaccuguguucuagaaggacuaaggagaauuacaaaaaagcccaugaauuauucaaugauguccaccauaaaucagggaaaggaagaaaauccuucugccuuccucgagcggcuacgagaggccuuaagaaaauauacuccccugucaccugaaucacuugagagucaauugauucuaaaagauaaguuuauuacccaaucagccacagauaccaggagaaagcuccaaaagcaagcccugagcccugaacaaaaaucuagaggcauuauuaaaccuggcaaccucgguguucuauaauagggaccaagaggaacaggcccaaaaggaaaagcgagaucagagaaaggccgcagccuuagucauggcccucagacaaacaaaccuuggugguucagagaggacagaaaauggaguaggccaaucaccugguaggucuuguuaucaguaugguuuacuaggacacuuuaaaaaagauuguccaaugagaaagaagcugcccccucauccauguccacuaugccgaggcaaucgcuagaaggugcacugccccagaggacgaagguucccugggucagaaggcccaaccagaugauccaacaacaggacugagggugcccggggcaagugccagcucaugucaucacccucacugagccccggguauguuuaacuauugagggccaggaaauugacuuccuccuggacacuggcgcagccuucucaguguuacucuccuguccuggacgacuguccucaagguccguuaccauccgaggaauccugggacagccuguaaccagguauuucucccaccuccucaguuguaauugggagacuuugcucuuuucacaugccuuucuuguuaugccugaaagucccacaccguuauuagggagggauauauuagccaaggcuggagcuauuaucuacaugaauauggggaacaaguuagccauuuguuguccccuacuugaggagggaaucaacccugaagucugggcauuggaaggacaauuuggaagggcaaaaaaugcccgcccaguccaaaucagguuaaaagaucccaccaguuuuccuuaucaaaggcaauaucccuuaaggccugaagcucauacaggauuacagaauauuguuaaacauuugaaagcucaaggcuuaguaaggaaaugcaggagucccugaaacaccccaauucugggaguacaaaaaccaaacggucaguggagucuagugcaagaucuuagacucauuaaugaggcaguaauuccacuauauccaguuguacccaaccccuauacccugcucucucaaauaccagaggaagcagaaugguucacgguucuggaccucaaggaugccuucuucuguauuccccugcacucugacucccaguuucucuuugcuuuugaggaucccacagaccacacgucccaacuuacauggauggucuugccccagggguuuagggauagccuucaucuguuuggucaggcacuggcccaagaucuaagccacuucucaaguccaggcacucugguucuucaauauguggaugauuuacuuuuggcuaccaguucggaagccucgugccagcaggcuacucuagaucucuugaacuuucuagcuaaucaaggguacaaggugucuaggucgaaggcccagcuuugccuacagcagguuaaauaucuaggccuaaucuuagccaaagggaccagggcccucagcaaggaacgaauacagccuauacuggcuuauccucgcccuaagacauuaaaacauuugaggggguuccuuggaauuaccggcuuuugccgacuauggaucccuggauacagcgagauagccaggcuccucuauacucuaaucaaggaaacccagaaggcaaauacucaucuagucgaaugggaaccagaagcagaaacagccuuuaaaaccuuaaagcaggcucuaguacaagcuccagcuuuaaggcuucccacaggacagaacuucucuuuauaugucacagagagagcugggauaacucucggaguccuuacucagacucgugggacaaucccacaaccaguggcauaccuaaguaaggaaauugauguaguagcaaaaggcuggccucacuguuuaaggguaguugcagcaguggccaucuuagcaucagaggcuaucaaaauaauacaaggaaaggaucucacugucuggauuacucaugauguaaauggcauacuaggugccaaaggaaguuuauggcuaucagacagccaccuacuuagauaccaggcacuacuccuugagggacuggugcuucaaaugcgcauaugcguggcccucaacccugccacuuuucucccagaggauggggaaccaaucgagcaugacugccaacaaauuauaguccagacuuaggccgcccgagaugaucucuuagaaguccccuuaacuaauccugaccuuaaccuauauaacgauggaaguucauuuguggagaaugggauacgaaggguagguuacaccauaguuagugauguaaccauacuugaaagcaagccucuucccccagggaccagugcccaguuaguggaacuaguggcacuuaccugagccuuagaacugggaaagggaaaaagaauaaauguguauacagauagcaaguaugcuuaucuaauccuacaugcccaugcuacaauauggaaagagagggaguuccuaaccucugggggaaccccuauuaaauaccacaaggaaauuauagaguuauugcacacaaugcaaaaacacaaagaggugggaaucuuacacugacaaagccaucaaaaugggaaggagaggggagaacagcagcauaagcagcuggcagaggcagcagaaaggaaagaaagggacaggaagucaaagaaagagacagagaagagacaaagaagucagaaagaggaacagacacagaaagagaguuaaaaagagaggaagagacaaagaagaaguugaagagaaagaaagagagauggaaguaguaaagaaaaaacaguauacccuauuccuuuaaaagccaggguaaauuucuaucuacccagccaaggcauauucuacuuauguggaucuucaacccguaucuaccucucaaacaguuugcaagaaauaacaaaaucuauccuuacuguauaaucccaaauagacucuuuggcagcagugacucuccaaaaccgccgaggccuagaccuccucacugcugagaaaggaggacucugcaccuucuuaggggaagaguguuguuuuuacacuaaccagucggggguagcacaagaugccacccagcguuuacaggaaaaggcuucugaaaucagacaacgccuuucaaauucuuauaccagccucuggaguugggcaacauggcuucuccccuuucuagguccuguggcagccaucuugcuguuacucgccuuugggcccuguauuuuuaaccuugucaaauucguuuccucuagaaucgaggccaucaagcuacagauggucuuacaaauggaaccccaaaugaguucaacuaacaacuucuacugaggacuccuggaccgacccucuggcacuuccccuggccuagagaguuccccucugaaggacacuacaacugcagagccccuucuuugccccuauccagcaggaaauagcuagagcggucauuggccaaauucccaacagcauuugggguguccuguuuagaggggggauugagagguaacagcgugcuggcaguccucacagcccucgcucacucucagcgccucugccugggcucccacuuuggcggcacuugaggagcccuucagcccaccacugcauugugggagccccuuucugggcuggccaaggccggagcccacucccucagcuugcagggagguguggagggagaggcgcaagcaggaaccggggcggcgugccgcgcuugcgggccagccggaguuccgguugggcaugggcuuggcgggccccgcacucggagcagccagccccgggcaaugaggggcuuagcacccaggccagcagcugcggaggguguacugggucccccagcagugccagcccaccggcgcugcucucaguuucucacugggucuuagcugccuucccacagggcagggcucgggaccugcagcccgccaugccugagccucccacccccuccaugggccccugugcggcccgagccucccugaugagugccgcccccugcuccacggcgcccagucccaucaaccacccaagggcugaggagugugagcgcacggugugggacuggcaggcagcuccaccugcagcccaggugugggauccacugggugaagccagcugggcuccugagucugguggggacauggagaaccuuuaugucuagcucagggauuguaaauacaccaauaggcacucuguaucuagcucaagguuuguaaauacaccaaucagcacccugugucuagcucaggguuugugaaugcaccaguagacacucuguaucuagcuacucugguggggccuuauagaaccuuugugucgacacucuguaucuagcuaaucugguggggacguggagaaccuuugugucuagcucagggauuguaaacgcaccaaucagcgcccugucaaaacagaccacucggcucuaccaaucagcaggacguggguggggccagauaagagaauaaaagcgggcugcccgagcuagcagugguaacccgcuuggguccccuuccacacuguggaagcuuuguucuuuagcucuuugcaauaaaucuugcuacugcucacucuuuggguccauacuguuuuuaugagcuguaacacuccccgcaaaggucugcagcuucacuccugaagccagcgagaccaggagcccaccaggaggaaugaacaacuccagacacgccgccucaagagcuguaacacucaccgcgaaggucugcagcuucacuccugagccagcgagaccacaaacccaccagaaggaagaaacucugaacacauccgaacaucagaaggaacaaacuccagacgcaccaccugaagagcuguaacacucacugcgaggguccguggcuucauuccugaagucagugagaccaagaacccaccaauuccggacacacuaccaauaaaaggaagaagauaauauuuuuuuaacaggaguuuuccaucauaguagauucuuuuuuuuuuuuuuuuuuuuugagagagucgcacucugucacucaggcuggagugcaguggcgcaaucucugcucacugcaaccuccacccuucgaguucaagcgauucuccugccucagccucccgaguagcugggauuacaggugccugcccccgugccuggcuaauuuuuuguauuuuuaguagagacggaguuucaccaucuuggccaggcuggucuugcacuccugacaucaugauccacccgccuuggccucccaaagugcugggauuacaggcgugagccaccaugccugacccaucauaguagauucuuaaggaugcuuucuacaaaugcauugugcuaguuggauaucuuuuggcaugauuguuacacguuuggcauggauaacauacagguuaaugucuucaaaaaggccaaccagauaggccuacugaaccaaagagauagcuauuuucaaaacaccaauagcuguacucuagaugugccaaucuauuuugaagucccaaacaauuucucaccucagacacuggaagaaaauuugccaaucagaaguucaggggacuucugauuaggacuuauuacagagugccucgcaaauaggucuguaauucugagguuucuucaccuauccuguagaggacacucucuuaggagcagcuuuuuuuuuuuuuuuuuuuuuaauaaauuuuggaaacaggauuuuacucugucuucuaggccgcaguguaguggcgcaaucauaguucacugcagccugcaacuccugagcucaagcaacccucccaacucagccuccugaguagcugggauuacaggugugagcacugugcuuggucucuuaugagcaacuuuuguaaccacuugcuuacuggaugcuuuacuuccaguugauuuauggacauuguugugccuuuuaugagccaugguauagagaccuccuuacuuacucuccuccuuuggcuggagcuuggcaagcuagagguggugcuggcacucuauaaccacuuuauuuuauggauaaagaaguaagagccuagaaaaauuauauaauuuguccacaguggcuaaagugggacuaaaacuuaugagcucuuuucacuaaacuacuuuaccacuguuaccugaaauauuuugggaguguaauauuaucaauaauagacuacuuauuuccuaacaacugguuguuaaugauaauguuaaauuauaguuaaauuuugaaguuaaaucacuguucgucaugguugcuaauauuugauguaaugccuuaggacaaauuuuccuaccuaggugucuuagucaaaguaguguggacuggguacuuaguucuagagucugggaaguccguguccuuaauagugccugcagaugguugucuucucauuguaacuuacauguuauguguaacucacaugccaauguucucacauggcagagaacagaaagauagauccugugucuccucuuuuuuaauuuuuaauuaauuaauuuuuuuuuugagacagagucucacucacccaggcuggagugcaguggugugauaucagcucacugcaaccuccgcuucuuggguucaagugauucuccugccucagccucccaaguagcugggauuacaggcacacaccaccaagcccagcuaauuuuuuguauuuuuaguagagacaggguuucgccauguuggccagccuggucucaaacuccuuaccucaaauccucaagugauccacccaccuuggccuccacuuuacagacaugagccaccaugccuggccuuuuguuuuguuuuguuuuguuuuuuuauaagggcccaaacccauucaugagggcucuacccucauuauauaauuaccuuccaaagguucuaccuccauauacugucacguuggggauuuaggcuucaacauacgaauuugcagggcacauauucuguccauaggccgggugcgguggcucacaccuguaaucccagcaguuugggaggccgaggcggguggauuacgaggucaggaguuugagaccagccugaccaacauggugaaacccugucucuacuaaaaauacaaaaaauuaguugggcgugguggcaugugccuguaaucccagcuacuugggaggcugaggcaggagaaucgcuugaacccagaaggcagagguugcagugagcugagaucgcgccacugcucuccagccugggugacaagagcgaaacucugucucaaaaaacaauaacagcaaaaaaauuagccgggcauaguggcgugcaccuguaaucccagcuacucgggaggcugaggcaggagaauugcuagagccugggaggcgaagguuguagugacccgagaucgugccauuggacuccagugugugcaagagagugagacucugccuuaaaaaaaaaaaaaaaaaaaaggaauucauuaaauguucagcuguuucuuccuccucacauguacagugguguccuccuccacucacugcuuuaccuaggauaagagcagccuugggucucuucacucuuggaagagucuuuucauauucuacuuuuaaauccauuuaguuuccuuuuguccuuagaucuuauuuuuaaagaaaagguuaugauuuuuagguuuucugacuuguuaucagggaaguguuuuggcuuguuacuaagaugggaauaaaauucuuugcaucuuuguauacucuaagcagaagugggagucacuuuuuuucacauuggucgagacagcaucuugcucugucacccagacuggagugugguaacacaauuauggcucacugcauccucgaacugcugggcaugagcaguccuccugccucagccucccaaguaacugggacuauaggcaugcacuaccacacccagcuaauuuuuuauuuuuuguagagacaaagucuugcucuaucacccaggcugaucucaagcuccuggccuaaagcgguucucccagcuuagccucccaaaaugcugagaucacaggcaugaacuacuguugccuggccuuuuuucaucuuuuuuuuuuuuuuccugagauggaguuucacucuuguugcccaugcuggagugcaauggcgccaucucggcucacugcagccucugccucccggguucaagcgauucuccugccucagccucaugaguagcugggauuacaggcaugugccaccaugcccggcuaauuuuuguauuuuuaguagagacaggguuuuaccauguuggcuaggcuggucucgagcuccugaccucaggugauccacccgccucagccucccaaagugcugggauuauaggugugagccacugugccuguccccuuuuacacauuuuaacauaugugauaugauaagucauuuuaucuuaucuaaaaagcugucauuugaggcuauuauuauuauuauuauuauuauuauuauuauuauuauuauuuuugagucucagucugucacccaggcuggagugcaguggugugaucuuggcuuacugcaaccuucgccuccuagguucaagcgauucuucugccucagccuccugaauagcugggauuacaggcacgcaccaccacaccuggcuaauuuuuguauuuuuaguagagaugggguuucaccauguuggucaggcuagucucaaacuccugaccucgugauccacccgccugggucucccaaagugcugggauuacaggcgugagccacugcacccagcugagucuauuauuuccuuaucaccaagaaaaagaaauaccaucaaguaauuuuacaaugccacaaauaugauauaucccacuguaggagauuuuaaggugugaucaauguauguauuaaaauugaugaaauaugggaguugucaccuauguaaaugugaacuugauuguuaacucuggcagaauguccacucagcagcaacccuucaguguuucugucaacaaaccauaugagaagucagaugaguuguauuguuugaaaauguuucauuggauaacaaaauguugaugguugcuaacgcuuagugaugggcauuuggaauuuguauguacacuccacuucuguauauaguaguaaguuuuuuauaauaaaaagauuaaaacuagaacaagcaaccuuccauuggcacuuucuggcaugaucaagaaagcaucugcauuaaaauuuucagugucguguuaguggauggaaagaaaauuccagagacaaaagucaaaagaauguuuuaaagaaauguuggguuaugaucucagugauguuuuuaaugacacauaagguagaaauguauggaaaaauaggacacaguugacaaauuugaaaagauauucagaagaaucuaacucuaaauaugaaaaaguuuuaggaauaccuacaccaauuuauuuugcaucuguuuuucuuuuuacaggcuguaugagagugauuuuaauaaucucuguccaaauaagucuaaaggagcuuaucaagaaguaaagcauaacauucuaggggauaagucauaguuggucguaguuuaagcagcauacuuuuuaguaucucuuauuuugaauaaaaaaaaauuaaguaccauguauauaguuaaucauuuuuaguguuuccaagauacugcuuuucuucauaggcuauaaaaagcuuuuguugcuuauauuaguaacaaaaacaauuuugcaaauggaaacauuucuagaaaccuuacuauuuauauuaguauuauauaaauuuauccaauuuccagaaauuuggguaaugcuaaaaucacuuuccaacaacuaagacuaggaaaauugucauuucuauuuuguaauaaaagcuugauaaaauacacauuaguuagcuauaugcaauguucucauaauuuaguaaaagcaaaaaaaagccuagaaagcuaaaucuuaguggaaaaaucuuuauuauuaaauuuucaaauguacuaauucugugcuuuuuauguacaacuuuugguuuuucagguuuuuccaaaaucuaaccuuuguuacauuaaaauuuuaauauuuuauuuaauugguaauguccuuuaaauaacauuaaucuaaauuuucaauacugaaauuuaaacauguccacauauuuaagaauuaaaaauuagauuuuuaaaaaauaaaauuagauuccuuaucacuucucauuccuaguugaauucaaaauacauuuuucaaauaaguaauaugguucaguucuuuugggaauuauaacauuggauaucuuaacucauuuccagagacaguuuuaucuguaaugccauauuaauauuacauuuaauauuuaauuuuauuuuuuauacagaagacaagauaaucuuuauuaacucauauuuacuugaauuacacaagaauguaagaacacauuuaaauauucaguguuucucauuuggauguggcaaaacuuuguuucacguuagacuacgaauuuuuuuauuguaacaaauauuuaaagaaauaccaguuuuuggcugggcgcgguggcuuaugccuauaaucccagcacuuugggaggccaaggugggcagaucacgaggucaggaguucgagaccagccugaccaacauggugaaacccugucuguacuaaaaaauacaaaaauuagcugggugugguggcgcgugccuguaaucccgcuacuuaggagucugaggcagaaaaaucacuugaacccagguggcggagguugcagugagcugagaucguacaucugugacauggauaauauucagugauaaaaggaaaugaacugcuaagccacaaaaagacauggaggaaccuaaaguacauauugcuaagugaaagaaggcagucugaaaagucuguauauuguaucauuccaacuauaugacuuucuggaaaggaaaaacuauaggcacauaaaauauccuuguauagucaugaaucuauaaauuauuuaguuuuguguguguguauguguauguauugaaaauaguuuaucuuuuagguuuagcaaauucuaaaaugagguuuuuuuuguuuuuuuuuguuuauuuguuuguuugcuuuugagacggagucuugcuuucucacccaggcuggagugcaauggcaugaucuuggcucacuacaaucucugccuccuggguucaagugauucuccugccugagccuccugaguagcugggauuacaggcaagcgccaccaugcccagcuaauuuuugucuuuuuaguagagcugugguuucaccauguuggucaggcuggucucaaaccccugaccuugugauccgucugccucagccucccaacguguugggaugacaggagugagccaccgcaccuggcuuuaguuuuuuuuuuuuuuuuuugauugaaguaaaauucacauaacuuagaauuagucauauuaaaauguaccacucaacacauucauaguguugugcaacuauuaccucugucuaguuccaaaacauuuucaucaccccacaagggaaacccuguaucuaauaagcagucacucccuauuucuuccucucccagucccuggcaacuacuaaccugcuuucugucuaugaauuuggccuauucugaguauuucauuucaauggaaucauagaauauucaaccuuuuguaaauccuuuguaggaauauaccacauuuuguuuauccauucaucaguucaugaacauuuguguuguuuccacuuucggguguuguaaauagugaugcugugaacaugcauguagaaguuuuuguuugaacacuuguuuuugguucuuucugauauaugccuaggauuggaauugcugggucuuaugguaauuccauguuuaacuuuuugaggaacucacaaacuguuuucuacuguauacuuaccauuucauaucccacuugcaauguacaagaguuauaauuuauccacauccuugccagcgcuuuuuauuuucuuuuuuuuuaauuguagccaugccaauguaugugaaauaauaucucacugugguaaaaugaguuuuauauguagcuuuucugccuguaacuuacucuguauguuaaaaggaggcacaaugaucaauguguuaaaaucuauuaauaucugaaaaaugggcugggcacagugacucacaccuguaaucccagcacuuugggaggccaaagugggcacaucaacuugaggccaggaguucaagaccgaucugguuaacauggugaaaccccaucucuacuaaaaauacaaaaaauuauccagguguggugcuacaaaccuauaaucccagcaacucaggaggcugaggcacaagaauugcuugagucugggauguggaguuugcagugagcugagauugcaccacugagcuccagccugggcgacagagcaagacucucuuaaaaaaaaaaaaagaaagaaagaaaaaagaaaauauaauaaauggucugcaaauuaagaguauuucaguguuguuucaacauauccuucuauagaaauauaguuuagacauuuuaauaagcaacuucuacuuaauuugauugagacaaauaaauucauuaaaacaggaaugcccauuagaggaacucuuugccguagaggcauccuacuuugccauagaagcuucuaauuugaguauaauaugcuugauuuugauugaauauaaagaaugaauaaagaugcuggcagucaucaagcgcagcuucugaucaguauuaccaaacauugcauaacuacaucuaguuaaacaaugaacagcucuuucauagggcaacucauucuguuuuagacaggucuguuuauaagccaugcuuuucuguaugcucaacuaaaggcucuuauccuugaagauacacugauuggaacugguuauuugaugugaagacagcuaucauauccucccaaguuuucuuuuuuuuccucaucagaugcuuucaguucuuucuacccaucacaguucagaggucucaaaccuucauaguuguacuugcucucuuuuggauaugcucuaguuuguggccauccauccuaaaggguauuugcucuagaugcgaucugacccacagaauggaacuuaacacauaaaauguuuacauguuugugauagcccugugauuuaccuauguguguucccauuccauucugcaagugaguaaacuugggcucagauaggagaagaaacuuuccuaaggucauauguuaaguggaagaagugagcuucaaguccuauucagauuuaacugccuccaaagccaugcuauuuucauuaauaaaaauaccaauauugauaaguguaacuaccauuuauugcguagauaauauaugcuuuuuuaaaaaaaaacuuuaauuuuuuuuuuuuuuuuaaagaaacagagucucacuucaucacccaagcuggaguacagugauacaaucauggcucacugcagccucaaacuccugggcccaagcaauccuccugccauagcccccugaguagcugggacuacaggugcaugccaccaugccugacuaauuuuuuuuuuuaauuuguuuuaaugucuggcauuuugcuauguuguccaggcuggccuugaccuuguggccucaagugauccuccugcagcagccucccaaaguguugggauuauaggcaugagccacugugcccagccagauaauauauucuugacguuguguuaaguacuuagacuaccaucuaaaucuuacagcuaacuugggaaauacagaguacuauuuuuauaaaugaggaaauugaggauuuaaaaccaaaugugauucuaaaacuguuagauucuaagacucuugauauuauacuauccugucuaaucuguuucaugguauuguugauguuuuaauaauuaggagcacaucuacuugguguuuuaguguuccaaaucuauacagaauagucuguaugauuaaaaaauauaauuuguaauuaucacauuuauuacuaauuuuuucuuucauuuccuuugaugcaaaaacauuacuaauuugauuauacauggguacagccuuucuaaagggcagucugucaguauuuaacaaaauacuuuuuuaaaaaaaaaugacauuucaaaauuuguuuucuuuuagguccaccucauucauuuaaccgagaugagacaauaaucauugcuuuggcaucagucucuguauuagcuguuuugauaguugccuuaugcuuuggauacagaauguugacagguaaaaauuaccauuuuuuguccuauuguuuauuaaacaugcaauuuaaucaauuuauuugcuccuuuuaaauuccguauguuaaaaaaaauagucucaaaguuaugcaaaauacacccagccucaauaguaucacguauggacaguauuguuucauuuaaauuaucagucacuaccccuuuccaugccacuggauuauuuugaagcaaaucacagauaucauauaucuguaaauauuuaauuagauauuauauaucuauaaauauuaucucuacaauacaagagcuuuuuuuaaaauuuauuuuauuuuauuuuauuuuauuuuugagacggagucucgcugucgcccagguuggagugcaguggcgcgaucucggcucacugcaggcuccgccccccaggguucacgccauucuccugccucagccuccugaguagcugggacuacaggugcccaccuccucgcccggcuaauuuuuuguauuuuuaguagagacgggguuucaccguguuagccaggauggucucgaucuccugaccucgugauccgcccgccuuggccucccaaagugcugggauuacaggcgugagccacugcguccggccaauacaagagcuuuaagaauacauauccauaauaccauuuucacaucugaaaaaauaacaguaauuccucaguaucaucaaaugucaaguugguucuaauauacuuuagguuugauggacuguuuaggaaaucagcguucauugauucauuugaauaacuucuauacaaucuucuuuaaaguuuuuauaauauugcuuaggguuuuaaacuuuuaaaguaagucaucaugggagugucucccagaauuuggcuuucaugcuauucugcauucaucuuaauuuauagguauuaccuaguuuaguaaauagcuuuacuccuauugacauuaggcauaaaucuugcugcuaaucuuucugcagcucuucuuuuuaaguguaauauuauaaaaaguguaaaaagauauucauuuuaagaaaaccauauauuaguaaccuguuuccuguucuuauaggagaccguaaacaaggucuucacaguaugaacaugauggaggcagcagcauccgaacccucucuugaucuagauaaucugaaacuguuggagguaaguuugccguuagauuauggacuguuguuucuacugugauacuagaccuggaacagugacuucauucaaucauuaagacauucauucauuuauuuaacccuauuuacuaaauuacaauuuuuugucaaggccuauucuaggcacuaggaacauaggugaacaaugucuccuggggcuucuauuugaauuggggagucuacagacagguacaggaauguauaauauaauugcaaguaguaguaagugcuaugaagaaaaguacaguggauaagaaagugaugaaaaggggguuauuaaagaaaauaugggccaggcgcaguggcucaugccuguaaucccaguacuuugggagguugaagcugguggaucaccugagaucaggaguucaagaccagccugaccaacaugaagaaacccugucucugcuaaaaauacaaaauuagccaggcauggugguucaugccuguaaucccagcuacucaggaggcugaggcaggagaauugcuugaacccgggaggcagagguugcggugagccgagaucgcaccauugcacucuagccugggcaacaagagcgaaacucugccacaaaaaaaaaaaaaagaaagaaagaaaaagaaaauauggccaggugcaguggcucacgccuguaauccuaucacuuugggaggcugaggcagggggaucacuugaggucaggaguucaagaccagccuggccaacauggugaaacccuaucucuacuaaaauacaaaaauuaacugggagugguggcgcccgccuguagucccagcugcuugggaggcugaggcuagcgaauugcuugaacccagaagguggagguugcaaugagccaagaucacgccacugcacucuaggugacagagcaggaauccgucucaaaaaauaaaaaagaaaaagaaaauauauuuagaaagagguugaccuuugauuagagauuuguacaggguaugagaauaaagacaugaaaguuugagaagagugugccacaagggauccauaauagacaacaaauaaauacuccuugucugcauauauuacauauuuuuauagauacauaaggcucuuuuauauagaauuuaaguuucauuuggugauaucucagaagcuacauuaaaaguguuaccaugaugaguguuuuuauauuuauuaagaaugacuugaaaacuaugguccccaaaccagagacuauuaaauaauagaugugauagauuugacuauauaaaaaauuguaagaacuuucuguuuugggagagacauaccauaaacaaagauaaaagccaaauuugaaaaauaaauuucaacauuucaacauauaagggaaaacuugauaaagaacugauauaaaucaagaugaaagaaacauucuauagcaaauggacaaaaaggcugagugcugugacucacaccuguaaucccagcucuuuugggaggccaaaguggguggauugcuugagcccaggaguucaagacaagucaugggcaacauggugaaaccccauuuauuuuguaaaaaauacaaaaauuagcugggugugguggcacaugccuguagucccagcuacucgggaggcugagguugaaggaucacuugagcccaagagguagagguugugguuagccuaggugacagagacccugucucaaaaaaaaaaggacaaaagguauuaacugccaauucacaaaagaaguaaguguggcuaagaaauguacaguaagauguccaauuuacaaggcugaaagaaauacuaguuaacccauggaauuuuagccaugauuaagugauagaaacacuuccaaacauugcugaauuaacuauauauugauauaaccuuuuuaaaggacacuuuguauaauuuugaucuggaaacaguguaugaaacacaacauauauccuuaaauaaaugaugguaaauccccaaccuguuuuaauaaaaaguaaaagcaauccccagaagccaaaaauaacgagaauggguuacauuuugcugguucuuuggguguugaguaauuuuuuuguauucuggauauugugaauauuguauuguggaacacugaacucaaaaauuagcuggguaucauggcacgcgccuguaauccuagcuacucaggaggcugaggcaggagaaucacuugaacccgggaaacggagguugcagugagcugagaccgugccacugcacuccagccugagugaaagagcaagacuaucucaauuaaaaaaaaaaaaaaagauuuuuuuuuguuguuuuaguaagcaauaaacuugguugaacacauaccacaaaucuguuuggggcagaagcucaaaucucaguucaguuauuuuaucuuuuuuuuuuuuuuuuuacucugucauccaggcuggagugcaaggcauggucuggggucaccgcaaccucugccucccgguuucaagugauucuccagccucagccucuauguagggaucuuuaugcaaguauuuaagucuccacaaaagugacuacaggcgcaugccaccacgcccagcuaauuuuuguauuucuaguagagaugggguuuuacuguguuggccaggcuggucucaaacuccugaccucgugauccacccgccucagccucccaaagugcugggauuacaggcgugagccaccacgcccggccucaguuauuuuaucuuuagcuggaaacucucuuguauauucacugggcuuuccucucucugaauuucuccuuucuaggguucuccccucauuuucuagcaacuguggcuguccaaaauauguccugaguuucccaaggccagaacaauuuucuguucuucuuuuuucuuuuuuuuuuuuuugagacggagucucacucggucacccagucuggagugcaguggcgcgaccucggcucacugcaagcucugccucccagguucacgccauucuccugccucagccuccugaguaagugggacuacaggcgcccaccaccacgccugacuuuuuuuuuuuuuuuuuuuuuguauuuuuuuaguagagaugggguuuuaccguguuagccaggauggucucgaucuccugaccucaugauccacccaccucagccucccaaagggcugggauuacaggcgugagccaccgcgccuggccucuuuuuuuuuuuuuuuuuuuuuuuuuuaauugagacagucuugcucuuucgcccaggcuggagugcaguggcgcggucucagcucacugcaaccuccguuuccuggguucaagugauucuccugccucagccuccugaguagcuaggauuacaggcgugugccaugauacccggcuaauuuuuguauuuuuaguagagacaggguuucaccacuuuggccaggcuggucucgaacuccugaccucaagugaucugcccaccucagccucccaaagugcugagauuacaggcaugagccaccacacccagccuagaaugguuuucuuuagcaauuuuaguuccacugcacagugcugauuucagccugcccucaggauaaaagucauaaaaauggguagcuugccccauaccacuuuuuucucaaagcuuuaaugccucucaagaucuaucugccuuuagaucuuucuuuuuuuuaaauuuuguccagcauuuauaaauguucucuaugggcaggcugggucugguaggagcuucaucagccauacuagaacagaauuuauuaauuucuugauaauggaauaaacuguaagcaacagagagcuguagcauucuguuuaaauuuguacuuuauuauuuaguaaauuugauuguucaauugugauauuaauaccuugcuuucuuuaaaacacuugcagcugauuggccgaggucgauauggagcaguauauaaaggcuccuuggaugagcguccaguugcuguaaaaguguuuuccuuugcaaaccgucagaauuuuaucaacgaaaagaacauuuacagagugccuuugauggaacaugacaacauugcccgcuuuauaguuggagaugagagagucacugcagauggacgcauggaauauuugcuugugauggaguacuaucccaauguaaguucuucauagaaaauaaacugaggccaggugugguggcuuaugccuguaaucccagcacuuuuggaggcuaaggcagguggaucacuugaggccaagaguucaggaccagccucgccaacauggcaaaacucccgucucuacuaaaaauacaaaaauuagccggguaugauggcacacaucuguaauuccagcuacuugggaggcugaggcaugagaauugcuugaacccgguaggcggagguugcagggagccgagauuguacagccguacuccagccugggcgacagagcaagacgcaaucucaaaaaauaaaaaaaaauaaacugacauuuauauuaguuguuaaucagacuucagagaggaccacuguauuacagauagagcauugcugacucacaaacuggauuauuaauggucugcaaugaaauaaggaucucacaccagaaugugaaucaacuaauuauacuguuuguuucgcugucuccuccuucuuucuguuuuucucuucuuuauuuaauuuuuugauaacaaguuuuuugaugaaagaagcaguacuuugauugacauucauucugaugcaacauucuuuucucaucagcaacugguaauaguuuguagauaagcacuuugaguggcaccaauacauaaaugaauauauuuacaaaauccuuuuguuuucuacuuauuaaccauaacaauauaauuuguauucauacuggugaaugauacacuuuucuaucuuaauuugaucaaagaauuguuuaaaaggaaauaaucauucauaauuuuuaauauuagagacauaaaaauuuauaauguuuaaauuccccuuuccaucccuuccucuccucucuacacacagaaaugucauacuaacucuuucaagauucugaaauguaguaguucauuagaucuucauggaauccuagccuauuugcaaauucuuuauaaggaugcuaauuuacucuucauguuaaagugaguuaauucuaccuuuuuuuuuuuucgcauuuuuuccucuauauagggaucuuuaugcaaguauuuaagucuccacacaagugacuggguaagcucuugccgucuugcucauucuguuacuagaggacuggcuuaucuucacacagaauuaccacgaggagguaagauagucaauagaugaaauugacacucauguggguucaaaauucacaacaggaaauuuuaauuauaucuucaaaguaaaaguauaauuuauauuauuggagauuuauuauuagucaguuguuugaaagauucagcaugaaaugcauuugaaauguaacagaaagagcuuucccacgcagcugccaagauggcagaggggcaguccuggugcuugauagcugaguaaaacuccugggcuaccuggaggcuaucaugacccagcagagaaaguaguggucauguccugugaggacaucaacauuucuggcaguuucuacagaaacaaguuaaaguaucuagccuuccucugcaagcggacaagcaccaacccuucccaaggacccuaccauuuauggguccccagccacaucuuuuggcagaccaccugcgguaggcugccccacaagaccaagcaaggcuaggcugcccuagaucaccucaagguguuugauagaaucccccugccauaugacaagaaaaagcagauggcgguuucugccacccucgagguuguacguccgaagccuugaagaaaguuugccuaccuggggcacugggcucagaagguugacuggaaauaccaggcaaugacagccaccaugggggagaagaggaaggucuauuaucagaagaucuguuaccagaagaaaaacagcucaugaggcuauaggaaaaggcugaaaagaacauagagaagaacauugacaaauacacgaagguccucaaggcccacagacuccuagucugaguccaauaaagacuguuuauuccucaugcuuguccuggccugcucuuccuccauuguugccauggggauguaggggacccaggggcagcaguccaggugcucuaggcagccugggacuuacaaagcuggagauaaggaaugaaucuuagucacugucuuucuauuagguuacuuuaaacaacucuaaaaguugugcagacauaauuugucuaugauguacuuguuugcaagagaguuucauaaaaucauuaguaaaaacaaccugcuacuucaguuggaauauuggcagcccgggcgugauugauggcucaugccuguaacucugacacuuugggagaccaaggcagguggauugcuugagcucgggaguuugagaccagccuggguaacauggugaaacccugucucuacaaaaaauauaaacauuagcuggacgugguggcaugcaccuguagucgcagcuacuugggaggcugagcugggaggauuguuugagccugggaggugaagguucuaguuagcugaaaucacaccacuguauuccagccuggcugacagcuagacugucucagaaaaaaaaaaaaagcaaaugugaacuggaacacuaauugaagaguuucccuaccuugugaauggggaaucuguuuguauuuccuaccuugucauauacuguacucugcagcuguuaggaugugagaaaaugccuguggggacaguaugagccugguguuguacaggguauuuauggauguguaggcuaggaagauaugcaaccaagggauuacagccauugcauucucuucccuguacuuugugaugagaaacaaauaaauuaauuuuaaagaaaaaaauauaacaggaagaauaagagaaagaacuuuggcuggcauggugacucauggcuguaaucccaacacuuugaaaggccaaguggaucucaaggaucacuugagcacaggaguuugagaccagcaugggcaacaaagugggacccuuucucuacaaaauauaaaaaaguuagccagauguggugacacgcgcacauaaucugagcuacuuggauggcugaggugggaggauugcuugaguccaggaggucuaggcuguagugagcuguguucaccccacugcacuccagccugagugacagagugagacccugucucaaaaaaacaaaaaaacgaaagaaaaagaacuucaagacuuacagggaccauuaagaauuuaauucuuggccgggcacgguggcucacgccuauaaucccagcacuuugggaggccgaggugggcggaucacaaggucaggaguuugagaccagccugaccaacauggugaaaccccgucucuacuaaaaauacaaaaaauuagccaggcaugguggcacgcuucuguauucccagcuacugaggaggcugaggcaggagaaucguuugaaccugggaggcagagguugcaaugagccgagaucacgccacugcacuccagccugggugacagagcgagacucccucucaaaaaaaaaaaaaagaaauucuuguccauuaauaauuucugaguugggugcagugacucacaucuauaauccgaacaauuugggaggccgaggcagguggacugcuugagcccaaggguucaaaaccagccuagacaacauagucagacccccaucucuacaaaaaaaguuuuaaucagcuggaggugguggcacacaccuguggucccaccuacucaggaggcugaggugggaggauagcuugagccuaggaauucuaauugcaaugagcuaugaucaugccacugcacuucagccugggugacagagugagacaucgucuaaaaaaaaaaagaaaaaugaauuccuuuucauacucugaacauucuuccucuaagauauacaugcgagcauacuuagaaaauguucuuuucaaaagaaacuauccacggaguaaacaaccuacaaaugagagaaaauauuugcaaacuucacguccaacaaaggucuaauauccagaauguauaaggaacuuaaacaauugaacaagcaaaaaacaaauagccacauugaaaaguggacaaaugacaugaauagacacuucccaaaagaugacauacaagcagccaacaaauauaugaaaaaaugcuccauaucacuaaucaucagagaaaugcaaaucaaaaccacaaugauauacuaucuuacaacagucagaauggcuguuaaugaaaagucaaaaaacaacggaugcuguugagacuggagaaagcggaacacuuauacauuauuggugggaguauaaauuaguucagccacuguggaaaguaguuuggagauuccucaaagaacuuuaaacagaaauaccauuugacccagcaauccuauuacuggguauauauccaaaagaaagcaaauaauucuaccagagagacacaggucuucuguuuuucacagcacuauccacaauagcaaagauacggaaucaaccuacuugucugucagugguggacuggauauaaaaaauguguuaaauggccggacgugguggauuacgccuguaaucccagcacuuugggaggcugaggugggcggaucaccugaggucgggaguucaagaccagccugagucaacauggagaaaccccaucucuacuaaaaauacaaaauuagccgggggugguggugcaugccuguaaucccagcuacucgggaggcugaggcaggagaaucucuugaacgugggaggcagaaguugcggugagccaagaucgugccauugcacuccagccugggcagcaagagugaaacuccaucucaaaaagaaaaaagaaaaagaaaauguguuacacauacaccaucgaguacuacacagccauaaaaaugaaugaaaucauauccuuugcagcaacauggauggagcuggaguagguuaugcuaaguaggaauagaaaaccaaauaccacauuuucucacuuuauaagugggacguaaacaucggguacucauggacaugaagaugacagcaguagaaacuagggacuacuagaguggggagagagggagaggggcaagggcuaaaaacuaacuguuggggccggacgcgguggcucacgccuguaaucccagcacuuuggggggcugaggcaggcggaucacgaggucaggagaucaagaccauccuggcuaacacagugaaacccugucucuacuaaaaaugcaaaaaauuagucgggugugguggugggcgccuguagucccagcuacucgcgaggcugaggcaggagaaugccaugaacccgguacgcggggcuugcagugagccgagaucgcgccacugcacuccagccugggcgacagaucgagagucugucucaaaaaaaaaaaaaaaacaacuaccuguuggguacuaugcucauuacacgaauaacaggaucauuuguaccucaaaccucagcaucauacuauaaacccagauaacaaacuugcacauguaccccugaguuuaaaauaaaagaggccagguaccauggcucacaccugaaaucccaacacuuugggaggcugagacgggcagagagcccaagaguucaagaccaacauggugaaacccugucucugcaauagccaggcauaguagcaugcaucucaggaggguaaggugagaagauuguuugagcccgggaggcggagguuacagugagccaagaucucgccacugcacuccagccugggcagcagaccaagacugugucugaaaaauaaggcuaggugcgguggcucacgccuguaaucgcaacacuuugggaggccaaggcagguggaucaccugaggucaggaguacgagaccagccuggccaacauggugaaaccccaucucuacuaaaaauaucaaaaaaaaaaaauuagccaggcaugguggcaggugccuguaaucccaggugcuugggaggcugaggcaggagaaucaacaagagcgaaacuccaucucagaaaaguaaauaaauaaaagaaaaaaauguucuuuugauucuagggcauuuucagacuuuuuaaagcccauuuuuggaucuuagguuaagaaccucuuagcuaggcuauauuauauuuuccuuguauuaauuuuguuuaagugaacuacaaugcaucauuaauuuuuuuaauuuuuaauuuuuguggguacauaguaguguauauauuuaugagguacgugaguuuuguuguuguuguuuuuuguuuuuuuugagaugagucucgcucuguuccccaggcuggagugcaauggcgcaaucucaguucacugcaaccucugccucccugguucaagcaauucuccugccucagucucccaagcauuacaggcaugcacccagcuaauuuuuguauuuuuaguagaggugggguuucaccauguuggccaagauggucucgaucuccugaccucaggugagccgcccaccucugccucccaaagugcugggauuacaggcaugagccagcgcaccuggcuggcuuucauuuucaaagucaccucauuguccaucaugccagucagggaaaaguaagggaagguaaaaggaauugucccuuucugucuccauaagucccacuccuaugcuuguuuguuucccagaaccuagugcacacuuagcuccaaaagaggcugguaauauaguuguuguugauguuguuguuuccugcuuguauugcugccucaaauaauauuggguucuguuacuagguaggaagagaagaauacauuguggggaucagccuuugcucguguuucagagcuauguaguuauauucccuguuguaacuguggucuuccucaccuuucaugcauauuuuugcuaguuguucagagcaucuuuuuuuuuuuuuuuuuuuuuuuuugagacggaguuuagcucuugcugcucaggcuggagugcaauggugcgaucucagcucacugcaaccuccgccucccggguucaagcaauucuccugccucagccucccgaguagcugggauuacaggcaugcaccaccacgcccagcuaauuuuguauuuuuaguagagaugggguuucuccauguugacucaggcuggucuugaacuccugaccucaggugaucugcccaccucagccucccaaagugcuaggauuacaggugugagccacagcacccagccuggagcaucucuuuaauacguuugcuuucucacuuuguuucaauauacaccucaccucauagauaccccaaaguuaccuuugcuauaauugugucuuugugcuuucuucuacccucaucccuugcuacauuuccuugucauauuauagcccugacauuauuuuuucagucucucugacaucuuuagugaagagaacuuuaauauaucaguuuucuuagaucuuuguuucauuguauauuagcauggaucaucuuuucuagcugaugcuucauguauaaauaauuucuccugaauaauuuauccguucauuuaucuugacaucuugcuucuccuaaauacagaauuguccaaaguauugccugugucagcaacuugaugcacuugcuguagugcuuuagcacauuaaccauuggacuguguccacuuagcucuucaauauuauacugccuuuaaaaaguuggcuuagcacagaacuuaaaauaccauccuaaucucccuuuucaagacuugcauaauuuagcaagguuucaagucaaauguaggcugaaaagaaugauugccaucagauauaaguuuuauuuaaacagagcuguuacucugaaacauuagcuaauguuaccacuaaauaaggguaauaccuuuuuaaaaacuaaguacauagaugcugcuauugcauauaaauauaguagcuauuugaauuuaugggauuuuucuuuuuuuuggagucucacucuguugcccaggguggagggcaauggcauaauguuggcucacugcaaccuccgccuccuggauucaagcgauucuccugccucagccucccaaguagcugggauuacagacguccaccaccaugcugggcuaauuuuuuguauuuuaguagagacaagguuucaccauauuggccaggguggucucaaacuccugaccucaggugauccaccugccucgaccuccaaaagagcugggauuacaggcaugagccacugugccugcccagaauuuauguuuuuuaccugauuauuuaaaaaauauucccuggccaaaugcaguggcucaaggcuguaaucccagcacuuugggaggccgagguggguggaucgugaggucaagaaaucgaaaccauucuggccaacaugugaaacccugucucuacuaaaaauacaaaaaaaauuagcugggcgugguggcgugcgccuguagucccagcuacucgguaggcugaggcagaagaaucgcuugaaccugggaggcagagguugcagugagcugagauugccgccacugcacuccagccugggcgacggagcaagacuccaucucaaaaauaaauaaauaggccgggcgcgguggcucacgccuguaaucccagcacuuugggaggccgaggcggguggaucaugaggucaggagaucgagaccauccuggcuaacaaggugaaaccccgucucuacuaaaaauacaaaaaaaauuagccgggcgcgguggcgggcgccuguagucccagcuacucgggaggcugaggcaggagaauggcgugaacccgggaagcggagcuugcagugagccgacauugcgccacugcagucggcaguccggccugggcgacagagcgagacuccaucucaaaaaaaaauaauaauaaaaaaauaaauaaauaaauaaaaaauauucccaaguacagauguuucuugacuuacaaugggauuacaucccaaugaacugauuauaaauuggcugggcaugguaguucaucccuguaaucccagcacuuuaggaggcugaggcaggagaaucaaacuccugagcucagaaguuugagacuagccucggcaacauagugagaccccgucucuacaaaaauaaaaaaauuagcuggcugugguggcaugcaccuguagucccagcuauuuaggaggcugaggugggaggauugccugagcccaggaggucaagacugcagugagccaagaucaugccacugcacuccagccugagcaacagaacgagacccuguuuuuauuuauuuauuuacuuuugagauggagucucgcucugucgcccaggcuguaguacaauggcgugaucucggcucacugcaagcucugccucccggcuucaugccauucuccugccucagccuccagaguagcugggacuacaggcacccgccaccacgccgagcugauuuuuuguauuuuuaguagagacaggguuucacuguguuggccaggauggucucgaucuccugaccucgugauccacccgccucagccuccccaagugcugggauuacaggcgugagccagcacgccuggccagagacccuguuuuaaaaaaaugaaagaaagaaaagaaaaaagaucauaaguuagaaauauuguaaguugaaaaugcauuuaauacauuuaaccuacugaacaucauagcuuagccuaaacuaucuuaaauaugcucagaacacuuacauuagccuacaguuggccaaaucauccaauacaaagucuacuuuauaauaaaggauugaauaucucaugugauuuauugaacacuguucugaaagugauaaaaaggaaugaaguaugguuucuacugauuguuuacugcuuucccaccacuguaaaguugagaaaucauaaaucaaaccaucuguaagugaaagaucaucuguaugccuauacuauacuauuuuuacuugaagugcucuuucacugaauucuauccuucccagcaucuucagauauaacuuuguuauuuggaguagaaauuugguaguaaggaauuauacuguuauuacuuauucagcuguuuguugcuuccgaauaaggaagaauugaaccuauuuauuuauuuguaauaagaucucccuaugaauuuuuuccauauuauaauagcaacgcaugcuuauuaccaaagaaauaucugaccaaaaaaauagauauagacaacucagacuucaccagaaaauuacuguuaaguaguuuguauauagucuuucauguccuugggagggcagggggauagcacuggugauaauauguauaaauauccauagauugacuauuuuuggucagguuuuaaaaauacauauaacuaauaucuuguugugcuuuccuuugagauauuugccuacugcaguguucugcccagggcaaaauuauuguauguuccacccucccuccauacccaaauaaagaaaauuaaaaugaguacagaggggaguuuaaaagggaaaacuuuucucaaaagggcagucuauaguucugcccauugauuugguauuauuauauaaauauauuccaauguuuccaugaguuuuccuauauaaauauuagcucaagauuguacgacauauauuuauguuguggcuuuauccagaguaagaaaugcagcucuugcaggaauugaguaggagccaaguuaauacaagcuuuggaagacuggagaacaggaaguggguaagggaggaaaugagaaagaaaucaacucuuaggugaagaaauugguaacuccuauuuuuucuucaaauuguacuguugcuuaauuuuuuuaaaucaaugauuauuauaauuaucuauaguuucauuauuggugaaauugcauuugaaugcucauuaaugagcguaauacaucugaauacugagucuauuugugccaaaauacaaauccucaguaaauguauugacuuuguucugauugcuuuguuuuucucuauaccuaagcagauauuuuaaauuucagaaauugugcuauagaauuuuuuuucaguuccagagcuaugguuuuauuuaauacaagguuuauauaagauuuccuuauagagaagaaaaauauaauguacuuauauuuggugagaggcuuagguuagauucauucuuucagucagcaaucauuuacugugugucuacucugugccaagccuuuuaaagucaggugaaagauguucucuuucugccuucauggagccuguaguccuaugauaaggauaaaaaaguaauagaaggagcauaauacuacuuugcuucuguaaaaucagaaaaacaaguuuucauaucuuggugagagauaccacuuccuccacuuguuuuuccaaaccauuguaaaacuauuugugguuagauuugaaaagcugaggugggcuuagagauauggcuaaaccucagggcagaacuggaaugugcugucacagauuugaucuguuaagccauaggagagcaguuuaagauuuacguuaaaauuuuggagcuccauuaguuuuucacugauacuuauuuuagacaagcagacuuuuuuuuuuugauguuuauaccaaauauuccuuucuguauugccuccuuuuacagcccuauacuauaaaugaagagaaaaaacaagugcguguuagaaucugaaguggcagcauguuuguuaguuuuaguuaauguuuaacuauacaugcaacaggaguuauauuauaaaauauauuagaaaauagugaugagugugaguugaaauuccgauuucucuuuuuuuguuauuagaaaauuaaugggcagaaaaauaauacuacuucuauauuuauguauguucauuucauguucaauagucccuuuuauucauugauaaauauuugaaauuauccaaacagaucauuauaaaccugcaauuucccaucgagauuuaaacagcagaaauguccuagugaaaaaugauggaaccuguguuauuagugacuuuggacuguccaugaggcugacuggaaauagacuggugcgcccaggggaggaagauaaugcagccauaagcgaggugaguguauacaaaagguaucacacugauguacuuugaaaugauaauuuaauuaaaacaucuacuggccaggugugguggcucacgccuguaaucccagcacuuugguaggcccagguggguggaucaccuaagguaaagaguucgagaccagcuuggccaacauggcgaaaccccgucucuacuaaaaauacaaaaauuagccgggcacaguggcacgcaccuguaaucccagcuacucgggagucugaggcaagagaaucgcuugaacccaggaggaggaaguugcagugagcugagauugugccacugcacuccauccugggugacagagugagugagacucaggacaauuauccucauauacugccaauuauagaauacuaggaauuacaaaauuaggaaauauaaaagacaucucauaaaggccuuuguaaaguucaucaguuuauuuuggaacucacugccauuccaagucauuuuuacaagcauuaggaacaaauuuguaggaacugauuuuugaggcaaggguaaaguuaccaaguuuaagauaacacaguccaccuucugauaaucaccauuacaguguggaacguauccuucccaacuuuguucucugcauucauauauacuugucugugcacaacauauauguauuuuugugauuuuaaaaauuuauuuauuuguuuauuuugagauggaguuucacuuuuguugcccaggcuggagugcaauggugcaaucucagcccaccgcaaccucugccucccagguugaagcaauucuccugccucagccuccugaguagcuggcauuauaggcauguaccaccaugucuggcuaauuuuuguaauuuuaguagauacgagguuucuccauguuaggguggucuugaaguccugaccuuaggugauccacccaccuuggccucccaaagugcugcaauuacaagugugagccaccacgcccagcuguauuuuuuuuuuuuuuuuuuuuuuuuuuugagacggagucucucucugucacccaggcuggagugcaguggcgcgaucauggcucacugcaagcuccaucucccggguucacgcuauuuuccugccucggccuccugaguagcugggacuacaggcacccaccaccaugccugguuaauuuuuuauuuuuuuuuaguagagacgggguuucacuguguuagccaggauggucucgaucuccugaccuugagauccacccgccuuggccucccaaagugcuaggauuacaggcaugagccacugcacccggccacccagcuguauuuuugugaauuuuaaaaaauauuaaguuguauacauauuguuuugcaauuuucucacuguaucuuacagauuauuuauauugauauacauaggaaagucuagcucauucuuuuugauugauuaauaguauucacuaaaauggauuuaccacaguuuacuuauucaggaagggcauuuuauagguaaaaaauaaguuauagaaagguuuaaugacaugguuagggucaaauaacauugacaugacuaagauuuauauauaacuucuggucuaaugucuguucuucagaauaugcuacguucucucucuaaaaaauaucacucuaauuuaucagguuggcacuaucagauauauggcaccagaagugcuagaaggagcugugaacuugagggacugugaaucagcuuugaaacaaguagacauguaugcucuuggacuaaucuauugggagauauuuaugagauguacagaccucuucccagguaaaaacuacugucaaaaguugauauuuuuugaagugaagcaguuauaucuucuuucucuaccuauaguaccuaacucaacuuuuauguaagaaucuuuuuacuuucauuuaaaccuuuaguucauugcuaucuaguguuuagaaacauuauuagcagcaggaugcaaauuaggaauuuuuuuuuuuagaguacuccagguuuucaucugagugaaauuuaauuaauugccaguaauagcuuaucuaacuguauuuuguuuggucucugauugcuuuagcaguaaacauuuuccuuaugcaccaucugaguguuugagacaagguacacuuacgauguuuacugaguugaacccagaaggaauuagaagcaaugaauuauuuguaaacacuuuuuccuuuucuuuuuuuuucaugcucccuuucucccuccuuccuucuuuccuucuuucuuccuuccuuccucuucucucaccuuaucuccuucccuuccuccucuuuucucuucuuccuuccuuucaaugaaagaauacucauuggccaggugcgguggcucaugccuauaaucccagcacuuugugaggccgaggcuugcggaucaccugaggucaggaguucgagaccaaccugaccaauauggugaaaccccguuucuacuaauaauaugcaccuguaaucccagcugcucaggaggcugagauaggagaauugcuugaacccgggaggcagagguugcagugagccaagaucuugccguugcaccccagccugggcaacaagagcaaaacucugucucaaaaaaauaaaaaaaggccuggcgcgguggcuuacaccuguaaucccagcacuuugggaggccaaggcaggcggaucaugaggucagaaguucgagaccagccuggccaauauggugaaaccccaugucuacuaauaauacaaaaauuagccaggcgugguggcgagcaccuguagucccagcuacucgggaggcuggggcagaggaauugcuugaacccaguaggcggagguugcagugagcugagaucacgccauggcucuccagccuggguaacagagcaagacuccgucucaaaaaaagggaaagaauacucauuuaagugaauguuuguuugaggcuuacuugaaauagccaaaugaauuuauaguuuucccuucuuagggauuacaucguuguaguaucaucuaaaaacuuuaacuauaaaucuggcauugcauucuucuaggugcuauacagaugauuugaucuguguggccacugucuuuuaggaguaacaccauuaaaagcauagaaaaaggaacuagcauuggacaaauuuaugaaauagagcuauuuaauuuaaaaagauuaauaauggaguugaauuguuuggcuuuaaagacauuaggcauuacacauuaguuuauauauaucaaguguguguauauauauauacacacacacacacauauauauguaucguguguguguguauauauauauauaaauaaaauuuuuauuuauuuauuuauuuauuuauuuauuuuuuauugauaauucuuggguguuucucacagagggggauuuggcugggucauaggacaauaguggagggaaggucagcagauaaacaagugaacaaaggucucugguuuuccuaggcagaggacccugcggccuuccgcaguguuugugucccuggguacuugagauuagggaguggugaugacucuuaacgagcaugcugccuucaagcaucuguuuaacaaagcacaucuugcaccgcccuuaauccauuuaacccugagugggacacagcacauguuucagagagcacaggguugggggcaaggucacagaucaacaggaucccaaggcagaagaaguuuucuuaguacagaacaaaauggaaagucucccaugucuacuucuuucuacacagacacggcaaccaucugauuucucaaucuuuuccccaccuuucccgccuuucuauuccacaaagccgccauugucauccuggcccguucucaaugagcuguugggcacaccucccagacggggugguggccgggcagagaggcuccucaccucccggacggggcggcuggccaggcggggggcugacccccccaccucccucccggacggggcggcuggccgggcggggggcugacccccccaccucccucccggacggggcggcuggccgggcggggggcugaccccccccaccuccuggccgggcggguggcugacccccugccaccucccucccggacgggucggcuggccgggcggguggcugacccccccaccucccucccggacaggucggcuggccuggcugggggcugacccccccaccucccucccggacggggcggcuggccgggcggggggcugacccccccaccucccucccggauggggcggcuggccuggcggggggcugaccccccccaccucccucccggacgggguggcugccgggcggagacacuccucacuucccagacggagcggcugcugggcggagaggcuccucacuucucagacggggcggcugccgggcggaggggcuccucacuucucagacggggcgguugccaggcagagggucuccucacuucucagacggggcggccgggcagagacgcuccucaccucccagacggggucucggcugggcagaggcgcuccucacaucccagacggggcggcggggcagaggcgcuccccacaucucagacgaugggcggccgggcagagacgcuccucacuuccuagaugugauggcggccaggaagaggugcuccucacuuccuagaugggauggcggccgggcggagacgcuccccacuuuccagacugggcagccgggcagaggggcuccucacaucccagaugaugggcggccaggcagagacgcuccucacuucccagacgggguggcggccgggcagaggcugcaaucucagcacuuugggaggccaaggcaggcggcugggagguggagguuguagcgagccgagaucacgccacugcacuccagccugggcaccauugagcacugagugaacgagacuccgucugcaaucccggcaccucgggaggccgaggcuggcggaucacucgcgguuaggggcuggagaccggccuggccaacacagcgaaaccccgucuccaccaaaaccagucaggcguggcggcgcgugccugcaaucgcaggcacucggcaggcugaggcaggagaaucaggcagggagguugcagugagcugagauggcagcaguacaguccagcuucggcucggcaugagagggagaccguggaaagagagggagagggagaccguggggagagggagagggagagggagcuaaauaaaauuuuuuuaagagacagagccucacucugucaccuaggcuggagugcaguggugugaucacagcucacugcagccuugaccuccccaggcucaggugauucucccaccucagccucugaguagcugggacuacaggcaugcaccaccaagccugguucauuuuuguauuuuuuuguagagacaagguuucaccauguugcucaggcuggucucaaacuccugggcucaagugauccacccacuucagccuccaaaagugccuggauuacaggagugagccaccgcaccaggccaaacauuaguuuguaauucaaaaauauaaugaaauaaaucagugauuaguagauuaaguacagguuaaucaguuaucuagaaguauauuuucuaguuaauuaaaaguacagagauucaauugaggcauuuuucugaaaauagcaguaauugcaguaguaucaacaaguacuuuuuuuggccgggugcgguggcucacgccuguaaucccagcaccuuaggaggccgaggcaaguguaucaccugaggucgggaguucaagaccagccugaccaacauggugaaacccugucucuacuaaaaauacaaaauuagcuggaugugguggcacaugccuguaaucccagcuacuugggaggcugaggcaggagaaucgcuugaacccgggaggcagagguugcaaggcugagauugcaccauugcacuccagccugggcaacaagagugaaacucggucucaaaaaaaaaaaaaaaaaaaagaaguacuuuuuuuguuuuguuuuuaagagacagggucucacuccugcccaggccggagugcaguagugcaaucauagcucacugcagcacugaacucuugggcucaagcaguccuccugcucagccuccugaguagcuaggacuacaggugcaugccaccacgcccggcuaguauuuuauuuuuugucgagacaguguuuugcuguauugcccaggcuggccucgaacuccugggcucaagugauccuccugccucagccucccaaaaugcugugauugcaggcaugagccaccacacccaaacccacaaguauuguauuaucagaacuuugaccacaguuugguaauuucuuuguuaauagucucauguaggauuuuuguuuuagaagcaugucugacugaaaugauuuuuucaucagauuaguacacugcuacaaacaauauauuuugaaaaacuacuguguucaaagaaugacuaucgcuuuugaucugauaaauaauaaagaaugauauuaaauguuugaauagggaaaggcaauuaaaucuuguuuucagaagauuauuuuagcaaauauguaggauuaauuaaaauagaaauagaacuagaaggggcuuaaaaaggaaaaagaaauggagaguuacuguuuaauggguacagaguuucaguuugggaagauagaaacaguucuagaaaugguuaguaguaaugguuguacaauagugugaauguacuuaauaccacagaauggugcacuuaaaaaugguuaaaaugaucaguuuuauguuauguauauucuaccacgauaaaaaaaaaauaaaggaauaagaagagaguugcuuuaaaauaccccguaaucuuggauauggaaauggggagaggcaaaucugggagaaaaugcagagaagaaaucuguacuugugguuaucuguuaaaagaaugagaugucaggccagguguggcucacgccugcaaacccagcacuuuaggaggcugagagggguggggguggaucuccaggucaggaguucgagaccagccuggccagcauggugaaaccccgcucuacuacaaauacaaaaauuagacaggugcaguggcacacgccuguaaucccagcuacucaggaggcugaggcaggagaaucaccugaaccugggaggcagagguugcagugagccgagaucgcgccacugcacuccagccugggugacagaacgagacuccaugucaaaaacuaaaaagaaugggauucaaaggaauugagaaauauucagagguuggccgggcacgguggcucaggccuguaauccuagcacuuugggaggcugagguggguggaucauuugaggucaggaguucgaaaccagccgggccaacauggugaaagccuaucucuacuaaaaauauuuaaaaaucagcuggucgugguggcagucaccuguaauucuagcuacuugggagucugaggcaggagaacugcuugaacuagggaggcggagguugcagugagccgagauugccuccauugcccuccauccugggcaacagagcgagacuccaucucuuaaagaaaaaaaagaaggaacuauucagaggucuuaaaacacagugagggugggccaggcacaguggcucacaccuguaaucccagcacuuugggaggccaaggcuaguggaucaccugaggucaggaguuugagaccagccugaccaacguggugaaaccccaacuguacuaaaaguacaaaaaaauuagccgggcuugguugugggcaccuguaaucccagcuacucgggaggcugaggcaagagaauugcuugaacccgggacgcagagguugcagugagcagagaucgcgccaccgcacuccagccugggugacaaagcgagacucugucucaaaaaaaaaaaaaaaaaaaaaagugagggucagaguggcaaccagaaagaugaguuaauccuggagacuguucgaugggguauugacagacaacuaaauaaauuuuuaaagacaauuaaaaauaauaaauaagauggaaauuuaagauuaaaaugguuauuugggaguugucuacauagagaugguaacugagaaguuaugagucgaugcacuccuuuaacuggaacauaaaaagaaagaaaaauaggugaauaaugacugaauauugggguacuacccccaugaaguagguuaauuaagaagacaaaugaucagaaaaguagugagaaaacugaaaaauccuaaugccuuguaagucaguauuagaaaacuuuaagaacuaagauuucagccugaggaagcugauuaaaaaauaaaaauaaaaaaccacaccaagauugauggcaauagauguaauugaaaagaggaaacagaacugaggaaugauuuuugaauuugaguaggaggaggucauugguauuuuuagaagaguuucuguggaauacagaacacagaaaucauguuacagaguguauauaggaggggaaaguauuuaaaaagcacagucaagggauacagggcacucuugaaaauuuuaacaauuaaaugagguggaaguagaaaagaaaaaaggaucauauaaauauauuaauaaaccuagagaauaguguauacuaacuauaaaauucuuauaaaacauuuuuuaaacuuuuaugauauaccucaaaaugcaguaugugcuguauuauuaaauggaaacacuauguaaugaagguuacuucucuauaaaauguuaguaaaauaaaugauuuaucuguauuacagaggaagagugaaaugcuacaaaguuuaaauagaagggggagaaggaagaaaaaaagaagagauagaaaaaggaagaaagaauaaguguaauuugagaagggagcuaaaaaaaggucuguaacugguagagacauaguuaacaaguggcacauggggugagaagcagguaaugguaucugauagugcuagauauuacuauaagauauuuugggcaguucuaaagaaaaugagauuauaaaacuuuccuugagcaauccagcgauaguaaggaaauucaguaagguuuuaaggaaauccaauaagguuauuaucuuccaugaugaugauuuuugucauuaacauucaccuuuguaucucuaauaccuaacacuaaguuagcacuaaacaaguuucuauugaacaauuagauuuugaacugugaagauuuaguggaaauuuauuugguaauucuuaaccauugcauucauaaaagauugugcuucaauuuccuuuagcaacuuuuaaaauuauaauuuggaccuaauuuuuuaaaagagugaaauugugaauuuuuaguuauucuacuaaaccagcauuugaaaaaaaaauaauaaauaacacuuggaagguauguguauguguuguguguaugucucagagacagaucagauacauuaguaaauaccuugcaauucacagaugguauaggauaagguuuuaucacaugggguuucaaggaagaaagugauauacuaacugccaugauuauuaaauccuuuaauuuuaucucucaaguucaauguugauguuauugaucaacacuaaguaucugcuuaaauguuuacaguaugugaaacucacuuguauuuauacauaaggcaguauuacaacaaacuugggcgaugcugcacagauaauagaauuaaucuuuguaaaucuuuuuuaauauugguggagggcaaguauuuauuaguuguuuugaguauucaaauagaaacaaaacuuaaaugaaacauaaacuuauuuguaaugugguuuccaucugggucauuauaacuuuguauuaucuccauguaagugauauaaggaaggcugcagacauugccauuuugcuuacaggaagucugaaacacagaauaguuaaaugacuuuuccaaggucaagaugaagugaagauuagaaccuaaaugccuuauccucugucuuggcguucuuccuucuaauuuaucuugucauuuuaauagggugggaggacggguaaagagacaggaacagucucuguguucuuugccaugguuucuacuagaucauugaguguuggucccaggggucuucuaugugguucaauauauuauauacauaaacuuaauuuuauuaucauauuuuguaaaaaucaaaagccuaacaucagaguugauugugcuuauuggcaaugaauaggguuauuaaauagugauaaaauaguuaauaauauuuaaguccaugaucuaaauacuaccuguuaguuaaaaggaauuuuuagagcugggcacagugguucacaccuguaaucucagcaccuugggaggcugaggcaggaaaaucauuugagggcagaaguaugagaccagccugggcaacacggcaagaccuuaucucuacaaaaauauuuuuaaaaauuagcugggcauggugccacacucuuguagucuuagcuauuagggaggccacuugagugcaggaguucaaguuacagugagcuaugauaaugccaccguacuccauccugggcaacaaagugagagcguuucuuugaaaaaaaauuuuuuuaaaguauauugauuuuucuuucaaaugaccauuaucauaaauauuuuuguaacauuugauacagucuggcuggacuauaauagaaccaaugauguaaugagacauagugacuguucaacccacccacuuacauuugguucuguaggcauauuuguuguacuagguccuggaguuuuuccucaucuuuacccgccuccaugggaucaguguucaggcauguuuucaaguauuaaguaugccuuauaaacauaauagucuuuuuucccugaauuuaguaauaccagaaaccauuuaaaaauaccuauccaucauugaaacuaccauuugacuuaucaacaaauauuugagacuauucuaagcaaaacauucauuaauaaugcauuagacugggcaugguggcucacgccuguaaucccagcacuuuaggaggccgaggcugguggaucaccugaggucaggaguucaagaccagccuggccaacauggugaaacccuaucucuacuaaaauaugaaaauuagcuggacgugguggugugcgccuguaauccaagcuacucgggaggcugaggcgagagaaucacuugaacccgggaggcagagguugcagugagccgagaucaugccacugcacuccagccugggcaacagaguaagacuccgucuaaaaaaaaaaaaagaaaaaaaaaucauuaaaccuacagcaaggucucuuuaggauuuccaaaugugccugaaggggaugaaaaaauaaaaagauugugacacaauuuuuuuugcuuacuugguaucagaaauaccccuguuauucuaucauuuaugauaguuagaaauuuuauucugucauucuuuucuacaaauccacaggggaauccguaccagaguaccagauggcuuuucagacagagguuggaaaccaucccacuuuugaggauaugcagguucucgugucuagggaaaaacagagacccaaguucccagaagccuggaaagaaaauagccugguaagaaaaaacuaaguuauuaaagagaggacuuaugacugaauauguuuuaauguuguuugaaacaaaaauagacuguuaauaacguuaauaguuuuuggaguugccuaaugccacaaaucaaacuugauuuuuaugauguuuucaaauuuuucaauaugaaaaaaagucaguuuuaguuccauuuuguuuuuuuccaagcuuaaaauacuauuuagagagaauaacuaaugugucauaaguuugccagauuagguaacagcuggauaaauuaacauauuaauauuuuaaauauuauugaaauucuaucuuacucucuugagaauaguaccaaaacuguuaaguagugcaggcuuacauaaccaauggcuaaugaaaauuuaggcuagaccugaaaaaaaccaaggcgcagccuaugaauucugcuaauuauuaaaaauauaauucggcugggugcgguggcucacaccuguaaucccagcacuuugggaggccgaggcgggcagauugccugagcucaggaguucgcgaccagccugggcaacauggugaaaccccaccucuacuaaaauacaaaaaauuagccgggcgugguggcgugugucuguagucccagcuaguugggaggcugaggcaggagaauugcuugaaccugggaggcagagauugcaaugagccgagaucacaccacugcacuccagccugggugacagagcgagacucugucucaaaaaaaaaaaaagcauauauauauauauuuauauacauauauauuuauauauauauuuauauacauauauauuuauauacauauauuuauauauauguaaaauucacaacaaugaaauaucucaaguccccugccauuugaguaaguuguuguuacaacacugaaaacaucuuacaaauuaacaaauauacacucauauaaucuuuuaguauaaauaggauaaucuaauuaucuacuaucauuucugaaguuuauuuuuuuacuuaaacacauuuuuuuaaugucaguaccucuagauguaucuauuucucuccauuuggucaguauucuauugauaaaaucauauaaugauucuauuggaugauauaugauaauuauuguauuaaaaaggaaaaaacuaccucucccuacuaucacucuccguaaguaacucccuuuagcaaucuuuuggguuuuuucucuuccaaagauuaccauuauaacuucaaauacucuaucuauucuuaaguuaucucucguuuacuuucucccaguuuguaauauucuauuauuaaaugauuuauguuuugucuguaaauucaucuaauauuuaaauacaauaacgagaaauuuuugguauuaugauuauguaagcauucacugcacaacaaaguauugugcuuggauuuauaggaaauaaaaauucuacauuaguuacuaaaaucuccccugcgcuuuggggagaauguuucaaguuaucauccaucacuugagcccaaggguuugaggcugcagugagcuaugaucacaccacugcccuccagccugaguaagacccugucucuuuaaaaaaaaaugucaucaagucucagcugcccaggaggcugagguaggagaauugcuugaaccccagagguggagguugcagcgaggcgagaucgugccacugcacuccagccugggugacagagugagaccccaucucaaaaaaaaacaaaaaaaaauuugaaaagucaucaucaaaugauuucuuuuugguuucuugucaucuuucuuugucuuguuuuuaggcuauacucagaagcgcauuaaaaaucucaugucauucucuuucuuguaaacgauuguuuuuuugaugaaguuccuccuuaaguaauguguauuaguauguguauggugguaaacauuaugaauccuugcauguuuaaaaauguuuuuaucuugcccucacacucgaguaauaaucuggcuggauaauaguuucaauaucauaauuauuuucuucacaacuuugaaacuacuacuccaucauucucuagccuacaaucuccaugugcucuaggcccuagucuccagucuaaugagaauuucagugccauccugaaucguuucauugcuuuuuguuucguuauguuuuuguuuuauccucuuaauuuuuuuucucuauaagcuuuuaagacuuuaucacuagaauugugaaauuucaccuugauguuuguaggcauggaucuuuacacacauuuugcuuggcacuggguagguuuucaguuugaaaauucaaaaguuucuuaaauucagaggaauuuucuuuuuucuuuuucuuucuuuuuuuuuuuuuuuuuuuuugagacaggaucuugcucugucauucuggcuggaguauaguggugugaucauggcucacugcagcuuugaacuccucugcuuaagcuauucuccuucuucaucuuccugaguagcugagacuucaggugcauaccacuuugccuggcuuuuuaaauuuuugguagagacagggucucgcuuuguuucccaggcuggucucaaacuccugaauucaagcaguccuccuaccucagcuucucaaaguacugagaucauaagcaugagccaucaugccuggccugguauuuuuuuuuaauuauuucuuaccuuucaauucuuccuucuggaauucccacuagacaaauauuguaccaccugacauucuaagaaucauuuuuuucuuauauuuuccauuuuuucucccucuauguuuuucuuccucccgucccccuccccuccccacacaccuggccucccuuacuacauuuuucaagauuuacucagcuuuaucuucaaaugacccauuuaguuuucacuauuacccuuguaucaguuaucuauucauuaaaguuuuagcuuccacgaucauaauuauauuuccagaaacucguuugccuuuuccauagcaaucuguucuuauuuccagaauguaauaagagugauucauucugaagguguuguuuuuaugcuuuacacaaauuaauuuucuugacuauaauaaaaggacaaaaagugaaaaaauaagcaacuuaaauuauuuuacuauguauuuucacauuucaauuuuagauugucuugguaggacuaaaauaauauuuccauuuuggauccugauuuaaguggggugaugucaugucagagacaggguagagacacauuauaguuuccauacagauuuagaaugagcacugucuucauugguuaucuuagucacuagguuacuuucaaguuuggcuucuguuucaagucagauugaaauauuuaaguauguggcaauuaaggagccuauugucaagcacauacguccaagauugcuuccaaaacuacagucccugcuaugggaacugggacagauuuuugagaggucccugauagcaagugagaggcugaauacuuuacuaggauuaauuagaggugccagccucacaauagaguaucccuaaaagaaaaaucugugaaauuuuauucuaguaaaauacaacuucaucuuccuuaaauuguuuuauuucaccagcgcaaaugggaucuauuauuuugaaauaucucucggcaacccuauuauuaugagauaugcaucauaugcauauuuaccugaaaacuuuuuacuuccaguauagaguagguugccaaguaaggaauucauaauacuugguucacuuccagggaauccauuuaaaucuaaugugcuacagucaauaaacugcuucucugcagugacaauccaauacuagaguuagguagcaaguacauaguuuauaaaaagagagaaaugcagcuaugucuaaagaagccauuuuugcuuucauaguugcauugagauuaagaaacauuccuuuaguaguaaaacucagaaucuuucaaauauuaaugaauauaaaaacuagcuuuaauuuuauaaauugccagggacucaagcauaguuuagucaauaaaggggggaagaauaguuuccugauaaaaaugaaagcauagaaaauagucuaaaggaaauacaugaaaauguuaaaccauaguuaucucugaauauugaguucauaaaugacuuuuucuuccuauauguuucagaauuuacaguaaaaaugaacuacuuuaacaaucacauacacaugguuuuguuuuuguuuuuguuuuuguuuuuuugagacagagucucgcucugucacucaggcuggagugcaguggcgcaaucucagcucacuguggcgucugccuccuggguucaagcgauuuuucuggcucugccucccgaguagcugggacuacagucacgugccaccaugccugacuaguuuuuguguuuuucguagagaugggguuucaccauauuggucaggcuggucuugaacuccugaccucaugauccaccugccucagacucccggagugcugggauuacagacaugagccaccgugcccagccgguguuuuguuuuguuuuguuuuguuuuguuuuguuuuguuuuguuuuguuuuuguagagacaggguaguugccaagacuagucuuaaacuccuggccucaagcaauccucccaccucggccucccagagugccgggauuacagucaugagucagcaugccuggcccccacacacaguuuaaggcuuuuguuuuauguuaaaauauuuuaaauugguaaaauaaaaaauuauaggccacguuuauuuuaaaguagcuuuuuuccuccuacauaaaauuuucagguauaauuuguuuaacuguacuaccauucuucauguuuuccauucuuuuccaguuuuuugucacccauacuauagugcagggggacaauaauagcucacuguagccucgaacuccuaaagugcugggauuauagguaugagcccagccucuuuuccaaauguuuauacuccauuucuuagucugucuugaauucuuuucucuccccuguuaaaaucacuugccuggcuuuucuuuauuccuuaguguuaguuuuguauaaccucuuguaaucaaugguuuuauccuaauauauuuucacauaaaagguggcaacuuagccaggcacgguggcucacgccuguaaucccagcacuuugggaggcuggggcauguggauuacuugacgucaggaguucgagaccagccuggccaacauggugaaaccccaucucuacuaaaaauacaaaaaugagcugggugugguugugcaugccuguaaucccagcaacuugggaggcugaggcaggagaaucgcuugagcccgggaggcagagguugcagugaacagagaucaugccacugcaauccagccuggacgacagagcaagauccaucacaaaaaaaaaaaaaaaaaaaaggccaggcacggcagcucaugccuauaaucccagcacuuugggaggccgagguggguggauugcuugagaucaggaguuuuagaccagccuggccaacauggugaaacccugucucuacuaaaaauacaaaaaauuagccggacaugguggcaggugccuguaaucucagcuacucaggaggcugaggcaggagaaucacuugaaccugggagguggagauugcagugagccgagauugcaccacugcacuccagccugagcaacagaguaagauuccaucuuaaaaaaaaaaaaugcggcaacucuuccucaguuuauguuugcccucuggucuuuuuaagaaauauauaguacauuucagaagaaacuaccaguucuuuucacauaguuuuaguuuuuccauuuucucuuuuggacaaaaucuauagacuucugugaucuagaauucaacauuuuacauacuuuuucaucugacacaacccacauuaagaaauacaacuucagccaggugcaauagugcacacuuguagucuaagcuacauaggaggcugagggaggaguaucgcuugagccuaggaaugugaagcuguaguacacaaugaucccaccugugaauaaccacugcaguccagccugggcaacauagugagaccccaucucaaaaaaaaaagcaaaguuuacaucauuacauauaguauaauacuuaaccuuaccaccuacucuauguccuaguguuuucuauucuagucuagagcauuucaguuuugguuagaguuguuuguuuuaaaccacugagcugauuuuaugacccacccaugagauccaacuuacguuuuccuuccuuuggguaggaaagauugaaaaaguuccuuguuuaucuuuucuacuuuuuuuucccccuacuugucuuuccucauuaguguuaauaaugccacucccuuuaacuuauuuacacaagcauuaagguaucauuauuuaccuauuccuagaguuagaguccccuuucaaaggacgcaucagauuuugccugaauauuuauguuuucacuucugauuuauucucaauuuuuguacauuuaaagagcuauaauugauaaacugcacguauuaaaguguacauuuagguguguuuugauauauguauacacccauaaaaccaucaucacagucaugauugugaacaugucaauuacccccagaagauuucuugugcccuuuuguaaucucuccucaacuuucucuaucccccaugaguccccaggcaaccacugaucugcuuucugucacuagagauuaguuuacauuuucuagaauuuuauauaaauggaaucauauaaauguacuguuuuucuggcuucuuucaguaugauuauuuucaguuauaauuaacuauuaguuauaauuauucauguucauuauuaguuauaauauuauuauuaguuauaauuauuauucauguucuuauguguagccauaguuuauuaauugcuaaguaguauuucauuguaugcauaugauacaguuuguuuguccauccacucgugauggauauuugacuuauuuccaguuucaacuuuuauaaauaaagcugcugugaauauucauguacaagucuuuguauaaacauaugguuucauuuacuuagguaaauaucuaagaguagagugguugaaucaugugguagguauauguuuaacuuuuuaagaaacugccaguuuuugugaccgggcgcaguggcggaguucaagaccagccuggccaacauggugaaaccccaucucuacuaaaaauacaaaaauuagccgggugugguggugcauaccuguaaucccaguuacucgggauugaggcuugagaaucguuugaauccaggaggcagaggcugccgugagcugagaucgcaccacugcaauccagccugggcgacagagcaagacucugucucaaaaaaaaaaaaaagaaaagaaaagaaaaaagaaacugccaguuuucuaaagugguugugccauuuuacauucuggccagcagugcauaagaguuccaguuucucugcaucuuugccaacauuugguauugccagucuuuuuaauuuuaaacauucuuuuuugggggugguggagggaguacagagucucauuguaucacccaggcuggaguacagugcugccaucauagcucgcuacagccuugaccucccaggcuaaagugauccucccaccucagccuccugaguaacugggaccacaggugugcacaaccacauccagcuaauuuuuaaaaauuuuuggccagguacaguggcucacgccuguaaucccagcacuuuggaagguugaggugggcggaucacgaggucaggagaucaagaccauccuggccaacauggugaaaccccaucucuacuaaaaauacaaaaacaaaauuagccaggugugguggcgggugccuguagucccagcuacucgcgaggcugaggcgggagaauggcacgaacccaagagguggagcuugcagugagccgagaucgcgccauugcacugcagccugggcgacagagcgagacuccuaucuccaaaaaaaaaaaaaaaaaaaaaauuguagaaauggaaucuugcuauguugcccaggcuugucuugaacucauggccucaaacaguccucccacugcagccuuccaaaguccugggauuacaggcaugagccaccaugccuagccuagauuuauaauuaucauuuuaugcuuuucucucuuaaauaagaaaaaaggaggaggcuggaugugaugggucuugccuguaaucccagcacuuugggagaccgaggcagaaggaacauuuuggcacaguggugccuuagucaggcacagugguacuugccugucgucccagcuacucaggaggcucauguaggaggauugcuuagguccaggaguucaaggcugcaguaaccugugaucaugccacagcacucgagccugggcaacagaaugagaccucuuuuuuuguuuuuguuuuuaaaaaggaguuacaaaccaaaaauauaauaauaguggcuuuuauaguuaccuaaguaggcuuuuggguucuacuuauuaucuaauguccuuugagggacucccuuuaacauuucuuguagagcauaucagcuuuuuuuuuuuuuuuuuuuuuuuuuuugagccagagccuugcucugucgcccaggcuggagugcaauggcgcgaucucggcucacuccaacauccgccuccuggguucaagcaauuuuccugccucagcaucccaaauagcagauguagauauauacaagucuuuguauaaacauaugguuucauuuacuuagguaaauaccuaagaguaggaugauugaaucauguggauguuuaaaaacaaaccuagucuguuuuuaaaaagggaguuaaaaccagcuuuccccuggccaggcgcagugacucaugccuguaaucccagcacuuugggaggccaaggcagguggaucacgaggucaggaguucaagaccagccuggcuaacauagugaaaccccgucucuacuaaagauacaaaaaaaaaaaaaaacagccgggcgugguggcaggcgccuauaaucucagcuacucaggaggcugagggaggagaaucacuugaacccgggaggcggaaguugcagugagcagagaucgugccacuguacuccagccugggcaacauugcaagacucuaucucaaaacaaacaaacaaacaaaaaacuagcuuucccccaaagggagacuauuauagggagacuauuguucauugcuaauagauaggaauacugcagaaugggacuguuuuugauacuacuguuuuggaacuaguuuaaagaagagaugucuguaaguuuuaagguugaaaugaggcacucuuuuuuuuauucuuuugaggcggagucucacucugucacccggggaggagugcaguggcacgaucuuggcucagugcaaccucugccucccggguugaagcaauucugccucagccucccaaguagcugggacuacagaugcauaccaccaugcuggcuaauuuuuuuuuuuuuuuuuuugagacagagucucacucugucgcccagucuggagugcaguggcaugaucucggcccacugccuucaugguucaagcgauucuucugccucagccuccuaaguagcugggacuacaggcgcaugccaccacacccagcugauuuuuguauuuuuaguagagacgagguuucacuguauuggccaggcuggucucgaacuccugaccucgugauccacccgacuuggccucccaaagugcugggauuacaggugugaaccaccacgccuggccaauuuuuuuauauuuuuaguagagaugggguuucaccauauuggccaaacuggucucaaacuccuaaccucaggugaucuuccugccucagccucccaaagugcugggauuauaggcgugagccacugcgcccaaccaaguauccuuaacuggggguaaaggagaaaagcucaccuagagauagaagacagccaaauguccccaaguuccaucaaacucaaaacuuauuuuugaagcagaauuaguggcuauugauugacauaacguaacugaauuagcaacaaugaccuaaaccuguggccuugaagaaacaucuacgacuuauuguugcuuuuacuuuuaugaauaauucuucaaggaguuaagguaaaucuugcuugcuuacuuguucaucaccuuuugagcauguuccguaauccuugaagccuaaaauauguuauuagagcuauguaaaauacugguuaagguaauugauuuuucuuuuaccucaugugguaaacugaaaagcucaauacauuuuuuuuuuuaaagacacaugguuugacauguacuuugucuuacaggcagugaggucacucaaggagacaaucgaagacuguugggaccaggaugcagaggcucggcuuacugcacagugugcugaggaaaggauggcugaacuuaugaugauuugggaaagaaacaaaucugugagcccaacagucaauccaaugucuacugcuaugcagaaugaacgguaagacccuaagggguguggcaucuaucaaucaguauuagaaacugagacccaacaaagaauagaaaauaaauacuuuuaaaccagccuaauaguucaaugauuaccucauacaaucuaaaguuaucauuuuucuuucaauauuccuauucuucuauugaacauuuuuguuugguacaagugcaagaugaaaucugcauuuuuuaauauguaaagguauagugaaagaaguuagucuuucucuauuuaugguccaacuuuccugcaauaauaaagguaaaauguuuuuauaacuccaaaaguucauaagcacuucuauauaaauugucucauuuauccuuuguuguuauuccuucuuccucugcuuuuuuuuuuaaguaaauggaacuaugaacuugccuaucuaaccacuguuucacugacacuaagguuuguagacuuccuaucuaaugcucuuucuuauagaauauacuacuacuacuuuuauaugaaagcaauucaaaggucuuucuguuccaucauuaauauuauuuuacaagacauuuucuuuguuagaacuaugauuuuugguucuaaauagaaaggcuuuuuaaaaauuccuacaauuuggaacuuucuacaucuguauuucuuuuuuccauguuugggguaaaaaagccuuucuaugacuuugucauuuugucuaauacauguuuaaaacuuucagaaaggcauccaggaaaggguuacuggagaaaauugaaauaaaaauaaacucgauucuugaaacuuuuuuuuuuucugugugguuuuuguuuuuuuuuguuuguuuguuuuuggaaacugugucuuacucugucccccaggcuggagugcaguggcgugauccuggcucacugcaaccucugccucccagguuuaagcgauucuccugccucggccucccgaguagcugagauuacagucacgagccaccacgcccagcuaauuuuguauauuuauuagagacaggguuucaccauguuagccagacuggucucaaacucccgaccccuggugaucugccugccuuggccucccaaaaugcugggauuauaggcgacaggugugagccaccgugcccggccuauuuucuguucuaauuugugaaagcuauuuguauuagccauaggugaaaaauuugguuugcacuacuuuuguauaggucaaauuaguuucaaauauaaacucuuauaccuuguauaucagcaaaucaagaaaguuagacacuggcaauucuaauuauaaauuuucucacuuuacacauaccugaggacagucuucugcuuuuaucuccccucaucucuguauuucccauguccucuaguaugauguuuuuaccucucucaaaagucagcuaaagcuuuuauuuugaaugcuuucaaacuuuucuugaaugguaagaaaaaaaaaccuugauggcccaccuugauuuggccacuuuucgccuccugugucauucggcucaaccuucugcaugcaucuucucaucuccagucucuacuaauaauuuccucaaaauuauaauucaucccauaguuacgcuaacucuagguuuuauuuuccugagucuuacccuccaugucuccuuagcuuccuuuucuuguacuguauaacaauuuuuuuuucuucuuuuccuucuaucaucucccuuauaaauaacugucacucccaaggaaugacaaugacagcaaagaacccaugauaauuggagagcaguucugaaucuuugauccuuuauuugaacaucauauucugccuuauaccuuaggcucaaggacuuuuacugauaugacucagacuaccccagaaagauaugugccauuacuagggcaugccucuuaauggaggccuuuggaacaaccuaaaagcuuauauucuuuuuacuauuuggccauuggaacuuaauugauaacauaccuuuugaguaggcacuaugcaucuagaauuauggaaauacagaaaacauauaccaugguucuuccucucauaaaacauaacgucugguuguaugaauauacauuccauaaauauauauuucaugauguuauaaaacuauaggggagauuuuuuaauuaacuuauaaaccaaaauaaugaacauuuauaaaaauuauaucucauccacauacauuuuucaguaggcuuaauucacauaaaacuaacacuuaucaaguuauuaauugacacuugauuauuugauuagacuuuuuaaccuuuagaaaaauguacguuuggaagaaaaugaaaaacaacucagacuuuaaaaucagagguguuaaauuuggagagacaguuugucauaaauguacguucucaaugugauacuuuuuuucuuucuuuaagcaaccugucacauaauaggcgugugccaaaaauugguccuuauccagauuauucuuccuccucauacauugaagacucuauccaucauacugacagcaucgugaagaauauuuccucugagcauucuauguccagcacaccuuugacuauaggggaaaaaaaccgaaauucaauuaacuaugaacgacagcaagcacaagcucgaauccccagcccugaaacaagugucaccagccucuccaccaacacaacaaccacaaacaccacaggacucacgccaaguacuggcaugacuacuauaucugagaugccauacccagaugaaacaaaucugcauaccacaaauguugcacagucaauugggccaaccccugucugcuuacagcugacagaagaagacuuggaaaccaacaagcuagacccaaaagaaguugauaagaaccucaaggaaagcucugaugagaaucucauggagcacucucuuaaacaguucaguggcccagacccacugagcaguacuaguucuagcuugcuuuacccacucauaaaacuugcaguagaagcaacuggacagcaggacuucacacagacugcaaauggccaagcauguuugauuccugauguucugccuacucagaucuauccucuccccaagcagcagaaccuucccaagagaccuacuaguuugccuuugaacaccaaaaauucaacaaaagagccccggcuaaaauuuggcagcaagcacaaaucaaacuugaaacaagucgaaacuggaguugccaagaugaauacaaucaaugcagcagaaccucauguggugacagucaccaugaaugguguggcagguagaaaccacaguguuaacucccaugcugccacaacccaauaugccaaugggacaguacuaucuggccaaacaaccaacauagugacacauagggcccaagaaauguugcagaaucaguuuauuggugaggacacccggcugaauauuaauuccaguccugaugagcaugagccuuuacugagacgagagcaacaagcuggccaugaugaagguguucuggaucgucuuguggacaggagggaacggccacuagaagguggccgaacuaauuccaauaacaacaacagcaauccauguucagaacaagauguucuugcacaggguguuccaagcacagcagcagauccugggccaucaaagcccagaagagcacagaggccuaauucucuggaucuuucagccacaaauguccuggauggcagcaguauacagaguaaguggagggaucauauaaucucuccugugugucuuuuggggccauuuaaauaacuauuuagaaucaacuaauagauauauuucaacuagugauuauuuaccuuuaccacuuuuguaaaugauccauuugaggcggggcacaguggcucacaccuguaauccuagcacuuugggaggccaagggagguggaucaccugaggucaggaguucaagaccaaccuggccaacauggcgaaaccccaucucuacuaaaaaauaaaaaaaauuaggccaggcgcgguggcucacgccuguaaucccagcacuuugggaggccaaggcgggcagauuacuugagaucaggaguucaagaccagccuggccaacauggugaaaccccaucucuaaaaaauacaaaaauuagccaggcgugguggcgugcaccuguaaucccagccgagaucacgacacuucacucuagccugggcaaaaaagugaaacuccaucucaauaaugaaauaaaauaaaccauuugggccaggcgugguggcucaugccuauaauuccagcacuuugugaggccagggcagguggaucaccugaggucaggaguucgagaccagccugaccaacauggugaaaccccgucucuacuaaaaaugcaaaaauggccaggcacaguggcucaugccuauaacccagcacuuugggaggcugaggcagguggaucacgaggucaagaguucaagaucagccuggccaagguggugaaaccccugugucuacuaaaaauacaaaaaauuagccgcgugugguggugggcaccuguaaucccagcuacucggaaggcugaggcagagaauugcuugaacccaggaggcggagguugcaaugagccgagacuaugccacugcacuccagccugggugacagaaugaaacucugucucaaacacacacacacacacacacacacacacacacacacacacacacacacacaaauuagcugggugugguggugcccaccuguaaucccagcuacuugggaagcugaggcaggagaaucgccuuaacccaggaggcggagguugcagugagcugagauugcgccauuguacuccagccugggcagcaagagcgaaacuccaucucaggaaaaaaaauaaauaagccauuugguugggccucaaagguaauuagacuauuguaaagaaaaaaguaauauuuuugucauugauaauuaaaaagucagugucacaauagucagaauaauuacccaauuuaauaugugcuuuauguggcugcugcuuuauaaugcaacucacauacuugcuaugaaaaguugaaauaaaguaaauacaguucaagagcuccaaguaauguuauaccaguauaaucuuugaaacauuuuauugcauauauuaauauugauuaugucugcauuuagguuuuaucaaacuaaccuuaauaaaucuuaaagauccagagaaauuuugggaaaauuacuauaaagaaacuguaggcuaggcacgguggcucacgccuguaaucccagugcuguggaagacugaggugggugggucacuugaggccaggaguucaagacuagccugggcaacauagcaaaacuccaucucuacaaaaaauuuaaaacuuaguuuggugugguggucugcaaccucugccucccggguucaagugauucuccugccucagccucccgaguagcugggauuacagacaugugccaccaugcccugcuaauuauuguauuuuaguaaaggagggguuucgccauguuggccaggcuggucucgaacacuggacuucaggugauccacccaccucagugucccacagugcuggcauuacaggcgugaaccacugcgcccagccuauuucucuuuuagacuaaggcauuuaugaaaaaaaguuauguuuuauugucaagggcuacaaaaugggcuugaaggaaggauacaggucucaaaacacaaucaggaaaauuuagccccuugcuugaguggcuuguauuacagaucaguugacagaccuuuauugcagggcucugagucaguaagacaucgugucagauaggccaggcaugguggcuuacgccuguaaucccagcacuuugggaggcugaggcgggcggaucaccugaggucgggaguucgagaccaaccugaccaacauggagaaacccggucucuacuaaaaauacaaaaguagccagacgugguggcacaugccuguaaucccagauacuugggaggcugaggcaggugacuugcuugaaccugggaggcagagguugcggugagccgagaucaugucauugcacuccagccuggcaacaagaaugaaacuccaucucaaaaaaaaaaaaaaaaaaaucuugucagauauaggaagaggaaauuauuagaauguuuguacucuaauauuucuguuauucuucugaaaaauauuguaugccaggugccuuuaaaauuugauccaggcugggcaugguggcucacaccuguaaucccagcacuuagggaggcugagucgggcacauugccugagcucaggaguuugagaccacccucggcaagauggugaaaccccccgucucuacuaaaauacaaaaaauuagcuggucaugguggcaugcgccuguagucccggcuacuugagaggcugaggcgugagaaucacuugagcccgggaaacagagguugcagugagucaagaucaugccacugcacuccagccugggcuacagagugagacuccaucccccaaaaaaaaaaaaaaaauuugauccaccuugagcauuaaauacaauuaaauacaauaauuaaguacauuuuaccaaguuaagaucgcuaccaaaaccagaagauuugagaauacagcugagaaguuuaaauguucuccuguguuuuguguguguguguuuucccuugccuuauaaaauaagucaaucaguuauuaaaacauuuggguuaaagagucucaaaaauaaguugguuaagcuuuuccuggaaaaacauugucuggcauuaugaauuucaagaaauguucauuagcacccuccugagacauugguuugaccuuuucuugaguuacaucccuuacccguuauuucuuaaguuuguuaaauagcucauuuuucugcacuuuuauuuucaguaggugagucaacacaagauggcaaaucaggaucaggugaaaagaucaagaaacgugugaaaacucccuauucucuuaagcgguggcgccccuccaccugggucaucuccacugaaucgcuggacugugaagucaacaauaauggcaguaacagggcaguucauuccaaauccagcacugcuguuuaccuugcagaaggaggcacugcuacaaccauggugucuaaagauauaggaaugaacugucugugaaauguuuucaagccuauggagugaaauuauuuuuugcaucauuuaaacaugcagaagauguuuaaaaauaaaaaaaaaacugcuuuauccuccugucagcacccccucccaccccugcaacaaagacuugcuuuaaauagauuucagcuaugcagaaaaauuuagcuuaugcuuccauauuuuuaaauuuuguuuuuuaaguuuugcacuuuuguuuagucucgcuaaaguuauauuugucuguuaugaccacagaguuauauguguguguaucaaaaguggucucaaaauauuuuuuuaagaaaaaaagcaaaaacaauguauugcugauaaucaguuuggaccaguuucuuaaggucauuaaaacagaagcaaauuaagacagguuugacugcaguggugucugguauccauguuuuauuucugggcacaagcuaguuuuuauguugauacguuccugaacauauuaucuuguuggacaucuuuucucuuguguuuuguuugaaugugcaauaguuuauaggccacaaauaagcuuucuuguaagcucucuuccuaacagggcacauauucuuccauaauauaaacacuuuucugccccaucucccauacuuuugaaggucaguucuaugacagugaauuuugcacaggagaagcagcuaccugauuucuuacuuucucucuccuuaucauggagaauacagaaacauugucugaaagggcucuaaagaaggaacuaccaaaaccugacuugaaaugccauuucuuuuaaccuuccaaauccuaaauguuuccuucaaggcaucuuaauaaacuuauuugcuucugguuuugggaguucauaagagagaauagaacaaaauacaggacaucaaauauuagccauuucccauuuuauuuuauuuuucuauguagguucauguuccauguucauuuauuuaagaaauacauuuuuauugguaagcuuauagagcuacacuuauggaauuuuuaaguagguaaauaaaugguuaagacaaaauaguguuauagccuucauucucugaauaggccaucuuugacucauaaaauuacccuuacuguuuauuauaacuucagaaguaauuuauaguucugaaccuauaguaucuuuuacccuguucccaagcaaagacuggugacuuuaucugaaaaugauuccucuucccaugaccuaaaacacugugaggaaaaaucauucaaguggcaugccaagucccuaugaaggaagggcugcuaucaaaccuaccuuuuuugagcaaacugagacuaaacuucucucuuuucaaaauuguguuaucuuccuuaauccuauuuucauaauuuuuccuuuugccaguuuuucacauuaucuuugauaugugagcaacauuuauuauuuacauuagaguauaccuuuuaguaauaaaaugacuugaaaucauauuauuuuuaaaagcccuuugcuucuuucauuacuuauaaucuccucuaaaacaaccucugcauguuuuuuuuaaauaaagcacuuucugucaaauaauggacuuuuuucuaaacagaaauuauuuucuauuaauuugcaaacugaugauuucacuuuuuuuuacuuuuuuuucgauuaucagaguacuuaguaaauguuauauaguuuaguucuaagauaguuccagggauuaaaagguuaagaggaaaacacaaaucaccaaauuucugauuuauguuuuuaucuccugaacaauauuuucucacucauauuccucuaucuuaucacuuagcuaaagacagccuaaauuucccaauuuucuguccaaaauauuugugauuuacuuguauauaagccuucucauuugccaugugcugugaucuuacaaguuagauguuacuauaccuaccauuuauucagcuggauugcugaacacaguucuggauucauagaauuaagaauaucuuguuagugcccaggauuuccacguuuuguguuuuauuggcccuuuucuuuauucagccccuuaaucuauuuucagucuucuggcacguaauuuuuuucacaguuauuauucuucuauuaacaaauuauuuuuaucuuuccuaguacauuuucacuuaguucucuugcccuuaaauaucuuucacaugcauuuuaggauauucuuuucaaauauuuguaggacaacuuugaaucaaaauaaauuauguuccuucuccaauuugaagcauugaggauaaaugaccauuugaggucuaacugaucuuuuccugccagaagaguuaucuuacguucugcuauauuuguauuugggccaguugauuguagguuguccaacauuuuuuaauauugggaaaauuaugauaaaaugcuuuaaaaauuaauaugccagauuaaaauaacugaauaguuuacuauuucauucaagcauguuuaaaacaaauaauuuccuuucaccaguuuuucuuaguaaacuccugaaaaaguaggaaagguggaaaguauauaucauuuuuauaaauuuuaaauuguacaucagacuuuuaaaaucuguaauauacaagcaagcaaaauuauuuuaaaugacuuaauuguaugcuaauacucaucugauaauaaaugcuucuuaaaguugacauuuaacugcuaucacaaaguuuuauauguagaaaagugggguccuuuugaauaaaagaucauucaacuaaaaauauuaaaauuuauuucacuggaugguaauguaaccuuaaaagcaucauaauagguaaagucuaauauuaguucccuuaacaaaauccuaacuguauaccagaauuaggucacugaaagaacuugauuugaauuacguuuagacaaaaaugauuuaauuguaaauucuuaaaacuuucuaaaugcauaauuggcaaaaaaaaaaacccacuguuaccaguguaggaaguuacaagaaggcacauacugaaugcugaaguauacauaugcuauuucucuuaaaccucagagcaaccauaugagcauuguaauuaauauucccauuuuacagaugaggaaacugaagcuaagagaagcuaaguaauaugcccaagguccacaucuaguaacagacaaagcugggauuucagucuaugucugccucucuccacaucucuuucauccauaccacacugccuacaugccauaugacaggauguguaaugggcuaacguuuauuuaaaaaguucaggccaggugcaguggcuuaugccuauaauccccgcacuuugggaggccgagccggguggaucaugaggucagacguucaacaccagccuggccaagauggugaaaccccgucucuauuaaaaauauuuuuuaaaaauuaacugagcgugguggugggcgccuguagucccagcuacucaggaggcuaaggcaggagaaucucuugaacccgagagguggagguugcagugagcugagaucgcgccacugcacugcagccuaggcgacagagcaagacugccucaaaaaaaaaacauaaaaauucagucacuauacucuggcacaauuuucauuuguauaugagccaaaccacauaccuuaaugauuugggaaguuaggcaaauaugagauauguagacauaucuaugcugauuguugcuugagaaauaauuacuaauucuagacaaaacucaauccuguaucuuccaucaugaaucuuaaaaucauuucacuucacuccuaacauuucuuacauugcagaacuaaugguaaaguaaauuuuacggaaaaaguuaagauagcuuugggaacagagaccuuucccuaaauugauuccauagcagauuugggggaauuaacaaagaauuucagucucaucaauccuuugaauccaucuucaaaacuucugcuuuuaauaacuuuagaaaauuuacuaaucuauagaacuaauugaguaggauauaggaaggauacaaggauauaauguccuuuuuauaaaaguuuaguauagcuucuuuacauguauccacuuguuccagaaaaugugcauugguucugaaugugaaaauauuuaaagagagaaaggaacacucaaguaagugugggcuucagugggaauuaucacaaaacauuggcaaguauuuuuauuuaaauuauuuucaaauuugacuucuacagccaaguggaauugguaggcuguagcuguuacacugaaauuucuagucuuuguaagugccuccugaaagucauuuaaaauggaaaaauauuucaaugagcuuuuccuuuuuucauauuuauggacaugaauauuuuauuggagaucauuaacuccuagaauuugagauuauauuuccauacaacauuuuauaaaguuauguugaacuuacuaccuguuaugugcagguuauuauguaacuauucacagauugcuucauauauugcuuuaucuucccaucuaacuucuuaaaguuaaaauccggacacacauguugauuaucuagaccagucauucuggaaauuguaacacucccacauaaaccccaggagacuuuuucagaaugcaauguuucuaaauguacuguuacuggcaguuuacucuccagcauauaagguugcauuuuaacuuuuagauuaugaacugugcaaacuuuacccaaaacuaucuugcaugauucccuccuaaauauauuccuugauuaaguaaaucuggcaaaucacuguuugagcuaguuacauaaaauuuguuaucaagagaaggcuuuucuacaaguuuccagauuaacauaaagaaaagagggaaucacagggcauuuaagugcaccuucccauuacuuuccuuaaaucaccucauaguuaggcugggcgcgguggcucacgccuguaaucccagcacuuugggaggccgagacgguggaucacgaggucaggggacugagaucauccuggcuaacacgaugaaaccucaucucuacuaaaaauacaaauaauuagccaggcaugguggcacgcgccuguagucccagcuacucgggaggcagagacaggagaaucguuugcacccgggaggcggagguuguugcagugagccgagaucgcgccaaugcacuccagccugggcuacagagugagacuccaucucaaaaaaaaacaaaaaaaaucaccucauaguuuaugucugacuuacuccaaaccucaguuaucugauuuguagucugugucaggaaaguuuucuucauaucuauucugucucccuccucuuugauuuuaaauuuuuuucuuuuacccaguaggacaaaaaagagcaguuggucaucauccccaauauucuuagucuucaguaugcuucaggccucucaaugaacacuuaagucucaauucuucagacaaaauugcuuaagcucuucuccucaguccuauuuuaaugacuuuauauuuaagaauauagaauuauauuuucuuuuauauucaaauucauuacuccaguuaaguaauaguuugauaguuugauagaaucgagaguuaagauguuucuauuugaaaguggauucaaccaucagaccaccagcaaaucggcacuuaauuuuuguguuaucuaacauuuucuauuguggaauuuuaugauuuuauauucucauuaguuauaacuaaaaagccaugcacacagaauuguauaucauuuugccauuaaaauuuuuuaacauauugcagcaagcuuaguuuuaugauugagccacaaccuuuuacauauuuuuuguaugaaauauuaaacacuaaaugcaagauuaacuuucaaaagcaaacccuacauuaaucagguauuaucuauggacauuuuuguagaccacuuuugaaauacuuauuauuuugcaacauagacuggacuauacaacuuucauuuaacuuuuaggugacugauuuaaguugagugugcauauagagaaaaaccuagaaauuuaucucauggcagauacauuugaaaguacuucagaagaauuuaugcuguauauuaaaacuaggcucaaaauaaaucuaucguaucuuuaaaaguccaauucuguuauuacugugauguuuguaguguuacuauuaaacauugugaacauacacauuuuuaaaacaacuugaaacccauuuuaaaaucuggguaagagagaaggaaucuucagaacaaaaucacaucauuaggguguccaguuuaugauugaauuuuuaagcaaauuacuguauuugaaacuacaacuugauuugguuuucaguuuuaaaaggcaacauguggguuuuauccauuuuauuuauaccuuuagauuucagaaacaucuucauguuuuagaugcauucuacagacaucauguuacuuaaaaacucagggccccuuucaucccuuuguacacugaaaaaguucaauuguuagcaaguaagcaauuagauccaguugaauauuuaaaguguuuguugcacaguucauuuaauguuucaucuuauuugacuuuuucacauagauauaauaucagauuucauuaauuauaaaaaguugcccaguucuguaauuacugaacagagggaaugacucaacuaauuggcuacauguugcaacaaauuuaggccuuuagaguugaagcacugacuuaaaacgacuuacauuucuguucuuuggucaaaugaccauacaugauaugggacaaauuguuucauuuuguuuguuuuuuaauaagggaacuugguaaaguaguuccugucagauaggauuuucucaagagacaauuuaacguuauaaagccuucuaaaagugaacuaaauauuuuauaacuuuaguaauagcuuggaugguuuugagaaaauaaccuguauuuaucacauugucaaacagaauuuuucuuugaaucagacaaguucaagcucuaaauugaugugcuauauacuuaaaauccuaggaaguuaucuguaaccagucucuugucucaggcucuucaccuuguuaccaauccucguaaguauguaaaggaaacauauuuuuaaagaagcuuaacaguaagaaaaaauuacuaaaagaugcaauucaaagauaggucccaguuuaacacugaauugcuugacuucuguggcuuuucuuuuucuggccacauuuauuuauuuaagcaauuuuuguaugccuuguuauuucauuuccauagagauuauauuguaucaguguuuauguaagcuggaaucauccucaguuuuuugcugauaauuuuucaaauaaagauacauggauaauuguaaaauacacuaacucuuaggguguuguaguagcugaaacauggagaugcguagcugucaugcuuuuucugaauggacaggagaaacauaagcuacggaguauucacuucugaggaugcuuuuccggaaaaagaaaggcuagaaaauacucgcacuuccucagaacccucuuucuuguuaacggguaucuuuuguugguguguuuugcucuuacauuacagauagacuaucauauaugacuuuaugaauaauuucaguuauuuugcuuuuguauaagcugucugaagccuugcuaugcuguauaaguuguguuugauggaucagugugaguauaaaauaaagcaaaucacuuuucuuuuguauuaucuauggaugccacuaugaaagcugacauuaagccacuaaagaguuuucuaugaauaaguguaaguaaaugcuuugauauauauaaaccuaaauaaaaagauuguauugauacagagacauuggagaaggagauuuuaaggcaguucuuuagguuuaaaaaggcuugcuguaaaauggugcguuauuccguuuauuaaagaucauauuaaugacaaua

SEQ ID NO: 191114 - RNA, 134580 nt, Homo sapiens
gggggggaccaugucccagcgggugaggcgcaaugggucccccacgccggccggcucccuuggggguggugcgguggccacggccgggggacccgggagccgcuugcagcccaugagggcgacgguuccguuccagcugaagcagcagcagcagcagcaacauggcagccccacgcggagcggcggcggcggcggcggcaacaacaacgguggcugcugugguggcgccucaggccccgcaggcggcggcggcggcgguggcccgcgcaccgccucgcgcagcaccagccccacgcgcggcggcgggaacgcggccgcgcgcaccagccccacgguggccacgcagacgggcgcguccgcgacguccacgcgaggcaccagccccacgcgcagcgccgcgccuggagcucgcgggagccccccacggccgccgccgccgccgccgcugcugggcaccgugucgucgcccagcucgucgcccacccaccuguggaccggcgaggugagcgcggccccacccccagcccgcguccggcaucggaggaggucuccggagcagagccgaagcucgccggagaagaggagccccagcgccccgguuugcaaagcagguaagugcugggggucgcgcagcaagggggaggcggcugcgggaaggggucccgggcgcgcgcugcaaucgcgcggggacugcagagcugccgcggagcccggguggcugggggcggggcugggggcggugccgggcggugggggacccggcagugcggccccgccuuucccgggccuacccuacgccccgcccgcccgcccgccucauucaccccucugcccgccccgcacggcucccuggugguggaggugcagcggcuaaaccuugggcuugagcugaugaguguuaaugauaaaccuggcuuccuggccuuacuccuggaggagucguuacugcuuacccucccuugagggugaggcuaggagugguuugucacuuuguuuuagggacaagguuaauguuggcauagcccauaucugcugcugcuaaguauuucuguucacaaaacaguuucagaucugggguacugaaugcauuagcaguggcagauuuggaucacugaacagaggaggcugagaaccguguuuuagcauuuccuaagacuugauaaauggguagcaagaagugaaaauuaaacaagauuccuuaggaagguuuauggguuuugucugaggcucuggguguauuucugauuuuguguacugauucuguguuuugaauguagaaaaacagaauccaguguuuugucuccaucuuguuauuguuuuagggagcuaacauucguuguuuuucuguuuaccuggaagcuuucuuggggaagguccugaauggagcuguugggugccaauggagucauucauaaagaguaacucaaaagagaaauucaaauugugggaaguggaaaggaauaaaauuuauaaucuuguugccuuaaggaaagaaaugggugguuuuuacuuacguauucauuuuugucaacauauaucuuugucuuuccuugucuggggaacuucuguuagaauuuuccaggcagaaugguugggaauuucaggaaacaaauucagaugaaauaguuuccgaaauggaaggaauaggaugacucuuucuuacuauuuauuuuaugaaaguuuuagauaauacuuauuuagagagaauugcccuggaaaaugaugaauaguauuuucuuuuuuugagacagaguuucuguugcccaggcuggagugcaguuacacgaucucggcuuacugcagccuccaacucccggguucaaacgauucugccucagucuccugaguagcugggauuacaggcgaccgccaccaugcccggcuaauuuuuguauuuuuaguagagacaggguuucaccauguuggccaggcuggucucgaacuccugaccucaggugaaacgcccgccuuggcuucccagaaugcugggauuacaggcaugcgccacugcgcccggcccgaauaguguuuucuaauuagaaccagagcacuguuuuauuuauguauuuauuuuuauuuauauuuuuauuuauuuuuugagacggagucuugcucagcugcccaggcuggagugcaguuaugugaucucggcucacugcaaccauggucuccuggguucaagcgauucuccuaucucagccucccgaguagcugggauuacaggcacccgccaucaugcccggcuaauuuuuguauuuuaguagagaugggguuucaccauguuugccaggaugguuuggaacuccugaccuuaugugaucugcccgccuuggccucccaaagugcuaggauugcccagcccagagcacuauuuuaaaccuuuugagaaugcagaaugcuuuucuaaaacugugauaaaaguacuagauuuccccucccugcuucauaaccucugucaccuacugaacucuuacuauuuggcaggugguuuuuaugcaaaaucucauuuaacccucacuauagcuuuuagagagguuaaguaacaaguggcagaguugguauuuauuugaacuuuggucaguuguacuccaaagaccaugucuuuauauuauaucaaggaagugacaucaugauguguaagauagaaugugggaaauauauagcacaccaaaauuacauguacuuaguuagguaacuuuuuuuuuuuuuuuuuuuuuaagauggagucucacucugucaccuaggcuggagugcaauggggcaaucuuggcucacugcaaccucugccucccggguucaagcgaugcuccugccucagccucccgaguagcugggauuacaggcaugcgcuaccacgccuggcuaauuuuguguuuuuaguagauacaggguuucuccacauucgucaggcuggucucaagcucccaaccucaggugaccugccgaccucggccuccccaaagugcugggauuacaggcaugagcuaccgcgcccagccacuaguuaaguaacucuuacagauaugaacaaaacugcuucaguccuucagccuucuggagccagcauagugcaucagguggaagggaaggagcuggcuuauaagugggcaguagagguggcagaaggaggcacagccuguagucugauaacagaaucuggcucucuuaacaacuguuugacacucagagaaacacccugaggagaacuggguugaauuaaguauuggcaagguguggaggaagguacucuuuuucucugaucucuaggagggcucuauuuccugggaugucaggcuacucccauguccucucuucaugguuuuugaacgcuccccuucccuagaucaucccguagaguauuugcuguaaaauuauccccauuugcuccccuaucaaaauaaauaaauaaauaaauaaauccagaaaaauaaaaacucuuauuucucaaaguguagucugugguuuaucuguaucagaauuagggugugugguauaauaaaaaauaauuuggccaggcgcgguggcucacagggguaaucccagcacuuugggaggccgaggcgguggaucaccugaggucagguuuaauaccuguguuccgccaacuagaaaaauaaaaacucuuauuuuucuagugcagcacuuucacuugggugugagaaauauugucuguuauuaagucauacucuaguuugaaugucucauaguuucauucccaggaauuguuguuucacucuaguaaauauccaugcagaguagaacaaaguguuuucagauuucagguguucauaacacacacaaaacuacgaugaaaucauuugcuguuuuuaucugacuaaaucuggaaggaaagucuuuguaaacgucagagucccuuuuucauuaaagggaggcuaccaccaguuugcagcugugaugaauguaaaaaucccuaccguaaaggguaagggucuaccccauauaauucuauaaaccucauaggacucaaauuucaggguccaucuagaucaggcuguugacuucuaggugucuuaucagaugaacuggaugcuguaaccuuuguuagggauccgguaucucagagucccuaaguugaagguaucaagaucccuauccaguugcuuuauucuucuaggguuagagcuaauuggcugguguagaacuuccuacucuugacuacuauaaaguaauccaagcacccaucccugacagauauuuuaaacuucccaccuucagugacugucaucuccauagcaaagccguuugucauuaggaacugagguauguuuagaaaagguaccuaggcaacaguguuaaccagaaaguuuauuuuugugccuucucuccuuuuacccaacuucauuuuacuuauuaaaaugucaaauagauuacaaauggagagaugguauaacaucgaggugaggaggauauacuuuggguagacaguuugaguuuaauaccuguguucugccaacuagaagccaugugauauggaaaguuauuuuucuuaucugugaaauggguggugaaaucuacuucauaugauaguagggauuaaauaagggaaaacugaaaaacagcacaguaccucaguauaaaaguuagcuguuguguaucauauuaguuuugcuucuaguuuuaguguauuuaacauaaauuaccaguguagguucaguuuucaugguuguaugaaguuucaaauuggugauaacauugccugugaacauccagaaugguguuucucaaaguguagucugugguucaucuguaucagaauuacuuagggugugugguauaauaaaaaaaauuuggucgggcacgguggcuuauaccuguaaucccagcauuuugggaggccaagguggguggaugaccugaggucaggaguucgagaccagccugcccaacauggcgaaacccugucucuacuaaaaauacaaaaaauuagacaggugugguggcaggcgccuauaaucccagcuaccggggaggcagaggcaggagaaucacuugaacccagaagguggagguugcagugagccgagauugugccacugcacuccagccugagcaacaagagcaaaacuccgucacaacaaccaccaccaccaccacaaaauauauauauauauauauauauauauauauauauauauauauauauauggcaagucguguucuugcuaguuucccccuuccuuuggauguauuaaguuguguauaaauucguuuguuuauuggaguuggggagugccaagggcagcaaaaagugauaacuucuuuggacuaauaggcagaaucaagaagcaagauaaccagaacuuauauuugugucaucuuugaugucuacuuucuaguaccuuaugaaauaugucucuaagaauuuaguguuucucuaacauuuggaggauugcugcuaacauuacacauucaagggaauucuuuuuuuuuuuggagacugggucucugucacccaggcuggaguguaguggcacgaucucggcucacugcaaccucugccuccgggguucggguaauucucccgccuuagcuucccgaguagcugggacuacagguacaugccacuaugcccagcuaauuuucuguauuuuggguagagacuggguuucaccauguugcccagggugcucuccaacuccugagcucaagcuaucugccugccucagccccccaaagugcugggauuagaggcacgagucacccacacccggcuaaagggaauucuuuugguuugugaugucuauauuuugcaaugaagaugagacaaaguagaaacuauuaguuuuaugucuuggcuaguagaauuuacauuuaauuaaguuaaauucuguaagcuuugauugaacuacucuguguuauuaacaguguaauacaaagauguaaaacacacaaggaauuccagagacucacaaacuagccauguaagacagauacauaagcauauaaugugaugaguuuucuggcuuagagagugaauaauuccacaggggauggguauagagguucccucagaggagaugaauuuugaauuggauuacaaagggaagaacagaacuuugcaguuggaucuuagaggugugaaaauaagccuaucauauucaguucuuuguggcuugaaauguaggguaauaggguguugggauggggagagcggaaauaguagagaaagaagggagagacguaaguuuucagaaugacuuugaauagaauauauacauuagaaaguauuccaugguuaauaguauguacucuggagccagacugucaggguucagacccuggaguugccauuuacuugcuagcaguuuaacuuuaggcaaguucacuuuacuuguaaaaaggggauacuaaugauacuuaccguagauaauuguuucaaggaauaaaaucuuuguaaucugugugugggguauaggaaucucaauauuagauauuuuauuuucuuuuuuuuuuuuuuugagauggaguuucacucuuguugcccagacuggagugcaauggcagaucuuggcucauuguaaccuccgccuccuggguucaagcgauucuccugccucaaccuccugaguagcugggauuacaggcgccugccaccacgcccagcuaacuuuuguauuuuuaguagagacaggguuucacuauguuggccaggcuggucucgaacuccugaccucaggcgguccauccgccucggccucccaaagugcugagauuacaggcaugagccaccgcgccuggcagauauuuucuuuuuuuuuuuuuuuaucggagucuuacucugucgcccaggcuggagugcaguggugugaucucggcuuacugcaaccuccgccucccagguucaagccauucuccugccucagccuccugaguagcuggacuacagccgugugccaccaugcccggcugauuuuuguacuuuuuuuuuuuuuuuuuaguagagacgggauuucaccauauuggacaggcugguccugaacuccugaccucgugaucuguccgccucggccucccaaagugcugggauugcaagcgugagccaccacgcccagccagauauuuucacaucauugucuuccuucucauccaaggcuuuaggcacucacaguuauuauuacuaguauuuauauucuuagaauaaauagaauauauauauauauauauauaaaaugaguagagugugacuugagauaggagaaacucacaaaggcauugaucaccugaauuuugggggaauggcagugggaauggcaagaguaaaaaagauugaaaagacugauuuggcaaacuguuggauguagggauugagaaacggggaguugagggugauaguuuggauggugguucuaauugauaacagugaggagaacagauuugggaaaagaaaaugaacucaguuguggauguauuugguuugugcucucaggaacuucagauaauuuucuagauuguggcaaauaacauuuuaaaacucagggauacacuuugaacuuggggguaaaaauuaggacucauuuauugcaguucaguaaacauucauuuaacauguacaucaugcuaggcauuuacaugugggcaacacucgaaaugacuaaucacuaggguggauaaaaugauagggaaaaugcugaagauagaacucugggaggaaacaagcauuuuuaaggguagaaagaaaagccagugaagaaaccugugaaaugugguaggaggagaaaugguagaauaguguugagaaagccgaaaagaaagauuguauuucaaggagagauaggaaagauuuucaaaugucgugaaguaggcugagccuggagaauaggccuuugaaucuggcauguagauuagucaaugaucugugagagaaaguaguuugagaagcauguugggggcacaaaucaaaguggaggaugaggaaguagagguaaugaguauaaaguacuuuaauguggacggaaggaaagugaaaaaacugggugaagggugugcuuaagcuucaguuauuuacaggauguggaaaacuucagcuuguuuauagcuuuuagggaaaggauuuauagaaugaaagauuguaaauucaagagaagaugguaaauguagauggagcaagguuauggaaaaugcgagaggcaugggauccaguacaugguagagucuggaaaucucagaaacaaggacauuuuuuucucugaggaggggaagagguaagggcguagguuaagaugauagguaaaucagcaguagaagggaaggaaguugagaaaguaagcuacuuccuuuuccaaacuacuugaaggcaaaaauagcaugcuugucuuuauacuauauuuuuaaauuuaaauuuauuuuuuuaaacuacgugugcauaauuuaaaaugucaaauagcacugaacuuauuaucaaauaaaauguucccuugucacaucuuucuccacucccucuuccugcccccuagaaacaaccacuuucaacucuuagagguuucuuuggcuguuuaccuacacauuucuuuuucuuucuuucuuuuuuuugagacagagucucgcucugucacccaggcuggagugcaaugucaggaucucagcucacugcaaccucugccucuuggguucaagcaauucuuaugccucagccuccugaguagcugggauuguagguguguagcaccauucccugcuaauuuuuguauuuuuaguagaggcaggguuuccccguguuggccaggcuggucucgaacuccuggccucaagugauccacccgccuuggccucccaaaaugcuggaauuacaggcgugagccaccgugccuggccuacacauuucuaaauaauaugcuauacuacugcuuuaggagcuguuuuuuuuuuguuuuuuuuuuuuuuuuuuuucaguuuuauguauuauguagugacuugcuacuguggaaaauguacacuuaauucucuaaucaccauccuaccgaauccuuccauuguagguguagcaucuuuugguuaaaucaguauuaauguuauuaugaccauguaaauauugauuacaguagagccuuguuggauacuacaguuauauuuucuuuuuaaauaacuuuuuguggucuuugagguuaaaauuguuuuucauuuugauugcuucguuuucuauguaccuaucacaaauuuaucccuaagaaaguuuugauaauggaaacuuccuguaaauaauuaaaaacauagcagagaguuacuuuuguuuauuuuccuuggagauaugucuuuuggagucccucauccucauauuccaaauuagcucauugaucucuacaucuguggcacagcuauuagaaccgggaacuucccugggaauucucuucacuucucuccuguuuuggauacucuaauuucuggauguuguuuugcuggagugcauuuuccaauaauuuuuugagagaggauacaugggagguauauguuauacccagaccuugaauaucuucagugaugucuuuauacuugccgguuugacuggguauagaauuagaauuguagguuggaaauaauuuuuccacuggguauugaaagcacuucaucuucuagcuuuuggaauugcuguugagaauuuggaugccauucugauucuuaauccuuuguuggugauggugucuguccucuguggaaggguuaccaccauucugaaaugaggauugccuuguugugagguguuucauuguuuguuuucuguucacugugcugguuacucugugggcuuuuucagucuagagacuauuucugggaauuuuucuuuuauuauuucuccuuucuguuaucuuuguuuuuugucuuuuuggaagcuguguuaucuaguugugguauaucuuggagcacaucuguaauuuaacaauuucugucuaguuuccguaucuuuaucuguuugcauuucuuuuuuauuauuuuucaaaauuucaaaauauauuuucuuuuaaaaaauagagacugagucucgcuguauugcccaggcuggucuggaacuccuggccuuaagugaugcuuuugccuuggccucccaaagugcugggauuacucacgccuggccuguuucuuuuuuuucuuucuuuuuuuuuuuguuugucuguuuuugagacagagucucgcugucgcccaggcuggagugcaguggcgagaucucggcucacugcaggcuccgccccccgggguucacgccauucuccugccucagccucccgaguagcugggacuacaggcgcccgccaccucgcccggcuaauuuuuuguauuuuuaguagagacgggguuucacuguguuagccaggauggucuugaucuccugaccucgugaucugcccgccucggccucccaaagugcugggauuacaggcgugagucacugcgcccggcagccuguuuuuauuucuaucagauuuauuuauuugagacggagucucgcucugucgcccaggcuagagugcaguggagagaucucggcucacugcaaccuccgccucccggguucaagcaagucuccugccucagccucccgaguagcugggacuguaggcgcgcgccaccacgcccagcuaaauuuuuuguauuuuuaguagagacgggguuuuaccaaauuggccaggcuggucucgaacuccugaccucaggugauccgcccgccuuggccucccaaaugcugggauuacaggagugagccacagcgcccggccuaucagauuuauuuuuaucuuguauucguuuuauugauuuuuacauuuuggccauuauacuucaguucuucaagagcacuugccuugcuguuuguucuuuguccuguuaaugccuaaaaguuuuuuguuuuuuuuuuuuugagauggagucuugcuccguugcccaggcuggagugcaguggcacuaucuuggcucacuucagccuucgccucccggguucaagcaauucucccaccucagcccccugaguagcugcgacuacaggggcacaccacuacaccuggcuaauuuugguggguuucaccauguuggccaggcuggucuugaacuccugaccucaagugauccgccugucuccaccagccagaauguugggauuauaagcgugagccgcuuggccuggccacuuucuauuaauauuuaagugagacauuaaaaugcugauuaaauguuuucuguguuuagaucaggcugcuugucuggagcauguuacucuagaaagaagacgcagggacucccaaaaguagguuuuuuuucuucucuugggccaguuuccccagggaagagaccucaguaucaugccuaaggauauguguaguguccuuaaguccagagccugucucguuaauuucuauagcgcagauuuucccaaucuuuuuguucuggagacuccuuggcaucguuuccauuucucagggaacccaggcauuugucaccaggaaguugagauauauugcucuaguaauaauuuaugcucuuuugaguacgagugguuucucuaugaaucuguuuauuugaccaucuuauuagccuauucauuuuguaugguuuuccucucuccccuaaggauaucaucauuauugcaagugaguagugaaguaaaggaaacuuuaguuuuuccuucuaaagaaauuccuguaugauuuuuuuuuaccuuguuuaagugauaacaauaguuuuauccccaguuuuuaguauacaagaugcuaaugagauauuaugugaucuaggguauguacaagaggcacacccccagccagcuuuuaagacuaaacauguuauuuuuaacuaacuuuuuuugggggaaaaugugcaguuaagcuuagcuuaccuuucuugaaauuaaucucuucccuuuucuuagauuuuuaaaaacuuauaaggcaaccauaauguuuugauuaaauaauuuauauaagacaaaaugggauuuauuuuuucuaaagguauauuuaauuuaaaugaacuuaguaaaguuauuuuuuacaauaggaaaauuuauaauguuuauaguaaaagcuacuaaaaccauaaagcaaggcaauauaaaaaaauauagcuuaacacaauuuuaucugagagcuucaaaaauuucuuuuucuguaacaagaucugugucaaauauaggucuagcagaauuauuaauguguggcgauuucuuggucucuauucuagaccuguacauaaaaagugauauuuucaaaacugaaaaaaacaguuuauuuauuucaacaaaacguguauauauauuuuuuucuguacaaauacucaguucuggguugagcuugaaaugagcacacccagauuucauauucaacugaaaugaaacuuucuucuuugaucuugaugcuuguuaaacaagaagaagcuuguugaugcauaugagaauuugaaaacuacagcaaaauauucaucgcuuacaugugaaugacaagacuuuauucuuuccauagaaaucuagaacuuauuuuggggcagaugaggaaaucuuggguggagcauaggaucaggcugcagcaaaguuaucaccuaaacaucugcuuccaaaacaacuugguugaaaacuuguuuuugcucuugccucuuuucccguguauuguucuagugaguuuauguauuuuuauucuguuaguauuauuuaauaggaaguaucugacauuuuuuugauugaggcuggcauguagcaguugagaugaaauuagugcuaguuuaacccaaaagaaauuuacugacauuuuucuucuucuucaugagcuaguauaggcugcugcuuggagucuucgcccucaaggaacuaacucuguaauuguaugguuuaauuuaccuaccagaaugugucucucuuuccucuccucucuccccuacuccauucuuucuuugcaggcaauaaugugcacaugauaaaaauuauaaaugguaaggagaauacagucagcagucuucuugcuguuugucucaguucauucuucucaagagaaauccaguuguuucuuuguauaauuccagagcuauucuauguauauucagauauaugcauaugucagcugggcuuguuggcucaugccuuuaauccuagcacuuugggaggccgagauguguagauugccugagcucagaaguucgagaccagccugggcaacauggugaaaccccgucucuacuaaaauacagaaaaaaauuagccgaguauagcggucggugugcgccuguagucccaacuauuugggaggcugaggcaggagaauugcuucaaccugggagguggagguugcagugagccaggauugcgccacugcacugcagccugggugacagagcgagacucuguccccaccccccccccaaaacaaaaaauacauauauauauauguauguaugugugugugugugcguguaugucguugugcacauagguuuauaguggaccaugcauuauuucaucaggcuuuuauuuauaaacauuuagaucauuucuagccuuuugcuguuaaaugaugcuagguugaauauucuuguauauacuucuuugugcacuuauauaugaauuuaucuguaggacaaauucuuuuuuuauuauuauuuuuuauuuuuuuugagaagaagucuugcucuguuguccaggcuggagugcaguugggugaucuuggcucacugcaaccucugacucccggguucaggcgauucuccugccucagccuccugaguagcugggacuacaggcgcacaccuggcuaauuuuuguauuuuuaguagagaugguguuucaccguguugaccaggcuggucucgagcuccugaccucgggcguucugcccgccucagccucaaagugcugggauuacaggcaugagccaccgugcccggcugacaaauucuuagaaauagaauuuuuugggucagaagggcgugcauuuuucuuuguguugucagauauauuuugggaauugauaucaguuuguaccugaauuucaugaacauuuuuuccccauccuccuuuggauuauguuuuaucauuucaucuuacuauuauuuuuuggaguccuugcccucaaggaguaaacucuuaauuguacaguuuaaucuaccuaccagaaugucuccuucccucucucuuuucugucuucccuaucuucacuauuguugccucuuuuuacuguguucuaaagugguugugcuagagcacugcugucuaguagaacuuugugaaugaugguguguugucuaauauuucauaugguagaaccuuacauauaauucuguuuccucccacccauccuuugugauauaauugucaaauacuuuguuauucaucaaauauuuucucucucuuauaaacuuuguaaugcuuuguuauuuauuuauuuauuuuuauuuuuuauuuuuugagauagagucuuguucugucucugaggcuggagugcaauggcgugaucucggcacauugcaaccugugccucccggguucaagugauucuccugucucagccucucgaguagcugggaucacaggcacgcgccaccacacugggcuaauuuuuguguuuuuaguaaagacgggguuucacuguguuggccaggcuggucucgaacuccugaccucaagugaucugcccacgucagccucccagagugcugggauuuacaagcgugaaccaccgugcucggcuuauuuauuuguuuguuuguuuguuuauuuuuugagauggaguuuugcucuuguugcccaggcuggagugcaguggugcgaucucagcucacuggaaccuucaccuccuggguucaagugauucucccgccuuuagccucccaaguagcugggauuacagacgccuaccacauaccugguuaauuuuuuuuuuuuggauuuuuaguagacacgggguuucaucuagccaguguuuuagagcaauuaaaaauaggaagaaagucuuuuauauuuauccuaauuucuacuauuuucagcagccuuaauuucuuuguuugaaaauagggugguucuaguuagugugaaugaaaaaggguuuauuuaaaaagugaagaauugauaggauuuguuaacugauuagauuugguagaugaaagaguguaaugauggcugggauuuggaaccuacuuggguggucggguuaauaauguugccaguauuaacuuguuucauaaaugcuguuaaaauuuucuguauucauacagaguaggccauggacuuuuggagcauaaugcacuaaaauuuuuaaccuuuaaaaguaauaaaaauauggaaaauuuggacgauaaaggaaaaggcucauguauuaggguuaucuagaggaacugaacuaauaggauagauguauauauaaaggggaguuuauuaaggaguauugacucacgugaucacaagguaaagucccacaauaggcugucugcaaucuggggagcaaggaagccaguccgagucccaaaaccuuaaaaguagggaagccgacagugcagccuucagucuguggcaaaggccugagagcgccuggcaauccacugguguaaauccaagaguccaaaagcugaagaaacuggagugagauguuuaagggcagaaagcauccagcacgggagaaagaugaaggccggaagacucagcaaguccgcucuuccaagaucuucuccugccugcuuuauucuagccgcacuggcagcugauuagauggugcccacccugauugagggugggucugccucucccaauccgcugacucaaauauuaaucuccuuuggcaacacccucacaaacaaacccgggaacaauacuuugcauccuucaauacagucaaguugacacucaauaauaaccgucacagcucaugauuauuuuuggauguucccuucuaauuugccauucuuuuuuuuuuuuuuuuuuuuaagacggaaucuugcucagucgcccaggcuggagugcaguggugccaucucagcucacuguaaccucugccucccaguucaagcaauucuggugccucagccuccagaguagaugggauuacaggcaccugucaccacgcccagcuaauuuuuguauuuuuaguagagacaggguuucacuacguuggccaggcuggucucgaacuccugauugcaggugaucugccuaucucagccucccaaagugcuggaucacaggugugagccaccgcuccgggcccuuaauuuaccauuccuuuuuuuuuuuuugagauggaguuucacucuuguugcccagguuggagugcaauggcacaaucuuggcucacugcaacucccaucuccuggguuuaagugauucuccugccucggccuccugaguagcugggauuauagucgcucacgaccaugccugguuaauuuuuuguauuuuuaguagagacaggguuucaccauguuggccaggcuggucucaaacuccugaccucagguguuccacccgccugggccucccaaagugcugggauuacaggcgugagccaccacgccuggccaaaaguuuguaauuuuuaucuuacaugcuguucuacugggauauaaugggcuauauuuaguagugucugggaaaaccauuuaauuauauuuuccuauugugcauguauguugguauuucuaaagauaaagacaaguuugggaggcugaggcaggcggaucaccugaagucaggaguucgagaccagccugaccaccauggagaaacccugucucuacuacaaauacaaaauuagccgggcguggugaugcaugccuguaaucccagcugcuugggaggcugaggcaagagaauugcuugaaccugggaggcaggguuugcagugagcugagguggugccauugcacuccagccugggcaacaaaagugaaacucugucuaaaaaaaaaaaaaaaaaaaagauaaggacaagggaugucuguuuauauuauuuuauuuuuuuuaaagacaaggucuugcucuguuucccaggcuguagugcagugacaugaucuugguucgcugcagccucgaccucccuagcuuaagugauccucccaccucagccuccugaguagcugggaccacaggugcaugccaccuugccaggcuaauuucuuuauuuuuuuuguagagauggggucucacuauguugcccaggcuggccucaaacucauggcuucagacaauccucuuucuuuggccuuccaguguuaggauuacaggugcgagccacccugccuggccuguuuauguuauuuuagaacccgugcucacuuugugcagagcaggauguugagaacacauccuugaccuuauggacuuuagaauuuaagaaagagauaauucagauuuuugcaguauucagggguuaacaguacaaagaagaacauauguaguauuaccgaaaagaguaguacuucaugacaaaagccugauauggccguauguggcucuaucuugagucagaaugcuuugugugcagucaggaauuguugggugauugguagaguagagaucuuucacuucuauagaaagcagaugccauuaaugcuaucccuaagaauucuuggaaggucuacuccuggaaauuaauuuaaugucaugggaaugcuccuguucuacuucagggauguuauaucucaauuguauagggaagauugaggacccacaccuuuggacauucucucuagcaguuaaacuuuuuuacccguaaaucucaguaaccugcaguccagaaagggagaacuugcaagauuuaagugagacucaauacaaauuuugucaaaugaauaaauggcuuccuguuaaaaaauaaaaaaaacaaaacaggcugggcaugguggcucaugccuguaauccuagcacuuugggaggacgagacuggaagaucacuugagcucaggaguuuucgagaccagccuaggcaacauagagguaccucaucucuacaaaaaaauugaaaaauuagcuagaugagguggcacacaccuguagucccagcugcuuagggggcugcgguggaaagaucccuugagcccagaagguggaggaugcagugagccaugaucaugccacagcacuccugccugggcaacagaguaagacccugucucaaaaacaacaacaauagcaacuaaagaaacccccacaaaagugaagacccgugccccauccucuauucaucuuuuaaaaaguauuuaacuuuuguuuuguuuuguuuuguuuuguuuuaagagacagggucucgcuauguugcuuaggcuggucuggaacuccaggccucaagcaauccuccugccucagccuccagaguugcugggauuacaggcaugaacauuugugccugacauuuaucuuuuguguauucguucucuauuaguuuggaagcuuugaguaucacuggauuuugucugucuugaaaacuauuuucuugucuaucacuggauuuugucugucuugaaaacuauuuucuugucuuuuaaucaauuucccugauaauugagaguuugagaaauucacacguuaauugaaccuuagaaauccucauaauguguucauuuguuaacccguuuuucuucauuuacuugaauguauuauauccucuuggcaauuaaagugcggcaaacaccaaaaaagauuuuuuuuugcccuaaucauuuauuacuauggugacugaaaagaaaugauuuuucugucacuaaugaaauggucuuccagguucucucuugcauuucaaguaugcuacuauucaaccuuuucugugcauguauauaagcauuuguccguacuauucaaccuuuucugugcauguauauaagcguuugucaggacagagguagacucgugauugccaaaauuuccccagugaaaucaucuuggccuggagggggugcgggaagagagugagugagagagagagagagagagagagagagagagagagugagaguguguguguguguuuguguguguugaagacuuacuaacuugauucugauugaaaagaaagacaguaauauuaaauuuuauuggccaaauuuuuuuauuuauaauauuuacuuuaagaacacuuacugagauauaaaauauauccagaaaagucuaccucaaaaaaaaaaaaucucagaguugcugggauuucaggcaugagccaccaugccugacauuugucuuuuguguauuuguucucuaucuguuuggaggcucuggguuaucacuggauuuuugccuaucuugagcacuauuuucuugucuuguaguuaaacuuuguuuaugaagguuguacugauagcccacuauugaguaguuuuaaugucuucaauaauccuggaaaucuucccauuggaaauuuuuuuuaauacuggaaaauuguguauuucuaguaaugauauuauguugauucauauacacauugucugauacucuucuguaucgauuaauaguauacacaucuuacugcauuucaggcuguguacaguaagagguaauagaacaguuuccccuuuguaaucuuuuuuuuuuuuuugcccauauuggagucagacuugcaucauacuguauuuuuaaaaagauuugaaaugugaccaauuuguuaauaagucugaacccucaaauaggcggcaagaaaauaugguauaauguguuguuauaaauaagauugaauacucugucaaauuuauaaacuucuagugggcauuuauuucuuuuucucuuuacaaauuacucuaguaaaaacaccuuuauaagugucuauuuggggcugcuaugaguauacguuuauauauauauauauucucuuuagaaaaaaugugccccaaaacaaaacagaaaaagaaaaagaaauguccccaggauuaagauuauuuguuaaguuuuaaauaauuuaaugcuuuuucuggaguagauuugguuuuaagaaggaaaaauuauuugguuccuauaguuuuacuuuuuucagaaugucauaugaaugaguuguagcauuuucuagcuucauucacuuagcauagugcauuugagauucauucauguuauugcauguuucaguaguccauuucuuuuuauugcugaguaguguugcauuauaugaauguacgacacuuuguuuaugcauuauuaguugaaggguauuggggaguuuguaguuuugggugauuaugaauaaaggugcuauaaacauuuguauacagguuuuuuuggugaaccuuguuuuuguuuucuuuguuaaaaaccuaagauugggguuucugggucauacaguaaguguauguuuauaagaaacugccaguuuuccagugucuuuggcuaauauuuuguugaggauuuuuacauuuauauucaugagguauauugguuuguaguguucuguucuuauaaugccuuugcuugguuuagauauugggggaaaguuggcuuuauaaaaugaguugagaaguguucccuuccuuaucuguuuuuagaagagguuauguagcauugauaguaucucuuccuugacugccaaaauuuccccagugaaaucaucuuggccuggagugggugcgggaagagagugagagagagagagagagagagagagagagagagagagagagagagagagagagaguguguguguguguguguguguguugaagacuaguuuagugugguaaugagaaggggagaaagaguagaacagggaguuugaucuguaagacagugaacaaucaauugggagaacucacuaccuuuggaauguuuuuguuagaaaaauuuuaacuauaaauucagcuuauuuaauagauacaggacuauuagguuaucucuuuuuugaggaaugagcuuugguagauugugucuuucaaggaauugguuuauuuguggacaugcaguugugguauuucauuauucaucuguggaguuuguagugguggcauccuuucggucauuccugauuugaauauuuguauauuuucucuuuguuuggucagaauggcuagagagguuuauuauuuuuauaggucuugucaaagaaccagcuuuuaguuucauuuacuuucuuuguuauuuuuucauuucauucaucucugcucucgucuuuauuuucuuccuccuacuugcuuuugguuuaguuugcucauuuucugguuucucagauggaagcuuacauuacugauuugaaaucuucuuuuucuaauagaaacauuuaaugccauacauuuuucucuaagcaguuguuuagcugcaugucacaaaguuugauauguauuuucauuuuaauucaguuccagguauuuucuaguuuuccuugaggcuuguucuuugacccacagauuacuuagaaggguuuuauucaguuuuuaaauauuuugggauuuuuccagauagcuuucuuguauugauuuuuaaauuugauuucauaucagagagcauaccuuauuuuauuucuuuucuucuaaauuuguugagguuuaugucccaggauaugaucuacuuugauaaauguuucacaugcccuuguguauugugcuguuguuggguagaguguucuauaaaugucacuuaggucagauugauugauagugguuuucaggucuuacauaucuuugcugauuuucuauuuguuuuaucaguugcucagaaaggaguguugaaucuccaaauauaguggaauuuucuauuucuucuuucaguuguugcuucauauauuuugaagcuuuaaaaaaaaguccauaaacauuuagaauuguuauauauuuuuuggugaauugaccauuuuacuguauaauuucccucuaucccugguaauuuuucuuguucuuaagucuacucugauuagaguuugcaagaucuauuuuuacuauccuuucuauaauuccauccuuuguuguauuuaaagggaugucuuauagacagcguauuguuggcucuuguguuuuuaauuuuaauuuuauuuuauuuauuuuuuuugagauaacaguuuccucugucacccaggcuggagugcaguggcaugaucuuggcucacugcaaccuccuccucuuggguucaagcaauucuugugccucagccuccugaguagcugggacuacagggaugugccaccaggcccagcuaguuuuuguaguauuaguagagaugggguuucaccauguugaccaggcuggucuccaacuccugaccucaggugaucugccugccuuggccucccaaagugcugggauuacaggggugauccaccaugcccaguaggucuuguguuuuuuaaaucuagucugaugaucuuguauguuaauuguucuguugagaccauuuacaguuguugacauuauugauauauuuggauauaggugugcuguuuuuuuuuggagacagggucuugcucuguugcccaugcuggaaugcaguggcacaauuauggcuacggugguagccuugacuucccaggcucaggugaucuucaaaccuuggcuuccugaguagcugagacuauaggcgcaugccaccucaccuggcuaauuuaaaauuuuuuuagagauggguuucacuguguugccuaagcuggucucgaccucguaggcaagugauccuccugccuuggccucucaaaguacugggauuauagguguaagccaccucaccuggccccuucugcuuuuuguuccauaaucucccuuuuccuaccuuucagauugcuugacuguugucuuaguaauucauuuaauuuauguauuuuuuuugacucuuuguauguuuuguuuuguuuuugguggcugcuauggggauuacaauauacauaccuaacuuuauauuuuacuuagaguuaauacuuuacugcuucaggugaaaugcagaaaucacacaaucuauguuucuuuagccucuuuacauuacagugauucuauauguuacaucuuuaaacauugaaaaccacauacucagcauuauaauuuuugcuuucaacagucauaccuauuuuaaugaauuuaaggggagaaaaauguuuuauguacaaguauauuuauuacuucauuugcacuuccuuuauuccugaaguuaguuucccuuugguaucauuuuccuucugcuugaagaucuacauuuagcauuuguuuuagaacaggucugcugcugaugaauuaucucaguuuuccuucaccuaagaauaucuuuuuuaaaaaaauugagacagaaucucacucugucuuccaggcuggagugcaggggcgugaucuuggcucacugcagccucugccuccuggguucaggugauccucuugccucagccucccaaguccugggacuacaggcaugagccaccacaccuggcuaauuuuauauuuuuaauagagacaggguuucaccuuguugaccaggcuggucucgaacuccugaccucaagugauccacccguuuugaccucccaagguguugggauuacagguaugagccacugugcccagccuaagaauaucuuuacugcaggaaauuuucacuagauguagaauccuggguuuauuguuuuacucuuuuagcucuucaaaaauguaguuuguugucuucugugcuuucugaugagacaucuauaaucacuggaaucauuguuucuuuguauguaauguguuguuuuucacuggcuccuuuaggaguuuuuuucuuuaaucuuugauuuuuuuaguaguuugauuauuuaugggcauacauuuauccuguucguguucacuuaauuauuuauguuucucaugaaauuuggaagguuuuguuuugucaaauauuuuuuuucugcuccaguuuuuuucuuuuguucuucugggacuucacugacauaacuuuuugauauucucagaucucugaggcucuuuccugucuuuuuuauuuuuauuuuuuugagauggaauaucucucugucucccaggcuggagugcaguggcauguucuggcucacugcaaccucugccucccggguucaagcgauucuccuaccucaaccucccaaguagcugggauuacaggcacgcaccaccacacccagcuaauuuuuguauuuuaaguagagacgggguuucacuauguugcccaggcuggucuugaacuccugaucucaggugauccaccugucucggccucccaaacugcugggauuacaggcgugagccaccacgccuggccuuuuugguuuuuuguuucuuuugagacagaaucucgcucucuugcccaggcuggaaugcaaaagugugaucuuaguucacugcagccucuaccuccugggcucaggcgauccuccuaccucauucuccugaguagcuggcauuaugggcgcacauaauccugccuggcuaauuuuuguauuuguuuuguagagauggguuucacuguguugcccagacugguggcaaaguccuaggcucaagcgauccaccccccuuggucucccauagugcugagauuacagacgugagccaccgugcuuuuuuuuuuuuuuuuuuuuuuuuuuuuuugacggagucuugcccuguugcccaggcuggagugcaauggugcgaucuuggcucacugcaaccuccgccucccggguucaaacgauucuccugccucagccucccaaguagcugggauuacaggcacacacuaccaugcccaguuuuuuauuuuuauuucauuuuuaguagagaugggguuuuaccauguuggccaggcuggucucaaacuccugaccucgugauccacccgcaucggccucccaaagugcugggauuacagguguaagccacugcgcccggccaccaccgugcucauuuuuucccccaccuuuuuuucacucuuguucagacuggauaauuucuguugaucuauuuuuaggcuuacuguuucuuucuucugucacauucuguuauucaguccauucaguaauuuuuauuuuaguuuuuuuaaucuaaaauuuucauuuaguucuuuuuuauaguuucaauuucuguaugaaaauguuuaucuuuucauuaauuucauguguauuugcccuuacuucagaaagcaugauuauaauagcugcuuaauuuuugacaauuccaaaaucugagccaucuuaggguuggugucuccugcuuguuuguacauuuugaauauuuuacuugagacucugaguccuauuuaaggcaccuggaaauguugaguuuuuucuuuuagcaggcaaucagacugguuggauucauacuccaagugucaucuuaccuucagugggcugugguucuaaugucaauuuacuuuucacagucuuugcaguacuauuugggucugucuuuuguguauguaccucccaggagucaguuugggaccugagugguggucgguaucuauaucuuaauuuaggucugaagaucuguguuauacuauuuugggucaguucauacaugcacagccuuuaggugugccuggaacuucauacauggauuuaggaguguuccuuuuucagcucccuguucuccaugauuuauuuucacacucuguuucccaggagaucuuguccucauucucugaugacaaagccaggauuuuuaaccucuccacacuaucaugaacuuccuacaacuggauaugccucuagaccaagauggugacagagaggaagaaauaaccugguuucucucugcacuguuccaguuacagagccucaguuccucuggucagagggaaggauucucucaguuuuaggugccuuuguggucacugccgaagccauaggagugcaguuuugugaccaguacuugacuugggcuagggccagaagaguaaaaaagagagaaaaagagcugggauuccacccauagccuucauccugcagggcccuccuaccuaguccauuggccacaaagaaaguguuucuccuggacuuuuuccugcccacuccuacugugcaguucuaagauuugggaugcccuugaaucuaauccaggacauaugggagggggaaaaacucagugaaucacuucccuaucagcucuucuaguuuuuguuuuguucccaaaucuagcugccauuauuuacuuuuuugaauccucggaggacuccauauaugcuguccggguuuuuagugauaauuggugcuagagauagaaguguguuaguucaucuuagccagaacuguaggcauuucccacccuuacuccaucaacuuuuaauuucagaugcguauuugaaagucugaguacaguaugagaaauaguaaaacuguaaaaauaggaaaacaauuauaguaaaacuguuaacuguuacugaguaccuucuauauuccaacuauaaugcuaaguguuuugaauauguaauguaauucuuaaacugccuuuauaaaguagguauauuaccauuuuaauauugagguuaauuauuuguggucagauagcuauuaagugguguaaugaguguauaaaccugggccuuuacagacuccagagucgcucauccacuugcugagucagcuaacauuaaaaaauuauauuuuuaggccaggugcauuggcucacaccugcaauccuagcucuuuagaaggcugaggcaggcagaucaccugaggucaagaguucaagaccagccuggccaacauggcaaaaccccgucucucguaaaaauacaaaaauuagccgggcaugguggcgcgugccuguaaucccagcuacuuggggggcugaggcaggagaauagcuugaacccgggaggcggagguugcagugagccgagaucaugccacugcacugcacuccagccugggcaacagagcaagauuccaucuaaaaaaaaaaaaaaaaaaagaucaacaaucccacgaucccaauacuggguaaguauccaaaggaaaugaaaucaguaugucgaagagauacuugcacuccuguguuuauugcagagcuauucacaauagccaauagccaagauaaggaauuaaccuaaaugcccaaccacaggugaguggauaaagaaaaugugagguagguguguguguguguguguguauguguguauguguguguguguacguguacagacugguaguauauagaaauaccauucagccauaaaacagaaugaaaucuugucauuuguggcagcaugggugaaucuggaggauauuauuauauuaagugaaauaauccaggcacagaaauacaaacaccacaugaucucacucauguggaaucuaaaaaaauucguuucauaggaguagaguagaauauugauuaccagaggcuggaagaggaggugauagaggaggaggggacugggaaaagucagucaacugguacaaaguugcagucaggaggaauaaguucuaguguucuguugcacaguagggugacuauagcuaauagcaauguagucaagauagcuagaagagauugugaauguuauccucacaaagaaaugauaaauguuggcugggugcaguggcucacgccuguaaucccagcacuuuggguggcugaggcggguggaucacaaggucaagagaucgagaccauccuggccaacauggucaaaccccgucacuacuaaaaauacaaaaauuagcugggcauggugguggugcacgccuguagucccagcuacuugggaggcugaggcaggagaauugcuugaacccgggaggcguagguugcagugagccgagaucaugccacuacacucuagccuggcgauacagugagacuccaucucaaaagaagaagaagaaaaaaagaaaugauaaauguuuaaaaugauggauauaauuacccugauuugauuauuauacaguguauucaugcauugaaacaucacacucuuauccuguaaacauguacgauuguuaauuagaaauaaaaaauuaagaaauaacuauuuuuagcuucagaauaaugaagcguuagaagcacucuuuuuaaaauuauacauucauaguuuuauaaccugcucuuuccacuuaaaauauuggcaacaauuuccauaucaauagguacacuucuacaacauuuuaauugcuauguaguauuccauuguguggaucuuccacauuuauuauuggguagucuuuugcuguuauaaacagugcacagaacguuaauuuccauuugguacuagguugaguuccauugugguuugaaugugauugcagaaauugaacuuuugaauucugacugugcacuugugcugaagauauuaugcuaugugacucagcuguggguaacucuauaguuagugaacuuuauuauaggaaauaguguuauugugcuacauuuauauauagagaguuuuacugguuuuuauugaaaagcguguaucuuuuuauuuaauggcgaacauuacuuaauauguuauaaucuucucugaaauaauaguauguguuuuauacauuuaguacuuugcuggauuaaauucauuacaucauucacauucgauauucagucacauuaagccuuuuuuuuuuuuuuucuuuugagacagagucucacucuccuuucccaggcuggagugcaguggcgcgaucuuggcucacugcaaccucugccucccagguucaagcgauucuccugccucagccuccugaguaacugggauuacaggcacccccugccacacccagcuaaguuuuguauuuuuaguggagacgggguuucacuauguuggccaggcuggucucaaacuccugaccucuggugaucugcccaccucggccucccaaaguguugggauuacaggcgugagccacugcgcccagccccauuaagcuuuuuauauaccagauuuuguucaaaggcugcagaccaaaccuuucauuuuuguuaacuguccuguaaaguauacugauacaaggucuaugagguuaaaauauguggaugacacagugcaaacucauuauuuccaaaaaaaagcauguugaaccacaguuccuaucagugaaucuagaaaacuauuuuuauaugcaaauaauacauuccaguucauuuauauacuucugugcauuuucacaaauaauaacuaauuaucccaugauaucccucuuuaagggugagugucauuagcuccugaugauuugaguacauuuaauuagauaucuuuucugaaguuauauuuaacugaaagaauauauugacuccagagguuuuaagcuguucuuuucacugccauuuguguauaugguaggaaaaaugauaaaaauauuugaaagaauuagcuuggcaacauaguagaauagccuggaaugucugagaacugcucagugauuuguguggcuaauagugcuagguagaaggcuuagauuagucuuagaauuggcacaagacgagaaugagacaacugaggcauuggcccuggauacauguuuuuggugucugccagaaagcuugguaauugagauaaauaauauuuaaauaaaaugcuucaaaauaaaaauuaauuuaacacaauucaaagaacuaauuaugaaaauuuuaaagauaggguccaacagggcaaagauuaagagucaugcaaguacaugauugaguccuguuuaaaauuuugauaguucguuaucaugcaugacuuaccuugaguaauuuaucuaucuaguaaguuauuuugcccucagaacacgugccucauuugccuuaccguaguaguuuuggccucgcuuauaagaagucagucugaaggaauuacggguuucucugugggucaguguauuaguuuucuauugauaugugauagauugccccaaauauagcagcuuaaaacaauauccguuuauuauuucacaguucuguagguugaaaguuggggcggggaggaggcuccacuguguuuucugcucagggucucaaaagccaauaucaagaucaagcuggguuuggcuuuuaucuggagacuuugguggggaagaaggugcuuccaaacucauucauggaguugacagaauccaguuccuugaggugauaggacugagaugacugcauugucguggacuguuagcuuuaggggucacucucagcucugaggcggcucucauaucuuuuccacaugacccucucaauuuucuuuuuucuuuuuuuuuuuuugagacagaguuucguaugcugcccagcuggagugcaguggugugaucuaagcuuacugcaaccucugccuccugggcucaagugauccucccaccucagccucccaaagugcugggguuauaguuggccaacccucucaauuuucaaagccagcaguggaauaucucucauauagaaucuuuuuuacuugcucuucugcagccagccaaagaaaacuuucuauuuuuaaagggcacuugugauuagauugggcccuccuggauaaucuccccauuaauaacucacuacuaacugauuagcaaccuuaauuucaucuacagaaucucucuuggcacaugauguaaucguggaugugauaucucguuguguuuucaguccuggggauuaggacaggaaauccucuuuuuguuguuguuguugagacagagucucacucuaucacccaggcuggagugcaguggugcaaucucggcucacugcaacuucugccucccagauucaagcaauucuccugccucagccuccugaguagcugggacuacaggugcaugccaccaugccuggcuaauuuuuguauuuuuaguagagacaggguuucaccauguugaccaggccggucucgaacuccugaccucggguguucugccugccuuggccucccaaagugcugggauuacaggcgugagccauggaaacuggcaggacaggaaaucuugggagaccauuuuaaaauucugccuacuguagucagcuaagaaacuaauacaaaccauucauccuacucacugguagugacuuauugauauaaauauuacaaacacaaacaaauagcuauaaauauguauuauggcaacauuuguuaugacuaaaauuugacagaagaaaacauucauucugcaauuugugucugcauaguuugcuuaaauugggaaugguauuguuacaaagcaaaccuuuugaugauagagacuuuguugagaaaaucugauauagucaaaagcagauugggucuuuauuauaaacuuuacauuaaaaacaauugaaacggaaguuauguuagcaaaauaaacaugaaaauugaaaaaaaauagaaacaguuuaccuaugguuuucagaaaacuaauuuaaaaaauguugacucauugaaguuugcauuggaaaaauacuuugguaaaauguuuauugguguuacacguucacaaacgcacacacauauguaccauauguacagucauaauucuaggugaggauggcagacagaaggcuugaagagucagagaaguucagccagccacauuuuuuuuuaaauuguaucugagcauguacuauguauguuuauauuuugacacugcuagcuggguuuucacuggugggugggauguggggguauguuacagacaacuuucacuuucuacuguauucacuucugguuuuugacuauuuugaaauaacauguuucguuucauuucuuuuuuuuuuuuuuuuuugagacagagucucgcucugcugcccaggccagagugcaguggcgcgaucuuggcucacugcaaccucugccucccggguucaagugauucuccugccucagcccgcugaguagcugggacagcuaauuuuuuguaguuuuaguagagauaggguuucaccguguuagccaggauggucucgaucuccugaccucgugauccaccugccucggccucccaaagugcugggaguacaggugugagccaccacgcccggccaguauguuucauuucuauaauaaaaaugcagaucgaaaaucuguguuguagcagugauuuaaaauaaagugaaaugauuuuuaaagaguuuaaaaauagaguaaaaaugucguaaaaacugggacuugcuccaggccucuauuugaguuacuuuaguaaauuuuucuuuuuuuugagauggagucuugcuuugucgcccaggcuggagugcaguggugcgaucuuggcucacugcaaccuccgccuccuggguucaagcaguucuccugccucacccuuccgaguagcugagacuacaggcacgugccaccauaccuggcuaauuaucauauuuuuaauagagacgggguuucaccauguuggcuaggcuggucucgaacaccugaccucaagugauccacccgccucggccucccaaaguggugggauuauuagcaugagccaccacgcccggccuaaguauuucuuuuugaggcagcuuaaagaaaaaaagcuuuguguaugugugucugugugucugugugugugugucuguguuugugugugcgugcgcgcgcaugugcugucucuuuuuccauagaaauaauauugcucuguucuugaauccaauuauuacaaugaaggugauaauuauguagagaggaauaacugugucaagguauuccugaaugguacugguguuauguuuuagaccaaucucaagauaaaccuuagccauuuggccccacuagauaguguagggaucuaaacuaaacuagauaaccuaaguuaaauuaccuauuucuacucaaguugaaguaguaugcuggcuauauuuuuuucugcuagguuucagucuuuggaggccuuugggauauugacagaugaggagauaauugauaaguagugaaguggacagcuagcauggcugaaccacagaaaagaguaguggauugagguuauagggugauaauagugaggauaguaguagaguaguauuagaaguaaaaucacuguucccaggcaugguggcucaugccuguaauucuagcacuuugggaggcccagaugggaagauugcuugaggccaggaguuugcuuaggcaacacaguaaggcuccaucuuuaaaauauauauauauuguaaauauauaucauauauuuuauaaaaauauauuuauauaaaaaauauuuuuauaaaauauauauuuuauaaaaauauauaaauauauaauuauauaauacauacauauuauauuauauaauauauauuuauauauuuuuauauaauauacaauauaauauauauuaauauuuauauauuuagauacauauauaaagauauaaaaauauuuauauauuaaaugcgguggcaugcaccuguaguccuagcuacuugggaggcugaggugggaggauggcuugagcccuggaguuagaagguacagugaacucugaucugggcauaguggcgggugccuguaaucccagcuacuucggaggcugaggcaggagaauugcguaaaccugagaaguggagguugcagugagcugagaucacgccacugcacuccagacugugugacagagcgagacucucucucaaaaaaaaaaaaaaaaaaagaaaaagaagguauagugaacucugauugugucacuguacucuagccugggcuacagagugagaucuuguuccuaauaaauaaauaaauaaauaaauaaauaaauaaaauaaaagaacauuuucuaaagugugguauaggaugguagauuuugggucaaguuuuauuuucuguaucagcaaagaaaaaggaaagaaaguaauauuugaaugcaugucucaugcauuaaauauaugccucuaagggcuguguuuauuuccauuucauaaaugagaauacucaguccaagagaacuaaguaauuuaauguuucagagaauuucuaaaugugggauuucaacucaugucugcuucguuuuggggaccauguuuuuaaagucuucucacaguguuauauauaauauaauuuagucaacauuaaaccuauuacgaauagguauccuaccaaguuggauaauuugaaagaacaccaaaauaaggaauaauauaugccaaaaguuccucccuucuugcagaaggguucagacaguuucugguugaagcagagauuaaauacauugauaaaucaauagacagagugaucuggaauaauugguagaaauugguuguaaaaugguguuagggacagauuuuuuuuagucuuuuaaacccacaucuugauuugauagacacaaaaaucaugauaugauauuggagauuucaaaauaaguauuucaaaauuaaaacagcagugauucuaggaagaaaaaacuuaaucuuuaaaacauagauauuuuucuguaccagucauaugguaucaguguggguggggcuacuuauuuaucaccaggcuuuucagucccaaauaguauggaaaucugugaauuguucuguuuuuauuaccugagugcaauaaaaaagauuagcuuuguaaaauaaggagaggauaaaguuugcuuauuuucgggagugaaucagaagauguucuuccuccucaaauuuucuagauuuuuuuuuuggaaguuacucuguuaacugaaucaaauuugaaugauaaaaacuaucauuugagauguuuuugccaacauggaacauaacuaagaaaaaauguuuuucacauuguuucaagugggauuuucaggcaugucauuaugaaaguauuuccuuaaaucaucuuucagaacaaaaauauggaugaguauugcuuuuuuuccgccuuauccuugagugcuuuauugggucaaaguugaagaaauauuaaagcacuaauuugcuuuauccaguuuguuggauuuuuuucuuuguuugcuugaaguauuuuucuagacucuugauugcaaaugacaacucagcuuaaacuaagcagaaugacaguagaacugaagaaauaaccacaaacauagauagauguggccacaaaaauuaaguacuuucaggacauucucuuaauuucuuaaucuuucauuugggucuguuuguuagcuucauucucacauacugucuaaguacuuucaggacauucucuuaguuucuuaaucuuucaugugggucuguuuguuagcuucauucucacguacugucuaaaucaacaaaucuuuauugaguaccugcuaugugcuagcuacuauuuaguugcuggggaaacaagugaugaaauaagacauaccaauuuguuccaaaggcuuaaggggcaaaaaugaaaagagaaauaagacacaucaagcuucuguccucaaggagcauacuuucuuuuuucuuuucuuucuuuuuuuuuucuuuuuuuuugagauggagucuagcuugucacccagucuagagugcaguggcacagucucggcucacugaaaccucugccuccuaaguucaggugauuuuuaggccucagcuuccugaguaggugggauuacaggcgccugccaccaugcccagcuaauuuuuguauuuuuagagacgggguuucaugaaacacguuggccauucuggucuugaacuucugaccucaagugauccugccucagccucccaaaguacugggauaagccaccgcccccuggccaaggagcauacuuucuaguguagagacuuugucuacauagcagggaacagggccacagaccauucaagacucauauuuccgucugcaagacccacaaggcaagagggcuucuucuccaccaacuccagcuagaaaaauuacagggaaggauaauguuucauucugcgcccauuucagagucaguuacugcauccagaagaaugaauuauuguuauuagcugagccuggucauguacucacccuguuagggacuagcaucuguuaccaaaagacaggaaggucuggggcaaaugaguauacugggcaggcaaaaauagugcuaccaugguguuugcauuuugaaguuuaauuccuuguauuuaaagcugcaaauaaauuugccaaauaugcaaagcuuuacuaauuuuugaaagcuugaaaguguugaucuuucuccuuauuucuaaaucuaaaguaauugugaucuucaguuucauauccaaagagccagacaaauaacuuaaugauuuaaacauauugcuucccacauaauucacuguauugacaggaagguuguaguuuugucgaucauaaacaccguuuugagauuaaugcuacaugguguuuuaauuuggguuccaccaaaagaagacccugagacaaggauuuguuugguuccaaauaguucauuuaagaauguugaagaaguaggaaagagacagggaagggacaaaaguuaauaagcgugcuuuaauaaguaguauaccacacugggcaacuggucaucagucucgcugaacucccucugcuagauuacauagagaauaugccucuggauugucccauugagggauaagacauuuacuaccucuugcccuucacugguugaaguuucugggaauaacucccaggcucucuugcuuguccugcugccaagcugaguaugcuccuucaggcagagaaagcucuggcagagaggcucagaugcugagaaauugucuggagaacuguucauagaaacugcagguguucuccacacuggcugugaauggaaaugggugggacauugauagauucagcuaugaauggugaaauacauuguauauucucaaaacaggugaauuuuuccuuugauuuugauuaaaauucccauauauugguagagcaguguaaguaccuacccuaaccaugccgcucccacgcugguucacuuuauuugcuuugcauuagggugguuaccacugccugcugcagcaaaucccagaaauuguugugacuuagcaaugguuuaucauguucaauauagguuggguggcucucuggcagagcucucuuccaaucaaugacucagagacccaagcugacacuccacaaucuaagaguuuuuuuucuguuuagccauguggaugggaaaaaucauggagaaaguacaucagcuuuagguguguuaguuacuucauucauaaccuguggccagaccaguugcauggcugugaccuaacuggaagggaaccugggaauuguaagaaauugacccauuugacccugaagaauuuuaauuuuaauagagucuucaaguccuguaaaaaucacauuuauucuuuuuuauuuacauguugagcauauaauuaauuacuauuuucaccaccugccucccccuccuuuuuguuuugagaaggagucuugcucugucgcccaggcuggagugcaguggcacgaucccggcucacuacaaccuucaccuccuggguucaagcgauuuacccaccucagccuccugagucgcugggguuacaggcgugcgccaccacgccuggcuaauuuuuguauuuuuaguagagaugggguuucaccauguuggccagggcugaucuugaacuccugaucucaagugauccacccgccuuagccucccaaagugcugggauuacaggcaugagccacugcaccuggcacuauuuucuuuuuuuauuuuuaucucacuauuuccuuuuacaaacaguaaaaauaagggcaagucauuuaguuuuucacaaaauugaaacuucacauucuuauauaagucauuaauuuggcaucugacaaaugcgguggaauuuucuuaauuuccuuuuuaaaguuuugacaacauuugguaucuauguauaucauaauuuaguaaauguuuauugaaaguauaagaucggaggugacagacugggugugguggcucaugccuguaauccuagcacuuugggaagcugagaugggaggauuguuugagaccaggaguucgugaccagccugggcaacaucauggcaaggcuuugucucuacaaaaaauaaaaaaaaauuagccaggcgagcugacaugguggcaugcaccuguaguuccagcuacucuggaggaugaggugggcggauugcuugagccuggaaggucgaggcuacgguaaacugcguucacgccacugcacuccagacugggcgacagagugagaccucauuucuuuuaaaaaacaaaaaggacuuaaaguaccuuuugaaauaugagacuuuaguucuguucacuuuccauauuuugcuccuuuauugucacucuuugaaaacugguguuaacauauuuuugguugcaagugagucuguugcaguuuuguuuuuuaauuguuugcaaaagaaagacuacaacgggaguccagaagggagcuauggaguguuuacaaacugaagcagugugaacuuugguuguagcuggcugauuuuguguaugcuagagggcuaaauccuuaauucaccauuaaguaguuccucuuacuguuugcuuuggacuaaaguugcuaguuccugcucuagagugaugaauuaaaggcuagccuacccuauuuuucuuuuucuguuuuuuuuuuuuuuuuuuuuuuuuuuuuuuuugagacguugucuugcucugucguccaggcuggagugcaguggugcaaucucggcucacugcaaccuccgccuccuggguucaagcgauucuccugccucagccucccaaguagcuggaauuacaguugccuaccaccacacccggcuaauucuuguauuuuuaguagagaugggguuucaccauauuagucaggcuggucuggaacucuugaccucaggugauccgccugucucggucucccaaagugcugggauuacaggcgugagccacugugcccggccuacccuauuucuuauggauuuuacuuuauuucuuuaucucuucauaaagagccuucuugaaaagguuaugucuaacuucuuccuguuugugccucagaauauccagugugacuuuugccugaugacuuuauugaaauggcucuugaacgagguuacagugucuucuacaugauggguguuuuguauuauuuuugauuuaauccgcauagcaaucuagugaggcagcuucuuuucaaacuucucuuucuuuucagguaccugaaauguuccucccugcaccccccccaccucugaaauguucuuguuuccuaggguuccauacaguacuuacuucuucuguuucauuagcugcuauccauggcuuuaaccugucuguaauugauuacuucuaaauuucuccuucuggugcagaacucuagacacacucuuaaauccauacuaauguauaaaauugucuaucaagucucaauuugauaucauauagcuauaucaaacucaguggguuugaaacugagcuaauuaucuccugguugccuaagccugaaacuuguggaacacauaauaacgcuaguuacuauuuacugugucugggcuccguacauauauguuuucacuuaauccucauaauaacccuguuaccagaacaauuaaggaacuuaaccaguugguaauaauacuuaguauaacugaugaaguugaauuugaaccacgucuggaugguuuccaauuccauacucuaucuacucugcugcacuucuguuccccuucccuucaauauggacauagcacagaggugcagagaaauaccccuaggaggacccgguacuaccaacgucuugaguugcuguaaaacauuucauguugcaugauucugguugacuugcucacuuaguuuacuacaauagcuacuuaacagaucuuccugacccaguuucuucuccauccacagggcuguccagaaauuucuucuaaaauacaagucuaauugucauuucccuuacugccuucaggauaaaaaccaaaaucuuuggcauagcaucuaggaccuucucuggccaauucauggucauauugcauggucuuuuuguuucaaucauuuuaagauacauggaguuucuagagcuauaauucgccauuuugcuuuuguuuuuguggcaugcucuuucuuccuccaucacuuucaacuucucauuuuuacaaguuggggccggaugcaguggcucacacuuguaaucccagcccuuuagggggcucaggcaggaggaucacuugagaccaggaguucaacaccagccuggccacauagugagaccccaucucuacaaaaaauuuaaaaauuagcccaggcaugguggcgcaugccuguagucuuagcuacucaagaggcugaggugggaggauugccugagcacaggaguucaaggucauaaugagugccacuacacuccagccuggacaaaagaguaagacccugucucuuaaaaaaaaaaaacaacaacaaaaagccugagcaacaggugauucucugucucuacaaaaaauacaaaaauuagccgggugugguggugugcaccuguggucccagcuacuugggaggcugaggagggaggaucacuugagcccaggaggcagagauugccgugaaccaagauugugccaccgcacuaccgccugggcgacagagugagaccuuaucucaaaaaaaaaaaaaaaaaaaaaaaggccaagugcuaccucucucagaaaaccucugcuugcucuucuagguauuuccucuccucuuuaguaccccucauuugugguguuuagcaccuuggucauaccucuagugggagacaaccucugagauggcucccaguuguucccaccuucugguguucaugcccuguguaauacccuccuuuuuaaugugugagcagaaccuagugacucaauucuaacaaaagaauacagcaggcuggguguggcagcucaccccuguaauccuagaauucugggaggccgaggugggcagaucacuugaggucaggaguuugagaccagccuggcccacauggugaaauccugucucuacuaaaaauagaagaauuagccgggugugguggcaugugcccguaaucccagcuacucgggaggcggaggcaggagaauugcuugaaccugggaggcagagguugcagugagcugagaucgcaccauugcauuccagccugggggacagagcgagacacagucucaaaaaaaaaaaaaaaaaaaaagaauauagcaaaagugaugggaugucacuucugagauuagguuacugaaagauugucacuuauguauuacucuucccuucuuacuugcuuguucuguuggggaagcaacuugcuacguuuauauagucuuguagagaggcccauguagcaaggaacuagugucuguggccaacaacagucagcacgggacugagguuugccaguagccauaugaaugaacuuggaagaaaauccauuuuagccuugauaacugcagccccagcugauaccuugguuguaucucugugguagacccugagccagaggcauccagcugaaucauaccuggauuucugacacugagaaucuaugagauaauaaauauuccuuguuuuuuuuuuuuuuuucuuuugagauggaguuucgcucuuguugcccaggcuggauugcaguggcgcuaucucagcucaccacaaccuuugccucacagguucaagcgauucuccugccucagcuuccugaguagcugggauuacaggcaugcgccaccacaccuggcuaauuuuuguguuuuuaguagagacgggguuucaccauguuggucaggcuggucuugaacuccugaccucgugaucugccugccucagccucccaaagugcugggauuacagaugugggccaccgcgccuggucagauguucauuguuuuaagccacuaaguuuugggguaauuuuuucugaaacaguaguuaacugauaaaaauuucgaugccugcaagaggggugcugccacagcaaauacauagaaauguggaagaagccuuaggagguugaaagaauuuuguccgucaugauacagaaauucccuugaacagacuauuggcauaaaucuggacuuugaggaagcugggguuaagaacuuaaaaggugaugagaagcauauuguugaaaaacggaggaaggagaauucuuauuauguagaggcagaaagcuuagaagcacccuuaccacuaauagcauggaaaauaggaagcuuggcugaugaacugaguguuacuaaaccaaagagguuucuuuucuuuuuuuuuuuuuuuccuuucuuuugagacagucucgcucugucaccaggcuggaguacaguggcgcaaucucggcucacuacaaccuccgccuccgggguuuaagugauucuccugccucagccucccgaguagcugggauuacaggcacgcaccaccauucccggcuaauuuuuguauuuuuaguagagauggaguuucacgauguuggccaggauggucucgaucuccugaccucgugauccgcccgccucggccucccaaagugcugggauuacaggcgugagccaccgugcccagccccaaagagauuucuaagcaaagugugaaagcugccacuggauuucuucuugcugcuuauaguaaaaugcaggaggugcccugugaguuuuccucuaauaguauggacauaccacucuuacaguauuuaucauacuguguuauauauacuuaauuuuuuguauuucucgcuaggcuaugaauucugugagaggccuucuaacguguagugguuuagaucuugcucagauucuaaagagauuugcacucaagccuuggcucugucucuuacaaacuaagugacaaguuacuuaaguuuuccauccucacuuucuuaaucuggaggguaggauuaaugauaguagaauauaaacuccuaaaaucucuguauuuuuacuugugugcucacuacuagcaccuagaagaaucuggagucauaauaggugcuuaauaaauauuuauugaauuaacgaauugaguaauuucugccucagauuguugguuuaaauuagguaaugcauggaagcaguuugcucaaugccuaauaaauaugaauugcucaguguuuguuguguuuagcuguuuuucucccuauuauucaucuaguccuugaugcauagaaaaccauuucgugaauaaaacaacucacaaagcaaaagaguuguuuguaguucuggaugauacaucaggagucaguuuaauuuaaagugugauauauuaauaugauauauauuaucauaaucauuaucauaucauguaauuauauugauacagcucugaugaguggagggacaccaggguccuuagucucgcacugaauuggauaaaaugacacagauacacauggagugguuuuaaggagcugagaguuuaauaggcaagagagaaggaagaagcucccuuauacagagacggagggaguggggcuccuaagccaagagaggaaacccugugugcgguagaaaaguggcugcuuauaugaggaggcuggaggaggugguguuugauuugcauagggcucaggggauugauuugaccaggcaugucauucacauagcccgugaaaaaacuggcccucccacccuagccucuuaauaugcaaaugcagggugcuaugauguucuacauacauggggauauguggggacagccauguugccaggcacauguuggggcaaggaagaagacagugggaaucuccauguuugaguggauccaguguuuuuuuuauuuugagacggaguuucacucuuguugcccaggcuggagugcaauggcgagaucuuggcucacugcaaccuuugccucucggcuucaaacaauucugccucagccuccagaguaacugggauuacaggcaugcgccaccacgcccagcuaauuuuguauuuuuuuaguagagacgggguuucuccacguuggccaggcuggucuugaacucccgaccucaggugaucuguccgccucugccucccaaaguguugggauuacacgugugagccucugcacccggacaaggguggacacaguuucuaauggccagcauuugcauaucaaaauuugcuggcccagcucuaagagcugggguuuuccugcuagaugagaaacuucuggagcugcuuuaaaagaaacaaaaacuucccaaggacucuuuuuccucucuaucugccuaaaauaauuuaauaacuccuauaacaauaucauaauaauaugauacauuaauauuuggacaugaagagacuucuauuucuggccaugauggagaaauagucccuucuaugguaaacagugagaaaauuggucaaaagauaucaucaaacaacuauuuuuuagauauuagauuacaggcauugugggaauauuauuuuugagagaagggaaacauaguaaggugagcacuaugauugccuuagauuucugccagaagacacauuuuagaucacacuguaggcagggggaaucucagggcaugaugccuuguugauuugagauagggauuggaauucagagagguugcaguggcuggaaagagcuggacaaaguuucagagaagagggaacuguguagaaaaagagcucuagaaaucugaauagguguuuucuuuagcuuuugcugaaggaauauauagaauguguguacagugaaacuccauuaggcuggacaaggaaugacugaggagcucuauguuaaguaauucccaggguuagggaguuguuaagcacuuaccagagugcuaaguuguuuuugaucacccaguauguucaguggagaccccaaaagggccgugccuuaaaaguggggcuaaauuagccuagaguaaaggcuacucccaaucuguccaaacaaaaccuuaaaacaaacuuuaaggaucaaguugaugaacagguuacuuaacugacuuucagaacaaagcacaggaaucuuucaagaaugauaacaaaaucccgauacuuaaaaacaugauacugucuagcauccaguaaaaaaugacuagaagcaggaaaauguaaacuauaaugagaaaacuaaagcaguggaaacagacuaugagauaauagagauaauauuauaugacaaaaauuuuuuaaaacuggcauuauaaauauguucaguaugcucagagauuuaaaggaaaacaugaauguaaugagaaaaaugaaauauauugaaaagaacugaucaaaauuucuaaaaugaaauuuaacugaaaugaaaaauuuacugauugagguuaacagcagacaacagcaguuucuuaucugaugagaaagaucagugaaguugaaaacggcaguagaaaccacacaaaaauugaauguaagagaaagauuaaaagaaauaaugaacagaaccuuugugaucugugugauaacaugggcgugauuguacucucagaagaagaagaaggaagagccacaaaaaaagucugacaagggagaggggggagggauagcauuaggagauauaccuaaugcuaaaugacgaguuaaugggugcagcacaccaacauggcacauguauacauauguaacaaaccugcacuuugugcacauguacccuaaaacuuaaaguauaauuuaaaaaagucugaagaaauaaugacugaaaauuuuccugacuuuauaaaaacuacaaucaugcagcuccaaguucaauuaaucucaagcagaauaaacacaaagaagaccauaccaaggcaccauaaucagauggcugaaaaccagugauaaagagaaaaaaaguuuuuuaaacagcuaaagaaaaacgacauuuuauguacagagaaacagccaaaaaaaagggcaaauuucuugccagaaacaauguaagacagagcaaaauagaauuuggcauuguuaaagugcuaauagauaaaaugaaacuguaaacccagguugaauuuuauacccagcaaaaaauccuucaauauaaaggcuuuuuauacauacaaaaccugagaguaaauuacacuauaaaaaaugcuaaagguaguucuucagguggaaggaaaaugaucucugauagaaacuugguauacaaaagaauaagcaccugaaauagucaauuaaugguaagauaaaaggacucuuuggacauuauuugauuuauuuaugaguuaauugccuaaagcaaaaugauaauguauuguguauauauagacauuauacaaugucuacaugaaaugaaugacaauaguagcacaaagacaggaagcagcaauggaaauauuaggccuaagagucuuauauguaaaaugauguauuuuuauuugaagauacagugugauaaguuaaagaugcauauuauaaaacccuagauagagcaacuaaacaaaaaguaaaagaaauauagcuaaugugucaguagauuaccaaccaaaccaagauuaugaaggaagagaaggggaaaaaagaacaaagaacagguagagaaaauggaaaauaagcaagaugauagguugguaugaccauauaauauuaaauacuuuaaccauuuaaauuaaaauacagagauuaucagacuggauuuaacaaaaaguaagaucuaauuauaugacaucuaccaagacauuaaauaugaagaaacagguuuaaaguauaaagauggaauaagaugcacuguacaaaacugagcguaggaaagcuaauauagugauuacuguuuaagggagacuucagaguaaggcauauuaccaagaaaaaagagggacauuucaaaaugacaaggggguuaauuuaucaauuguaagaguguuugcaucgaauaggaaaaauucaaaauucauaaagcaguguucaacauuuguuucccaguaauuaauaguauaaguggagagaaaaucagaauuuagaacacuuaauaacauugucaacaaauauaaccuaaguugcauuguagaacacucagcgacagugauagggacaggaggcagggaaauucugggcagaagagggugagucccuggcgagggccccgcccucaaacugaaaaagccugguacuauauggcccagugugagaacugacaucccuguuuguccggucagauguugccuuuuccaaaaccacucauggccugccccgccccucauucugugcccauaaaaaccccaggccuugcuggcagagggaggagaagcagcuggacauuggagacuauaguuggaugucagaagcaguuugacuucaaagggacagcuugacagcgcagcuucagagaggauucugguuggcuggacuccaggggaagaauaccuuccugcucugucuccuuuucagcuccucuucacacugagagccacuuucaucggcaauaaaaucucccgcauuuaucauuuccuguuuguucgugugaccucauuccuccugggugcugggcaagaauucagaugccacgaaugugggugcaaaaggcugucacgcugacccuccacugagcuguuaacucuuaagccgucugcggauggcaaaguuaaaagggugcuguaauguuuccccucgggcuucaagggucaugagcacccuacccuagauggugucucggggcuaguauggaguuugcucuugcugacacccaaaagcagucgcccaaccacugcacucucucaccugcgcucccccuccugcgagggguggaguaacaagugagugggaguuggccccugccaaugccgaaguggcuggcuaguuccagcgcccauacaucccuguuacugccugagaaggggucagggaaauaucccgcuucaacagcacaguacguauucuuuucaacugcaccuggaacauucaccagcauaaacuguaugcugagccauaaaauaagcgucaguaacuuuaaagagagugaaauauagaauauguucacugaccacaacagaauuaaauuagaagucaguaacagaaagauucuugaaaaaucucaaauauuuuugaaauuaaacuuuucuaaauaauccaugggucaaagaagaaguugcagaauauuuggaacugaaugguaaugaaagcacauaauauauuuuguggcauacaguuaaaacguguagaagaaaauguuuauaaaugauuauaguaggaagaaaggucuaaaauaauaauuuaagcaccuaccuuaaucuagaaagagaacuaauuaaacccaaaguaaguagacaaaaggaaaucauaaagguaacagaauccagugaauuaggaaacuguuggccagguguaguggcucaugccuauaauccuagcacuuugggaggccgaggcgggcagaucaccugaggucaggaguucgagaccagccuggcuagcaaggugaaaccccaucucugcuaaaaacacaaaaauuagccgggcgugguggcaugugccuguaaucccagguacucaggaggcugaggcaggagaauugcuugaacccugggaggcggaggguacagucagccgagaucacaccacuacacuccagcuugggcgacagggugagacucugucucaaaaaaacaaaaaaccaaaacaaaacaaaaaccuguuuaguagaggaaauuaguuaaaucacaggcagguucuuagaaaggauaaauaaaauugauaaaccuuuaguuaauuuaugaaggaaaaaagauacaaguuuuaaauaucaggaaugaaaaaguagauguuacuacagaucguacauaaaaggauaauaaaggaacauuauggacaacuuuaugccaauaaauucaacaagaugaaauggacaaauuccuuaaaagagacaaacuagcaaaacugacucaggaagaaauagaaaacuugaauaucccuguaucuauuuaaaaauucuuaauuuaaaauauucccaaaaugaaaacuccagaccagauggcaucagucgugaauuguguaagaguuuuaagaaagaaaaaauacuaauugcucauaaacccuuuaagaaaauagaagagauaauaccguaacuaauuuaugagguaguauuauuccaauaccaaagccacacagacauuguaagaaaacuacagaacacaaaauuuuaauuuuuuuuuuuuggagacagggucuugcucugucacccaggcuggagugcaguggcgcgaucauggcucacugcauccuugaccuccugggcucaagcaguccucccaccucagccucccgagcagcugggaucacaggcacacgcuaccacaccugguuaauuuuuguauuuuuuguagagaccagguuuugccauguugcucuggcuggucucgaacucaugagcuuaagcagucugccugccucagccucccaaagugcugggauuacuggugugagccacugcaccuggcccaaaacuucuugacaaaauauuagcaaguugaauccagcaguauaaauauaaugaugauacaucaugaccagguagaguuuaccccaaguaugcaaguuugauuuaguaguaaaaaaaucaauauacaguccauccuuauuauucgcagauuuuguauuggcaaauuugcccacuagcuaaaaguuauuuguaacuccaaacucaauacuuucuugcuuuuuuguggucauuuguggacaugugugcaguggaacauuugaauuguccaauauauacauucccaauugagucaagcaacguucucucccuuuuucuucagcucucguguuauaaacaaauguccuuuucgugaucgugccauauuuuucagauuuuuugcuaaugauuuuguuguuugaaaucauuaugcccccaagcacaguacugaagugcuguuuaauguuuuuaagugcaagaaagcuauaaugugccuucuggagaaauuaacauguauuagauaacuucauuuaggcaugaauuauagugcuguugccuaugaguuuaauguuaaugaaccaguaauauauauuaaauaagaugucuuuaacagaaacauauauuaaacaagaucauguauugauugguugaugaaaguguugugauuagaggcuuauaggaauauaacuguauucccuaggaauaauggcucaguauuugcuaauuuauuguucauugugacuuuauagaacaaauaacuaccauaaauaacgagaaugggcuauauaucuguuacucgauuaucuaagagaaaagaagguaaaccacaugauuaucucaaaaaaaauuuuuuuuuuuugagagagucuugcuccauggcccaggcuggaaugcaguggugugaucuuggcucacugcaaccucugccuccuggguucaagugauucuccugccucagccucccgaguagcugggauuacaggugcccgcuacuaugccuggcuaauauuuuuguauuuuuaguagagaugggguuucaccauguuggccaggcugguuuugaacucccgacuucaagugauccaccugccucugccucccaaagugcuaggauuacaggugugagcuacugugccuggccaauuaucucaauuuauacagaaaaaguauuugauaaaauucaccaucuauucauguuagaaaugcucaggaaacuaggacuagacgucaaccuucuaauuaaaggacugcuuuauuauauauaaguguauauaauauaagccugcaguuaacaucauauuuuuuucuucauaagaucaagaacaacuaaggaugucaacucucacaauuccuacucugauccuaaaauuuauaugaaacugcaaagacuaaaauagccaaaacaauauugaaaaggaauaauuaaaauuaaagaacuuacauugcguuuggacagagguacagauaaauggaaaauaauagaacauugagaaauaauucacacuucucgauaaagguuccuaagguaauucagugggagaaagaauaguauuuuccacaaacaguuuuggagcaacuggauauccauauaggggagggggauaaucccuuuccuuaaacuguacacaaaagugaacuccaaauggaugaaagaccuacauaugaaggguaaaauggaaagacuucuagaagaaaacauaggagcaaaucaucuugaccuuggaguaggcaaaggucuuuuaggacacaaaaagcaugaacuauuaacagaaguagucgauaaauuguagucuauuaaaauuaaaaaaugcuauucgaaaggcaccauuaaaaauugagaagacaagccaaaaagaagacaaggcaaaacuguuuguaugcauauauuugacagagaacuugcauccagaauacauaaauccaauucaauaagaagacaaaccuaucaguuaaaaaauggacaauggauuugaucagacauaucacugaagaaaauguguaaguggccaaaaagcacuuuaacucaaccucauuugguacuggggagaugcuaauuaaagccacggugaaccauugcucaucuacuagaaugaaugaaaugaaaaaguaugacaaugccagauguugaugaggauaguggaacaacuggagcuguaaugcauuguuggugggaauguacacuggguacaaccaguuuggaaaacauuuuggcaguuucuuauaaagggagacuuacacuuguccuaagauccagcauuuccacuguuuacccaagaaaaaugaaaauacuuauccauaaaaagauuucuucaagaauuuucguauaugacuuauuccuaauugucaaacacuggaagcaauccgcgcccaucgguaggcuauuagaggcugagcgcgguggcucaugccugugaucccagcacuuugagaagccgaggcggaucacuugaggucaggaguuugagaccauucuagccaacacggugaaacccgccucuacuaaaaauacaaaaauuagccagguuugguggcauaugccuguaauccgagcugcucgugaagcugaggcaagagaaucuccugaaccugggagggggagguugcagugagcugagauugccaucacugaacuccagccuggacaacagaaugagauucggucaaaaaaaaaaaaagagguauuagauaaccaaauuguaguauuuuguauuaaucuggguucuccggagaaacagaaccaauaggauacauauauauuuuauugauacaauaacauacacacagauuuauuuuaaggaauugucucaugcacuaauggagucugagaagucccguuaucugcaguaggcaagcuggagacccaggagagccaguaguauaguucuagacuaaguccaaagaccugagaaccagaaggaguugacauaauuaccaccacauauauucauacaauggaguacuccucagcaauaaaaaggaaugaacuguuacaugcaacaacaagcauggaucucauggacacuaugccgagugaaugaagucagacacaaaacaguauuaugugauuacauuuguaugacaccuuuuaaaaaagcaaaacuaaccuuuaauaauaggaaguaggucagaguuuaccuggguucaagaguggagagauugacuucaaaggagcgugaaaaauuguuuagggcuuauggcaguguucuaaaucuugaugguaguagugauuuaauggcguauuuggcuuucaaaacuccaaagaugggugcagauuuauuuauuuagagauaggauguugcccugucaccaaggcuggagugcagugacucaaucauagcucacuccgaccuugaccugcugggcucaagcaauauuccugcuucagccucucuuguagcugggacuacaggcacaugccaccacaucuggcuuauuuuuacauuuuuuauagagaugggggucuuacuguguugcccagauuugucucaaacuccuagccacaagugauccucccucuucagccucccauagcauugggauuacaggcgugagucacuguacccagccugguacauuguuuuuuauguaaaugauaccucauguuuaacaaaagaauaauuacuaauuggauuuuuaaguuucuacaauaguccuuaucuuuuugauacuaugccuaugggaaaucauuuugguuaaaucaaucauuuucuuucuaggauaaauuauuaauuagguacugcugggccuguaucaauauuugguuaugguaucuguuaauguuugaaaacuuaguggagaaauuaacugaaaaagaaacauggaaauaacuggagaagaugcaaaauuagaaauaaauuguggaaauucauuuuuuccuaaauuuucccuuagauuauaaauaaauucucauguaaguuuaucauuuuaaaaacauaauuuuaaauaucuuuaauauucuauguauuuucugucaguuuuccuguucuucaauuuuuggacauaucuuuguauuugaagccuuuuuuggcauuugauuauucuucuguaugcauacuuagauguagaaucacugaaucaaggaguaugaauuucaaaaaaauauagauaauaaauucacauggcaaauuccaaggguacaauugggaaugcagugaaaugucuuccuugugccuuuguugacaaauuucccuucuuggaggcagccagugucaucagaauuuugcguuuccuucguguguguguugcaagaaguuuagauaguggaugaaagacaaauuuuacaagaagguaauuauauuauacauacucuuuaaaauaaaaucaacuacaguuauuuuuacuugaauuucauaaaagaaaaggaaacuauaaugaaacugauagaaccucuuugaauuuaaauauuuaccagaagaaaagaucucuaagauuaagaaaagaaagguuuggaguaauauuuuugaaauauuguuaauauauaaaagaaauauaaauuaccaguaaaaguaugacuauuuuagaacucaguuauugaaauagaaaugaaauguuuuuaucuuuuuuagacuggugaaaauugauaaaauauacaagaauggguacccuugugauguuauagguuuuugcaaaauuuuuucaguaaaaggcaauuuggcaguacuuccaauuuuaaucugucuguuaucuugaauauaguaauuugauaucuagaaacuuuucacgaacagaucuuaaaacaagucuaaaaggauaccuaucugcugugaaaguguccauuaauagaagauuaaguuauagugaaucuaccaaauaggauaauguacaaguauuaaacauagugauguguuguagauuuuaauuuauugccauggaaauagguucucgacauacccuuuuuauuucucucaacaauaaguaauugaaugcauaaugggaccucauuuauauaaaaucauauguauguccaaggguagacagauuucuguaaauacaaauacucauuaaagugguuuucugccugggcacaguggcccacaccuguaaucccagcacuuugggagcuugagguggguggaucgcuugagcucaggaguuggagaccagccugggcaacauggcaaaaccccaucucuaccuaauauacaaaaaauuagccaggcguaguggcguacgccuggagucucagcuacuugggaggcugaagugggaggaucacuugaaccugcgaggcuugagguugcagugagccgagaucaugccacugcacuccagccugggugacagagcaacacccugucuaaaaaacaaaagcaguuagcucuggaugguggacuauuagaauuuuuaacacucuuagguuucuuuaugcugaauauuuaucauuuguauacuugaaaaaauuucucuccuuucugaacaauuaaauaugucuaauuuauuugcuugcuguuucuguggauaauaggagacauagccuuuaagacaauaccugaggccaggcacagugacucacgccuguaaucccagcacuuugagagccugaggccaguggacugcuugagcucaggaguuugagaccaacuugggcaaaauggugaaacuccaucccuacaaaaaauacaacaguuaacuggguguaguggugcgugccuguggucucagcugcuauggaggcugaggugggaggaucucuugagcccaggauggugaggcugcugugagcccugaucccaccgcugcugugagcccugauccugccacugcaguucggccugggugacagagugagacccugucuccaagaaaaaaaaaguacccaaucaaguucuaaaaauauuuauaucuaacacugguuuaucaaggucuguagaaccuuuguaauggaauaccuaagggucaugguuugggaugcuccacuagugcagcugaaauuacccaggaaccaguugaacagguacucauaguuggggaacucugaacuccaggacccaaggcguugacugaaauuuucaaugcuacacccugcuauauguaguuaaacucucuaaagacuuaguuuuuaaagaacaagucaaguuugagccauaguuuuuauuuacuuugaauuaaccaaaaagcaugugaauuuauugcauacacuuguccuuguugauaaaugauaguaacauuggaagucauucuuuucucugcaucucaagucuucuucauuuaggaaauuaacaaagaaaauuaauuuuuucauuggccauuuauaacauauugccuguaucaggguuugccuuaaucacugggauggggggugggaaguaaaauuccuccccugcagaaucaugcucuguaccggaacacaggaacagucaggaaccuuuccagugaacuaugaguucgggugggugguugaggaagauuuuccagaggaaguuacaucugaacugaauuuugaaagguuaagcaugaauuagccacaccaaagaaagggauauaaggguagagacaaacaccuagaggcauguaagggcacaguacauacugggaacugcaaguccauggucuuaguguagggaucaaggcagugcaggcaaaaaagugaggcuucagaggccagaucaugaagagucuuguuagcugucaguuucuuaccguggauuuccuuauaaauacagccuuaguucacuuagucugggaacuuuugagucaucuuugcuucuucagauuuuccucccauaaccuccuuaauaauuaggcaccaaauccugucaguuuugggaacuuggauugaaauggaaaaaugacaggguagauguagacuguguucuuuauuacaggcugcgacuuauucuuuuuaauuucuagggcuuagcacuggcucacaggcccuuacugucugaacaaauggauuaaaggaagggaguuccaaagauaaaauguucagcauuuuuacauguauaacucaucuguucuccaguucauuaucaaaauaauaauaaucuggcugggcaugguggcucacgucuguaaucccagcacuuugggaggccaaggugggcaggaucaccugaggucaggaguuggagaccagccuggccaacauggagaaacgcugucucuacuaaaaguauaaaaaugagccagguguuuuggugaugcaugccuguaaucccagcuacuugggaggcugaggcaggagaauugcuugaacuugggagguggagguugcggugagcugagaucaugccucugcacuccagccugggugauggagcgagauucuuuccccccaaaaaagaaauaauaauaauccaauaauuuuaauaaucuuuggcggacugguugaaaaguuaacccuuagauuuuuaauuaaaaaaaaaaaugaaaucagacccauuaguaaggucuguugaauuaauguaccgguaggcaacugaagcaacaauggucauaguuagggaagaaaagugccagacagcuuuuagccauuugauauaaugcauauauaccaguuuacauugugugugugugugugugugugugugugugugugugugugugugugugugcgcgcgcgccuccccacccugccagcugagacuaguuuucuugcgacuaucccgaaagggauuuuuuuuuaguuagaggaaaaauugugaacauguauauuuauugcguuucacuugucacaguuaauaauguggguacauauuuuccugaaaaugaguauauacugcauuuguuuucugaaaaugugcuacaaaaggaaaacugaacauggagagauagguagcauuuauaacaauuacguauuagugaaauaacugugccauagugaaauaacugagaaagcaaauuaugugucucagacauauuugugaagcagcuuuuaugguuaucagcaacacaguugcuguaacuauuguauuaguggaauuggaucuuaugugggucacauaaccagcaccugaacuuuuguacuuguagcuaugcaagacccuuaccaagauaauaauguaauauagagaggugucaagagguguuuucauacauguauuugccaucuuauagaacuagaauaacacuguaauauaauauuaugaauauaucuuuaaaauauuuuuaaagccccuaugaaaguuaagcauaaaugagcuaagcucauccccuuccccugccaaaagauaaaauauaugaggguguuguagcacagaaaccaagacauaaagacaugcaguagaaaccaggggucagcaaacuucuucuguaauguaccacauaguaaaauuuuagacuuuacaggucaagagguaaaaucgaagauauuauguaggcacuacuauaauaagagagcaugcaauuuuucacaaauuuuuaaaggacaaaauuucaaaauauaauaauugaaugcauuuuuuguaauacagcucuaaugagaaaagggaauucuuuuuaaagggauaacauuucacuuaauucuaguuaaaaguuagcguuccauaucaucaaaucaauugcaaauguucaucugcuaaugcugauuuauaugaaauuuuacguaucaucuucgaauuugacuuuucacccagacaagagaugcacauggcauaacuuugucauuaugauuuguagugcugagcagcagugugaagcaaugagagggccauaugaggucuuugcuguguguacuuaauucugccuuuuuuuuuaagcacaaaagcagccauagacaaccuguaaaugaaugaucauauuuguguuccaauaaaacuuuacuuauggacauuaaaguuggaaugugauuuaauuuuuauggauuacaaaauauuuuaauuugucccccaaccauuaaaaaauguacaagccaguuuuagauugcuagccauacaaaaaacaggugcaagacagauuuggccuguaggcuguaguuuucccaaccccagauauaaaccauaaaaauucccaaaaucuaauauagauauuuuuguauuuuuaagcauuuuaugauuucagaaaauuaguaacuuguuuuaaaaguguuucuauuguuuuaauaccuuuucucgaacaguauacuccauguaaaaauucaaacauuauagaaaugccuaaauuaguaauuaaaacacuaauucugucccccagaagguuaggugcauacuuuuuccagauuuaaaaaauaaauguacuaacacuggccggguguggugccucaugccuguaaucccagcacuuugggaagcugaggcgggcgagucacuugagaucaggaguucaagaccagccuggucaacauggugaaaccccgucucuacuaaaaauacaaaaguuagcuggcaccuguagucccagcuacuuggaaggcugaggcaggagaaucaccugaaccugggagguggagguugcagugagccuagaucgccacacugcacucuagccugggugacagagcgagacuguaugucaaaaacaaaacaaaacaaacacuuuuaugcacaucuaauuacuuuuuaaaacaaaauaugagaucaugccuuuuauaaacaugugaggacuugccuuuuuucacugacuuuaucaugaaugagucuuuagaucaggacguguguaucuaugugcuuaauucuuugaauggccuaucauuacauuaugugacucugccguaauguguccaaucaucuucucauuuuggacauuuuguuguuucuaguuuucugcaauucauuguuaugugcucuuuuuguaaauaaacuugaaaguugaucauuaauuuugaaauaguuuuuuuaaugccacuuugauuugggggcuuaaucuuaaaggaugugcacauugaauauaguuuuaaugugguccauuuauuuaggagaacacauuuuccuuuuuuacuggcaacuaugggguaaggguaguuagaauuauucucacagaaaauuauacauagauuuauuuuccaauuauuaaaucauguaugagguguugguugguacuuaaaguuuauuuugauguaucaaagcuuggccugcauuauugaagauguuauugcaaaacccacuucuuuuuuuuuuuuuuuuuuuuugagacagagucucacucugucgccagacuggagugcaguggugcgaucuuggcucacugcaaccuccaacucuaggauucaagcgauucuccugccucagccuccucgguagcugggauuacaggcgcccgccaccacaccuggcuaauuuuuguauuuuuaguagagacgggguuucgccauguuggccaggguggucucgaacuucugaccucaggugauccuccuaccucggccucccauagugcugggauuacaggcuugagccaccacgccuggccaaaaccaacuuuuuuauaugugucuuuccucacauuacuuauuaaugugaggaaacauuaauaaguaauaugcuuuauugccaccauauuauuuuacuauuuuaauuuacauuggaugucuuauaacuauuauauuggcaaauacccacuuuguuugcucagaaaugaaaccuaccccuguuacaaagcuggugguugguucuuggcacuugauuugguuuaugcaugcccuaggauacucucaaaggcaagggaucaauuagcaagguguuaauuugucuuaaucuuuugggcugguacuaaguuauugugaagcagauguguuauuacuccauccucugugaagauugaggaauaagaugaucacuaagugccaguauuacuuuuagaugucauuaucaaauaacauugucacuaauuuuuuagugacaauauuuagugaaagauugucacugauuuauuuuauauuuucccaugauaauuaccuuccugucuuauuuucauuauguccucccauuucccugaaauguaucgaacaaggguuuaauuuauaaacaagaaggagauccaaauaagaauuuguuggauaugagagauacauugauucuauggaaaauuccugggcccaaucccuggagauuuagauuugcuaggccuagggugggucaacuguuuucacucaguauaguucucuggagagucaugaaaguuauugcguguaugaguagcuuguuccuuuuuguuucuguuuauauacaguaauccuuauccuuuuuuuuuuuaugguuucaguuacuucuagucaaccuuggucugaaaagauuaaguggaaaauuucaagaaauaaacaauuuauauguuauaaauugcgccauucugaguagggugacgaaaugucuugcuaucucgcaucccccaccaggaacgugaaucauuccuuuguccaacguaugcacguugucuaugcucccuaccugcuagucacuuuggagcccucucaaucguuggauugacugucaugguuuugcagugcugauguucgaggaauuuuuguuuuacuuaauggccucaaagcccaagagcagugaugcuggcuuguuguuauacuuguucuauuuuauuauuaguuauuguuguuaaucucaugcugugccuaacuuacaaguuaaacuuuaucauagauauguauauauaggaaaaaacaguguauauagaauugaguacaaugugccauuucaggcaucuuuacugggggucuuggaaguauccccugugguuaaaggggauuaccauaguuaaguuggagaacuuucuacauaguuuaaaacuuaguuucugcuuuguuucuuuccuaauuuuauuaaaacaagcauuuuugucuuaaaucuaggugacaaaacacgacagccuucuucaagccccuccaguauuauccgacgcacuuccucccuggauacucuugcugcaccguaucuugcuggacacuggccucgggauagccaugggcaagcugcaccuugcaugagggacaaagcuacacagguaagcuuauuauaguucuuauccugaaguguuuuucucugaagcuacuucuucuaauauuauuuguucugcuuugaguagaacaaacauuuaguguauauuagaauuaacuugagaaacuuaccaaaaagagcagauuccaagccugaccuccagguauucuguagucgguuuugguuggggccugggaaugugcauuuuaaauagcuaucaaaguaauucugauacauacagauaauuuauggacauacuuuuuuuucccacuuauucuuuauaaguuaguuuacaacagggguguccaaucuuuugucuucccugggccacauuggaagacgaagaauuguauugggccacgcauaaaauacacuaacacuaaugagcuuaaaaaaaauugcaaaaaauucauaauguuuuaagaaaguuuacgaauuuaugucgggcugcauucaaaaccauccugguccucaugaggcccaugggccgcagguuuuggacaagcuugguuuacaauaucauaauauauuuaauauauggaauuuggucuuaaaaauuuguaacagcaaagauuagugaccaucuaacuuuacguuuuugugccaaaaaaaccuucauguuucgggagauggggacuguauuacuuugcugauccuaaaaauguaaauauucugacaaagggacucuggaagcaaaguuuuauacuucuggguuuguaaaauuguuuaauagaaagggaucucaagaaaucauucagggccaggcgggauggcuuacgccuauagugccagcacuuugggaggccgagauggguggauggcuuuugaacccaggaguucaguaccaaccugggcagcauggcgaaaccucaucucugcaaaaaaauacaaaaauuagccgggcaugcuggugcacacuuguaguaccagcuacuugggaggcugaggcaggagaaucacuugaaccugggaggucaaggcugcagugagcagugaucauaccacagcacaccagccugggcaauagagugagaaccugucucaaaaaaagaaaaaacaaagaagaagaaaucauucaggucuaccccuuaguuuuacagaugaagaaguugaggucuaagaucauacagccaguugaagacugcaucuuaguuugguguaguuucuuacuuaccacaauuauaacuaguuaaauauuuguguaguuauuuauuuauggcuucuaacauucacuagauaguaagacccaugaagauaggaauugugucuggcuugucuauugcuguauuuccaugcccaggacuuaauacuaaaugcagaauaaauggcccaaggaauauuugcaaaggaaugaaugagcaaaacaguuacagcuuuauugcuagugaagaaugaaaaacauuuaaagauuuaaaagauuuuuuauacugauuguugaaagucagguaggguacaucuugauuuagacuucagauuuacguuacuccuggucucaacauuuuuugaagauuuuuuuuuucuuucuuuuuuuuuuuuuuccccugagauagaaucucgcugugucgcccaggcuggagugcagugguauaaucuuggcucacugcaaccacugccucccggauucaagcgauucucaugccucagccucccgaggagcuggacuacaggcgugcaccaccauuucugacuaauuuuuguacuuuuaguagagacgggguuuuaccauguuggccaggcuggucucaaacuccuguccucaagugaucugccuaccucggccucccaaagugcugggauuacaggugugagccaccacacguggcccgagauaauguuuuuuauuuuuauuuuuauuuuuugagauaaguuucucucuguuucccaggcuggauggaguacaggggcacaaucuuggcucacugaaaccuccaccucccggguucuagcaauucucuugccucagccuccugaguaggugagauuacaggcacaugucacuacgcccagcuaauuuuuuguguuuuuaguagagacgggguuuugcuguguuggccaugcuuaucucgaacuccugaccucaagugaucugccagccucccaaagugcugggauuauaggcgugagccaaggugcccagcccugagagaauguuuauuaaagaaccgaguaaacacuuuucugugaugguuuuggauuuguauauugauuuccaaaauuccagguauucuuagugggcucaguuuauuuucuguucugauaaucuugaaacggaauccuacuguuagggcagacaauugggauuuggauuaccuugguguuuauacuuuagugcaaacuacagaaaugaaaauguagacucuguacucaucaaaaguaaugaaucuuuucugaaauugacuuuuuuuuucuuuuuuuggaauggagucucacucuguugccuagguuggagugcaguggccugaucucagcucacugcaaccucugccuccuggguacaagcaauucuccuguuucagccucccaaguagcugggacuacaagcgcacgccaccacgccuggcuaauuuuuguauuuuuaguagagauggaguuucaccauauuggucaggccagucucaaacuccugaccucaggugauccacccgccuuggccucccaaagcgcuaggauuacaggcaugagccaccgcgcccagccuaaaauugacuuuuuuaaccaaagaguucugugaaacucuguaguuauucacaaucuguaacuuugcugagcuuagggcauguaguuuggaaaaugaauacgguguccacuugcuuucugcuuaauccacaugucacauuuaaauuuguagaaguuuauuuccuugagcauuucuacagcacccuuuauuuccacugcaguuuuagguucaauggguucagacauuuugucauauuaguaagaguaugcuaucauacaagccauugggagccucuugaucuguggaugcaguucaguaagucuuuucagcaaauugcugugaccuaacaauugaauuaaaauauaaacccuauauuccuugccuuuuucuaaauaucccccaaauugagaauguuaaggguacaaauaaaaagaaaauuuagaucugggugugguggcucacgccuguaaucccagcacuuugggaggcugaggugggcggaucaccugaggucaggaguucgagaccagccugaccaauauggugaaacucugucucuacuaaauauacaaaaauuagccaggcgugguggcgugcaccuguagucccagcuacucgggaagcugagacaggagaauugcuugaacccgggagguggagguugcugugagccgagaucgugccaccucacuccagccugggugacagagugagaccccaucucaaaaaaaaaaaaaaaaaaaaaagaaaaaaaaaaaaaaagaaagaaagaaaauguauaauuaucauacuguuaaucuuauuuguaaagcucguguagaaucuccuaaaggauaacuggguacuccauccuuucaguuacauggugggcucucaucuuuggcaagugaauuuagcaguaacacaauuaaucaaaaacucucaaauaccuuauuugcagauauuggguuucccuaaguguaugcuaguuaaaucaacuuuuaaacauugugguaaaauauauauaacaagguuugcugguuugaccauuuaaaaauacaugccuaugucauuuuauugaacuuuauugggcuucgcagauauuguguuuuuuuacaaauugaagguuuguggcaacucugcccugagcaagucuguaggugccauuuuccaaaaaugugcucacuuugugucucugccccauuuugguaguucuugcaauauuucagccauuugcauuauuauuguaucuguuauggugaucugugcucagugaucuuugauguuacuguuaauuguuuugaggugccaugaaccaugccuauauaagacggggaacuuaauugaugaauguuguguguauucugacugcuguucugcugagucucucccucucauugggccucuuuguuuucucagacacaacaguauugaaauuagacaaauuaauaacuuuacaaugcccucuaagggucaagugaggugaagaguuacaugucucucuauuucaaucaaaagcuagacaugauugagcuuagaaagcaaggcacgucaaaagcugagauaggccaaaagcuaggccucuuguaccaaacagcuagccaaguugugaaugcaaaggaaaaguuuuugaaggaaauuaaaaauacuacuugaaugagcauuaugaaugauaagaaagugaaacagcuuuauuggcaauauggaaaaaguuuuagugaucuagauagaagaucaaaccagccacaacauuucauuaagccaaagccuaaucuagaguaagaccuuaauucucuucaguucuuaugaaggcuaagauaggcgaggacgcuacagaagaaaaguuugaagcuaacagguugguucaugagguuuaaugaaagaagccaucugcauaacauaaaagugaaaggugaagcagcaaguacugauauagaaacuguaguaaguuauccagaagaucuagcuaagauuacuguugaagauggcuacacuaaacaagaauuuuuuuuuuuuuuuuuuugagauggagucuugcucugucaccuaggcuggagugcaguaaugcagucauagcucgguacaaccuuaaacuccugggcccugggcucaaucaguccucuugccucagguucccaaguagcugggacuguaggcacacacugacaugcuuguauuuuuucuuuuuuaaauguuuuuguagagacaggaucuugcuauguugaccaggcuggucuugaacuccuggccucaagcuguccucucaccuuggccucccaaaguguugggaucacaggugugagccacugcacccagcuagauuuuuaaugacaaaacagccuuaucuuguaagaagaugccgucuaggacuuucauagcuagagagaagucaaugccugacuuuaaggaacaggccaacucucuuguuaggggcaaaugcagcuggugacuuuaaguugaagccaguacucauuuaccauucugaaaauccuaagacccuuaagaauuaugcuaaaucuacucugcuuuugcuugauucauggaacgacaaagccuggaugccagcacgucuuuuuauagcaugauuuacugaauauuuuaagcccaccauugagaccuacuguucagaacaaaagauuacuuucagaauguuacugcucauuggcaaugcaacuggucacccaagagcugugaugcagauacacacagagaggaauguugcuuucaugccugcuaacacaacauccauuuugcagcccaugguuccaagaaauaauuuugacuuuccagucuuauuauuaagaaaauacauuuaaugaggccauaacugccauagauagugauuccucugauggaucugggcaaaguaaauggaaaagcuuuuggaaaagauucaccauucuaggugccauuaagaacauuugugauuuguaggauuaggucaaauaucaacauuaucaggaguuuggaagaaggugauuccaagccucauggaugacuuugaggguuucaagacuucaguggaagaggucauugcagaugugguggaaauagcaagauaacuagaauuagaaguagaaccugaagaugugauugaauugcugcaaucucaugauaaaacuuaagcaugacaaauugcuucuuauggaugagcaaauaaagugguuucuugagauagaaucuacuccuggugaagauguggugaauauuguugaaaugaaaacaaaggauuaagaauauuacauaaacuaacuuaguuguuaaagcaguagcagguuuugagaggguugucaccaauuuugagagaaauuguacuaugggcaauaugcuacccacgcagcauugugugcuacagaaaaaucuuuugugaaaggaccugaguccguugaugcagcaaacuucauugucaucuuauuuuaagaaauugcugcacgggugcgguggcucacaccuguaaucccaguacuuugggaggacgaggugggcaggucaugaggucaggaguucgagaccagccggaccaacauagugaaaccccuucuauauuaaaaauacaaaauuuaguggggcaugguggugugcaccuguaaucccagcuacucaggaggcugaggcaggagaaucgcuugaacccgggaggcagagguugcugugagcugagaucacaccauugcacucccgccugggcgacagagugagacucugucucagaaaaauaaagaaagaaagaaauaaaauaaauaaaaaagaaagaaauugcuguagccaccuuggccuucagcagccaucacccugaucagucagcagccguuaacaucaagucaagacccuccacugucaaaaagauugugacuuauugaaggcucagaugaucauuagcauuuuuuuuugagacggaaucuugcucugucgcccaggcuggagugcaguggcacagucucagcucaaugcaaacuccgccucccagguucacgccauucuccugccucagccuccuggguagcugggacuacaggcgcccgccaccacacccagcuaauuuuuuguauuuuuaguagagacgggguuucacuguguuagccaggauggucucgaucuccugaccucgugauccaucugccucggccucccaaagugcugggauuacaggugugagccacugcgcccagccacauuuuuuaaaucaauauuuuaaaauuaagauagguauguuuguuaagacauaauguuauugcacacuuaauacacuauaguauagugcaaacauaacuucuauaugcacugggaaaccaaagaaauucaugugacuugcuuuauuguguuacucccuuuauugcaguggucuggaacugaacucccaauaucucuugaguuauaacuguauauaauuuaguggcauuaauuacauucacaauguugugcaaccauugcuaacuauuuccaaaacuuuuucaucacuccaaaaagaaacccuguaacuccccauccuccuuuuuuccucacuauuaauaccacuggcaguuaauacuuaaccacuaucucacuuucuguuuccaugaauuugcccauuucauguaaguggaaucauacaguuuguuuuccugcaucugacucauuucacuuagcauaauguuuuugagguucauucauguuguaucauguauugaacuuaauuccauccuuacuuccuccuaccuccuucccuguguugccuaggcuggaguauagugggaugaucacaggucauuacagccucgaccuccuggguucaagggaugccuccccugcccagccuccugauuagcuaggacuaugggcuugcaccacuaugcccagcuaguuuuuugaguuuuuaguagagacaggaucuuucuauguugcccgggcuggucuagaaguccuggccccaagagauguccacucuggccucccaaagugcugggauuacaggcaagagccaucacaccuggccuuaaucucucuuaaugggugaauaauauuccauuuaucaauauaccacauuuuguuuaccuguuaaucuguagauggauauuugggguguuucuaccuuuugacuguucugaacaaugcugcaguguacaugcaaguaucugugugaaucccugcuuucaguuccuuucgauauauaccugagaguggaauugcugggucauaugauaauucgauguuuaguuuuuagaggaacugccaaacuuuuucacagcagcuguaucauuuucuauccccauguaugaagguauauaauuccaguuucucuauauauuuacuaacacuuguuugaaaaauuauagucguccuaguagguauguugugguauguaauuguuaggauuuguuuccccauauaacuaauggugcugaguaucuuuucaugugcuuacuggccauuugcauaucuccuuuagaguucagacacugucuuaacaucucugugccucuguuuccuuuuuguaaaaugggagaacuauaguaccaauuuuuugagguuacuuugaagauuaaauaaagaaaacauauaaaacucucggaacaguaucuggcaccuaguaagcauucaauaaauguucucuguuaaauuaaaaauuaaagugauuaccuuuauugucagauuugaacaaggauggaauguagguuuuauccccuaaggaauuugaucuauugcuauugccuuccuggagcauccuguugagaagaugcaggauaaagauugcugagacugauaagugauuucugccuuuagcaagggaccuggggcacuuuuagcaguuauuugccugucuagacacugcugcagcaaagaguauguuggaaauacuuuaucuuagguuguaagugggugcuuucagaaagcugauguagacuuuuggcaaauuuuaucaugucacuacucuaagcccugguuucuugauuuucuuuuugagacaaucuugcccaggcuagagugcaguggcacaaucucagcucacugcagccucugccucccaaguucaagcaauucucuugccucagccuccugaguaguugggauuauaggugcccaccaccaugcccggcuaauauauauauauauaguauuuuuaguagagaugaggcuucaccauauuggccaggcuagucucgaacaccugaccucagguaauccgccugccucagccucccaaagugcugguguauugcaggugugagccagugcgccuggccugauuuugaaauaauuauguauuacucucaggccuuuccaccuccuaggggaagauuggaaaugggagaaggauucuggaaaauacagagaaagagaaaugcagcauuuaaaaaguuaagagggccgggcgcaguggcugacaccuguaaucccagcacuuugggaggccgaggcagguggaucaccugagguugggaguuugagaccagccugaccaacauggagaaaccccaucucuacuaaaaauacaaaauuagccgagugugguggcgcaugccuguaaucccagcuacucgggaagcugaggcaggagaaucguuuguaccugggagguggagguugcagugagucaagauaguaccauugcacuccagucugggcaacaagagugaaacuucaucucaaagaaaaaaaaaacaaaaaaaguuaagaacauggaacaaguuuugaaagauguuaaucucuccuguugcauaccccaccucaucauuugcuuuggucaugagaaugagugaaugauuaagguuuuacuguacaugauuauuugucaucauaauuacuugacacaaagguauucucuuuuuuuccugucuguuuggcagccauucuuuauucuguguauguucaaauagccugagagccuuuuagcuuagugcuccagcaugucagugggccuaauugccuauaagacugauuugccauuucugcuuuagaguuuguacagagcuacaaugucaccaaccucugcccccacacugccuccguguucuuuuaaagauucuugucugauccuuugcgaguuugccuuccaaaaacguuagacuaauuuauauuuccagcauuagcuaccuauguggcaaaucuauuaauuugguuuaaacuaccugauuuucagagugccuuuuauauuugcugacuauaccaauuuagggagagaaacuguaguguguaugugugcuugcauuauuugggauuccuuugacucagaagguauuuucuuuccaacuuucuuaaccuaggcuuauuuaccuuauaggugauuuaucugaguauuuaacuuuuugugacccacgugauugaugucugguuuucuuuccuauuuccuucuuauuuuuaacauuuuuuuagagacaaggucucacuguguuucccaggcuagaguguaguggcuauucacaggcauaaucaccgugcacuauagccucaaacuccuuggcucaagggauccuccugccucagccuccugaguaguugggacuacagucgcaugcccccacaugucuuucucuuuccuguuucuuugguuugguuucuuuacggcauaaaccagucaucuuuugcuuuuaaaagucuuacauuauuuuuucuuggacccucuguguuucugaggcuauuuuuuuaaaaacccucaaagguugauuuugauuaauauuuuaugaaaguguuuguuuuuucuaaaaggaccuuggcuucagaguauuuuaugaaaguauuuuauuuuuacaauuuauagguuggcauuugcuauuuauggaaaaguucugaguuuuccaguuuauggaaaagaucugaauucagaaacuuuguaagauguccugugauuaaaacaauaaaaguugaauauuuguuaaacuagagguauuuguugaauuacugaagacagcuguuuauaaaucuacaaacuuguuuacagguuguuuucuuugaauugaaagaauagucuguaauuuagaguaaaaauaucacuauuuuacauauuugguagaucuaagcauuacuaaaaaguauauuuuaauguuaugaaaaugaagaaguaaaauuacuuuuugaguaacagcuguuuugaauaaaaccuuggucuacugguugaaauuagaauguaacaggagugaguagaaaguguaacauuaggaguaaaagaaauguuaaaaucuuuuuuugggggccuaaauucagugacuucaguguaaguucuguuguugccugucaguagcuuugccuuccuuaggguaagccuaggagucugagaauuuuaauuucgaaaucuuuacuacuuggaguuguguuccuguccuuucuuauuucacauguuagaucaaauuucucuaggccagugacaccauacauuguuuuuuguuguuguuguuuuuauuuuuauuuuuuuaggguuuugcuugucaccagcuggagugcagugccaugauuguggcucacugcagccuugaccuaucaugauuaagcaauccucccuccuuggccucccagguagcuaagacuacaggugcaugccaccacaccuggcuaauuuuuaauuuuuuuuuuuuuuguagagaugcgggccuuacuauguugcccaggcuggucuugaacuccuggacucaagccauccuccucccucagccucccaaaguguugggauuacaggugugguccacugggccuggcccauuaaauaggcugggcacaucuagcagaugaaggguuauauuuuggaauccuuuaaaacaaauaguuucauggccaggcaugguggcuuaugccuguaaucccagcacuuugggaggccacgguggguagaucacuugagcucaggaguucaagaccagccuggccaacauggugaaaccccgucucuaccaaaaauacaaaaaauuggccaggugugguggcgugugcacuugcaaucccagcuacucgggaggcugaggcacgagaaucacuugaaccugggagguggaggucacagugagcugagaucgugcuacuguacuccagccugggugacagagugagacucugucucaaaagucauucagucaguccaucaaucaaucaauaaaacaaauaguuucaugauuguguaacuuaauuuuuuuuuuuuuugagacagagucuugcucuguugcccaggcuggagugcagcagugcaaucuuggcucacugcagccuccgccucccagguucaagcaaucuccugccucagccucccgaguagcugagauuacaggagugugccagcaugcccagcucauuuuuuguauuuuugguagagauggggguuucaccauguuggccaggcuggucucgaacuccugaccucaggugauccacucgccuuggccucccaaagugcugggauuacaggcauaagccaccacgcccagccuaauuuuuuauuuuauugucagaagagaucuacucucaacaaaauuuuacgcguacaauacaguauaaauauaauagguaugauaauuauacagcagaucucuagaacuuacucauuuugcuuaacugaaacuuuauuuccauugguugguaacucucuccauccccccagucccuagcaaucaccauuccauuucugauucuaugauuugacuauuuuagauuucucauauaaguugaaucaugcaguauuugucuuuuuguggcugacuuauuucauuuaguaggauguccucacaguucauccauauuaucauauacugcagaauuucuuuuuuuuuaagacugaaugcuugaauaauauuccauuguauguauauaccauaguuucuuuauccauucaucugccaauggauauuucuacaccucugcuauugugaauagcgccgcagugaacaugugagugcagauaccucuuugaaauacugauuucaguucuuuuggaauugcuagagcaugugguuuuuccauuuuuaauuauuuguuuuguuuuuagagacugggucuuguucuguugcgcaggcugaaauacaguggcgugaucuuagcucacugcagccucgaacuucugagcucaagugauccuccugccucagccucccaaauagcuggacucuaggcaugugccaccacaccugaauaauuuaaaaaaaauuuuagagauggagugucacuuuguugcccaggcugaucaugaacuuuuggccucaagcgauccucccaccucagccucuccugcgucacugagauuauuggugugagccacuaggcccagccaauuuuuaauuuuuugagugaccuucauacuguuuuccauagaagcucuacuguuuaguauucccaacaacaguguacaggcguuccacuuucucuacauccuuaccaacacuuggcuuuuugguaauagucauccugacaggcgcgagaugauacuucauuguaguucugauuuaucuuuccccaaugacuaauguugaacauuuucuuacauaccucuuggucauuugugcaucuucuuuggagaaaugucuauucaaguccuuagcccacuuuuuuuuuuccccaaguccuuagaccuuuuuuuuuuuuuccagacaggguuucgcacuuguugcccaggcuggaguacaauggagugaucucaauucacugcaaccucugccucccggguucaagcgauucucaugucucagccucccaaauagcugggauuacaggcacccgccaucacgcccagcuaauuuuuguauuuuauuagagaugggguuucaucauauuggucagccuggucuugaacuccugaccucaggcgaucugccccccucugccucccaaaguacugggauuacaggcgugagccaccacgccuggccagcccauuuuuuaauuauuaguuuuauugccauugaguuguauguguuucuuacguauuuuggagauuagccucuuaucaaauauauaguuugcaaauauuuucuuauuucuuagguugcuuuuuacucuguugauuguuuucuguguugugcauaagcuuuuuaguuuuugcuuuuuuuggucugugcuuuugaugucauagccaugaaaucauugucaagaccaauaucaugaagcuuguccccuauguuuauuucuaggaguuuuauaguuugugucuuauauuuaaaucuugaaucaauuuuaaguugauuuuuguaugggguaagagucuagcuucuuucuuuugcaugaggauauucaguuuccccagcaccauuuguugaagagacuguccuucccccauuggcacccucauugaagauugguugaguguuaauguguggauuuauuuaugggcugucuauacugucccauugauguaugucuuaucuuuaugccaguacuauauuauuuuuauuacuguaacuuuguaauauguuuugaaaucgagaaguaugaugccucuagcuuuguucuuucucaaaauuuauuuggcuauucguggucuuuuguaguuucacacgaguuuuagaauuauuaccuauuuccauaaaaaugccacugggauuuugauagggauugcauugaauuuguagaugacuuuggguaguguggguguuuuaacaguauuaaaagucuuccaguccaugaacaugaaaugccuguuuguuuaugucgucuuuaauuucuuuaaucaauguuuuuuaguuuucuguauauaagucuuucacuuccuuaguuaugauuauucuuauguuauuuuuuggugcuguuguaaaugagauugcuuuccuaauuuucuuaauuuuuuucuuauacacauagguguauauauuuaugggguagcugagauauucugauauuugaugcaauauauuugauuauaaugcauaauaaucacaucagaguaaaugagauaucuaucaccucaagcauuuauaauuucuuuguauuacagacauuccagugauauuauuuuacuuauuuuuaaauguauaauaaauuacuguuuacuggagucacccuguugugcuaucaaauacuagaucuuauucuaucuaacuauauuuuuuguacccauuaaccaucccccuucccuucuugccugcugcuaaccuucucagccucugauaaccauccuucuacucucugucuccaugaguucaguuguuuuaauuuugagcucccacaaaugagaaccugcaaaguuugucuuucucugacuggcugauuucacuuaacauaauguccuccauucaugcuguugcaaaugacaggaucucuuuuuuuuuguuauggcugaauaguacuccauuguguguauguaccacauuuucuuuauucauuugucuguugauggacacuuagguugcuuccaaaucuuggcuauugggaacaguuuugcacuaaacaugggagugcagauaccuuuucaauauacugauuuucuuucuuucagguauaugccuaggaguaggauugcuggaucauaugguuccucuauuuuuuguuuuuuugaggaaccuccaaacuguucuccuuagugguaguacuaauuuacauuccugccaacaguguaugaggguuccuuuuucuccacauccuugccaguauuuguuauugcccggcuuuuggauaaaaaccauuuuaacuggggugagauggcaucucauuguaguuuugauuuguguuuuucugaugaacagugauugagcacuuuuacauauaccuguuugucauuuguaugucuuuugagaaauaucuauugagauauuuugcccauuuuaaauuggauuauuagaguuuugccuauugagcuccuuuuauauuuuggccauuaaucccuuguuggauggauaauuugcaaauauuuucucccauucuuuggguugucuuuuucacucuguugauuguuuccauuacugugcagaagcuuuuaacuugauaugacccuauuuguccauuucacuuugguugccuuugcuuguggguuauuacucaagaaaucuuugcccagacaaacaucauggagaguuuucccaauguuuucuuguaguaguuucauaguuugaggucucagauuuaaaucuuuaauccauuuugauuucauuuuuguauaaggugagagauagggucuaguuucauucuucugcauaagaauaaccaguuuccccagcaccguuuauugaacagacuguccuuuccccauguauguucuuggcaucuuugucaaaacugaguucacuguagauguauggauuuaucucuggauucucucuucuauuccacugaccucuaugugucuguuuguaugccaauaccaugccauuuugguuacugucauucuguaguauaauuugaagucaguaaugugauucuuccaguuuuguucuuuuugcucaggauaacuugggcuauucugggucuuuuguggauccuuauaaauuuuaggauuuuuuuuuccauuucugugaagaauguuaugguauuuugguagagauugcauuaaaucuguagauugcuuuggcuaguaugaacauuuuaacaauaucuauucuuuuaauccaugaacaugggauuucuuucuuuuuuugugugucuuuaauuucuucacucaguguuuuacaguuuucaaugaagagaucuuucacuucuuugguuaauuccuagguguuuuauuuuauuuguagcuauuguaaauggaauuacuuugcugauuucuuuuucagauuauuugcuguuggcauauagaaauaucacugauuuuuguauguugauuuuguauccugcaaccuugcugaauuuaucagcucucuuuuuuuuuuuuuuuuuuuuuugugcguguggaggcuuuagguguuuccaaauauaagaucauauuaucugcaaacaaggauaauuugacuucuuccauuacaguuugggugccuauuauuucauucucuuguccaguugcucugucuagcucuuccaguacuauaaugaguaacaguggugaaagugggcauccuugucauauucccuaucuuacaggaaaggguuuccauuuuucccuauucaauaugacacuagcuaugggucugccauaaaugacuuguauuauguggagauauguuccuucuguacccaguuuuuugaagguuuuuaucaugaagagauguuggauguuaucaaaugcauuuucagcaucaaaaugaucauauaguuuuugucuucauucuguuaaugugauauaucacacugauuugcauuuguugaaccauccuugcaucccugggauaaauuccauuuggucauaauaaaugaucuuuuuaauguguuguugaauucaguuugcuaguauuuuguuaaauuuugcaucaauauucaucagugauauuggccuauaguuuucuuucuuugaaguguuugguuuugguaacaggguaauacuggccucguagaaugaguuuggaaauauucccuccucuguuuuucagaauaguuuuaguaggauugguguuaguucuucuuuaaauguuugguggaauucagcacugaagccauuggguccugggauuuucuuugccggggugcuuuuuauuaugguuuugauuuuguuacuuguuauuggucuguucagguuuuggauuuauucauaguuaaauauuguuagguugugugugucuaggaauuuauccauuuauucuagauuuuacaacguauuggcauauaguugcucauaguagccaauaaugauccuuugaauuucugugguaucaguuguaauaucuacuuuucccucucugauuuuauuuauuuagaucucucuuuuucucuuagucuggcuaaagauuugucaauuuuaucuuuucaaaacccaccuuuuuguuuuguugaucuuuuguauuguugucuucaugucaaauucauuuauuucuguucugaucucuauuauuuuuucuguuaauuuuguguuugguuugcuccuuucugguucuuuaagaugcauuauuagguuguuuauuucaaguuuuucuuguuuuuugauguaggcacuuuuagcuguaaaauucccucuuagugcuacuuucacuguaucccauagauuuugguauguuguguuuccauuauuuuuuuugagaaggaguuucgcucuguugcucagguuggagugcaguggugugaucuuggcucacugcaaccuccaccuccuggguucaaacaauucucuugccucagccucccaaguagcugggauuucaggcacaugccaccaugcccaacuaauuuuuguauuuuuaguagagaugagguuucaccauguuggccagguuggucucaaacucucaacuucaggugauccaccugccuuggccuccccaagugcuaggauuacaggugugagccacugcgccuggcccuccauuaucauuuguuguaagaaauuuuuaaauuuccuucuuaauuucuucauugacccauuggucauucaggagcauauuguuuaauuuucauuuuuuuuuauaguuuccaaaauuccucauuauugauaucuaguuuuauuccacuguggucagugaagaugcuugauauuauuucagauuuuucagaauguguuaagacuuuuuuuugugaccuaacauagucuguccuugagaaugauccaugugcugaggaaagaauguguauucuacagcuguugguugaaauguucugcaaauaucuauuagguccauuugauuuauaguauagauugagucugauuuuuuuguuguugauuuuauguauaaaugaacuguucaguacugaaagugggguggugaagucuccagcuguuauuguauugggguccaucucuauuuagaucuaauaauauuugcuuuauauauuugugugcuccaguguugggugcauauauauuuacaguuguuauaucuuuuuuuuuucuuuuuuuuuuuuuuuuuauugaucauucuuggguguuucucgcagagggggauuuggcagggucauaggacaauaguggagggaaggucagcagauaaacaagugaacaaaggucucugguuuuccuaggcagaggacccugcggccuuccgcaguguuugugucccuggguacuugagauuagggaguggugaugacucuuuaacuagcaugcugccuucaagcaucuguuuaacaaagcacaucuugcaccgcccuuaauccauuuaacccugaguggacacagcacauguuucagagagcacaggguuggggguaaggucauagaucaacaggaucccaaggcagaagaauuuuucuuaguacagaacaaaaugaaaagucucccaugucuacuucuuucuacacagacacagcaaccauccgauuucucagucuuuuccccaccuuucccccuuuucuauuccacaaaacugccauugucaucauggcccguucucaaugagcuguuggguacaccucccagacggggugguggcggggcagaggggcuccucacuucccagaaggggcagccgggcagaggcgccccccaccucccggacggggcggcuggccgggcaggggcugaccccccaccucccucccggacgggucggcuggccgggcgggggcugaccccacaccucccucccggacggggcggcuggccgggcgggggcugaccccccaccucccuccgggacggggcggcuggccuggcgggggcugacccccaccucccucccggacgggguggcugccgggcggagacgcuccucacuucccagacgggguggcugccaggcggaggggcuccucacuucucagacggggcggccgggcagagacgcuccucaccucccagacgggguugcggccgggcagaggcgcuccucacgucccagacaggguggcggggcagaggcgcuccccacaucucagacgaugggcggccgggcagagacgcuccucacuuccuagaugugaugguggccgggaagaggcgcuccucacuucccagacugggcagccaggcagaggggcuccucacaucccagaugaugggcggccaggcagagacgcuccucacuucccagauggcauggcggccgggcagaggcugcaaucucggcacuuugggaggccaaggcaggcggcugggagguggagguuguagcaagccgagaucaggccaccgcacuccagccugggcaccauugagcacugagugaaugagacuccgucugcaaucccggcaccucgggaggccgaggcuggcggaucacuugcgguuaggagauggagaccagcccggccaacacagcaaaaccccgucuccaccaaaaaaauacgaaaaccagucaggcgugguggcgcgugccugcaaucgcaggcacucggcaggcugaggcaggagaaucaggcagggagguugcagugagccgagauggcagcaguacaguccagcuuuggcucggcaucagagggagaccguggaaaggggagagggagagggagaggauaucuuuuuguugaaucgacaccuuuaucauuauguagugaccuucuuugucucuucuuacaguuuuugucuucaaaucuguguugucuaaauauagcuacuccugcucuuuuuugguuuccauuugcaaacaacaucuuuuuccaucccuuuuuuuuucagcguauauaguuuuucauaaaugaaauguguuucuuguaggcagcagaucauuggguguguuguuuuuauucauguagccacuguguguuuuguuuggagaguuuaguccauuuucauucaauguuguuauugaugagugaagacuuacuccugccauuuuguuauuuguuuucugguuguuuuguggucuuccuucuuuccuuccuuccugucuuccuuuuagugaaggugauuuucucuggugguaugauuuauuuucuugcuuuuuauuuuuaguguaucuguuguuguauguuuuuugauuugagguuacuacaaggccccguuugaauaaacuuucuaccccaucucuuucuuuaccucccuuguaaggccuauaacuauucaguuugcccuucugaggcuauuuucuagauccgguaggcaugcuuuauuguuuucguuuucuuuuuuuucuuuugucucuucugagucuguguuuucaaauaaacugucuucaagcucacuaauucuuuccucugcuugagcaguucuacuacuaaaagacucuaaugcauucuuaaguaugucaguugcauuuuucaacuccagaauuucugcuucuuuuuaauuauuucaaucucuuuguuaaauuugucugauagaauucugaauuccuucucuguguuaucuggaauuucuuugagcuuccucaaaacaguuauuuugaauuuucuaucuuaaaggucacauaucuguuucucuagcauuggucuccgguucauuuggugaggucaugcuuuugugaauggucuuaaugcuuauggaugcuaaucugugucugggcauugaagaguuagguauuuauuguaggucuuuguaguccaggcuuguuuguaccuguccuucuugggaaagcuuuucagauauuugcaaagacuggguguuggcugggugcaguggcugacaccuuuaacucuccagcacuuuggaagguugagaagggcagauugcuucagcucaggaguuugcgaccagccuggguaacauggugaaaucccaucucuacaaaaagaaauacaaaacaagccaggugugguggcauaugccuauagucucagcuacuuggaggcugaggugggaggaucacucaagcccaggaaggugaggcuacagugagcugagauggugucacuguacuccauccugggugacagugagauccugucucaaaaaaacaaaucauagguguuguaaucuaagcugugucuuuauuagggugcaccccaagcucaguaauguugugauauucuugcagaguuguagauauacugccuugacaauguugaugaagauccagaagaauuaucuggauuacaaggcagagacccuuguucgguucuguuucuuucucccaaacagaguguccuucucuguucugagcccccuggagcugggggagggaugacacaagcaccccugugacuacuaucaaugugauugcacugggucagaccugaagccagcacagcuuuucacccaaggccugcuguaaccacuaucuggcuaaugcuuuugauugcucaaggcccugggcucugcaguuaguagguggcaaaaucagcuagguuuguguccuuuccuuccuggugguaaguuuccccaggcccugggcagguccagagguguuguagggagccagggacuagagucaaaaaccuuagaagucugccuggugagcuggcacucagaccacaagaugcaguccuucccacucuuuccucccuuuuccauaggcagaggagccucaccuuguagccaccacuaccacagacccacagguaguacugccaggccacugccaguguucccuuaaggcccaaaagcucuucagucagcuugugguuaaugcugccuggcguggaacucacccuucagggcagugguuuccccucuggcccagggcagguccagaaaugccaucuagagccaaggccuggaaucgagaaccccaacagucugcuuggugcucucugccacuguggccaagcugguaccuaaggugcuuucaguuuuucuucauugaauaugguguuagcugugggcuucuccuuuaugaauuuuauuuuauuauguugagauacuuucuguuauuccugguuuguuuuuaucaugaaagagugaauuuugugaguuuuuucugcaucuauugaaaugaucauauaaugcuguucuuuauuuuguuaauguggcauauuauaucaguugauuuuuuuguuuauugaaucgucugugcauccuagggauaaaugccacuucguugugguauaugauuuuuuaaaaauuuuguuguugguuggguuugcuaguauuuuauugaggaucuuugcaucuauauuugucaaggaguaacuaauacauuuuuuaaccucauuaaaaauaauuuugaagauguacuccaggucucaguaaugaaccuggcccuaugugcuccacucacugaugcugcccagcgaucuaguuuguuuggaaugcuuuucccaccauuugacuggaugacucauacucugguaguaucuccucauuccauaaaacugugccuaccgaccuccccuguccuucaaauucuggauuagaugccuuaggggacuucuaucaucacauauaucauaauuagcuaucuauuccuucucuccuagaagaagcucuucgagaauaagagcuguauuuccucuugaccuccaaucguuaaucuagugucugacacauuauuagauacuuuaauauaagccuucuaguacauaagacaagacugaacaaaaugaaaacauuuaauuaaaacucaauuuuacuuuuuauuaauaccuaaguguccuacaaucaaagcacagcuucuuaguugaacaaagaaagcaauugucuuuuacauuaggcauauaaguaaaacugauguuuuugcuagguauuuuuuccugcccugaauaucuuaucacugaagugaccaaagcugucuguuguucuuuaugcuuauuuuuauuugucuuaguaauuaauaguguuacucucaucaucuuuaauuuguucuuaauaaaucuaugggaaucuuuuauauaccuuugcuuuucuuugaauuaauccugauuuuuaaaaacuuuuuauuuugagaaaaaucuuaaguuuacagaaaaguugcaaggauauuaaguaccaguaaaccuuucaccuauauuuaccaaguaacauuugccacauuuugcuuuauuuuugugucuguauguacaauuauguuauaauuugcuaaucguuaguaaguugcagacauucuaacucuucuuaacuauuucagcauguauaugaacagggacuuuuaaaaauaccaauaaacuuaucaaauucaggagauguaagauugauauaauacuguuauuuaauauaugguuuauauuccaaauuuuucaguuguucagaauuuguucucuguagcaauuuccccuguaagcuaggauccagucagggagcacacauggcauuuacaugucauuucucuucaauauccuuuaaucuagagaaguuccucagccugaguuuuugagucuuucaugacauuaauguuuuuuaagaguguagaccaguauuuuuuugaauguugucaacuuggguuuauauauuccuuuaugauaagauucaauuuguuacauuuuuguuaggaauacuguaugugauguauguuccuuucugugccuguggaucaagagguacaugaagucagugauguuaaguuugauccaucagaacccuuuguaacuaauaguaauuuguggagaaauauuugagauuguaaauauucuguucuccaagaaacauucauugguuuuagcauuuguugaugauuauuacuuaagucaguuauuacuauaauaguuccaaagugaugacuuuguagcucugucauucuucuguauugauuuguuggucuaauacuuucuaauggagguauuucuuuauggaauuguccuaaauggaguucauaaaauaucaguggaaaugaccuaagauuuuucuccuuuuuauuauggaaauguuaaauauacaaaaaaaaaaucagaauacuacagcugugauucaagaguuuuaaacauuagucauauuugcuuuaccugucgugugugugugugugugugugugugugcgcugcaauuuuugaaaguauguuggagauaugacauuuuuaucccuacauauuuugauauguaucuccuaagaauauuuucuauauagcuacaacagcauuaggucaccuaaaaaaauuaacaauuccauaauaucacauaauaaccaguuuauguuaaaauuuccccaauaugucuuuuuuuuuuuuaaugacccaauucaacauuuauacauuacacuuggacccaaaaggacccaguuccacauucauacauugcacuuggcuucucuuaagucuuucuuaauuuagaacaggucauucucgcacuuuuuuccuuaauuacauuaaguuuuuaaaugaauuauucacuuuggaaagaaaauaaacuguuugguuuuguaauuagcaaguaauuugcgaguuuuggcaccgcacaaauauccuguucuuuaguagcuuuuaccuaguaguuuucacuuccauugaugauccuugccuacuucaguuguuuucuuggagguugcaugugcccaagcacacaaccacauacacaaacacaaaugaacaagaaaaacugauuuuuuuugguuacacacaaaauaucauauucuauacauuuuucugcaaccuuguauuucacuuacuauauuaaggaguuuuccuaaauagagggauucccucuuaucucuaaggguuccuccccucuuccaugaggagagguauaaaccaacuuuuuuuuucuaacuauauuugagaaccucuauaagcucugaauuaaauauugaacuaacauuugaaaugcaaggauaaaaauuuaaacaauuuuugaauuuggaauuguauuuauaaagcaucucuucaucaugauuuuagccugaaguuuucauauaaauaguaauauaaaauguaugaaagagggguuaucauuuacauuugauuagaauuugcaaaaaacuauuuucauaaaacuuauucuguuucuauccucuguuuuacaugaaauuauuauggucauuuuuuucaucaaaaaauauuugcauucuuucauauaucuuuaugaccauagagauaacaaaauaaguuacgacuacuuggccuaauggaaugaaaauaauaauaaacauuuacugagugaauguuuuguucuuggcaccgugcuuaaaaauuaaacccuuuacauauacuaacuccuuuaauuaccuuauaauuuuaguauguagaugacauuauuccuuuuuuuuugagacagggucucgcucugacauccaggcuggagugcaguggagcaagcacagcucagugcagccucaaccucccaggcucaagcaauccucccaccucagccuuucaaguagcuaggacuacagucgugagucaugaggcccagcuaauuuuuuacauuuuuuuagagaugaggucucccuguguuccccaggcuggucuugaauuccugggcucaagugauccuguagccuuggccucucaaagcacugggauuagccaugcauaagcaugagccgcugugccuggccugacauuauucuuauaaaugaggaauuuaaaaauucauauaagagaagcaucuuguaaagauacaauuuuuuuuuuuuuuuuuuuuggagauggagccucucacugucgcccgggcuagagugcaguggcgagaucucagcucacugcaaccuccaccucccaaguucaagcgauucuccugccucagccucccaagcagcugggauuacacgugccugccaccacgcccggcuaauuuuuuguacuuuuuguagagacgggguuucacuauguuggccaggcuggucucaaacuucugacuucgugauccacccgccucggccuccugggauuacaggcaugagccaccacgccuggcccaaaaaauguuauuuaacugaucugaaacuuaaacauguuuguuuaacaccaacauaugugauucugaaccacgcauacuaugcugcuuauucacaauagcaacgacauggaaucaaccuaaaugcccaucaacaguagccuggauaaggaaaauguggugcauauacaccauggacuacugugcagccauaaaaauaaacaagaucauguccuuugcaggaacauggauggagcuagaggccauuauccuuagcaaacuaacacaggaacagaaaaccaaauacugcauguucucacuuauaaaugggagcuaaauaaugagaacacauggacacauagaggggaagagcagauucuggggccuucuagaggguggagggugggaggagggagaggaucagggaaaauagcuaaugaguacuaggcuuaguaccugggugacgaaauaaucuguacaacaaacccccaugacacgaguuuaccuguuuaccuauguaaccaguacauguacccuugaacuuaaaaauuaaaaaaaaaaaauucauuuguuaagguuuuaaauuuuauaguauuaaguuuauuauuuugauuuugguuuuugauuuugauacuuuaugcuauaugguccuauuuacauguugaucuuugugacagguauuuuaacaauggacuuaaagagccuguggauccuaauaugagaaauuauaaguacaguaggggucaccucugggaugugugacaucaguugguaaccucaaagugaaacuggaguuuagggugaaauagggcauagaguggugggaaguugaccaaauuguagcccuuccuuuugauucaguguauuuaaggauccuugucagaauggaguccuuuuggcuauaaggagaagauccagaccugggacaugacuaauuagaaucacagugucuucauuuuugaaaacuuuuccuuccccauuugaaacuagaccauuuuauaauuaguaauugguacguuaauagugcaaaagauauucaaacugcacaguauuuuuugguauuuuuuauuauuucauguacaaaauucagaagguacagaaggguauacacuaagggucuuuuuccccagagacagccacugguaccaauuuucuuuguuaccaucuauuuucuuccagauauaauuuacacacacaugcauucuuuuuagcagucccauauaaaggcaguugcuauacacacgguacugagccuugagguuuuucacuuaacaguauaucauggagauuauuucaugucuguauauugugaauuuccuuauucauuuuuauagcugcacaguacucuguuauaaagguauaccauaauuuauuuagccaaaccuaaauaaaucuaacuuacuuacauuguuucagucuuacuuguaagaacagugcuacagggaauaauaggcaagucauuuuguacauaaagaugugcauuugguaucugugcaggauaaauuguuaaauaagggguugcugugucaguuugcgcauuuauaacuuugacagcaggugcugaauauccccccauaaaggcuguaugcucccacuaacaauauaggagaguuuauauuagcaaauugcucaaucuuguugaagcuuuaacuuucauuucccuucuuaucagugagguugagcauaguuucaugugcuaggaacucauuuguauuuucuuucccaauacacuuuuuaaauucuggguuugguauaacuacuuaagguuuaacuuuuuuuuuuuuuuuuuuuuuuuugagacggagccucccucugucauccaggcuggaguacgguggcacgaucucggcucacugcaaucuccaccucccggguucaagcgauucuccugccucagccuccugaguagcugggauuacaagcacacgcuaauuuuuguauuuuuaguagagacaagguuucaccaugcuggucaggcuguucucgaacuccugaccucguggccuguccgccuuggccucccaaagugcugggauuacaggcgugagccaccgcgcccagccagguuuaacauuuuugaagcuguucucugaagauacuuauggcaagacuagacauaauauagaaguuaauauuacaagcucuggagucucagguuuauuucuuggcuuugccgcuuguaacaccuuaggcaacuuacauguguuaagucagauaaagcauaugaaagcacagugccuagcacauaagagcacaagaauguuagcuauuauuagugugccuggugcgugcuaauaauaacugacauuauuagcuauuauauguuaguuaacuaugguaacucuaguuauuauauauaguuaacuuuguuccauaaaugcuuuauuuguaguauaauuauaauuauguaaaaauacuaauuuuuuauuagcaauaaaaaugaaguaugccaaaauauuaauuguaauuaauaccaguuaaguaacuggugccaggagaauuuugaguaauuuguguuaauuauuuuuaaugucuaauuuuuuuguaauggaaauauguuuuauaauagaaaaauaugguagacauuguugugaaaugauuuuuguuaaauacaccuccccucuuuuuucauuacagacagagagugcaugggcugaagaauacucugaaaagaagaaagggucucacaagcgcucagcaucuuggggcaguacagaucaacuuaaggaggucagaaaaaugguucuaagauaguggguguggaaauaugauccuuuuguuggcuauuuccuugauauuaugggcagcaaggauuugucguuuuccauugauuucuuuuuucuuuuuggcuucugaaauaacaaaaacaauuauuguguugauuuaauaaagauuucaauagggauauuuauauaucacuuaccugauuauguauguuugucuuuuuuuaggagaauucauaccugucuauuaacaucagauuuaaaaauuguaacaauacaacaaauucacauuuauucuuuuuuuuuuuuuuuuggggugugcaugugugugugugagacggagucucgcucuguugcccaggcuggagugcaguggugcgaucuuggcucacugcaggcucugccucccaggcucaagcaauucucgugccucagccucccaaguaccugggacugcagguguaugccaucauggccagcuaauuuuuguauuuucaguagagaugggguuucaucauguuguccaggcuggucucuaacuccugaccucaagcagucugccugccuuggccucccaaagugcugggauuacaggcaugagccaccgcaccuggccacauuuauuauuuuucuauauauggugguguuucugaaaugcaguacucacuauaaccaugaugguuauggcuccaugcuaugauuaccauuuucugugcugcuaauuagugacauuuucauuucacacauaauguagaaaugcaaaaacucggucaaagaauaaauaagauauucauuggaauugcauucguuauuuaaagaugauaucugugaauauauuucaugacuugaguugauuuuuaaauacuguguaauuuuuggaacuguugaaagcuagguguucaauaaaucuaaauugaaauaaaaauuaacuuaugguaaaggcaaugagaaugauuguuauuuuuuuaauucuucgugaaaacuguaauguaauuuauucuaagugcugaaaacuauuuguguaguacuugggaagcucgaaggcugagaacaauguuggaacauauacacauacaugcauguguagauguguauaaaauuaugaacaaaaaaugagacuuugugauaugguucaaaaauucaaaggacuuauuaaggguaaguuuuacugguucuuauuaagcaaggauguguuuuuguuucauguagaaaacacucugguguacuugcuauuuuugcuuucucagauugcaaaauuacgccagcaguugcagagaaguaaacacagcagucggcaucaucgagauaaagaaagacagucuccauuucauggcaaccaugcagcuauuaaccagugucagguaagaguaccaauaccacaaaauccagaaaaggaauuuguuguuuuucuggugauuuguuauuucauugguaauuguuuaggacaaaaaugcucaaaaacauauuugaaacagugauuuaaauacugaaucacagucuuuauaagaaaacagaauauuaaguugacaaaaugauauuuuccuuuagugaccuaagauacgacuucuaggagacauagcuacuuaucuauuuugguuuaccauauuuuuggcuuuaucaguucaauauuuuggaggcagaaugacacagagaauuaagcauuggguauggaacaggcccuggcugaauaacuuaucuuuucuaagucucaguuuccucaugugaagaugggaauaauaauaccugucucgggcggggaacaucacacaccagggccuguugugggcuggggcgaugggagagggauagcauuagaagaaauaccuaauguaaaugaugaguuaauggguacagcaaaccaaaacggcacauggguauguauguaacaaaccugcauguugugcacauguacccuagaauuuaaaguauaauuuaaaaaaauguaaaaaaaaaaauagcugucucauagaagucuuuugauagagacaaaccuuuaucugcuuugauuuuuuaguagaacccaugaacugcucuugauggcucauccauccaaagaacacuuuuuuuuacugaauugaaauuggaugagaucucuuggcaaggagaaagcaaguucauuucaggucuuuucaggaucuuucaaguuccagaauugaagcuuugggaaugaggaaggcuggauugaauuuuccauguuaacaguaaggcagcagggccuggaagguagagggaaacuagaagacuuaguucugugacucucagguuguuuuauaauacuggaguuggcaaacuguggcccgggagccaagaaugucccaccauguguuucuguaaauaagguuuuauuagaaaacagucacucucauuuuuuauguauugucuauugcuccuuuuugugccacaaaaauauacauuugacucucuauaucuucagguuuugcauuuauggauucaaccaaccauggaucaaacauauuuuuggaaaaauagaauagaauauguauaaauauaaauauauuuuaaaauauaauuaaaaguacaaauaaaaauacaguaugacaacuauuuacauaguauuuacauuguauuagguauuauaaguaaucuggagauuauuuaaaauauacaggaggauguuccuaaaucauaaugcacuuaccaugccauuuuauauaagggacuugaguaucuguggauuuugguauuuggagggggguccuguccuggaaccagucuucugaaauugaguaguugaaacagagacugucugguucacgaagccuaaaauacuuacuguuuggcccuuuacagauaaggcaggccaaccccuuuuauaguuugguagugucugauguuuguuaaauguauagauuguuugcaauggaaaguauggguaaagguauagacuuuuucaaacugauuuugccccaaaauauuaauacucgggucagauuugauuucacagguuuauagagauuguuuuuuguuuguuuugagacagggucuugcucugucacccaggcuggagugcagcagggugaucacagauucacuauagccucgacuuccuggguuuaugugauccucccaccucagccugcugaguagaugagacuacauaugugcaccaccaugccuggcuaauauuuuuuauuuuuuauuuuuauuuuuguagagauggggucuguguugcccaagcuggucacuaacuccuggcuuugagugauucucccaccuuagccucucaaaguguuggaauuacaggcaugagccacuauguccagccaaauuuauaguucgauuauaauuuccaguaacuuuuuucuauauuugauauuuuaauuaaaaacaugguuauacauuaguauucguguauauucuguacaaacuagauuuauuucuggagaaauagaaauuuuaaauugacaaaauaagaaaugaaaaauuuguaaagacuaauaacuuuugaauuuggaauguuaauuaaaaacccagucucacucucaagaggcugaagacccagaugauuuuacagaugaauuugccaaccuuccccuuccucucauucauucauaaauaaaugguauguguuucuaaaaaauaaggccacuuuuuacucccaguccauauuuuuacuccaaguagaauagggauuaggauggaauuuuauugaauuaaguggcuaguuuuaggacuucagaaguuucugaagugauuauuuuuuaaacuuguguuaaaaccaacaauuuuaaagugguuauucaaauuuucauuuuuuucuucuugcaaguugaauuuacuuaauaaagauuauuggaauuuacuugaaauuuauauuuaauuuaaaaacauuuccuugcagagaggguaaggacaagaaaauagagaaacuugaaaaauaguucaucuaguuugaguuuuguacacuugacacaucaagcgucuuaacuguuucucccauuuuauuuaguguuaucagccaaccgcaagucaggcacaugugcaucaugauaguaaugacaguaguacucauguuuaauugaaacucacgcuggccgggcacgguggcucacgccuguaaucccagcauuuuggaaggcuaagguggguggaucaccugaggucaggaguucgagacuagccuggccaacauggcgaaaccacaucucuacuaaaaauacaaaaauuagcgaggcuggcgggugccuguaaccccagcuacuugagaggcugaggcaggagaauggcuugagcccaggaggcggagguugcagugagcagagaucgugccacugcacuccagccugggugacagagugagacuccaucucaaaaaaaaaaaaauuuaaaaagaaacucuuaggcuguaaacaugaaaauaauuucuauuaaguuauuguuuugguggguucucuaucuaguggagaaaagugccacacgauacauguguacuucugaggccauucaucagcccauacaauauuuauuaaucauuuuggccugugaccguaguacucauuaggggauguggugauaaaagaaauauugucuguccuuaccaguucucauauuaaagagauaugaguaaacaguuaauuauaacacuguauaaugaauguguugauagggagaauucagaaugcaacagaagauguguuuauuuggaaaaggauggagucaucuagaaagacgucucagagaaaauggugucuagcugauccuugaaagauaaguauaagguggaaaaagucauguccccagauaggaguagugguaagagauuaggcaggauagagagguaaauagcagccaaaccugaaagucuccauguucacuuauuaagacauuuagacuucaaccuaggcuauuuuuuaaaaugcaggauauggauaugugacuauuucauaauggucauuauggggucagauauagaacgaauugggaagagacaagauuagaaguagggaaauaauuuaagaauaggauuuagugauccaaguaagaaaugauggccucuaguaggguagaaacuuuuaaacugcugaggaugaacuugagugauauuuagaagguaagaauuaauaguugaauucuauuaaaaggguuuacuaugguaagcauuuggauacauuauuggcauucaauccucaucuuuaaggugggguuuguuagucucuccauuuuauagacaagaacaucaaggcccagagaggucagguauauuguuuaaggucacacgagacagccagaauucuaaccuaggcauuguaaccucagagucugagguuuuuaaacucugugcuagcugaugguugacaauauuugagaaaaauagagaugaaaguuaaggaugaugucaauuuuaacuuuuaaaauaugauuuaaggccggccguggugguucacgccuguaaucccagcauuuugggaggccgaggcggguggguugcuuuagcccaggaguucaagaccagccugggcaacauggcaaaacccccucucuacuaaaaacacaaaaauaagcuaggcguggugccgcgugccuauaauccaagcuacucgggaggcugaggcacgagaauagcuugaaucugggaggcggagguugcagugagcugagauugcaccacugcacuccaguugggggagauagaguucucuaaauaaacaaacaaacaaugaaaaaauaaaaaaugaaauaggauuuuagaaguuuaucuaucuaccucagcaccauauauaaaaguaacucaaaaucgucaaggaccuaaauguaagagcuaaaccuaacagcucuuagaagaaaauguagucauaacauuugugacauugcguuaggcaauggcuucuuagaaaugacacuaaaagcaaaagcaagaaaagaaguagauaaauuguacuuuaucaaaauuaaaaacuugugauucuaagggcaucaucaagaaugugaaaagauaacccacagaauaggauaacccacaaaucauauaucugauaaggcauuugugucuaaauuacauaaagaacucuugcaacucaguaacucacaaaucauauaucugauaaggcauuugugucuaaacuacguaaacaacucuugcaacucaguaauuuaacaaaaacauuuaaaaaugggcacaggaucugaacagagaguucuccaaggaagauguacaaauagccaauaagcacaugaagaagaugcucaauauaauuugucaauggggaaaugcaauucaaaacuccagugaaauaccaguucauaugcauuagaaugcuguaauuuaaaagacagauaauaagugucaggggaggauguggagaaauuggaauauauauauauauauauauauauauauauauauauggagagagagagaagcuccuucucaauuaaaaaauauauaaacuuuuauuuauuuuuauuuuauuuuauuuauuuauuuugggauggagucucucacugucgccuggacuggagugcaguggcgcgaccuuggaucauuguaaccuccgccucccggguucaagcgauucuccugccucagcuuccugaguagcugggauuacaggcaccuaccaccaugcccggcuaauuuuuugaguuuuuaguaaauacaggguuuuacuguguuggccaggcuggucucguacuccugaccucgugagccuccugccucggucuucccaagugcuaggauuacagacgugagccacugcacccagccuacuuuuuuuuguuuguuuguuugcgacggaguuucacucuuuaugcccaggcuagagugcaauggcaugaucuuggcucauugcaaucuccgccuaccagguucaagugauucuccugccucagccuccugaauagcugggauuacaggcgugugcuaccacacccagcuaauuuuauauuuucaguagagacgggguuuuaccauguuggcuggguuggcugcaaacuccugaccucaggugaucugcccgccucggccucccaaaguacugggauuacaggcaugagccacugcacccagccuauuuauuuuucuuuuuuuuuuuuuuuuguauuuauaguagagaugggguuucaccuuguuggccaggcuggucuugaacuccuggccucaggugauccaccugccucagcuuuccaaagugccgggauuacaggcgugagccaccgcgccuggcuggaacuuugauauauuaaugguaggaauguaaacaguugcuuuggagaauaauguggcaguuccucaaaagauuaaacguggaauugccaaauggcccggcacuuccucuccuagguauauacccaagagaauugaaaauauauguccacauaaaaacuuguacauguauguuaauggcagcauuauucauaauagccaaaauguagaaaaaacccaaugucuaucagcugauaaaaggguaaauaaaaugugguauauccauaugauggaauuuuauuugaucauaaaaaagaauggaguaccaguacaugcgacaacaugccugaaccuugaaaacauuaugcuggccaggcacggcggcuuaugcccgaaauaccagcacuuugggaggccaaguuggguggaucacuugaggugaggaauuugaaaccacccuggccaacauagugaaaccccaucucuacuaaaaauaccaaaaaauuagcugggcauggcggcacgugccuguagucccagcuacucgggaggcugcggcaggagaaucaccugaaccugggcggcagagguugugcugagcugagaucgcaccacugcacugcagccugggcgacagagugagacuccaucucaauaaguaaauaaauaaauaaauaaauaaauaaauaaaagaaaacaugcuaguaaaaaaaaaaaaaagacacaaaagggcacauaacauacgauuccauucuuaggaaauacccaaaauaggcaaacccauagagauagagaauagacugguaucgggggaaccgcccccaauauuucaacguagguucuauuuucccuaagugucggcuagucugagaaauaaagagaaagaguacaaagagaggaauuuuacagcugggcugcugggggugacaucacauauugguaggucuguaauguccgccugagccgcaaaaccagcagguuuucauuaaggacuuuaaaaggggaggggguguaugaacagggaguaggucacaaagaucacaugcuauaaagggcaauaaagaucacaaggcaaagggcaaagcaaagaucacaaggcaaagggcaaacuuagaauuacugaugagcuucuguguucagcugugcacauauugucuugauaaacgucuuaaacaacagaaaacaggguucaagagcagagaacuggucugaccucaaauuuaccaggacgggaucuuuuccccacccuaauaagccugaggguacuacaggagaccagggcauauuucaguccucaucucaaccgcauaagacagacacucccagagcggcuguuuauagaccuccccccaggaauguauuccuuccccaggguauuaauuauuaauauuccuugcugggaaaagaauucagugauaucucuccuacuugcacguccauuuauaggcucucuguaagaagaaaaauauggcucuauucugcccgacccugcaggcagucagaacuuugguugucuucccuuguucccuaaaaucgcuguuauucuguucguuuucaaggugcacugauuucauauuguucacccauguuuuacaaucagauuucauauuguucaaacacacauguuguacaaucaauuuguacaauaguguuccugaggugauguacauucucagcuuacaaagauaacaggauuaagagauuaaaguaaaaacaggcauaagaaauuauaagaguauuauuugggaacugauaaauguccaugaaaucuucacaauuuauguucagggauugcaguaaagacaggcauaagaaauuauaaaaguauuaauuuugggaaccgauaaauguccaugaaaucuucacaauuuauguuccucugcugcggcuccagccagucccucuguucggguucccugacuucccacagcagacuggugguugaguagggcugggaaaguuggggagaaaugaugaacgacugcuaaugaggggcugcuuuugguaugauuugaaaauagauugcagugauggucacacaacucuguucaauaccauuaaaaaaccaaaguuagcuggguguggugguacccguuguagucccagcuacuagggaggcugagguggggggauuacuugagcccaggaguucaagaccagccugggcaacauaaugagacccugucucuuaaaaacagcaacaacaaaaaacccauaguuguacaauuuaaaugagugaauuguaugguauuauacauuauauucuaguaaagcuuuuaaagaaaugucaaccaacaugaaaaacacaaauauauaaaauacaaauacaguugucuagaaauaguaaauuaaauuagaugcuuaaaaagaaccaaaaaaguaaacagggagguuauuuaacagugcacucugaggucagacuguuuggcuugaaguguugaguccugcugccugcuagaggugugaaguuccucaguuucucugcauaguaauauuaccuguucguuguguuguccagaggcuuaaaugggauaaaauguuauaaaacucuuuaugcaauucuaaguacauaguaauuucucaguaucuuaggccauuugagggagcaccuaaauguaaaagauguaaacagacuugguuuccuugccaauuucuuguuaaacuuuuuaaagcuuuuauuauuacaaaaguacucacaagcucauuauagaaauuuuagaagcuaagaaaagucgaauagaaaaauuaucucuaaagaauuuuuuuaaugaaauaggaaaauuuccaaaagagagcuguauuucuguaucuuucuccccuauugcugacauuuuuuuucuuuuaaguguuuuauucuuugcauuccucauugagagcauauuauauguuagauuacacugccuuuuuguauuuaacauggaacauugugaguauuacaaaugcuucauuuuugcugucuuagauucuguagaacauuuuccuaguuaagguuauuuaguuggguccauuuuguguguguguggacuuaaagcuuuuucaguauuuauucuuuucccaagauagguuuuuauauuauuugauuaggaagcuugaguauuugggggauucuuuguguguuuuucugagacuuuuuacaaguuauuacaguauuuuguuuguauuucacgauaugcagaagaugauuuuuacuaggaaauuaaucucuuaacauugaagggacaguauugcuguuaggauagugguguagucuacagcuacuaguuaacaaaagauaguuuuucuugggcuuacaguuagaaaagaauucucacauacuuuucugcauguuuuuuuccccuggaaauucaggggagauuauucauuaggaagaauaaauacugccagguuucuuagagcuagagucuuucacauuucaaagguuuccccaaaugacaaaaccgucagauguuuaaaugaaauugucucauuagaaaauauagccaacacauuucagaauuauuugauugaguguuagagucugauguuaguaacaagagugggagaugccagcaucuucacagucacauaaacuaauuuugagguaagaauuuuauuuuuuuauuauuuuuuacaguaguuauguuuuuuuuauuauacuuuaaguuuuaggguacaugugcacaacgugcagguuuguuacauauauauacaugugucauguuggugugcugcacccauuaacucaucauuuaacauuagauauaucuccuaaugcuaucccuacccccgagguaagaauuuuaaaaguguguggguguuuuguggcuguuacuauagccucaagcaagaaagcccuuccauaggauuuucuuauuucuucaucugggcugaagacgcuuacuagccuaggaggguuugagagccaagagacagugagguagaaaaagaaacuuacuuuucucugaggaauggaaggugcauuguaauuugaaaaugaaaauuacugcccuacacuaaaaucuugggaugucaguccaaaacagagcaugaauguuauuuaauuuuuaaaaguuuuuugccguuucaaaauugagagaauagguacuuuugcugugaccuuuauuacagaauauaacugcagcuuggaagagcuguaaagguagguaccagaugagaggacagugauugcuggaggacagaaaugaaguaacagugacaggauauuaagaaugaaggccacaugguggucuggagucaaaggcccuuaagauuggaaagcuuuuuuucaggugcuuacuaauuuuuuuaccauucuaaacaaguuuuuggcugggcgcagggcaguggcuuaagccuauaaucccagcacuuugggaguucgacguagauggaucacuugagcccaggaguucgagaccagccugggcaaccuggugaaacccugucucaucaaaauauacaaaaaauuagccaggugugguggcacauaccuguagucccagcuacacaggagguugaggugggagaaucaccugagccagggaagucaaggcugcagugagccguuauugccccuaccgcacucuagccuggacaacagagggagacccugcuuuaguccaucaaucagcaaucagccaaucaucaguuuucaccucccuuugguuguauuaggguuucuggcucauuuuucucucaugaaacucuguugaauuccuguauagaccuuucuccauccuacuugccuaucaaagcacauuuucauaaaaaaaaaaauuaaugcuauaucucuuuccccuacucagcuacugcuuaucaccaguguaccacagaugagccaaugcuaggcugcugaugggacuugugggaagugagggaaguuguuggcuuuuagcauuaaaaugaaaggagucaaaaacagcaacucuaaaagacaggaagcugacugggcuagucaguugacuucaucuauaacagguacaccuaacuuuuaagguauaccuaagucauacguggacugaauuaaaaaaaaaaaauucuucccacauuuuauuauuuacuucagcauguaacugucucuaggaaaggaccuaaagagacaauauuaggcagguaaagauaugacccugucaucuuuuuccucuauuuuuuucaauuauuguauaauaaaauggacauuuuugauuguacaauuuauuaauuuuaacauauauguagauuauaccaccaccacuauagucaagauaaaacauucccucauucuuuuccuuuguauacaugcuucccccaucccuaaucucuuguaagcacugcucuguucuccaucacucuaacccucucuuuuugggaaugacauauaaauggaaucauacaguauguaaucguuugagacugucuucuuucacucaacgauagugcccuugcauuuccucuaaguaguuguguguaucaauaguuuaacuuuuuuuuuuuugagacagagucucgcucuguagucuagacuggagugcaguggcgugaucuuggcucacagcagccucugccucuuggguucaagcgauuuucccgccucagccucccgaguggcugguacuacaggcacacaccaccacgcccagcuaauuuuuguauuuuucguagagacaggguuucacuauguuggccaggcuggucuugaacgcuugaccucaggugaucugaccaccucgaccucccaaagugcugggauuacaggcaugaaccacugugcccggccaguuuauuccuuuuaguugcuaaauaguauuccauuacauggauuucccacaauguagcuauugauauuaaauucuuguugaaggacaucucaucuugauuuuaauuugcauuacccuaaugaacaucuuuucauaugguuauuugccaucuguguauccuguuuggugaagugucuauucaaaucauuugccuauuuucaaaugugguugguuguuguuauuaguuuugagagcuuauuagacauucuggauaaaaguccuuuguuggguaaguuacagauacuuuuucccagucucaacuugucuuuuguucucuuacugucuuucacagagcaaacauaaaaaaauuuuguuggcaguauauuauuauuuucuuuuauggggauuacuuuuggugucauaucuaagguagucuuuaaagaaacaacuuucagucuugaaucagaacaaccuacuuauaauuaucacagaagaucacaagacuucauuuuucugucaacucaaguuuguggaagugaggacaucuuuaagggaaauggagaauuuauaaaaaaagaagacaucaguucagacuaucuuaaauaaauauauuucugaauuaucuaagauuagugaaguacucauuuuagaaaauuucugauuaucaaaggauaggaaacuacuuuuagaagaauugaaaauuucaaaagauaaaaauuaagaaucacauacucucacuguauagggauaacuuuucaauauuugggggcauuuuaaauuugguaggauguaaguuuaguccugauucugugacccuagauuauuagcuucucagagucucauuuuuucaauguaaaauggggguaguaacugccuauuuuuauagagagagcuuuuguaaaaguaaauaaaauaauguauauaaacugcuuagagcaaugccuagcacauauuaagugcuuaauaagugcuacuuacucuauaaaacaaaauggagcuucagucuuuuuauaaaaccuuaugucggccaggugugguggcucacgccuguaaucccagcacuucgguaggcugaggugggugggacacuugaggucaggaguuugagaccagccuagccaguaugguaaaaccuugucuguauuaacaauacaaaaauuagccaggcauguuagcacauaccuguaaucccagcuacucaggaagcugaggcaggagaauugcuugaacccaggagguggagguugcagugagcugagaucaugcugcugcacuccagccuggaugacagagugagacucuugucucaaaacaacaacaacaaaaauccccauauguucuguuguuuucuuugucccuaacuuugaauguuaauauuuuguuaacauuguugagguuguccaaagcaucauuuuuaaugguccugugguauaucauauuauggauauucuaugcuuuucuaugccugcuuucuuccuuuccuuuuccuuuucccuuuuccuucccuuuccgucugucuuucugucugucuuccugucugucugucuguccuucccuccccuccccuccccucccucccucccucgaucccucccuuccuuccuaggguuucacucugucacccaggcuagaauggagugaccaugucacugcagccucaaccuccugggcucaagugauccucccacuucagccuccuaagaagcugggaccacaggcgugugccaccaugcccggcugauauuuaaaauuuuuuauagagacugggucucccuguguugcccagccuggucucgaagucugguccuuaagcaguccucccucggacucagccucccaaaguccuggaauuacaggugugaaccacuguaucuggccucucuauuguuaauuguucuuauuuuuccauuuuucauuaauauauaccauugagaugaacaaugaaaaaugugucauguccaaauuguuuuucagauuaaaagacagcaaauuuaaaauuaaguauuuagguugggcaugguggcucacaccuguaaucucagcacuuugggaggcugagguggguggaucacuugaggucaggaguuugagaccauccuggcuaacauggugaaacccugucucuacuaaaaauauaaaaaauuagccaggcgugguggcgggcgccuguagucccagcuacuucggaggcugaggcaggagaauggcgugcacccaggagguggagcuugcagugagccaagauugcaucacugcacuccagccuggaggacagagcgagacuucaucccccaaaaaaaaaaaaaaaaaaaaaaaaaaaauccccaaauuagccgagugugguggcaaacaccuuuaaucccagcuacucgggagggugaggcaugagaaucacuugaaccugugagucggagguugcagugaaccaagaucacacuacagcacuucaggcugggcaacagaacgagacucugccucaaaaaaaaaaaaaaaaaaaaaguauuuaauuuuuaucaugacuaacacuucaguaauaaaagaucuaauauggcacuuuuuaauauauaguuauugaauucuagaauauagugguugcuuugcauuauuacuguauauaguguauuugugcuuauuuuauaguuuauggagcaaaauuuaguauauuaagccauuuuugcaucuuaaccagcugcugccuaauuauuacaggaaaauaguguggaaguucagcuauucuaaaucuaaaauaauugguuuugguacauauucucuaaccuuuagauggucuguagcuauugagccauauaugacauucuuuuaccuugcagugaauuucauagcuuguucauauuggggaaguuguacauggaagucauauugcuugaagguagauaauuuaauggcuauggaggucauuugacuguaccugcuuuaaaauuucucuaguuacaaaaagaaucauaugaauaucuacauugauacaaaaaaaaagcccuugggaaauguccauguauguagaaauacucaagaacauuaaaauaaggaaaacuuucuuaauaugaucacacacauacacacacuucuguuuaccuuaagaucccaugcuauuuaauggggaaacaugagagauacuuccacuaggaugaggaacaaggcaaggauucuuaccaucccuacuucuguuuacauuguacuagugguauuaacuaauacaguuagaaaagagaagucaguuagagccauuagaauuggugaugaacgccaggcgcgguggcucaugccuuaaucccagcacuuugggaggcuaaggcaggcggaucacgaggucaggagaucaagaccauccuggucaacauggugaaacgccaucucuacuaaaauacaaaggauuagccaggaguggugguguguaccuguagucccagcuacucaggagucugaggcaggggaaucacugaacccgggagguggagguugcagugagccagaucaugccacugcacucuagccuggugacagagcaagacucugucucaaaaaaaaaaaaaaaaaaaaaaaaaaaaaagaauuggugaugaagaaauaaaacucccuuucagauaauaugauaguauaucuaguuggaaaaccuccgagaaucaauaaaaccaaugaaaaaaaauuuuuuuuuuuugagacggagucuugcucuguugcccaugcuggagugcaguggcgcgaucucggcuuacugcaagcuccgccuccuggguugaugccauucuccugccucagccucccaaguagcugggacuacaggcgcccgccaccucgccugacugauuuuuuguauuuuuaguagagacgggguuucaccguguuagccaggauggucucgaucuccugaccucgugauccaccugccuuggccucccaaccugggauuacaggcuugagccaccgcgccuggccagugaaaauuuuuguaugacugcaguccauagcauuaacaagcuaaaaucaauaccauuuauauauacaaacagcaaccagcuagaagacauaauggaaaauaaauuccaauuuacaguagcagcaaaaacaacuaaauacuuaagaaugaaauuaauaaguacuacacaaucuacauggggaaaauuaagaacacuuuugaaagauacaaagcagaccuguacaaauguaaaauguguuacucuuggauaggaugaguuaauauaauacuuucuaauuuaauuuauaaauuuaacacaaucccaauaaaaauaucaguaagcuuuuuuacagcauuagaaaaguugcuacuaauagaacuugcuacguaaagcucauagggaaaaguaaauaugugaguauaaccagcaaagcugugaaaaggaaaaacuaugagggcagcuagcguuaccagaugucaaaacauacuauaaagccuuuacaaguaaagcaaugugcuacugguacaugaauugacaaacugaucagaggaaugacuagaaagcccaaaaauugacucaaguacauacagaaauuuacuguaugguaaaggcaucucaaaucacuggucagagaugaacuuuugaauuacuagcacugggacaagucguagccauuuauaaaaagaaugagaccacaccauauacaaaaacaaccucuaaauggauuaaggaucuaaauguaaacaacaaaaccauguaaguauuagaagacauuagugaauucuucuguaaucucagcagaaaaaaaagauuucuaugacucaaaauucauaaucaacaaaagguugauaaguuuaauuauauaaacauuuuuguauggcagaaaacauuauaaaccaaguauaaaaacugaaaaaacagaaaauauucacaacauauaccacagacacaaagggcuaauaacccucguauaaagaacucucaaaaauugagggaaaugaugcuaccagugcaugcaugcacccuccaguggcauaaggauggcccuugccugccaccagcccccacaagcaccucuugggagucugaggauuggcccaugcagccugcugcugccacugagucacacaaaccaccucggggccuggagacugaccuacucaguccaccacugcuacugcacugccaacaccacacacaaugcccagaguccugaggacccaccugcccagcucaccacuggcaccugagcaugccacauggaaacccaaggacuagcuuacccagacccaccaauacuggugcuugucugugccacccaggggucuaaggaccagcacaccaggcccacugccaccacugcugaugccugaggacuagccuggcuaguauuccuguacccugcaaagccuuaccacagccuucacugacaacuccagcuuaagcugcugagaaacucagagacaccacuguugcugauuauggccaaagaaaucauauagagacuacacuacugcacccacccagaaucaaagacaaagcuacccaagcaacgcaacagauaaaucuauaggaaaaaggcuuucccuaugaaagccaauucaaaaaauuggaggaagugacuguuauacuaaauguacaaguauuaauauaaggauacaagaaaaguagaaaagcaaggaaccauggcaucuccagaggagcccaauaauucuucaguaacagaucccaaagaaaaggagauuggugaaauuccugaaaaacaguucaaaacagugauaucaaagaaacucaaugacauacaaaagaacacaaacaauacaaagaaucaggaaaauaauuuauuugaaugaguaauugaauaaaagagauagauagauuaaaaagaaccaaacaaaucauggagcugaagaaaucaaagaaugaaauaaaaauucaguugagagcuuuagcaauagacuagaucaagcaaaagaaagaauuucucaacuugaagacaggucuuuugaaacaauccagucaaaaaagaauaaaaagggaugacaaagccucugugacauauaggaagcaacaagcaaccaaguauuugaguuuugagacuuccagaagaagagauggucaaaggcaucgaaaaccuauugagugaaguaauagcugaaaacucccucagucuuacaagagauauggauauacagauacaggaaguucaaagauccccaaauagauuuaacccaaaaaggucuucuccaagucauauuauagucaaacugucaaaagucaaagacagaauuccaaaaacaagagagaagugucaagucacauguaagagaauccccgucugucuuaguucguuuguguuucuguaaaagaauacccaaggcugguuuauuuauaaagguaaggguuuuauuuggcuugugguucuguagacuguccagaaccucagacugcauccacucauggcggaaggugaaggggagccagugugugcagagauaacauaucaagugaggaagcaagagagauagaggcauggugccagacucuuuuuaaccuccagcuauugcaggaacuaacggagugaauucacuucuucccuagagaaaaguauuaaucuauucaugagaaaucugccuccaugucccaaacacuucccguuacgccccaccuucaauauugugcaucagauuucaacaugagguuuggaggaacaaacaucccaaugauagcaccaucagacuaauaguaaguuuuucagccaaaacuuuacaggccaggagagaaugggaugauauauucaaagugcugaaagaaaaaagacugcuagccaaaaauauuuuacccaggaauaauauccuucaaaaauaaaggaaaguuggcugggcaugguggcucacgcuuguaaaucccagcacuuugggaguacaaggugggcagaucaccugagaucaggaguucgagaucagccuggccaacauggcaaaaccccaucucuacuaaaaauacaaaaaaaauuagcugggcaugguggcagguuccuguaaucccagcuacucgggagucugagacaagagaaucacuugaacccgggaggcagagguugcaaugagccaagauugcgccacugcacuccagccugggugauagagugagacucugucucaaaaaaaaaaaaaaaaaaaaaaaggcugggcauggucuuucaugccuguaauccuagcacuuugggaggcugaggcaggcagaucuuguggucaggaguuugagaccagccuggccaacaugacaaaacccugucucuacuaaaaauacaaaaauuaacugggcgugguggugcacuccuguagucccagcuacucagguggcugaggcaugagaaucucuugaacccaggaggcagagguugcagugaguggagauugugucacugcacuccaucuugagugacagagugagacucugugucaaaaaaaaaaaaaaggcaaaauaagucuuuucuagacaggcaagaacugagggaauuaaucaccacuaggucagcccuacaaggaauacuuaagcaaguccuacaucuggaaaugaaaggaggauaucuaccaucaugaaaacacacagacauguaaaauucacugguugagcagacauaaaucagaaagagaaagucaaauauuaucacuacaagaagcccaccacaucuaaagguaaacaauaaaagaggaagaaaggaacaaaggauauacaaaacaaucaaaaaaacaauuaaagugacugacaggaguaaguucuuaccuaucaacaacaaccuugaauguaaauggcuuuaauuagaagauguagacuggcugaauggguaauaaaauaagaaccauuaguaugcugccugcaagaaacucacuuccccuguaaaaacacauauugauuuaaagugaagggauggaaaaggcuauuccacgcaaauggaaaccaaaaguaugcaggauucgcuguauuuguauaacacaaaauagacaucaagucaaaaaccaaaaagacaaagaagguuauuauauguaaugauaaagggauuaauucagcaagaggauauaacaauuguaaauauauaugcaccuuacaccagagcaccaaguguauaaugcaaacaguguuagagcuuaaagagagaaauagaccccaaugcaauaauaguuggagacuucaagaccucacuuucagcaucaaacagaucaucuauauagaaagucaagaaagaaacauugcacuuaaucugcacuguaggucaaauugaacuaauagacauuuacagaauuuuucauccaauagcuacagaauacacauacacauaucagcacauggaacauucuccaggauagaccauauguuaggccccaaaacauaucucaacaaauuuuuaaauauugaaguuaucaaguaucuucucauaccacagacuagaacuaggaaucacagacuagaacuaggaaucaguaacaagaaggaaauuuggaaacugugcagauacauggaaguuaacaugcuccucaaugaccauuggucaaugaagaaauaaaggaaauaaaaaaaaauuucuugaagcaaaugaaaaugcaaguacaacauaccaaaaccuaugagauacaguauaagaauugcuaagaggaaaguauauaccaauaaaugccuccauuaaaaaaaaagauuucaaauaaacaaucugaagaguguaccucaaggaacuagaaaaguaagaacaaaccaaaccgaaaaguauuagaagaaagauuauuaaagauaagcgugaacaacuauacacuaacaaauuggaaaaccuagaggaaauggguaauuucauugacacauacagccuaccaagauugaaccaggaaauaguagaaaaccugaacaaaccauguuacugguuaugagauugaaucaguaauaaaaauugucccaacaaagaaaagcccagaacuaaaugguuuuacugcugaauuuuaacagacauaaaauagaacuagcaccaguucuucucaaacuauugcaaacaauuauagaggaaggaguuucuccuaacucauuuuaugaggccagcauuacccuguaccaaaaccagacacaggcacaacagccaccaccggaaaaaaaaacaaaacaaaaaaaaacacaaaaacccacuaugggccaguaucccuauugaacauagaugcaaaaauccugagcaaaauacuggcaaaccagaucuaacaacacaucaaaaagguaauauagcaagauuaagugggauuuauuccagugaugcaaagaugguucaacauagacaaaucaauaaaugugauauaucacaucaacagaauguaggacaaaaaccaacaaucauuguaauagauacagaaaaaccaugugauaaaauucagcacucauccaugguaaaaacucucaacaaauuaggcauagaaggaaaauaccuugacauaauaaaagcaauaggugacaaacccacagcuaaauuguacugaauggggaaaagcagaaagccuuuccucuaagaacugaaacacgacaagggugcccauuuucaccaguuauucaguauaguacuggggguccuagccagagcaaccagaugaaagaaaaaaaaggcauccaaacuggaagacagaaagucaaauuuuucuuuacaaaugacaugaucuuauauauggaaaaaccuacccauuccaauuuaucuguacauaaaauaagaaccaaaagacuacaaaaaaaaucacaaaacugauaaaugaauuuacuaaagucgcuggauacaaagucaauauauaaaaaugaguaguguuucuauacacucacagugaacuagcuaaaaaagaaauaaagaaagcaauucagguuacaauagcuaaaaaagaacaacaauaaaaaacccugagaauaaauuuaaccaaggaaaugaaagauaucuacaacaaaaacugcaaacacuaaugaaagaaauugaagaggacacaaauggaaagauauccuauguucauaggaagaauucauguuguuaaaaugaccauacuauccaaagcaaucuauagauugauugcaauuaaaauauuaauuguuuauguuaaaguaccaaugacauucuucacagaaauagaagaaacaauccuaagauuugaauggaaccacaaaaguccccaaauagagccauacaaagcaaaaagaacaaagcuagaggcaucauacuaccugacuucaaaauauauuacacaaagcuauagucauccaaacagcauggauccacggaacagaauaaagaacccagaaauaaauucaugcauuucagccagcugauuuuucacagaagugcuaagaacauacacuggaggaaagaacaucuucaauaaauagugcugggaaaacugauuuaugcagaaggaugaaaguagaccauuaucucuuaccacauauaaaaaucgaccuaaaauggauuaaagccuuaaagguaagacccaaaacuacaaaacuccuggaagaaaacauaggggaaauguuucagcacauuggucuaggcaaagauuuuauggcuaggacuacaaaagccuagguaacaaaaaaauauauacaaaugagacuauauuaaauuuaaaagcuucuguacagcaaaggaaacaacagagugaagagaaaaccuguugaauggaggaaaauauuugcaaacuauucauccaacaaggaacuaacaucgagaaucuucaaggaacucaauagcaaaaaacaacaacaacaaagaaucccauuaaaaaaugggcaaucugacuagacauuucuuagaagagacagauuaaaugucugacuagacauuucucaaaaaaagacauagauuaaauggccaacaaauauauauuuuaaaaaguucaucuuuacuagucaucagggaaaugcaaaucaaauccaaauccauaaugagauaucaccucaccccuguuagaauggcuguuaucaaaaagacaaaaauuaacauaucaaagggauacccugcgcucacauguuuaucguagccacucucgguagccauuguauggaaucaaccuaagugcccaucaacaguugaaugaauaaagaaaaaugugguugugugugugcguguacauguguauacauaacugaugaguauuucauuguguauucuacaauauaaaaacugaaggaaugagagcacugguaguuuaugaaacuuagcaaagguuuagaaaaaauaaauccaauuuagagaguuucaugaaacauauauauucauagagugcagauaaaaaugugaggaguaaaaauauuuuacuauuugguuuggcauuaugaaucaaaguccugaaaaaucuuuacuauccuuuauguccccccaggaaaauagcuccucaccccaggaauuuauucuaaggaaguauuuacauaugugugcaaauaauugucuaggaggaugugcaugacaguaugguucuguaauagugaaaaauugaaaacuauuuguuuaauagagcauugauuucuuaaguaaugcccucauaaaaaaauuaugcaacuauaaaaaugauuugguuaaacguuuuaaagcauagagauagguuacaggucugguauaauguuaaaaaaaaaaaaccacuggguucagaacacuagguacgaucuguuucugguuaaaaguguauauguauauagaagaaaaaggacuagauagaagaguuuuuauaaaauuauuaauaguuguuaucucuggugauugacauguauuuaauuuucuuucuucacugaauauuuuuuuuacuuuugcaauaaagaaaacaauggcaguccaggcacagugacucaugcuuguaaucccuguacuuugggaggucaaggcugggaggaucacuugaggccaggaguuugagaccagcccgggcaacauagugagacccuaucucuaauuauauuuuuaaaauuauuuaaauaaaaaaagaguaaacaaugaaguuaaaaauaguuucucagggcagacuuuuuauggacauauucaaguucucuggaucacuauaucucuggcuuauguuuaaguauguucuuaagucuauugaaaacuguagaaauaaaaaaaauuaaaggugaguguauuagucucuucaggcagccauaacaaaauauuaugcauagacuacgugacuuuacacaacagaaauuuaucuuccaguucuggagacucuuaagugcaagaucaaggugccagcaggguugguauuugguugaggguucuccccuuggguugcagacagcucccuucuugcugugugcuuauaugagcucuucgugugcaugggaaugggaggugacucucugguguccucuuggaccggggcugccucccccauaugaccuaauuuaaacuuuacugcugagugggcacaguggcucauguuuguaaugucagcacuuugagaggcugaggcugucugauugcuugagcccaggaguuugaggccagccugggcaacaugguaaaacccugucucuaccaaaaaaguacaaaaauuagccaggcaugguggcaugugccuguaaucccagcuacucgggaggcugaggugggaggaucgccugaggccaggaggcagagguuguagugagccaagaucaugccacugcacuccagccugggcaacaaggugagacccugucucaaacaacaacaacaaaacaaaacucaacuacugccuuagaugccccauguccaaauacagccacauuggcaguuagggcuucaacauaugauuuuggggggacacacacauccauauaccagccuuguugaacaagcaucuuauauguucuaggcucugugcuuggcaguggcacuaaagagauuaauaagacauaguuucucuccucagguuaauuguagaaaaauaauccaaaagaaaaaaauaccaccucuguucccagguguagcuugcuucugauauuuuggggaaauagucuuuuuuucugggugaaauauaaaucugugugugugucuguuuuauacgcaugcauuggcuuuugguugaauaaacaugaaggggcaaaggaagaauguucuuuucacuuccugcuuuugugaaauaucuggcguauaugaaacuuuuguuccaguagguagaacagaaaauguugagaaauuagguguguagguuucuagagagaaauuauagaauuuauucuauaaacauagaauuuauguuuauauuugaggaaagggaaaaucaaaaaauauaagggcuaaacccuugaagacauauagauaagcuuuagucccauaauuuucuguuugcaaauuugcaaaauuauuuuacaauucaccuaaaaauugcaucauucuuuacagaucacucuguguuacuugaaguuuauagcucagcugacuacugcagguuacaucagaaauuugaguuuuuauaccuauggaguguuagugacuuaaaguuuuauugucugaccaguacuugauuuaugacauugauugugcuuuagccacccacuaaacuguauauagaguugucaccgcuuaugaaagcugaaagggucuaaccaggacaaguguucacaucaaaugaacuagacuaagagaauagaucuauggauauggcuaagaucuuccucaaaaaaauaguuuugaggcuggacacaguggcucacgccuguaaucccagcacuuugggagguccaggugguggaucaccugaggucaggaauuugagaccagccaggccaacguugcgaaaccucaucaucucuacuaaauauacaaaaauuuagcugggcguugucgcgggugccuguaaucccagcuacucgggaggcugaggcacaagaaucacuugaacccgggaggcugugguugcagugagcugagauugcaccacugcacuccagccuaggagacagaccgagacuccaucucaaaaaaaaaaaaaaaaaaaaaaauagguuuugacaauuguauaucugugcaccaaagaucugagcuauggagaguggcucaaaaauauaaguugaauuuuuaaaaauuauauaaauuuucucuauaaaacacuuauagaacacccaaacuuaaaauuuucuuuccuuugguaguggaugcugagaauggaaaagggaucagaaagaagagauggaaguaaagggaauaaguaauacagaagcuugaggcuguggggaaugugggaacagagggacuuauaaaaagggaaaaauuaggagacacuauaugugaaagaaaauaagugacacuugaaaaaaaugugaaaagauaauuauuuuaagaauaaaauacauaauagggaaaauacaaaauaaaaauugcagcuacuguuuucugagcauucaugcuuuagacgccaggcaccauaccagguuuccugucauuucaucuuuaaagccaugagguagguuucuguguccuguguuacauaugaggacccaacacuaacugagcaguggagacauccucucucagcacuucugcguggagcuuccccuuggccuuuuuuaaucacagauuucuuguguuugccaaggauucuuguuguauuuauuaugcuuuuucuuuuuuuuuuuuuuuuccaguucugaaggggagcaggaauaaaaggagaaauagagauuuaacacuaaguucuguaucagacagcaagauuaucagggaauaaaacugauggucauugauuagaaucauuucuaaucaguguuaccuuugucuuccuuugucuuugucuguuaccuuugucuucuugcccaccucuuccugaaagagguuuuccaaagaaacuuuccuaaaugaaggauagguuaaucacauuucuuugcuagacagcagaagaaucugcaagauguuuaucuggcacacugauguuacuagcuuuggcggauaccucuguuaaugcuuguuucauauuuuauuuugaauaucuugucaggaaacaaguaauauccuguaauuauguaaccagauaguucuuuccaaaaguaauacugugacaauaaaaacauuuuuaauuuaaaaaucucuacauagauuuuggaagugguucuguuaaauaaauaagucauauugugaaaauggccauacugcccaaaguaauuuauagauucaaugcuauucccaucaaacuaccauugacauucuuuacagaauuagaaaaacuauuuuaaauuucauauggaaucaaagaagacccuguauauagccaagacaauccuaagcaaaaaguacaaagcuggaggcaucaugcuaccugacuucaaacuauacuauaaggcuacaguaaccaaaacagcaugguacugguaccaaagcagacauauagaccaacggagcaggacagagaccuuagaaauaacaccacacaucuacaaccaucugauccuugacaaaccugacaaaaacaagcaaugaggaaaggaucuccuauucaguaaauggugcuaggaaaacuggcuagccauaugcagaaaacugaaacuggaccucuuccuuauaccuuauacaaaaauuaagauggauuaaagacuuaaauguaaaacccaaaagcauaaaaacccuagaagaaaaccuaggcaauaccauucaggacacaggcaugggcaaagacuucaugacaaaaacaccaaaagcaauugcaacaaaagccaaaauugacaaaugggaucuaauuaagcuaaagagcuucugcucagcaaaagaaacuaucaucagagugaacaggcaaccuacagaaugggagaaaacuuuugcaaucuacccaucugacagagguuuaauauccagaauuuacaaggaacuuaaacaaauuuacaagaaaaaagcaaccccaucaaaaaauggacaaaggauaugaacagacucuucuuaaaagaagacauuuacacggccaacaaacauguaaaaaaaaaaaaacaugaaaaacucaacaucacugaucaucagagaaaugcaaaugaaaaccacaaugugauaccaucucacgccagucagaauggcaauuauuaaaauaagucagaaaacaauagaugcuggugaggcuguggagaaauaggaaugcuuuuacacuguuggugggaguguaaauuaguucaacgauuauggaagacaguauggcaauuccucaaggaucuagaaccagaaauaccauuugacccagcaaucccauuacugaauauauacccaaaggguuauaaaucauucuacuauaaagacacaugcacauauguguuuauugcagcacuguuuacaauagcaaagacauggaaccaacugaaaugccaucaaugauagaccagauaaagaaaaugugguacauauacuucauggaauacuaugcagccauaaaaaggaaugagaucauguccuuugcaaggacauggaugaagcuggaagccaucauccuuagcaaacuaacacaagaacagaaaacugaacaccgcauguucucacucauaagugggaguugaacaaugagaacacaugggcacauagaggggaacacacaccagggccuguuugaggugggaggugaagagagggaacuuagaggacuggucaauaggugcagcaaaccacuauggcacacguguaccuuuguaacaaaccugcauguucugcacauguaucuuauuuuuuuuaagaagaaacaaaaacaauaauaaaccccccccagaauauaaauaauuauauagauuaaucuguucucauguugcuguaaauaccugagacuggguaauuuauaaagaaaacaggggcugugcaugguggcucacaccuguaaucccagcacuuugggaggcugacaugggcggaucacaaggucaggaguuugagaccagccuggccaauauggugaaaccccgucucuacuaaaaauaccaaaaaaauuagccaggugugguggcgggugccuguagucccagcuacucaggaggcugaggcagaagagucgcuugaacaugggagguagagguugcagugagccgagaucacaucacugugcuccaaccugggugacagagugagauucgucucaaaaaaaaaaaaaaaaaaagaggcuuaauugacuaacaguucugcaggcuguacaggaagcaugacgcuggcauuuacuugguguccggggaggccucaggaaacuuaaaucaugguggaaggcaaagggggaaagacacaggucacauggccaagcaggagcaagagagagaagugggaggcgcuacacaccuuuaaacaaccagauuucguaagaacucacaguacuaagagggacugugcuaaaccauucaugagagauccacccccaugauuugggugagacauccaaacuguaucauuguggcacuaggagaguuuaaaguuauauucugaaaucugagcucuguuacagucguaaaagaauuucugagguugacauucuuuuacuauauuuauuuaucccuguucccuuugcagucguucacagaugugaauaaauguucaaaauccuaccuucauugugugggauuuggguuuuaaauuauauuucauacaugcuaaggagcagguuuggucacucacacuuuuugugaggccuguaaacuuugauuuauuuuugaguuacuuaugucuguuggaauuacgcuucagccuagaaaauuaaaagguaauguuaagccucucuucuccaucccauuuucuuaaggcuccuguuccaaagagugcacuuauuccuguaauucccaucaccaaaucaacaggcucccgguuccggaauagcguggaaggauugaaucaggagauugaaauaauaauuaaagagacuggggaaaaggaagagcaacuuauaguaagugaucuuguaucuuaaaaucauucuugaacucuuauaauuauuaaaaaugcacaguuuggguuuccauauuuacuuggguuucuuccuucucauugagagagcaaaaauuuaucucuuuugaaaaaucuuugaccugggugagugaaugaaaaguuuucauuuuguugcaugucauagaggcaacugaucugacuugaauuuggauuacugaacagaaacuauuuuuuguuugucuguauuuagaaaccauuaggugauauacuucuuauuugcuguaacuccaguuaacaaaaguuuagcuuacuaauuauggggggcagaaguuuacaugacauugaauaccuucuaagcaugaaucugucugcuccuuuuuugaaugucagugacuauuugguuuugguugacaugcuaggcuaugucaucauaaaguacauuuagaaauuaucuggcugugcacaguggcucacaccuguaaucccaacacuuugggaggccaaggugggcggaucaccugaggucaggaguucaagacccaucuggccaacauggugaaaccccgucucuacuaaaagaauacaaaaauaagcugggcaugguggugcgugccuguaaucccagcuacuugggaagcagggagaaucgcuugaacccgggaggugaagguugcagugagcugagaucgaaaaaaaaaaaaauucugccuauucucuuuacugacuagaauacacaugagaauaguugcuauguaaaacagaaaaauuaacuguuuugguuuaaaaaccaugccacagaguauauuuauuuaucuaaccgucucucuauucuuuagugaaggaggaauugaguauuguauugaugcuuaagauccucucccuuaagauaaaagguugguuuagcuuagagaaaauacagcuccccacacccucuccuccauccugcuugaugggguacagauucccugauguaauaaagguaaaugaaucaaagacgugcagggaguugguuuccuugcuaagugauccacacaggcuuuccucuguguguguacuugauuuucuccccaucaacagcacuucugugauuaaccuuucccccauuuaggaagguugacuugaaaaaauccuuucagggcguggcaucaguguuccugguucacaugaugaauaaccuuuuuccucuaauguggaaccuaguguuacaccuagauuucauggcccucauuuauaauuuuuaaaauaacccuuagcacacgauaagugauucaguacaauucauuuauucagcaagcauuggccaccugcuguaugccuggccuugggaauacaaagucuucaccgaagacucucagugugggggucagauuagacagggaugucacuaacgugcaacaugaaauccuaauaaguaggaagggauuucugauuugugagucucuggcacuauaugggaagguugacauuggguucauugcuggugauucgaaauuaauuauaaauauaccuauguuuuuacaauuuuguaacagccgcaagauauuccagauggccaucgugcuccacccccccuuguacagagaaguagcagcacgcgcagcauugacacacagacgccugguggggcagacaggggaagcaacaacagcagccguucccaguccguguccccaacaucguuccucaccauuuccaaugaagguagcgaggagaguccuugcucagcggaugaccugcuuguugaucccagagauaaagguacagugcuggaggaaugugcuacuagaugauaauggaauaccuccucuuguaucauucauucuauucauuuucuagcagaacacacacacucgaggcuacucaguuaauguguucaaagccuagguuuucaauuuggaguguaaacagguuugacugucaugcucaguugauggucuaguugggcaaguuuaugagcuuuuguuaguuuguagcucuuuuuuugcacuuguuaauacaacuuccuuauuggugagaaacauucuuuuuggaauaaaugagaugagcacuugcucugaaaagcacuuuggucucugucaccugauagucaugauuuuauuaccuuaaugcuuuuuaaaucaauacaaagccuucaaguuaguguuuuuuaggaucuguacuugugacauuuuaaacaaggauuaaacagauuuauaucaaugcaggaugaguguuuaaagcaagccugauguaaaacguuggaggguacuuuuaaaaauaaccuuaaaauaccuuagaaguuacuuggaaauagaagcaguuugaauguuaauuacaaauauucuugccuuuuaaaacaaauauuagccuugcaucuaugucaggacaguauuuucuuagccuaauccugguuacguuguguacuugaaagcaauaauaaugacauuuauuuauaaauucuaaagcucaguucaguagucauuuauuuagaaccuccuccauacaguguguugaauguccuaaaaugcccugcuguuaggacuggcugcuacuacuacucaucaccuaagacauuaaaacugugacaagcgcagaagacagacgauucacugaagaaguuacuuuaaacugugggaaguuguaaacuguuacucuuuggacuuuuauugcuagcuucuaggucugauaaaacacgggucagauaaaaucuggcccuugauuucccauacuuucuacuucuacgucaauaacauguagaaagucuauaaauaaauaaacucaauaaauguuguguccugauccauuugauuuuaguagcugguuggccucugugaauuucuuuuguaggaaaacugggcuguagugcugcugccagcaaggaguuuguagcuuagcugguacagacugaaaauuuagaacagauauuuaacauauuaaaauuuuuaaguuaauauaaauugaggauaucagcacuaaacaagaauaucagaguaaagaaauguuccuccugauaggguuaauuuagaaagauuucaaaaaacuugagucagagccagacuuugaaggaccuuuuggaaaauaaacagaacuuacuccuuuuagguaaggggaaauucauaggcaaaaaaaauguuuggcauccgguagcucucacuaccuggagcaaagauuguaaccagcggagcagagaaaucaaacugagaaauuuugaagcacaggccaagaauuagucaucagcaaccaaugaagaaccauuucagauauuuguacugggaaaaauggaaguaguguuugagugcauuuguuuuguaaagaauagaaauaaggcagccagcuagaucaguguucacuacugaggauuaugugauacaggccuaggcuaugguaauuguaaguggaagugaaauaaauauuuuauuugugugugcauuuauuuaacaaacauuaauuaucuccuugauuaauaaagcacuguuccugcccucaaguaguucauggugggcuaguccaagaacaauuaaauauaguaugacuauacauuuauguaguaaucuaaugugucauuucuugcagagaaugggaacaauucuccuuugcccaaauaugcaaccucaccaaaaccuaacaacaguuauauguucaaaagggaaccuccugagggcugugaaagggucaaagucuuugaggaaugcucguaaguaucccuuccaccauccccacaaaaaaacuauuaugagcuuuuuuuuuugagauaggaucucacucugucaucuaggcuggacugcacugaugcagucacaggucacacugcaaccucuaccuccuuagcucaaguuaucuucccaccucaaccucccaaguagcugggaauacagaugcacaccacuagccuggcuaauuuuuuuuuuuuuuuuuugagacagaguuucacucugacacccaggcuggagugcaguggcacaaucucagcucacugcaaucucugccuccuggguucaugccauucuccugccucagccuccugaguagcagggacuacaggcgccuaccaccacgcccggcuaauuuuuuguauuuuuaguagggaugggguuucaccgcguuagccaggauggucucaaucuccugacuucgugauccaccugccucggccuaccaaagugcugggauuacaggcaugagccacugcgccuggccuagccuggcuaauauuuuaaaguuuggagagacagggucucacuguguuguccaggcuggucccaaacuccugggcacaagcaauccuccugccucagccuccugaagugcugggauugcaggcaugagccacugugcccagccuauuaucagcauuuuuaaguaagcugaaagaauaguauagugaucacucauauaucuacaacucagauuagauaauagcuaacauuuugcaguauuugcuaaaaguaaccacaguacuacuauauaaccacaguacgauuaucuuagaaaguugacaguaaugcuuaauaucagcuaauauccacuuguuacucaaauuucuuuaguuguuugcagaaugucuucuguggcugucauuugugaacauguauccagucauguuuacauguugaauuuagggguauauagguuuggcugcugcuccugaacgggggaggucccaaaggucucagcagcgugggaaggcuaggucggaguuccugccgaagggaccuguguggugcugcugaaccacugugauguggcaucuccuuucaccgaauuccacaacagaguuuccagggcuggggaugguauuucugccuccccucuuugucuucgccuuuccuuggggauauuuuuccuuucauguauuuaccaugcuucccauggguuaaggcagugucuugucagggaacccaggauuguggggaagcugguugucuaacccagucucaguuuuucuaguguagaagccaugaauugugcugggcagaauaaggguaggguugucacagauguggaagucugauucucaguuuuuucacuucucuguggccccaggaacugucucuucauauuugaauucuaggauauugcuaguaaucaucucaguaauacguauuuguuuuugguuuucuguggcagggaguggaaccauguguuucuuugccacuauuuuggaacuggaaagcagaaaugggcucauucuauuagguuaaaaucuguuagcccaaauguacuuuuuuggaguugugccugccccccuccacugccagcccugcugagacagguucucacucugucacccaggcuggagugcaguauuggagucaacaguucacugcagccuugaccuccccgggcucaggcaauucucucaccucagccucccaguuagcugagaccacaggcaugccaccacacccagcuaguuuuuguagagaugggguuuuggcaugugcccaggcuggucuugaacuccugggcucaagugauccaccugccuuggccuccuaaaaugcugggacuauaggcaugagccacugcauccggccugaguugagcucuuugauuuacucauuggcccuuaggauuugccuaagugcuaaauguagagauuugguugauuggcuccaaagcauuuugauuguuuuuaagaaaugacuuuaaauauuuguugggugguguccugugguaccugccuuagacuauugcauuuggaaaguuucugaggacucagugucugagcuauguacuacuacauuauuuaucuuuaaagggagagaagaaaagaccagagaggugugugugugugucuguagauagaucaaacauaagauaaacccuaacauauuacaugguuggguuuuuuguuuuuguuuuuguuuuuauuuuuuuucuugagauggaguuucacucuugucacccaggcuggagugcaauggcaugaucuuggcucacugcaaccucugccacccagguucaagcaauucuccugucucagccucccaaguagcugggauuacagacacccacaaccaugccuggcuaaguuuuguauuuuuaguagaaaugggguuuuaccauauuggccaggcuagucucgaacuccugaccucagguggaucuaccaccucugccucccaaagugcugggauuacaggcaugagccaccgugccuagucauguuacauguuuuauggcacauugaucuguuaguagaagguaaaccuauucuuuuuuuuuuuuaauguaauguuuauuauacguuuuacugguagaaagacuguguaacacuauuaauauuuuaaucacguuccaaagacaaauuagcagucguaacuaaguguggauaucuaagaaguaauuuuaaccuuuugucaauaaaauaaguuacucaaagucuuuuaaaaaaauuagugucuuuuugucccagauaugucaaaauuagaacaauaaccaccgugcacaccacaaugaaagcaaggguagauuguuggucccaauguaacauuuuagcuuuagccauucuuuuaagaauacuuuucucacuaagucuuacuuuugcuuuaaaguacuaacucugaccugaacuggggggucgggauggggugaggagugaucucugauuucuagaaaugugucuguuuaccugaaagaaaauaggugguuggauuugggcccaaaaaggacaaaaccagauuuuguacuuccgucucuauaaucuuuuugauaacagcacauaccauagccaugucaucugcacuuaguaaguccuuuuuaaugaaguugaauauacucuuuccugaucccagcuaaugaaguccuuagauucuuacacauuauggcuucuuugcaauauagaggcauuuuuaaguuauaucuacuuugagacacaauccuuuuagaauaacugcuuaagaaaaaauaaaauuuuaaaaacagcgugaguuuuuuucuuucuauguaugguuuguaaguugaagagugcuuugaaguaacguuaguauuugcagcuucuccuagcauauguguaggucacauauccuguggugggucauguuuuucuuggguaaugcacucuuagaagccacagagguuaggaaagugauucuucuuggugggcugggguaaugacaggaagaagaaggcacaaggagaguuuuuuuggugcuuuauguuauauugguguuaauguucuguuucucgaucugaucaguuagacaaguuauuacuguuuacauuauuuugugugagguauaucguaagucuguuuucaugaaagcagcaaggaaguuacaugguuuuuagauuccugucauuaaaaaaacaauuccagaucaaaaacuuuaucuaaaucaggaaguuuguacuucagaaaugugaaguuucaucccagagaccuauuagcagccacgagucuuaagucuuuuuuuuuuuuuuuuuuugagacagagucucacucugucgcccaggcuggagugcaguggugugaucuuggcucacugcaagcuccaccucccggguucgcgccauucuccugccucagccucccaaauagcugggacuacaggcauccgccaccaugcuuggcuaauuuuuuguaucuuuuaguagagacaggguuucaacguguuagccaggauggucucgaucuccugaccucaugauccgcucgccuuggccucccaaagugcugggauuacaagcgugagccacugcgccuggccuucuuaagucauuuuuaagaagauaaccucaaacaaauaauuaaaaaucuagcccucauuuggauggaacuguuaaaauuagccuuuucauuuucuacaagaaguuuuucauucuacaagaaugaaaguuaacuucgguaauucugucuucaaaggaaaauuuaaggcauuauuuaauuauggaaacauaaccucaacuuccucaaguucaguguauugaaaaucaugcucucagaugauaaaaauagaaggguguauguuguucuuaucaguaauauauccaaauauacuuguggcacuaaaaguacucaacuauucuacaaagaauagugcccaaguugaacauaaccuacaugauguauuuuucuuuguucuuaauuguuauauuugccaaagcucuccauaguguucacuguuaauaaaaaucugcccaccuaaucauugucuacuuggaacacacaucuuuuugguguccacuccccauccgcuguuuacucauucuucaaaacccagcucagaggguuacuaccaaacccucccucuuccuacaggccacagguuauccacccccuugugcuaccuguaaaccuuuuuauaaaccucuguaaucaugccuguuagauucucuuguggcggucuuaaccucuucugugcuguggacagcuuuggcagucugugugguaaagcuuguggaucccuucucugaauaauguuuuaaaugcaucauauacacaagauuauaaaggaagcuaguuauguugaaacacagcucuguccccaucacuccucaccccacaagaacuauaaauuuaguccaccuccuccuuguggauuguuucaacuuuguauccucagaauuuagugaacacuugcauuuuuauugaacugauuuagauuuuuugugugugugugagacagggucuugcucugcuguccaggcuggagugcaguggcccgauuauggcucaguacaaccuccaccucccagggccaagcuauccucccaccucagccucccagguagcagggacuacaggugcaugccgucagacuagauuauuuuuuuuuuuaagguuuuuauaaagacgaggucucacuauguugcccaggcuggucuggaacuccuggguucaaguaagccuccccgcucagacucccaaagugcugaaauuacaggugugaaccaccauggcuggcugauuuagauuuuuauugucauuggaagagaugagaaucaaccuaagucuugauuuauuuagguucucccaccuuaguucuguggcauuucuguguugcuuuaacaauguaguuuuuuuauacuuuuaauuuucaugaaauaccauuaauaccaauaucuuuuucaacaauuuggguuaauuuucaggaggaccuaggaaaagggaaggauuuggcuuuaauaaaaagcuuucaaagcaaaggaguuuucauuuugauuucacauuuacauuauauugcucagaaaacuaucaggguuaacucaaagaauuguuuccaucaaagagauuuuuacaagcacuugaagagaaaagccaggccuaccauaguuuuagucaugcagugguggaacuuagcaaaagacggacauuguauaucuuuaauuuccuugcugucuccuuccaguauacuauagaccucggaaaaaucauggcaguggaauauaccauacauaaaggcauacaugucuuuaaacaucuagauuuucuuuugcuauaggaaauucauuauucccuugaccgucuuagcucaucauugacaugcagugcucaucgggcugagccaccugcaugguaauggggcugucaagggaacugaaagcagcaaugaugaugggggcuucuugcauucuaagauacauauguugaaucauaugucagauagcacuuugguccuuuauguuugaaggugggggacagagcuugaguuuuauauuccuuuucugugauguaaguuaacuguuuuuaaaaaauaaaagagcuuguuuccaagcuuuuuuuuuuuuuuauuuuuuaaguucagugacuuaaaagcauuggguugucuguucuaugucuaggccaaaacagcuucaugaaaucccagccuuuuauuguccugacaaaaacaaggugaauuucauuccuaaaaguggaucugcuuucugccucgucagcauccucaagccacuccuuccuaccccggaucuuacacucaagggcucuggccacagccugacagucaccacuggcaugacaaccacucugcugcagccuauugcuguggccucccugucuacaaacacagagcaagaccgagucucucgaggaacaaguacagucaugccaucagcuucucuacucccaccaccagaaccaauugaggaagcugaaggauaggucacagugcaacguggcuguuguucugggaaauugggaaccuccucagaucacuggauucugauggcaucgugcgcuucuggucggcugugaugugcuccagcuuuccagugacaugugacggcgaggcuucuggaagaaaggaucccccgugacggcucugccccacuugugaacgccaacccucagugcuuagccugcuuuuuaucaaagcacugauugaaacaagaaaggucucauucuuuaccuuuggagagacaauaucacguuuuuguuuucgaauuagacuucuuuaaaacacacacacacacacacacacacacacacacacacacacacacaccccugauccuugccaacaugauuccuaaagggagaugugacugaugcugcaagaaccaucuuuucuaugaaaaugacuauuuuauaauauaccaauguuacauuuucugaaacguagcaaacaggauauucaaaagauucuuugguggccucuguuucuuguucccuuucuagaugugugcuuuucucagcuguuuucagcuuugggaccaaagggauuguugacguuuucccagcaaucuuaaucucaugacuauguucuucucccaaacaaggauugauagguaaaugcauugaacaaguauauauaaaaagagauuaaaaagcaauauucguacauuaugugauuuauguuuuugaugucaaaaguuugugcuuugggugaaauauuuguauaacugcuguuuucuucacuacuccuguacacauuucaccauguggucagaaaaguuguagucugaagacaagugcuuuaauauguucucacccauauuggaacuugauuuaaaagucagugagccaaaaggaagcuauccagcguugauugcuagcuaagaguaaggagccccuuugguuuucugugauauauauauauaucacacgcucucccuccuuuaccacaggugucauucuaccuuuaaucaucacuguaucauagccccaaagagauccugaaauggcugugcauggauuuccuccuuugcccuugugauguuguugucuuguggauuugguugggcuaguaguuugccaggaguguaauccaguggauagugauccaaacuguagccgcagaauccugugacugacauuuuucuuugugguggugguuggcccugagauuuguugccuacagauuuugcuaauuuaccccccuaacgcuucacauaguggggaaaauacacaagaagaacuugaguaugaacgauaagcaccuuugaaaacuccauacaguuuuggauuagggcucauccuaauauaaaucacugccaguaucacaugacaucaguaugugauuucuggguaugugguagugagauuaaggagcagcuuuuuuuuuuuuuuuuuuuugagacggaguuucacucuuguugcccaggcuggagugcaauggcgcaaucucggcucacugcgaccucugucucccagguucaagcaguucuccugccucagccucccaaguagcugggauuacaggcaugcaccaccacacccagcuaauuuuguauuuuuaguauauaugggguuucaccauguuggucaggcuguucuugaacuccuggccucaggugaucugcucgucuuggccucccaaagugcugggauuacaggugugagccaccacgcccauccaggagcagcucuuuuuuuaaaagugaguuucagcaaacaguauugaauaaaagcauccuuuucauaucuucauauacuacuuuaugaugcaauaauuuacuguuccuauacauauuauaagguagaaaaaaguuuuuaaauccuuauaaagaggaugcaguuuagaagguuaauaugucagcuuacccagacauauucuaucaaggaaaaccuagugguagcaauaaaucuuuggaaaggacuucuuauacucauguaccuuuaaaacaucuaagcaauuuaaaauaaucccuguugaguuuaaauucgagaugcauuuagguaaauuggauaaauucaacauuugaauaaauccgucagguuuuagauggugggauugaugaacuuugguacuuucucaauccaaaacuaauuuauuuggaacuaguacguuauggcuucucagucaugaaaagcucaguuauuuggggucuacauuuucucacugagagccuugauauuuugccuucuuuguuaugcauuauaacuugacuguaucaccacugaguaucugcuguaucagaaguucagaagaaaagguaaaacugaaaucagaauggggguagaggaaguuaaaaacaaguuauuuaaaaagaacucuugguuuuuggaugacuugaauucuguuaaaucuguguucuuggccuugcacuuccguuccucuuccaucucuaucccugcuagucacaauggcauuuuagaacuagaaugccacucuguagagguuuucccuuuugcucuguugugccuauuugucuaauucauaucuuucuguggaguuucauauguccuuaaucuaaaguaacuuaaaauuggaauggaagaacaaguuucagaauuauuuacagucuuauacauagaacuucuaguguaauguuugguuguaaggagaaugugaauuugcagguaaaugaauuguauggcaaccagacagaucccugggguuugggagaaauagagcuugagauuugaaaaaaagguacaagguacaaaacaacucuaacugccagugccaaagggcuaauuuuuaagcauguaagcuuuaccacagucuugaaaaaaauauuaaccauagguucauucagcuguuuuauuuaacccuuaguucccuggugguugauuuuuuuuuuaaaugggucuccagcuuuccagugaaaugugacacucucaauagaaugcauaauguugguuucuaaaguuacacuccauaauuauuguuauucuguagaaaacuguacagaagguaaauagaauagcuucaaugggaauauaauuuaaauuuuuuuaauuuuauaaaaauuuauuuccauugcauuaaaagaaauggguagcaugugucuuucagagaaaggagcuauuugguuauucacuuugucaaucuuagguuuuuuuaaaucuuuaaacaauuucuucuuugugaugauaaaaauaauauaaauuuacuguuucugaucaugacugagucuauuacuugucauggcuuuuguacgcaacuguguuuuaaaaauaccgguuuugccucuuugguuacauguggugagcauggaugucaagauuauuuuucaacuagauuauucaauuuguuuuauauuucuuauacuuaauacuuaugacuacaguccaaaucagucuuuuagaaggugcucuugcuaacuguggaauauuugacgacaugaaaguccuuuuucuuugcuuucagugguuggcuuucacugaaagaaaguguaaaaaaagucagaauuuauagcuuucacuauguccaagacuaggacuggguuauaaagauuuucuuuugugaaggaaaauaaaagaaaauuugccacuacugcauuuacuuuacuauuguaaacuuaagauucauuccuuagucuuuggaauuuugaugucucaaaaccagaugaguggaagugcugaauuugcaaaauaaagcuaagaaugcuuaacucugcacuuuaaguucuacucugaccaaauugaagaugagcagagcagcccugaacagcauuuuguuuauacagucuuguuuaagaauagaauuuuuuuaacucuucauuuuuugucucuguggaagcuguguaacucuuuuuaaaaugcaauuuaaaacauuuuguuauucuaacaauucucucaaaaaacagcauuuccaaugguaaucgguauuguuacgcuguacuuauguauucccuguaccugaacacuuguugcugccucacaagaaaauagaacuuuuauguuaaaaauaaagucuguucuucuuga

SEQ ID NO: 191115 - RNA, 36441 nt, Homo sapiens
uguaaaauuuuuacuuccuuuuuuauuuuuuuaaauucucagugauccuuauucugauuccuuuugguuuugacaauuaaaaauuaugaaagcugguuguuuugucuccuauugcugaaauaauuuaguugauuuaacacuacagaugguguuaggauaaugaauacagaacaucaaugagaaucuaaauuauaucucuugagaccucccucauuccaagggaggucucauaaguauacaugcauacauguauaacuuauaaaaaaaaaaaagccacauaaaucaccaugacauuauagaagcagauucaagagaaaauagaaaaauguguucaccauuaaacucaauacuaauuuuuagaaguaacaaccuauagaaucaacauuaaugagacgaaauaauauguugcaguuaagaacaacaggcuuuggaguaaauaagaaguagguuugaguuggugacuuuugcuguguggccuugggcaagcuauuuaauauaccuaggcuucagucuucaucaguaaaaugagauaauacuacuaucucacaggguuguagcaagaacaaaagaagauaaugcauguaaaaccagagugcuuagcacauauaauaaagcuaaauuaucauuagccauuguuacuaugauuauuauuaauuauaauuauccuagauacauaucugagcaugauuauguauuuuuccuauuuacccagcuugacaaggugcuuaaaucuuuucuuuagcacuagaaaaaaguagguuuuaauugaaccucuuuucauuucauccauuuuacagacaaauuauuuaugaagauaagccaacaacucauaauuuaaggaucucuuuauguucgucacaaagguuaucaaugcuuuuaagagcaucugcauaguuuuguuauuuaaccuuuacacacaauacauguuuuucaaacugcaaaguugauaacuaauaucauuuucaaauaggcauaguauaaccuuaaauauuacaugauucaaauuauuauuauuuuuuuuuacaaagaaauaaaccuguaaaggaucacugcacuacaguuguccauuaauuaucugcggcaaaacugggauccuaguagaagcuucagcauauggaugguuccucuacugccugggcacccucugugacagcuuugacacauuuggccauugucugugaggcucugcuaauugaaucugaaagauauuaagaaaaugucauuuugauaauacaacuuuuuaaaaagcacauacuaaaacuuuaauggugcacauauucaggaggaaaaaagauuauaaggcccuaugcaaguauauauaauuauauguaaccaacagauuccaacgauaaaccccuuacuggccacaugcuuucaauaacuaucccuggaaacaaucaaauaacuauagagcagcuagacagugcaccaguaugcagccauuaaaaaauuauagaaaaguauuaaaaacauaggaaaggccaggcgcgguggcucacaccuguaaucccagcacuuugggaggccgaggcagguggaucacgaggucaggagauugagaccauccuggcuaacacagugaaaccccaucucuacuaaaaauacaaaaaauuagccagguguuguggcauaugccuguagucccagcuacucgggagucugaggcaggagaaucgugugaaccuaggaggcggagcuugcagugagccgagaucacaccacugcaaucuagccugggcgacagagcaagacucuugucucaaaaaaauaaauaaauaaauaaauauaggaaaaauguguacaauacuauuauugaaaaagguuacaaaacagcauauguacuaaaauacauugaauuguccacuucaugaguaaauuuuaggguacaugaauuauauuucaauaaagcuaucaacccccaagugaauaaucucacuuuuuuuuuuuuaaagagaccagaucugacuauguugcccaggcuggucugaaacuccuggauucaagccaucugccccccucagccucccaaaaugcuggaauuacaggcaugagccacugcaccaggccuaaucucaccuucuguuucacuaaaaaauauauaggccaggggugguggcucacaucuguagucccagcacuuugggaggcugagguggguggacugcuugaguccaggaguuugagaucugccuggguaacauggcgaaaccccaucucuacaaaaaauacaaaaauuagcuggauguggugguaugcgccuauaguccuagcuaccgaggaggcugaggugggaggaucacuucagcucaggaggcagagguugcagcaagccaagauugugccacugcacuucagccugggugacagaguaaaaucucaucucaaaaauuauacacacacacacacacacacacguacauguaaacaguaauaauuacauauaaauaacaauaguuaauuaauauaauauauauguguauaaugcauauguaugucccuggaggaagagugacuaaaauguuaaaaauaauuauaguuauuucuugauagugggaggguagugauuuuucuuuuuuuaaaaaaaaaaaaacuuuuagguucagggguacaugugaaggcuuuuuacaccaguaaacucaugucacagggauuuguuguacagaauacuucaucaccgaggaauuaagcccaguacccaagacuuaucuuuucugcaccucucccuccucccacucuccacucucaaguagacuacagugucuguuguuuccuucuuuguguucauaaguucgcagauaaauaccauagaagugauuuuuuguugugcuuuugagcauagguauuauuuuacaaugaagguaaucuuuauuaucuaacuaaaauacuuauuuaaaaaaucuuagauacaaacuauauaaaaaaauuaagaguucuaugugcuuuuagauagaaaauuagucaaaauaaucuaucaacuauuaacuaccucauaaccuagauguuguaucaacuguucuaagaaucugcaauaaacaaguuucaguuugucugcauuccuuaaaaacauuccuaacaauuuacaucagaagcacuguuuaacauguuucacauuuaaauguuuugauucuuccaccuauaauucucagaaaaaccugcaguuauuugccacuuuggaaaauucaccauaaauugcuacacagugacuuuccuuacaacagcaaaauuuuauauuuaaaaucuauuaauugcuuggauuuucaaacuuugcuuacauuucagaaacaaaaaaacuagaguagaaucagaaaauaugcuuacguuaguuccaauguuugaaaaccuucaaagauuaagaauugcaaacacuaucaaucacaaauuggaauuauaacaccaaaugaggugaucugauuacuucuuaccuuucguauuuggcagagucauguugacaauuacauaccugucauguagaagucuuuuauaguuagcugagguggaacaagugggucagcaagaagcugcugguucacuagcugcacaaaaaagaagagaucaacaauaauauggaaaacuaguacuguuacaccaguagauacaacauuaugaaaacugcucauaggcgagcuguuaccuuugagagcucauuugcuugcuggaaguaauuagccccuucaauaucaucauaucgaacaagauuaggagagacuucuuccaaucuguuccuuacuugauccagaguaucauauggaagagucauuccagcaaucuacaacaugucagguccccaaaaacaacaaaaagcuuuaauacuuaaaaauaucaaauaauagauaauuguaacuauggugaaauaaugcagcacuacugaaaaaccuauugguguccauuaguagacauacauuuaugaaggaagcaguuaagcagggaacacaaauaucaaaaauucuaauucauucacagcugucaguacauuagugacucuaugaaaugaagagacaauacuaugcuaaauccaaauguuuuugcuaaccuguuauuaaaauacauaaaguuuacaauguguuauuauuuuaaaagucaggaugcuuacuuuuacaucaauaaagagcuaacagauguauuuucaggcaaaagacaagucaacaauuuucaacaauaaaagcaccaauuucaggccaggugcaguggcucacaccuguaaucccagcacuucgggagaccgaggugggaggacugcuugaggcccaggaguucaagaccagccuggccaacauggcgaaaccccaucucuacuaaaaauauaaaaauuagccaggcuuggugguacaugcguguaaucccaguuacucaggaagcuugcgcccgggagguggagguugcaguaagcugagaucacgccacugcacuccagccugggcaacagagaaaaacucugucucaaaaauaaauaaaauaaaauaaaagcaccaauuucaaguuccuuuauuuuuuaagagacagggucuugcucugucccucaggcuggagugcagcggugcaaugagagcucacuguaaccuugaauuccuguuucugaauacauguuuucuauagaaauuauucaaaucaucucugcauuucagacuggcaucuuccuugacuuugaaaaucauucuaacaggcuaaaauaucaaauaugccuuuaguagcaucacuaagaaaugacucagaaauuauaccucagagagugcucuuauaauuuuccagucuucucuugccaagccaggaggugucacugcuaccuuagucugcugagcucuacccucaguguugacauauguagcagacuucucuguguaagcagcuccugggagaauaacaucagcuaugggagccccaacaucaccaugauguccugcacaaagauggaaaaugguaaaccaaaauuuuauuaaaaacugauuuucuacuguacaugaagauaguauauaucauuuuaaaucccauuuuguaaagucacaaaaguuuuuaaaacuaaaaugaaacaguagugaaguaauaaaaauuaaagcccaccucaacccuaauucaacucccuucccaaagaaaauuauuauuauuuuuuugagauggagucucgcucugucgcccaggcuggagugcaguggugcaaucuuggcucacagcaagcucugccuccuggguucaugccauucuucugucucagccucccaaguagcugggacuacaggugccugccaccacacucagcuaauuuuuuguauuuuuaguagagacaggguuucaccguguuuagccaggauggucuugaucuccugaccuugugauccacccgccucagccucccaaagugcugggauuacaggcaugagccaccgcgcccggccccaaagaaaauuauuguuaaagcauuugggggccaggugugguggcucaugccugugaucccagcacuuugggaggccaagguggacagaugacuugaggccaggaguuuguguccagccuggccaacauggcaaaacugcaucucuacuaaaaauacaaaaaaauuagcccaaugugguggugugugccuguaaucccagcuacucaagagggcugaggcaugagaaucguuugaacccgugaggcuggggcugcagugagccgagaucacaccacugcacuccagccugggugacagagugagacucuaucucaaaaaaaaaaauuuuuuuuuuaaagaaaaaaaaguaucuucucagacuauuuuaugcaaauacaaauauguauaauauaauacacacauauaaaauagccaaguaaguauacugaugcuuacaaaguagaacugcucagauguaccaguuugugaaauuugguaaaguagacugaaaugggggaggaugcaaagacaggaauaugacaguaauacugaaaaaggcauaaacgaaaaacuacagaaaaauuuggaaacacugccacccauuaauaacaacuggcagaagaaaaaaguuauucagaaaagaagaccuuuagaaacaucugaaucaaguguaagaaaaucguagaauaauauauaguuuaauauaauuugugcacauuuguauaugcguaugaagauguuaugaaguacgcauaucaaaacucaacaaugauuauuucuuaaaggacuaaaaacaggauuuuaguuuauuuuguuuuuaauuuuauuaaaaauaacauuuuuuauugcucugucacccaggcuggagugcagugacgugaucauggcucauugcagccucaaacuccugaacucaagugauccucccaccucagccuccuaaguagcugggaucacagacaugcagcaacacgccuagcuaauuuuuaaauuuuuuguagaaacagggucucccuauguugcccagacuggucuagaacuccuaggcucaacaaauccuccugccucagccucucaaaguggugggauuacagcaugagccacggcacccaaggaacaggauuuaguucauauauuuugguuuaacuuuuuuuuuuuuuuugagagggaaugucacucuuauugccuaggcuggaguacaauggcaugaucuuggcucacugcaaccucugccucccagguucaagugauucuccugucuuagccucccgaguagcugggauuacaggcgcccgccaccacgcucggcuaauuuuuauguuuuuaguacagacaggguuuuaccauguuggucaggcuggucuugaacuccugaccucaggugauccacccgcacuggccucccaaagugcugggauuacaggugugagccaccgcacccggcagguaauaauucuuaaaagcaguaucaauuauguaacuaauaacacuugugguuuguuuaaaaaaaaaggaggaggagugggggaggcaaaauucucaaauggaaaacauucaguucacuaaauauauuacuaaaugguuucuaacauacauaauguacuacucucuuuuguuucuggugucacaggugauacuuaccuugauaaauaaugaaacaauccuuuggcaaauccugucgugugauacaaccuccaucugcucccaggagaaacagcaccuugggaggguucuuccgaauugcuuccaccccaggcuuauagccaagguccaaagcagcuacuugacuugcaauccugcaaagcaauuauggaauuuuaccauaacugcaguauuuucaauguaaaaaauuaaaugugauuuuuggaauaauuuccuuucaacaaugucaaaaaacccauuuuauuuuauuuuauuuuuuucucggcgauagagucucacuuugucgcccaggcuggagcgcaguggcgugaucucggcucacuguaaccucugccuccuggauucaagcgauucuccuucuucagccucccaaguagcugggacuacaggcacaugccaccacacccggcuaauuuuuguauuuucaguagagaugggguuucaccauguuggccaggcuggucuugaacucuugaccucaggugauccaccugucuuggccucccaaagugcugggauuacgggugugagccaccacaccuggccaaaaaaucccauucuuacccauuuaaaauagaugcuaaaaccagaaacagcagucuuuuacuguuuugagaauggcaaccaaagaaaugucagauucuuaggacgcucugucucuccaugacauaguauugaaugaaauaauucuagaaauuuuaugccaacuguaauugcuuuaagucugauucuuauucaauaaaguaagacauaaaacaugauaagucauauauauucaaagaagaaaaaucagauuauuucaaaaaugaaaagggagaaauugaaaaccacucauuaaacuguaauucagcaaaaaccauaaugagaaaaccaaaaccuuauagaaauuuuuucuacgaauauauauuacucuuauaagcacaaaauaaucuuuuaaagaagaggucuggaauaaauauacuuugaauagcaggguuguuguuuugguuuagcuugguauuuguuaacuaucuagaaauaguagccauucugaggaccuaaaacaaguuggaagcaugcuucgaaaggcucagaaaugguuauccugugugccccaauaguucuacuuuuagaaauauauccuaagaagauaauuucaagugcaaagguaucugugaaucacuguauuauuuaagaaguuaaaaacuaccaucaacauacauguuaaaaagaagaaaauggcuaaaaaaauuuauaguauauucaugauaucaauuagccauuaacauuuuuauuuacaaacaauuucuagaaaaaaauuucugaccauaguaggaaauucucauuuggcaaugaaaaccuauugaaaccaggacacaaaauuguauucacaguauaauuucaccuauguaacuaaaaaauauuacacagcugugaggugaaguggcucguaucuguaaucccagcacuuugggaggccgaggguggcagaucaccugaggucaggaguuugagaccagccuggcgaacauggugaaaucccaucucuacuaaaaacaaaaaaauuaggccgggcgugguggcucacaccuguaaucccagcacuuuggaaggcugaggugggcagaucgccugaggucaggagaucgagaccauccuggcuaacacggugaaacccagucucuacuaaaaauacaaaaaauuagccuggcauaguggcacgcgccuguagucccagcuacucaggaggcugaggcaggagaauugcuugaacuucagggauggagguugcagugagccgagaucgugccacugugcuccagccugggugacagagcaauacuucaucucaaaaauaauaauaauaauaauaauaaaauaaaaaaauuagccaggugugguggcacaugccaauagucccagcuuacuugggaggcugaggcaggaggaucgcuugaaccugggagggggaggcugcaguaagccaagaucaugccacuguacuucagauugggcaacagagugagacucuggucucaaaaaaauaaaauaaaauauuacgcaggguaaagaaaaaaacuagaagaaaaugcaugaaaauaguaauaauuaucuacacauuguagaauaaggaucaguuccauuucugcacauaucugucucuuuucaacuuaccuaaauuaaaccugcauuauugauaugguuugaaauaaaggcuaggugcaguggcucacgcuuauaaucccagcaguuugggaggcugaggcagaaguaucgccugagcccaggaguuugagaucaaccugggcaacauagugagacuuuaucucuacaaaaacaaaaaauuagcugggcauguggcaugcgccuguagcuucagccauuuaauacuugggaggcaggggugggaggaucgcuggagcucaggaagucagggcugcaguggacuaugaucaugccacuguacugagacccugucucaaaacaaaaagccaaauaauuaaaaagaaaaaaaaagaaagaaagaaauccuuuagcugaauucucauauuagcuuacauuuuuaucauuuaauuaaagaacuuguugcaauuuuugaaccaagguguaacuaauauaacaauuuuuauaguacuucacuuuuuuucucaacacucacuguuauuucaaauauuuuaaauauuccuuaucaucucgggcucuucucacacagaguaaaggucuauauuucacauguguaacugggauaauguugcuaaauguuguuuguaaauuaaauuuaacaguguaucaggaacacauacauauacacaacauuacuugaauuuauaguauauaaagcaauuacucaacaaaccuaugaaggauauucauaacuuuccaaucaccaguaacaccacuagucauccgaaucuuuugugcaaugcuagaaacagcugcaagaauugcugcuccaucauuucuuuggagugcagaacugccuaaaaccaccauugguuuuuuagcuuccuuuaggaccuauuuaaaaaaaaaaacaacuuugauuuuaaaauauuacaaguaagcugaacaccaaaccauauuugccucuauaauauagguugucccaagucuuagguguaacaugaaugucuucaauuuguuagcccaacauacagacacacauauacaaccagauuuaguuuaauccaaagcaucuugccaaugcuacugugaaauaugccugaguaucagcuaaaacacguuuucuaaaaguaauuauucagaauaaaaagccuagcaaauuauccuguggucagaauaacuaugggcaggucccagaaaaauuggggaacuucucuccagagauucagauguuaauuaaagaauaggaaaaacuaugcuuaaguaucaugccuacuaucuuccaucuacuuaccaugccacagauagggaggaggaggcagggaaagcaaugaucaccagaucacaauguuaaauaccuacaauuuuaaggcuuuguuuuaaaccauaguaacucuaaaugacaaaaacuaggagaaugcaucccaagaguaaaggaaacuacaaauuucacagaagaugggcaaauaagauguaaaguuauaggcugggcacgguggcucacgccuguaaucccaacacuuugggaggcugagguggguggaucacuugaggacaggaguucgagaccagccuggccaacacggcgaaaccccgucucuacuaaaaauacaaaaaaauuaaccaggugcgguguuauguaccuguagccccagcuacacaggaggcugaggcacgagaauugcuugaaccugggaggcggagguugcagugggccaagauugugccacugcacuccgucugggcaacagagugagacucugucucaaaaacaaaacaaaacaaaacguguaaaguuauagaauacacgucucauucucccacccauccuuugugucauucuucaauaaauagcuggccacaaucaaagaaucagcauggaaauuaugcugauauauuauaaagaggaauacauuaaucacaagaggaauuugccaaggaaaugugaauaguugagagaaauaguuuuuaauagucucaaagacaaugaaaaauaacacacucuuucucacuuaaaaacucaaagaagcaacacuguagaguauuauauaguaaggagauuuucaucauugaauucaggauagaacuggaagacaaacaaguaauaaauaccauuccagaaacaauaaaaaacuaaacaggccaggugcaguggcucaggccuguaaucgcaacacucugggaggccgaaguggguggaugacuugagcccacagguucaaguacagccugggcaacguggcaaaaccucgucucuacaaaaaauuggccaggcaugguggugugcaccuguggucccagugguggcugcagugagccaagacagcaccauugcacuccagcaugggugacagagccagaccaucucaaaaacaaaaaaaaaagacagaaaagaaagaaaacaugauuaaauacaaggacaggaaagacaggguacaggauacaaaacaaauggaaaaaggaaaaaaacacagauaugaaaaaccaggcaagguuggcucaugcuuguaaucccaacacuuuagaaggcugaggugggagaauugcuugaggccaggaguuugaggccagacugggcaucacaaugagccccaucuauacaaaaaaauauaaaaauuagcugggcauggugguguaugccugcagacccagcuacaggggaggcuuaggugggaggacugcuuaagcccaggaguuugaggcuacagucagcuacaauucugccauugcacugcagccugggcaacauagugagaccuuaaaaauacauauauagaaaagaagauucgacaacugcauugucaagaguuguuuuuuuuucuuuugagacagggucuuacucuguugcccaggcuggagugcaguggcaugaucucggcucacugugaccuccaccucccagguucaagcuauuaucuugccucagccucccaaguagcugagauuacuggcacacgccaccaugccaagcaaauugggguuuuuuuguauuuuuuaguagagauaggguuucaccauuuugcccaggcuggucuugcuccugaccucaggugauuugccugcauuggcuucccaaagugcugggauuacaggugugagccaccacaucaagaguucuuaaugaagguaacagaauuaaugaaaaauguauuuaaaucuauuauagaacaaaacguucucaggccaggcacaguggcucacgccuguaaucccaguacuuugggaggccgacacgggcagaucacgaggucaggagauugagaccauccuggccaacauggugaaacccugucucuacuaaaaauaaaaaaauuagcugggcaugguggcgugcgccuguagucccagguacucgggaggcugaggcaagaaucgcuugaaccuggcagacugagguugcagugagccgagaucaugccaccguacugcacuccagccuggggacacagcaagacucugucucaaaaaaaaaagaaaaaagaaaaaaagaaaaggaaacguucucucaaaauaguagucaccuaucacauggggaugggaauuagagaggagaaaggaagacuuuucacggaauauuuuuuaauauuuuugaucuuuuaaucauaauuuuuuuucuauucaaaauaaacaaguugugcuuugcuacuucauccucuugcacaucaccuucuucccuacaccugagacuguaagugaagcaaccaucuuggaaccacaaggagaaggacacacacaaucacaugugagcaagcaaaugcacugacgacagcaaagcaggaaggcaggcucucuuugaugauaugcuuggacaacugcaucagcuuuuuuuuuuuuuucuuucuucuuuuuguuuuuuugagauggagucucacucugucacccaggcuggaguccaauggcgcaaucucagcucacugcaaccucugccuccuggguucaagugauucucuugccccagccucucaaguagcugggauuacaggccacuacaaccggcuaauuuuuguauuuuuuuuuuuuuaagcagaagcgggguuucaccaugguggucaggcuggucucaaacuccugaccuugugauccgcccgccucagccucccaaaguacuggaauuacaggcaugagccaccgcacccagccugcaucagcuuucaaugugccuaccuccagacccccuugugugacaaacagaaacuccuuaguuuuuaguuguugguuuuuuuuuuguuuuuuuuuuuuugagauggagucucgcucugucgcccaggcuggagugcaguggcaugaucugagcucacugcaaccuccgucuucuggguucaagcgauucuccacccucaggcucccgaguagcugggauuacaggugcccaucaccauacccagcuaauuuuuguauuuuuaguagagacgggguuuaaccauguuggccaggcuggucucgaacuccugaccucaggugauccauacaccuuggccucccaaagugcugggauuacaggugugagccacugcaccuggccggaaauuccuuaguuucuuucuuuuuuucuuuuuuuuuugagacaggguuucacuccuguugcccaggcuggagugcaauggugcaaucuuggcucaccacaaccuccaccucucagguucaagcgauucuccugccucagccuccugaguagcugggauuaugcaugcaccaccaugcccagcuaauuauguauuuuuaauagagacggaguuucuccauguuggucaggcuggucucaaacucccgaccucaggugauccacccaccucagccucccaaagugcugggauuacagaugugagccaccaugcccggccaacuccuuaguuuuuuaaucaccuccaccaccacacauauauucuaaaauaaagagaaccuuguaucuuuagacugaaaguacauucuguccuauagucuuauagugaugucuucaccuuuaagacauauuuuggugaaguuacugaauuucaagaaugauaaucagaaucccagcacuuugggaggccaaggcgaguggaccacaaagucaggaguuggagaccagccuggccaauauggugaaaccccgucucuacuaaaaauacaaaaauuagccaggugugguggugcgugccuguagucccagcuacucgggaggcuaaggcaggagaaugaacccgggaggcagagguugcaaugagccaagaucgugccacugcacuccagccugggugacagagcgagacuucgucuccccgccaaggaaaaagaaaaaaaaagauaaucaggacaggguuuggggcggggcggaggaauaaaguuuacaugcuucuucacuaacaaaaggcagugucuauaaagcucagaaaggggggaaaaaaaagucugacccuggaauuucacauccugacaagcugucucuucaggaauagacauucucaagcaagcaagaacucaaggaauacaggcaaccaugagccaccuuuggggaaaagcaaaacaauaaagccaacaacaaaaugaauuaaagaaagaacucaaaugaaaaaaacauguaccucagaaacaaaaauagaaggacugguaaaauuuuaaggaauaacuccuuuuguaauaaagaaagauuuaaaugaaguuaaaagugcaauucuuucagguuuacuuugauuucuuuucagauaauuucaagaaaauuaaacucuggcaaauaaaaacugcauguacaguaugaucucauuuuuguuugacuauucauccaucuugcuuugcucucuacauaaauggagagauuaugauguuuuaucaauaccuguuuuggggugguggaauuuuagguaauguuuuacuuucuuccucauguucuuuucuguauugguguaaguuuuuuugggggugggacagagucucgcucuguugcccaggcuggagugcaguggcacaaucuuggcucacugcaaccuccgccuccuggguucaagcaauucuccugcuucagccucccaaguagcugauacuacaggcgcacgcuaacuuugguuuguauuuuaguagagacaggguuucaccguguugcccagucuggucuugaacuccugaccucaggugauccaccugccucggacucccaaagugcugggauuacaggcgugagccaccgcgcccaaccugguguaaguuuuaacacuuacauaggauuauuacaaaaacaguuaaguuuaaauaauaauaauuaaaaaucaacaagaguagauacacauaaguugagagcaccuggcuaaauggauggcuucccgaagcaaugucuugaagaauuuugggggagucucccagguggucauauguguaagugagguccacuggacugccuauaagggccacuuuuaagucauuaugcagccagcugaaauaaaaacaacauuuuaagaaguaaauaacuaagcuaagcaguuacuggucucaucaauccuaagugauacaucuauuuacuauuacaaaauguuaaaagcacagacaauacauuuaacagauaugauuuacuacguaccuuucaaaacaguguugcaaaaaggcaugccaaggcaauucagugauuuaauuugcuguguagaaaugcuauccagaccaggcgcaguggcucacaccuguaaaucccaacacuuuaggaggcuaaggcagguggauuaauugaggucaggaguuugaaaccagccugaccaacauggugaaaccccaucucuucuaaaaauacaguauuagcuggacaugguagcgcaugccuguagucccagcuacuugggaggcugaggcaggagaaucgcuugaacccaggagguagagguugcagcgagcugagaucgggccacugcacuccagccuggguaacaagagcaaaacuccaccucaaaauaaaaaauuuaaaaaaaaaaaaaagaaagaaaugcuaguaagccagcuauaaaaguuauuuauuuauuaauuuauuuauuuuugagagagagucucacucugucacccaggcuggagugcuguggcgcaaucucgacucacugcaagcuccaccucccggguuccagcaauuuuccugccucacccuccggaguagcugggauuacaggcaccugccucuacgcccagcuaauuuuuguauuuuuaguagaaggcaggcuuucaccauguuggccagacuggucuugaacuccugaccucaggugauccacccgccucagccucccagagugcugggauuauaagcaugagccacugugcccggccuaaaaaaauuuuaauuuuagaauuaaucuguaauuuuuauuuugcaguauuuacaugacagggucaauuaucucuuaauuauccauuaaggauauuuaaacauuuucauaauucaugaaaauauaccauguuauugacauuuauucuccacagcagggaacuauggcuccaguuccuccaaaaagucauaagugcaaugacuauauagucugguuugucugagauaaugcuuuuuuuuuucccuguuauccugauguaauuauuaauucccucuuucacucccguaguuuagacaauaaacuauaugguuacccucuuuauaaaucucuaagauguaaauuuaaaagacagaaagcaugcuagaaaauaacuggcuuguguucuuaaaaaaaaaaaaaaaaaaaagucaaaaaagggaccagaagagucaugaaacuaauuguaauguaugacuccagaauggauccugaggaaacaaaaaaauugcuauaaaagaaauuaugaaaaaaaaaaucaaugaaauuuaaauauaaacguaggcuuaugaaauaauauuguaucaaaacuaaauuucuggcuggaugcaguggcuuaugucuauuacucccagcacuuucagaggccaaggcaggaggaacacuugagcucaggaguucaagaccagccugggcaacauagggagauccugucucuacaaaagguauuuuaaaaaauuagcugggcaugguggugcaugccugcagucccagcuacucaggagguuguggugggagcaucauuugagcccaggaggucaaggcugcagugaggugugaucaugcuaauauaccuuagccuguguggcagagcaagaccccuaacacaaaaacuagcuggacgugguggcauaugccuguauucccagcuacucaggcagcugaggcaggagaauugcuugaacccaggaggcagaggauacagugacccgaaacugagaucucagaaaccaaaaaaacuaaauuucuuuuuuuugagauggaguguugcucuuguugcccaggcuggaguacaguggcaugaucuuggcucaccacaaccuucgcuucccagguucaagcgauucuucugccucagccucccaaguagcugggauuacaggcaugcgccaccaugcccggcuaauuuuguauuuuuaguagagauggguuucuccauguuggucaggcuggucucaaacuccugaccucaggugauccaccugccucagccucccaaaguacugggacuacaagcgugagccaccacgcccagccuaaauuucuucauuauuuaagagaaugcuccuuguucucaggaaauccacgcugagaauuuagguauaaaagggcaccauguccaccagaaacuuccaaaugauucagaaaauuagauucacacacacauauauauguaguguguauauauauauauauauauauacacacacacugagaaucauaauacaaauauggcaagauguuaacaucaguuaaucuaugugaacaauauacaaaaugguauacaaagaccauuucaagcaucuugaauuauuucaaaauaaaaagcuaauaaaguaaauuuaaaagacucgcaaggagaggagaaaacggaccuauuagaaauuguugcaacugggcguggcaguucaugccuguaaucccaguacuuugggaggccaaggugggaggauggccugaacccaggagcucgagacuagccuggcaacauggcaaggcuccaucucuaaaaaauuaaaaaggccgggcgcgguggcucacaccuguaaucccagcacuuugggaggcugaggcgggcggaucacaaggucaggagaucgagaccacggugaaaccccgucucuacuaaaaauacaaaaaauaagcugggugcaggggcgggcgccuguagucccagcuacucgggaggcugaggcaggagaauggcgugaacccgggaggcggagcuugaagugagccgagaucgcaccacugcaauccagccugggcgacaaagcgagacucugucucaaagacaaaaaaauaaaaaauaaaaauaaaaauaauuuuuuaaaaaucuaaaaaauuaaaaaaauuaaaaaaaaaaaaaggcucggugcaguggcucacaccugaaaucccagcacuuugggaggcugaggcgggcggaucacgaggucaggaaaucgagaccauccuggcuaacauggugaaaccccaucucgaggcggagcuugcagagccgagauccugccacugcacuccagccugggugacagagugagacuccgucccaccaaaaaaaaaaaaaaaaauugucuuccaguuaucuuuuggagucucacuaccacuaacacuauuaggaagaugccauuuuucacauauaaaacaaaaaaauuacauaaauauuuuuaaaccuugaauaaauacuauuaccaaccucuuucgaauucuagcauuaaacaguggugccucaaaacguggguuuguaccaaccagaagaacaacaucugccucuuccacaccagcaauuguaguauuaagaagauaauuggaacgcaaaucugugcuagaaauacaauauauaaaaugcaaauuuacuuuaaaauuaagacauacagagaauccaugaaauauucuccuaucaucaaacccauugccuucucaaacaaaaaauuuuaugaaguauuucuaaauuaaaugaacauuucagauacuuauuuuuuuucucagauagagucucacucugucucccacgcuggaaugcaguggcgugauccuggcucacugcaaccuccaccucccagguucaagcaauucuccugccucagccucccaaguagcuggaauuacaggcgcacaccaccacgucuggcuaauuuuuuuguauuuuuaguagagacgggguuucgccauguuggccaggcuggucucaaacuccugcacuuaggcgaucugccugccuuggccucccagagugcugggauuacaggcgugagccacugugccugagauacuuagugauaaguggauuccucuauuuccuacaacuucugguuugaucuuggucuauauaugaaaauaaacugggggauauguuggagaauccagguugucacauuuuauacauaacuuguaacuaaaaaaagaaaggaaagccuagauccuagcuucauauuucucacccagcuccugcaguggggaagaccucuucagugcauaaggugucagaguccacucuauuaagcaaaucuuugagagcuaccagggcuucagcauccaccaagccaccugcaauugcugccacaucuuugccuugaaaacucugcaacuagaaacagaugaaaagggcaucaccaagaaaccuacacgcagcaaagaccacaaugaaauguucagaaaauaaaacaguacuuguuuucaaguacaaaaaaaguuaacagacuucugauuaaaaguuuuacaacaugcccaggcacacuggcucaugccuguaaucccaguacuuugggaggcagaagugggcggaucaccugcagucaggacuuuaagaccagccuagccaacauggugaaaucccaucucuacuaauaauacaaaaaucagcugggcaugguggcauacgccuguauccccagcugcucgggaggaugaggcaggagaacugcuugaaccaaggaggcagaggcugcagugacccgagaucgagaucgcgccaccgcacuccagccugggcgacaacagcaaaacuccaucucaaaaacacaaaaaaaguuguacaacaauuauuaauuaaucuaaaagugaaaagcugcagagguguuauguggggccacagcuaauaacaucaacuuagaaggaagcuguuuuauauuuaggaacaaaggcacuucaaaaugaggucuggagaaugaaguggaacuauaguuaccuuaaaugcgaccuccucugaaguaucugccuuucccucuagugcuuuauguugucuuucucuaacaagaaaacuauucccuccacuuguacucuggcaagcuuauauucauucucagauucuucuuuaagaaucaccuucuguaggaaggcagcuuuuuuuuuuuuugagauggagucucgcugugucacccagacuggagugcaguggugcgaucucggcucacugcaaccuccaaggaaggcaucuugauaugccuguccuaguuaggcauuccuccuacgugcucucacucauauuacuccuuauauaauuacucauagcugcauauaauaauugcugaauugugcaacuuucucuacuacaagauuguaggaugcaggaaugaugugucucuggucuuuauaucccuuaauagcauaauaucuagcauauguccucaguagaugucuguaaaauggaaggagauuaaaucauaaucuugguaaaaguaaaaaagggaagaaauauacaucccccccuucauggcaaagauguuucuugauaaucacaaacacuauuuaacacuauuuauuucaaauuuuaccauuccagcuacgcgagagagcgcauccucccaagaaguauagguuaaaagcccuuuuucauuucugaccauuggcucgguaagucuuugacguuuuagcccaucauaggcaaaucuagaaaacagaaauuacaccauuguggaaucuugcuaaagaaguaacuauaauuuucaaguuaaaucaacaagaaauguuauuuaaauacaguacugguuaaagugucaaauaucuaaacaccuagauacaaguaauuauuccagauauuuuuagagaugaacuaauagauuuuaugaacuucaccuaaaacuaaaauaccaucugaaaguuugauuucuucccuuaaaucauacaaaaaaaaguuugauuucuuauacuuucagcuaacugaacaaucuuaaaauuacaacacaaaaaaaucugacagcuaaaaaagucaaaucauuuuuauuuacaaagcaugaguaucucuaaauauuuuaucaaaauuauauugugcaaacucuucuauucagcuucuuuuucaagcaaucaucccaccucggccuuccaaagugcugggauuacaggugugagucacugcgcccagccuagcuucuuuucucuaaugaacaaacugaaauaaguugagaauguaucaaucuacuugaauuucuccaugugggaggaaaaaauaucuuucucaaaguaaauacaauauccagggauugaccuaggacuauuaaagucaguauuaucacauuauauaagcaacucagauuccaguagucuauauucaguaacuaauuugcaaauauaaaagauaauucuucaaaauuauuauaaaauuuccuuuaaauaaacuguaaaaguuaaggaaaacaauauagcauauaccugguuuuaucagagauccacucuucauugauguccucaugcauacguggcaaaauccucaucacuucuccaguucuugugcuaaccacaauauuacuuccaaccgcauccauuacaucaauggauucugucuuucugagaaacacauacgguguuuacuauggugcuuuugggaauaaagaaaguuucuguuaccugguuuaccaaaaaauuuuuuuuacaauuaauucccuuucugaauuacuuuaaaaaaugaagcuuagaggaacugcaauuaaauaaaagaaccccccaccuuuuuuuuugcccuggggucucacucuguugcccaggcuacaguggcaugaucauaauucacugcagccuagaacuccugggcucaaacuauccucucaccacauuuuaaaaauuuuuuguagagccggugucucauuaugcugaccaggcuggucuugaacuacuggucucaagcaauccucccaccuuggccuccuaaaagcugggauuauaggugugagccacugcucccggcacacccacauuugaacacauaaauuccuggcacaguaaggaaggcuuuaaaacuauuaucugacacagaagcuaguuugaaggggcuccaacuagccaaaucugggacgauucaacaagaggggcaggauuucugucuaugggagauuaaggagcucaaaaaaccuucccacugaaaagcaaaaguaaagcuggccaaaaaugacaaaacccaccauuucagcaguuuagaaaucuaaacacauacaaugugggaagcuuuuaugcacugaaaaacugguggcugggcucagugcuccuccuaugcuccucuccacccccucaaaauggaauuucuucgaggccggggcaggcugugaagaugagaacuucuuugguacagauggagacaacucacuuaacuuggagcacgaggcaaacuuguuuguggaggugauacuuuggaggucaucguagcugaggauagccaagauuuuaccagccuaaguuuguagugguaauugcggcaagcauuccuaacagaggcugcuacaugugcaggugaaaccagagaaagcucaaccuauucauaaacuccuggauaacucugagacccaaagggcccagugcaaaguaauagcugggcaaacuugaaaacagccucaacuuugaauaugcuccuccauccacaaacagauccauuggcaaagaacauaacucuuauuaggucacgguguuugaaguacaauuauaccugacuacuaaacuaugcagacacaggggaacuccuaagaagccucacuuaaaaauaaaaccaagaauauuaaaauauguugaaagaaccaaagaaaaucauauuuaaaaauugaaggggauguaugacaaccacgaaucagcaaguagagauucucaguaaggacacagaaauuacacagaaacaaaaagccaaaucccaaguugaaaaguauaaaguuuaaaauuggaugauaauuuguuauguuuuaagaaccuuaaaaauaaucacaccucuugcaucuaucuacuccauuucuugguuuaaucaggagaaugagagauauacacagaaauguguaaacagcaauauuuuuuacagauuuguaaucauaaagaaauauacaagcuaaaugucuauuagcagaaacuggcuaaaugacauuccucauaguugaaaacuuaauaaacaacaacaugggagacuauacauuuaaaaugucaacacuauuaaacucuuuggaagaacacaugaaaaaaauaauuuugugguugaguacuuuagaauuaauuuccaagaaaacuacaguuaauuugcacagguucaauccauucuaacuacuuaccuucuauuuaaaggguuuuacauaaacaaacaaagucaacagaccaaaacaacugaaacccaggaagaaaaugaaccuuaauauuuuuuugaauaguaaugaauuaaggacaaaaaaacaaauugucauaaaauaaaagauaccuuguuucccaaggccgggcaguaaaggcauagggcuuagagguuagggcaccuacagggcagauaucaaugauauucccagacaguucagacaugaacaucuuuucaauguaugugccaacuugcauaucauuuccucugccuguuguucccaaaucaucuacuccugcaaucucacuugcaaaccuacaagauaaaaaaugugucaucaauggucaaguccagcaaaauuauuuccuuucuuauucaugaucacaaagagaugauuuuccaaacacuaaaaagaaaugaguauauuuuuaaaggugagcacaguccuagaauaaaaaauaaugaaauguuugcauuuaauugagguguaacacacaggcagaaacuuguacaaaucauauguguacaacucaccaaguuaugagugaaagcaaaugcuuauagauuuuaauuuuuaaauccaccugaaguugguacuaaaugaaagugaacuuauuuuauucauauaucagaaacagcaucccucuucucccacccaaaaaaaguagccauucuuuccaauguuauuauucaucaaauugugacuauuaaguauacaauuauauucuauaauagaaaaaaaaggaaaaaaaguuaccugaugcagcgaguacacuguauacaucuugucaugauggucuuuaccaauggcccaauguucuugucuuccacagcacgcuuccccucuaaaaaucggcuccuaucauuuccaaacaucauggacugguccuuaaguagauuaugaaagagucaaucucaugcugcuaauaaaauuaaaaucugagacaaccaaaaagauugacagaauucuacuacauaccugcagaucacauucaccucccuggucacaaauaggacaguccaaugggugauuugcuaauaagaacuccaucacaccuucccuguaugaaaauuguaacauauaaaaugacucucaaauacacacacacugacauuaacugcuggcacucaaaaugaccuauagacuuuauuuuuuuuuuuugagauggugucucgcucuguugcucaggcugcagugcaguggcacaaucuuggcucacugcagccuccugccuccaccucucagguucaagcgauucucuugccucagccucccgaguaucuaggauuacagaugcccaccaccacaccuggcuaauuuuuguauuuuuaguagaggcaggguuucaucauguuggucaggcuggucucgaacuccugaccucaagugauccucccgcccuggcgucccaaagugcuagaauuacaggcgugagccacugugccaggcccacauauaggccauuuaaacaaccuucauagauguauauuuguuauacaauuaauaguaauuuuacauuuaauaucagaaaugccaauuaucuaucauugugguaauauuuuuuuuaagagacggggucuugcuauguugcccaggcuggacucgagcuccugggcucaagugauccucccgaguaucauucugguaguauuaaacacacaaucuggaaaaugcuuagaggagccuagaauaaaguaucauuagagaacauagaaaauuaugauuuuuggucagguuugguggcucacgucuguaaucccagaacuaugggagggaggcugaggcaggaugaucaccugaggccaggaguucaagcccagccuggacaacauagugagaccucguuucaaaaaauaaagaaaauuguaacuuuuaacaauaccgaaugaucaaaaguugcugaaugguccucagaaaauauucacauuaauucaaaauaaaaacaaacacaaucaaucccaguauaguauaguaguagcuuaguaaguccagauucacccuucuucacaaguugagcaaguuacuaaagaaggauuuuuaaugcugauccuaaagcucaauaccauaaacuccugacuucaccuucucuacuauguaguacucacuucuauugcuccuagaagcugagcacaccaacuucuuccgaguuugauauuaaauucuuaaucuaugggaaggucuaaauaccaaaaugugcaauuuucugcuuuaugaaaggguacuacauugaauaacaauaaaguaccuggcuuuuuuggauuuuucugaguuuguuaggauauuccaacccuucauuacuggcauggcacaagcagcuacaaccugggauuucaaugaaaaaaaaaaauguguauuuguauuuauuugugauuacaagcaacucaauauauaaaaauguuaaauuauauaaaaacauuaaauuauacauuugauaacaggcaaagaauaggguauuuuuuaaaacugaauuuuguuaaguuuucauauucauaauacgaugaucuaguacuuugcauuuaucucagaaauaaaacauccugguuuuuagguuuauucuaauagucaaugcaauuuuuuauucugcucugaaacagaacaccaaauaacugcuuugauuagcaggcacuauugaauaaaaaaauugcauacaccaaaaugaaauuaaacuacugaaagugaacuucuucccugcaacccuuuucucuacuaaaaauggcagggcgucagcacuuuuaaugugcuacuuggcaacucuacauccugguuauauauuauacagccauuuggaaauacugacaacuauaaaucaccuuuaauuucuagauauguuacaauuauaugacauguguuuguaaagcacuucuaucuauguguuuccaguuuugaaaugaagagaaucaauuguacaaaagaauuaaauuuauagauagaaguaaagagggcuagguucuccacuacgauauugauucuaaauaaaguuugcugcaagauuuaaaguuuucuaccuucuacagcaugguguagaauuuuagguaucaaguaccuuaggggcuuucucaauuucaacaaggcacauccugcaguuuccagcaacagacaaccuuucaugauaacagaaucgagggaucugcaugccaaccuucucacaagccuagaaguaaaaaaaaaaaaaaaaaaaaaaaaagcauuagaauaaccugacuucacugcuguuauugcugaaacacacacauacagcaucuuauuacuucuaucuaucuaucuaucuaucuaucuaucuuaauucauucuuauuucagucccuuucuuugccuuugauucuaacccgucuccucugaagcugccucagaggaucucaggauccuuggcgugacuucaccuuauguggaagaaacuggauaaaguauccuuccacugugcugaagacuugacuucccacauccauuuugaaccauuguccacaauguccccagugguuucauaccuggacuucuucuuugccucgcuccccuccuuuggauuagagauuucacuacacauuaucuagcuggcuaucugucuuuggcuccuauaugcuacccaggacucaccucccacuguggcugaagguuuucccaguuucuguuugcccaguaagggggauuaucccugcucugccaauuaucaccuacccugcucugcaauuucuuccuccuuuuagucuauaaacauguucaaauuuccucuagaguuaguuccucauccucagccuucauucuaaagcaaucucaucaauuuccaguguuuaaacuauuuaguuagcaaaaauguguugagucuuuccuuugugcaggaugcagguauaguagugaaaaagacagauagugucccagccuucauccuagcugacauuccuuaugcugauuauguccaaaccuuaaucugcagccauguuagaccuccacuucuccaagcuucagauuuacagguauuugcauguguauguuccacagacagcuuaaauucaaaugauuucucuccccucuauacacuccaaaauaaccuaacaaaugcagaaaaccacaagaauuccuccggucucuuugaguucuaaagaacuauuugucuguggcucuacugaaacuucuuuuguguuuuuuuuuucucacuguuaaagcaauauugggaaguucuguacgacgggggaaaaaaucccucgggucuucaucauuccugaaggccugucuacauuucauucucccuugaaucuacucucuuguuuucauucccauugacacuaucuauuuuagggcuuuuguaguauccugucccaauaauacaaaaugcuuuuuccuugucucuuauuccagucuugcuauucuccaaaugaucauccucuacagucgcugucacccuguuuaaauaggcaacaaaacuccugauggaucaaaauauaagcucuucugcauagcagauacuguauuucaugacuggaccuucccuuccucaauaacuugauuuccugugaucucaucuucuacuuauaccuuauguuucaucaauauuaaacuauuugaagcuuucaaaauaugacaagcuaucugccuuaacuuuuuccauaggaaaugcaagcaugucguucuuguucacaauaugaacacaccuguucauccuuuaacaccuccucagggaugaccugaggcacccaauaccucuuucuacuaccuccuaucccugccacaacuuuucacuguaccuugaacauacauuuauaucauauuuugugcuuucaugucugugacuggcagauagucuagaaaugacugcuaaaaugaacaaagaacauuuagaucugugacaacuuacaaauggagugaagcaugacuucucuaugaccaauuuauuauuucuggaggaauaugaagaaauauuuagagcaugaauguaagcacaugcuacccuccauuuaccugcuuuguaggauauauuccuaugaauauuacuaaccacagaaagguuauaugaaaaugaaaagcauuaagcaggcccacaacaaauggagguuauuuuuucacaaacuuaccuauaguaacuaauuuaaguuacuucaaauuucuuuucuuuuuuuuugagacagagucuugcucuguugcccaggcuggagugcaguggcacaaucucggcucacugcaaccuccgccuccuggguucaagcaauucuccugccucagccucucgaguagcugggauuacaggugcgcgccacgaugcgcagcuaauuuuuuguauuuuuaguagagaagggguuucacagugcuggccaggcuggucuagaacuccugaaugauccgcccgccucggccucccaaagugcugggauuacaggcaugagccacugcgcucggacuucaaauuucuuaauggguauucauuuggaaugaaaagugaaacaaaagaacuaccauaauucacuaaaaaugccacaaacaaauauaugauagcucacuuugaagugccaagauuuaaaaugaaauaauuuuaauauaacuuugcuguguauaguuauuuuaaagaauuauuuacuaauaaucaguauaaaggaaauaaauuaguauuuuuaaaaaaaucagaacacacacacaaaauaguuagaauguaugccuacuuggaggacggucguucccgguuccaccaugacagacugaccaucaacaaauacuucaaucaaguugcuugcugcuguggcaguuguucgaacugaccaucaaagauauugaagcgaaaaacagauuaacaguuuauuauagcagaugauaauggaugaauugacucuaacuacaaaccuaaaauuuuucauuccuuauuauuccucuguauugcucuggaugcaaacuuaugguugucuacuuuugauagcagaguaguuuaaacugaaacuucuuucuucuucuuuuuuuuuuuuuuuuuuugagagggagucuugcccugucacccaggcuggagugcaguggcgccaucuuggcucacuacaaccuccaccuccccgguucaagcgauucuccugccucagccuuccgaguagcugggauuacaggaacucaccaccacgcccgcuaauuuuuguauuuuuaguagagacaggguuucgccauauuggccaggauggucucaaacuccugaccucaaguaauccuucugccucggccucccaaagugcugagauuacaggagugagccaccauacccaacuuuaaacugaaacucuuaaugucacugaaaauauguucaugggaagaucacuuuucaaaaacagaaugugauuuuuccauuuuggcauugauguguguaguuccuaauacuuucuauuccaugauaauuccuauaaacuguuuaaaguaaaauuauauuuugaaaauuauucaacuuagaucauuuguuucuucuuuuuuuuuuuuuuuccaagauggagucucgaucuaucucccaggcuggagugcagugguacaaucuuggcuguaugcaaccuccaccucccggguuuaagcuauucuugugccucagccuccuguguagcugggauuacaggugugccccaccaugcccagcugauuuuuauauuuuuaguagugaugggguuucacuaugauggccaggcugguuuugaauuccuggcuucaagcaauccaccugccucagccucucaaagugcuaggauuacaggcaugagccaccacacccggccgguuucuauuuuuauuuuaaaaaaucauggguuuagggucuuugauaaacuaugccauagacuuauaaauuuacaaaaauaaggucuaauauccacgaaugcaaauuuaagaaaauacucaccacauccuuuaggagacuuagaaaggccuacuaaggccuuucuuacagguauccuuaacauauugcuaaaaauaaaacaaagaauuauauuauuguagggaaaaaaacaaucaccaacuguuugguaauguuuuauggcuuuaaauuauuucacauacauuaugucauugaacacucauagguucugauauuuucacuuagucuguagaugagaauucucagucucagagauacugacuuguacaaugucaaagagcuaagcagcagcagcuauuguauacauuuggacuuucuaauucuaugcagagagcaguuuugccauuuaaaaaaaaaugacauagaaaggaucaaacuuaaagcacuaccacacaguaaaauaaacugcaagacuaacagugagcuuaucauuaaugguuauguaaaauaaaguugucuuuucugcuuuuauuuccuaccaauacccauucuaucauuucauguucuaagcauagcugucuacuaaauguuccugagauauucugagauagcucaccagcccaagccuuugaggugucuugauugcuauuuucugguacacuuaucuuacagauuuccaauuauguguuuauaagcccguucugcccucacugcauuaauuccuugaauuuuucuaucuucaguaccuauccaccaggcuggcacagaguaagcucuuaaacaauggcucucaacugaggacaauuuugcuccccagggaauauuuagcaaugucugaacacacuguugucacaaacaaggggaaguuacugacaucuaguggguagaggacaaggugcuggcuauucuacaauguacaggacagucccccacaauaaagauaauuauccaaagugucaacagugcugaaguugagacacugcucuaaaaggcuugcugaauuacugaaauaaaugggugucgauuauauaaacaccacgacuuaaagacacacaaaacagaaaaguuaccaaaacuucuuuuuauuuguuuuuguuuguuuguuucugagauggagucucgcccuaucacccagacuggagugcacuggugcaaucucggcucacugcaaccuccaccgcccggauuaaagcaauucuccugccucagccuccugaagagcugggauuacaggcacccgccaccacacccgacuaauuuuuuguaucuuuaguagagacaggguuucaccauguuggccaggcuggucucgaacuccugacuucaugauccgcccaccuugaccucccaaaguguugggguuaaggcgugagccaccgugcccggcccuuuuuuuuuuuuuuuuuuuuugagauagagucuuacucuguugcccaggcuggagugagugcaguggcacgaucucagcucauuguaaccucugccuccuggguucaagcgauucuccugccucagccuccagaguagcugagacuacaggcaugcacaaccaugccaggcuaauuuuuguauuuuuauuauuuauuuauuuuauuuauuuauugagacggagucccgcucuguugcccaggcuggagugcuguggcgcgaucucagcucacugcaaccuccgccucccagguucaagcgauucuccugccuuggcuuccugaguaaccgggacagguguguaccaccaugccaggcuaauuuuuuguauuuuuaguagagacgggguuucaucguguuagccaugauggucuccaucuccugaccucaugauccagucagcucagccucccaaagugcugggauuacaggagugagccacugugcccagccuauuuauuuauuuuugaggcaggggucuugcugucacccagucucacucugucacccaggagugcaguggcaagaucucggcucacugcaaccuccaccucccagguucaagcaauucucagccucccgaguaguugggauuacaggcgcccaucaacaugcccggcaaauuuuuguauuuuuaguagagacaggguuucgccacguuggccaaggugguccugaaguccugaucucaggugauccaccugccuuggccucccaaagugcugggauuacaggugugagccaauacgccuggccaauuuuuuuauuuuuuaguagagaugggguuucgccauguuggccaggcuggucucaaacuccggaccucaggugauccaccugccuuggccucccaaagugcuaggauuacaggcgugagccaccacgcccggccaagucaccaaaacuucuaaacuuuuugaguuuuuuuuuuuuccuacucacuugaucauauaggcuaagcacugaacuuuccuucuauucacuugaucauauagguugagcauccaaaaucauuuggaacuuuuaaagguauuaaaaaugccuguaaucccagcacuuugggaggcugaggcagguggaucacgaggucaagagaucgaaaccauccuggccaacauggugaaaccccuucucuacuaaaaauacaaaaaaauagccgggcgugguggcaggcgccuguagucccagcuacuggggaggcugaggcaggagaauggcgugaacccgggaggcggagcuugcagugagccaagaucacgccacugcacuccagccugggcgacagagcaacacucugucucaaaaaaaaaaaaaaaaaaaaugcaaauuggacaggagagguggcucacgccuguagucucaacacuuugggaggccaucacaggaagauggcuugggucuaacaguuagaggccagccugggcaacacagcaugaucccaucucuaccaaaaaaaaaaaaaaauuagcugggugugguggcaugcgccuguggucccagcuucacaggaggcugaccugggagcauggcuugagcccagguguucaagguuacagugagcuacaaucaugccacugcacuccagccugggugacagaauaagacccugucucaaaaaaaaaagaaaaaaggcaaauuaugugauuagaacguauuaaaaaauuucaacauuaaaguuucaauaguugcaauaguauuauugaauaauaguacauauacauagguuuuaagcacaaaauucugcauacuuaucauagaugauguacaacaggaaauuucauucauaaauuucauuaauuaagaauaugugauacugaaauugcaaauauccaaucuguuuccugcuagugaguaauguuggguaaaugaguuucugguucuuuacuuauagagcaggaggaaaacaauacuuccuagacaaugagcuauuaguaggggcucaacaaaugccaguuaaagcugaauucaacuuaggcaauacuggccacugacaaucaguauguguguguguuuugagacagagucucacucugucacccagguuguagugcaauggugugaucuugacucacugcaaccuccgccucccaaguucaagcaauucucuugccucccaaguagcugggauuacaggcaccugucaucacgcccggcuaauuuuuguauuuucaguagagaagggguuucgccauguuggccaggcuggucucaaacuccugaccucagugauccacccgcgucgaccucccaacguguugggauuacagacgugagucaccgcgccuggcagacaaccaauuuuaaagcacucuuucuuugagcucuuuuucuuuaguaccaguacacacuguguagauauuuuuguuuuacuuacuaaacuguagguuaguaaucaauuuuaguaccuaccagacuguaagcuccuugaggacaaggaauuuggacauuucccuuuuuugaagaccuagcacaggacccuuaugaaaauaaccaccaaacagucuuaucaccaaguucuagaacuagaguagcaucuguccuauuaaaaacuacugauggcauaaauauaaaccuaaacuuacuccauuagagcacugacagauuugaaaucaacaaucaguauuucauacaauuuuaaaacuuuaauacuuuuuuaucuccaaugcaauauaaaaauaguacucacuuuggauaggaaaucaacuagaacuagacuguugacauccagcaacaaagcauagcccaacauaagaaauacagauuugcaacacuucgauaugugcuuugaacauugauaugccaaguagcaauagaaauaauuaucucuuuggauggaaaauguuaaugacuaaucauuucuuaaacuagacuggauacuuuuccauauagggacuaugcuauuccacguucuccaacauggauccauccauuuacuucuugccuuccaagguaccacccuaucccaauccaccaucacuccuugccuggaguauuucaauagcuuuuuuuuuuuuuuuuuugagacagagucucgcucugucgcccaggcuggagugcagcggagcgaucucggcucacugcaagccccgccacccggguucacgccagccuccugccucagccucccaaguagcuggacuacaggcgcccgccaccacgcccagcuaauuuuuuguauuuuuaguagagacaggguuucaccguguuagccaggauggucucgaucuccuggccucgugauccgcccgccucggccucccaaaguggugggauuacaggagugagccaccgccuccggccuucaauagcuuaacaggucaccaagcuuccacacuauucccacacagccucuccccucuugccaccggcugugaccucagacugaaaugcucuucccuggccccuccuuauccuucaaaucuuggcuuaaaagccuuuucucaguuucauugaccaggcuaucuaacauuuacgauucccccagcauaucauccauuuuauucuucuuuacggacucauuucuggcucguaguaaauguucaauaacgguuaagugaacugaaucucuaauuucuggucguuaauuuguagagaccacuuucccggauuuaaaaagugcaggugcucuggcagccuuaagucggugaaaacaagaauauuccgcaaaacaaaaauaacuuguuuauucaucaaaaacaguuaacguuacacuucuauaccgucaauucgugugugaacagaguugugucugauccaagaccuuacaguucaagcacuggaucccaauaaccuguaaacaacguuuuguuauuugcaaugcaauccugggcuaacuuuucaaaagucguuuuucucaauuucccguuaguuaaaggaauaaaaaaaugcuguccaacguggucaauggaccaaacaaacaaggacaacaaacagaagcgugagccauugcuaacacaacagcgaccaaacaaucaugcacuguaucaggcguguaaaaaucuggggggaaaggcuuagucuuaaggccuaagucaucggacacugguccucucccggggaauaaaacggccuccuccucugagagggaaauguccugaauuuucccugcagagggaaggucaccugcaagccuacauucgugacagcguucccgaggacccccugauccucaucuucuuuucugcuucaucagaccagagaccguggcuaaaagccccccaucugccggcucucaggggcuuccgaggcggcggggcgggaggcggcgcccagucaaggacaacagaagacuacgucgcgugggccaaaggaaacagucccgucaauaaauaagccucuggccgacgcaccucacccuucccauccauacaagaccucaccuucuccccggagccgcggaggcuguucugcuaaacugucuggaccacgacgacccccuaggaggccgggucgcuuauucaauauggcggccucggcuaacucugucagccgggccuggagaacggaaagcccggagggacuagaauccuugcauucgacaaguuugucggcaauuucc

SEQ ID NO: 191116 - RNA, 36441 nt, Homo sapiens
ggaaauugccgacaaacuugucgaaugcaaggauucuagucccuccgggcuuuccguucuccaggcccggcugacagaguuagccgaggccgccauauugaauaagcgacccggccuccuagggggucgucgugguccagacaguuuagcagaacagccuccgcggcuccggggagaaggugaggucuuguauggaugggaagggugaggugcgucggccagaggcuuauuuauugacgggacuguuuccuuuggcccacgcgacguagucuucuguuguccuugacugggcgccgccucccgccccgccgccucggaagccccugagagccggcagauggggggcuuuuagccacggucucuggucugaugaagcagaaaagaagaugaggaucaggggguccucgggaacgcugucacgaauguaggcuugcaggugaccuucccucugcagggaaaauucaggacauuucccucucagaggaggaggccguuuuauuccccgggagaggaccaguguccgaugacuuaggccuuaagacuaagccuuuccccccagauuuuuacacgccugauacagugcaugauuguuuggucgcuguuguguuagcaauggcucacgcuucuguuuguuguccuuguuuguuugguccauugaccacguuggacagcauuuuuuuauuccuuuaacuaacgggaaauugagaaaaacgacuuuugaaaaguuagcccaggauugcauugcaaauaacaaaacguuguuuacagguuauugggauccagugcuugaacuguaaggucuuggaucagacacaacucuguucacacacgaauugacgguauagaaguguaacguuaacuguuuuugaugaauaaacaaguuauuuuuguuuugcggaauauucuuguuuucaccgacuuaaggcugccagagcaccugcacuuuuuaaauccgggaaaguggucucuacaaauuaacgaccagaaauuagagauucaguucacuuaaccguuauugaacauuuacuacgagccagaaaugaguccguaaagaagaauaaaauggaugauaugcugggggaaucguaaauguuagauagccuggucaaugaaacugagaaaaggcuuuuaagccaagauuugaaggauaaggaggggccagggaagagcauuucagucugaggucacagccgguggcaagaggggagaggcugugugggaauaguguggaagcuuggugaccuguuaagcuauugaaggccggaggcgguggcucacuccuguaaucccaccacuuugggaggccgaggcgggcggaucacgaggccaggagaucgagaccauccuggcuaacacggugaaacccugucucuacuaaaaauacaaaaaauuagcugggcgugguggcgggcgccuguaguccagcuacuugggaggcugaggcaggaggcuggcgugaacccggguggcggggcuugcagugagccgagaucgcuccgcugcacuccagccugggcgacagagcgagacucugucucaaaaaaaaaaaaaaaaaagcuauugaaauacuccaggcaaggagugaugguggauugggauagggugguaccuuggaaggcaagaaguaaauggauggauccauguuggagaacguggaauagcauagucccuauauggaaaaguauccagucuaguuuaagaaaugauuagucauuaacauuuuccauccaaagagauaauuauuucuauugcuacuuggcauaucaauguucaaagcacauaucgaaguguugcaaaucuguauuucuuauguugggcuaugcuuuguugcuggaugucaacagucuaguucuaguugauuuccuauccaaagugaguacuauuuuuauauugcauuggagauaaaaaaguauuaaaguuuuaaaauuguaugaaauacugauuguugauuucaaaucugucagugcucuaauggaguaaguuuagguuuauauuuaugccaucaguaguuuuuaauaggacagaugcuacucuaguucuagaacuuggugauaagacuguuuggugguuauuuucauaaggguccugugcuaggucuucaaaaaagggaaauguccaaauuccuuguccucaaggagcuuacagucugguagguacuaaaauugauuacuaaccuacaguuuaguaaguaaaacaaaaauaucuacacaguguguacugguacuaaagaaaaagagcucaaagaaagagugcuuuaaaauugguugucugccaggcgcggugacucacgucuguaaucccaacacguugggaggucgacgcggguggaucacugaggucaggaguuugagaccagccuggccaacauggcgaaaccccuucucuacugaaaauacaaaaauuagccgggcgugaugacaggugccuguaaucccagcuacuugggaggcaagagaauugcuugaacuugggaggcggagguugcagugagucaagaucacaccauugcacuacaaccugggugacagagugagacucugucucaaaacacacacacauacugauugucaguggccaguauugccuaaguugaauucagcuuuaacuggcauuuguugagccccuacuaauagcucauugucuaggaaguauuguuuuccuccugcucuauaaguaaagaaccagaaacucauuuacccaacauuacucacuagcaggaaacagauuggauauuugcaauuucaguaucacauauucuuaauuaaugaaauuuaugaaugaaauuuccuguuguacaucaucuaugauaaguaugcagaauuuugugcuuaaaaccuauguauauguacuauuauucaauaauacuauugcaacuauugaaacuuuaauguugaaauuuuuuaauacguucuaaucacauaauuugccuuuuuucuuuuuuuuuugagacagggucuuauucugucacccaggcuggagugcaguggcaugauuguagcucacuguaaccuugaacaccugggcucaagccaugcucccaggucagccuccugugaagcugggaccacaggcgcaugccaccacacccagcuaauuuuuuuuuuuuuuugguagagaugggaucaugcuguguugcccaggcuggccucuaacuguuagacccaagccaucuuccugugauggccucccaaaguguugagacuacaggcgugagccaccucuccuguccaauuugcauuuuuuuuuuuuuuuuuuuugagacagaguguugcucugucgcccaggcuggagugcaguggcgugaucuuggcucacugcaagcuccgccucccggguucacgccauucuccugccucagccuccccaguagcugggacuacaggcgccugccaccacgcccggcuauuuuuuuguauuuuuaguagagaagggguuucaccauguuggccaggaugguuucgaucucuugaccucgugauccaccugccucagccucccaaagugcugggauuacaggcauuuuuaauaccuuuaaaaguuccaaaugauuuuggaugcucaaccuauaugaucaagugaauagaaggaaaguucagugcuuagccuauaugaucaagugaguaggaaaaaaaaaaaacucaaaaaguuuagaaguuuuggugacuuggccgggcgugguggcucacgccuguaauccuagcacuuugggaggccaaggcagguggaucaccugagguccggaguuugagaccagccuggccaacauggcgaaaccccaucucuacuaaaaaauaaaaaaauuggccaggcguauuggcucacaccuguaaucccagcacuuugggaggccaaggcagguggaucaccugagaucaggacuucaggaccaccuuggccaacguggcgaaacccugucucuacuaaaaauacaaaaauuugccgggcauguugaugggcgccuguaaucccaacuacucgggaggcugagaauugcuugaaccugggagguggagguugcagugagccgagaucuugccacugcacuccugggugacagagugagacugggugacagcaagaccccugccucaaaaauaaauaaauaggcugggcacaguggcucacuccuguaaucccagcacuuugggaggcugagcugacuggaucaugaggucaggagauggagaccaucauggcuaacacgaugaaaccccgucucuacuaaaaauacaaaaaauuagccuggcauggugguacacaccugucccgguuacucaggaagccaaggcaggagaaucgcuugaaccugggaggcggagguugcagugagcugagaucgcgccacagcacuccagccugggcaacagagcgggacuccgucucaauaaauaaauaaaauaaauaaauaauaaaaauacaaaaauuagccuggcaugguugugcaugccuguagucucagcuacucuggaggcugaggcaggagaaucgcuugaacccaggaggcagagguuacaaugagcugagaucgugccacugcacucacuccagccugggcaacagaguaagacucuaucucaaaaaaaaaaaaaaaaaaaaagggccgggcacgguggcucacgccuuaaccccaacacuuugggaggucaaggugggcggaucaugaagucaggaguucgagaccagccuggccaacauggugaaacccugucucuacuaaagauacaaaaaauuagucgggugugguggcgggugccuguaaucccagcucuucaggaggcugaggcaggagaauugcuuuaauccgggcgguggagguugcagugagccgagauugcaccagugcacuccagucugggugauagggcgagacuccaucucagaaacaaacaaacaaaaacaaauaaaaagaaguuuugguaacuuuucuguuuugugugucuuuaagucgugguguuuauauaaucgacacccauuuauuucaguaauucagcaagccuuuuagagcagugucucaacuucagcacuguugacacuuuggauaauuaucuuuauugugggggacuguccuguacauuguagaauagccagcaccuuguccucuacccacuagaugucaguaacuuccccuuguuugugacaacaguguguucagacauugcuaaauauucccuggggagcaaaauuguccucaguugagagccauuguuuaagagcuuacucugugccagccugguggauagguacugaagauagaaaaauucaaggaauuaaugcagugagggcagaacgggcuuauaaacacauaauuggaaaucuguaagauaaguguaccagaaaauagcaaucaagacaccucaaaggcuugggcuggugagcuaucucagaauaucucaggaacauuuaguagacagcuaugcuuagaacaugaaaugauagaauggguauugguaggaaauaaaagcagaaaagacaacuuuauuuuacauaaccauuaaugauaagcucacuguuagucuugcaguuuauuuuacugugugguagugcuuuaaguuugauccuuucuaugucauuuuuuuuuaaauggcaaaacugcucucugcauagaauuagaaaguccaaauguauacaauagcugcugcugcuuagcucuuugacauuguacaagucaguaucucugagacugagaauucucaucuacagacuaagugaaaauaucagaaccuaugaguguucaaugacauaauguaugugaaauaauuuaaagccauaaaacauuaccaaacaguuggugauuguuuuuuucccuacaauaauauaauucuuuguuuuauuuuuagcaauauguuaaggauaccuguaagaaaggccuuaguaggccuuucuaagucuccuaaaggauguggugaguauuuucuuaaauuugcauucguggauauuagaccuuauuuuuguaaauuuauaagucuauggcauaguuuaucaaagacccuaaacccaugauuuuuuaaaauaaaaauagaaaccggccgggugugguggcucaugccuguaauccuagcacuuugagaggcugaggcagguggauugcuugaagccaggaauucaaaaccagccuggccaucauagugaaaccccaucacuacuaaaaauauaaaaaucagcugggcaugguggggcacaccuguaaucccagcuacacaggaggcugaggcacaagaauagcuuaaacccgggagguggagguugcauacagccaagauuguaccacugcacuccagccugggagauagaucgagacuccaucuuggaaaaaaaaaaaaaaagaagaaacaaaugaucuaaguugaauaauuuucaaaauauaauuuuacuuuaaacaguuuauaggaauuaucauggaauagaaaguauuaggaacuacacacaucaaugccaaaauggaaaaaucacauucuguuuuugaaaagugaucuucccaugaacauauuuucagugacauuaagaguuucaguuuaaaguuggguaugguggcucacuccuguaaucucagcacuuugggaggccgaggcagaaggauuacuugaggucaggaguuugagaccauccuggccaauauggcgaaacccugucucuacuaaaaauacaaaaauuagcgggcgugguggugaguuccuguaaucccagcuacucggaaggcugaggcaggagaaucgcuugaaccggggagguggagguuguagugagccaagauggcgccacugcacuccagccugggugacagggcaagacucccucucaaaaaaaaaaaaaaaaaaagaagaagaaagaaguuucaguuuaaacuacucugcuaucaaaaguagacaaccauaaguuugcauccagagcaauacagaggaauaauaaggaaugaaaaauuuuagguuuguaguuagagucaauucauccauuaucaucugcuauaauaaacuguuaaucuguuuuucgcuucaauaucuuugauggucaguucgaacaacugccacagcagcaagcaacuugauugaaguauuuguugauggucagucugucaugguggaaccgggaacgaccguccuccaaguaggcauacauucuaacuauuuuguguguguguucugauuuuuuuaaaaauacuaauuuauuuccuuuauacugauuauuaguaaauaauucuuuaaaauaacuauacacagcaaaguuauauuaaaauuauuucauuuuaaaucuuggcacuucaaagugagcuaucauauauuuguuuguggcauuuuuagugaauuaugguaguucuuuuguuucacuuuucauuccaaaugaauacccauuaagaaauuugaaguccgagcgcaguggcucaugccuguaaucccagcacuuugggaggccgaggcgggcggaucauucaggaguucuagaccagccuggccagcacugugaaaccccuucucuacuaaaaauacaaaaaauuagcugcgcaucguggcgcgcaccuguaaucccagcuacucgagaggcugaggcaggagaauugcuugaacccaggaggcggagguugcagugagccgagauugugccacugcacuccagccugggcaacagagcaagacucugucucaaaaaaaaagaaaagaaauuugaaguaacuuaaauuaguuacuauagguaaguuugugaaaaaauaaccuccauuuguugugggccugcuuaaugcuuuucauuuucauauaaccuuucugugguuaguaauauucauaggaauauauccuacaaagcagguaaauggaggguagcaugugcuuacauucaugcucuaaauauuucuucauauuccuccagaaauaauaaauuggucauagagaagucaugcuucacuccauuuguaaguugucacagaucuaaauguucuuuguucauuuuagcagucauuucuagacuaucugccagucacagacaugaaagcacaaaauaugauauaaauguauguucaagguacagugaaaaguuguggcagggauaggagguaguagaaagagguauugggugccucaggucaucccugaggagguguuaaaggaugaacagguguguucauauugugaacaagaacgacaugcuugcauuuccuauggaaaaaguuaaggcagauagcuugucauauuuugaaagcuucaaauaguuuaauauugaugaaacauaagguauaaguagaagaugagaucacaggaaaucaaguuauugaggaagggaagguccagucaugaaauacaguaucugcuaugcagaagagcuuauauuuugauccaucaggaguuuuguugccuauuuaaacagggugacagcgacuguagaggaugaucauuuggagaauagcaagacuggaauaagagacaaggaaaaagcauuuuguauuauugggacaggauacuacaaaagcccuaaaauagauagugucaaugggaaugaaaacaagagaguagauucaagggagaaugaaauguagacaggccuucaggaaugaugaagacccgagggauuuuuucccccgucguacagaacuucccaauauugcuuuaacagugagaaaaaaaaaacacaaaagaaguuucaguagagccacagacaaauaguucuuuagaacucaaagagaccggaggaauucuugugguuuucugcauuuguuagguuauuuuggaguguauagaggggagagaaaucauuugaauuuaagcugucuguggaacauacacaugcaaauaccuguaaaucugaagcuuggagaaguggaggucuaacauggcugcagauuaagguuuggacauaaucagcauaaggaaugucagcuaggaugaaggcugggacacuaucugucuuuuucacuacuauaccugcauccugcacaaaggaaagacucaacacauuuuugcuaacuaaauaguuuaaacacuggaaauugaugagauugcuuuagaaugaaggcugaggaugaggaacuaacucuagaggaaauuugaacauguuuauagacuaaaaggaggaagaaauugcagagcaggguaggugauaauuggcagagcagggauaaucccccuuacugggcaaacagaaacugggaaaaccuucagccacagugggaggugaguccuggguagcauauaggagccaaagacagauagccagcuagauaauguguagugaaaucucuaauccaaaggaggggagcgaggcaaagaagaaguccagguaugaaaccacuggggacauuguggacaaugguucaaaauggaugugggaagucaagucuucagcacaguggaaggauacuuuauccaguuucuuccacauaaggugaagucacgccaaggauccugagauccucugaggcagcuucagaggagacggguuagaaucaaaggcaaagaaagggacugaaauaagaaugaauuaagauagauagauagauagauagauagauagaaguaauaagaugcuguauguguguguuucagcaauaacagcagugaagucagguuauucuaaugcuuuuuuuuuuuuuuuuuuuuuuuuuacuucuaggcuugugagaagguuggcaugcagaucccucgauucuguuaucaugaaagguugucuguugcuggaaacugcaggaugugccuuguugaaauugagaaagccccuaagguacuugauaccuaaaauucuacaccaugcuguagaagguagaaaacuuuaaaucuugcagcaaacuuuauuuagaaucaauaucguaguggagaaccuagcccucuuuacuucuaucuauaaauuuaauucuuuuguacaauugauucucuucauuucaaaacuggaaacacauagauagaagugcuuuacaaacacaugucauauaauuguaacauaucuagaaauuaaaggugauuuauaguugucaguauuuccaaauggcuguauaauauauaaccaggauguagaguugccaaguagcacauuaaaagugcugacgcccugccauuuuuaguagagaaaaggguugcagggaagaaguucacuuucaguaguuuaauuucauuuugguguaugcaauuuuuuuauucaauagugccugcuaaucaaagcaguuauuugguguucuguuucagagcagaauaaaaaauugcauugacuauuagaauaaaccuaaaaaccaggauguuuuauuucugagauaaaugcaaaguacuagaucaucguauuaugaauaugaaaacuuaacaaaauucaguuuuaaaaaauacccuauucuuugccuguuaucaaauguauaauuuaauguuuuuauauaauuuaacauuuuuauauauugaguugcuuguaaucacaaauaaauacaaauacacauuuuuuuuuuucauugaaaucccagguuguagcugcuugugccaugccaguaaugaaggguuggaauauccuaacaaacucagaaaaauccaaaaaagccagguacuuuauuguuauucaauguaguacccuuucauaaagcagaaaauugcacauuuugguauuuagaccuucccauagauuaagaauuuaauaucaaacucggaagaaguuggugugcucagcuucuaggagcaauagaagugaguacuacauaguagagaaggugaagucaggaguuuaugguauugagcuuuaggaucagcauuaaaaauccuucuuuaguaacuugcucaacuugugaagaagggugaaucuggacuuacuaagcuacuacuauacuauacugggauugauuguguuuguuuuuauuuugaauuaaugugaauauuuucugaggaccauucagcaacuuuugaucauucgguauuguuaaaaguuacaauuuucuuuauuuuuugaaacgaggucucacuauguuguccaggcugggcuugaacuccuggccucaggugaucauccugccucagccucccucccauaguucugggauuacagacgugagccaccaaaccugaccaaaaaucauaauuuucuauguucucuaaugauacuuuauucuaggcuccucuaagcauuuuccagauuguguguuuaauacuaccagaaugauacucgggaggaucacuugagcccaggagcucgaguccagccugggcaacauagcaagaccccgucucuuaaaaaaaauauuaccacaaugauagauaauuggcauuucugauauuaaauguaaaauuacuauuaauuguauaacaaauauacaucuaugaagguuguuuaaauggccuauaugugggccuggcacaguggcucacgccuguaauucuagcacuuugggacgccagggcgggaggaucacuugaggucaggaguucgagaccagccugaccaacaugaugaaacccugccucuacuaaaaauacaaaaauuagccaggugugguggugggcaucuguaauccuagauacucgggaggcugaggcaagagaaucgcuugaaccugagagguggaggcaggaggcugcagugagccaagauugugccacugcacugcagccugagcaacagagcgagacaccaucucaaaaaaaaaaaauaaagucuauaggucauuuugagugccagcaguuaaugucaguguguguguauuugagagucauuuuauauguuacaauuuucauacagggaaggugugauggaguucuuauuagcaaaucacccauuggacuguccuauuugugaccagggaggugaaugugaucugcagguauguaguagaauucugucaaucuuuuugguugucucagauuuuaauuuuauuagcagcaugagauugacucuuucauaaucuacuuaaggaccaguccaugauguuuggaaaugauaggagccgauuuuuagaggggaagcgugcuguggaagacaagaacauugggccauugguaaagaccaucaugacaagauguauacaguguacucgcugcaucagguaacuuuuuuuccuuuuuuuucuauuauagaauauaauuguauacuuaauagucacaauuugaugaauaauaacauuggaaagaauggcuacuuuuuuugggugggagaagagggaugcuguuucugauauaugaauaaaauaaguucacuuucauuuaguaccaacuucagguggauuuaaaaauuaaaaucuauaagcauuugcuuucacucauaacuuggugaguuguacacauaugauuuguacaaguuucugccuguguguuacaccucaauuaaaugcaaacauuucauuauuuuuuauucuaggacugugcucaccuuuaaaaauauacucauuucuuuuuaguguuuggaaaaucaucucuuugugaucaugaauaagaaaggaaauaauuuugcuggacuugaccauugaugacacauuuuuuaucuuguagguuugcaagugagauugcaggaguagaugauuugggaacaacaggcagaggaaaugauaugcaaguuggcacauacauugaaaagauguucaugucugaacugucugggaauaucauugauaucugcccuguaggugcccuaaccucuaagcccuaugccuuuacugcccggccuugggaaacaagguaucuuuuauuuuaugacaauuuguuuuuuuguccuuaauucauuacuauucaaaaaaauauuaagguucauuuucuuccuggguuucaguuguuuuggucuguugacuuuguuuguuuauguaaaacccuuuaaauagaagguaaguaguuagaauggauugaaccugugcaaauuaacuguaguuuucuuggaaauuaauucuaaaguacucaaccacaaaauuauuuuuuucauguguucuuccaaagaguuuaauaguguugacauuuuaaauguauagucucccauguuguuguuuauuaaguuuucaacuaugaggaaugucauuuagccaguuucugcuaauagacauuuagcuuguauauuucuuuaugauuacaaaucuguaaaaaauauugcuguuuacacauuucuguguauaucucucauucuccugauuaaaccaagaaauggaguagauagaugcaagaggugugauuauuuuuaagguucuuaaaacauaacaaauuaucauccaauuuuaaacuuuauacuuuucaacuugggauuuggcuuuuuguuucuguguaauuucuguguccuuacugagaaucucuacuugcugauucgugguugucauacauccccuucaauuuuuaaauaugauuuucuuugguucuuucaacauauuuuaauauucuugguuuuauuuuuaagugaggcuucuuaggaguuccccugugucugcauaguuuaguagucagguauaauuguacuucaaacaccgugaccuaauaagaguuauguucuuugccaauggaucuguuuguggauggaggagcauauucaaaguugaggcuguuuucaaguuugcccagcuauuacuuugcacugggcccuuugggucucagaguuauccaggaguuuaugaauagguugagcuuucucugguuucaccugcacauguagcagccucuguuaggaaugcuugccgcaauuaccacuacaaacuuaggcugguaaaaucuuggcuauccucagcuacgaugaccuccaaaguaucaccuccacaaacaaguuugccucgugcuccaaguuaagugaguugucuccaucuguaccaaagaaguucucaucuucacagccugccccggccucgaagaaauuccauuuugaggggguggagaggagcauaggaggagcacugagcccagccaccaguuuuucagugcauaaaagcuucccacauuguauguguuuagauuucuaaacugcugaaaugguggguuuugucauuuuuggccagcuuuacuuuugcuuuucagugggaagguuuuuugagcuccuuaaucucccauagacagaaauccugccccucuuguugaaucgucccagauuuggcuaguuggagccccuucaaacuagcuucugugucagauaauaguuuuaaagccuuccuuacugugccaggaauuuauguguucaaaugugggugugccgggagcaguggcucacaccuauaaucccagcuuuuaggaggccaaggugggaggauugcuugagaccaguaguucaagaccagccuggucagcauaaugagacaccggcucuacaaaaaauuuuuaaaauguggugagaggauaguuugagcccaggaguucuaggcugcagugaauuaugaucaugccacuguagccugggcaacagagugagaccccagggcaaaaaaaaaggugggggguucuuuuauuuaauugcaguuccucuaagcuucauuuuuuaaaguaauucagaaagggaauuaauuguaaaaaaaauuuuuugguaaaccagguaacagaaacuuucuuuauucccaaaagcaccauaguaaacaccguauguguuucucagaaagacagaauccauugauguaauggaugcgguuggaaguaauauugugguuagcacaagaacuggagaagugaugaggauuuugccacguaugcaugaggacaucaaugaagaguggaucucugauaaaaccagguauaugcuauauuguuuuccuuaacuuuuacaguuuauuuaaaggaaauuuuauaauaauuuugaagaauuaucuuuuauauuugcaaauuaguuacugaauauagacuacuggaaucugaguugcuuauauaaugugauaauacugacuuuaauaguccuaggucaaucccuggauauuguauuuacuuugagaaagauauuuuuuccucccacauggagaaauucaaguagauugauacauucucaacuuauuucaguuuguucauuagagaaaagaagcuaggcugggcgcagugacucacaccuguaaucccagcacuuuggaaggccgaggugggaugauugcuugaaaaagaagcugaauagaagaguuugcacaauauaauuuugauaaaauauuuagagauacucaugcuuuguaaauaaaaaugauuugacuuuuuuagcugucagauuuuuuuguguuguaauuuuaagauuguucaguuagcugaaaguauaagaaaucaaacuuuuuuuuguaugauuuaagggaagaaaucaaacuuucagaugguauuuuaguuuuaggugaaguucauaaaaucuauuaguucaucucuaaaaauaucuggaauaauuacuuguaucuagguguuuagauauuugacacuuuaaccaguacuguauuuaaauaacauuucuuguugauuuaacuugaaaauuauaguuacuucuuuagcaagauuccacaaugguguaauuucuguuuucuagauuugccuaugaugggcuaaaacgucaaagacuuaccgagccaauggucagaaaugaaaaagggcuuuuaaccuauacuucuugggaggaugcgcucucucgcguagcuggaaugguaaaauuugaaauaaauaguguuaaauaguguuugugauuaucaagaaacaucuuugccaugaagggggggauguauauuucuucccuuuuuuacuuuuaccaagauuaugauuuaaucuccuuccauuuuacagacaucuacugaggacauaugcuagauauuaugcuauuaagggauauaaagaccagagacacaucauuccugcauccuacaaucuuguaguagagaaaguugcacaauucagcaauuauuauaugcagcuaugaguaauuauauaaggaguaauaugagugagagcacguaggaggaaugccuaacuaggacaggcauaucaagaugccuuccuuggagguugcagugagccgagaucgcaccacugcacuccagucugggugacacagcgagacuccaucucaaaaaaaaaaaaagcugccuuccuacagaaggugauucuuaaagaagaaucugagaaugaauauaagcuugccagaguacaaguggagggaauaguuuucuuguuagagaaagacaacauaaagcacuagagggaaaggcagauacuucagaggaggucgcauuuaagguaacuauaguuccacuucauucuccagaccucauuuugaagugccuuuguuccuaaauauaaaacagcuuccuucuaaguugauguuauuagcuguggccccacauaacaccucugcagcuuuucacuuuuagauuaauuaauaauuguuguacaacuuuuuuuguguuuuugagauggaguuuugcuguugucgcccaggcuggagugcgguggcgcgaucucgaucucgggucacugcagccucugccuccuugguucaagcaguucuccugccucauccucccgagcagcuggggauacaggcguaugccaccaugcccagcugauuuuuguauuauuaguagagaugggauuucaccauguuggcuaggcuggucuuaaaguccugacugcaggugauccgcccacuucugccucccaaaguacugggauuacaggcaugagccagugugccugggcauguuguaaaacuuuuaaucagaagucuguuaacuuuuuuuguacuugaaaacaaguacuguuuuauuuucugaacauuucauuguggucuuugcugcguguagguuucuuggugaugcccuuuucaucuguuucuaguugcagaguuuucaaggcaaagauguggcagcaauugcagguggcuugguggaugcugaagcccugguagcucucaaagauuugcuuaauagaguggacucugacaccuuaugcacugaagaggucuuccccacugcaggagcugggugagaaauaugaagcuaggaucuaggcuuuccuuucuuuuuuuaguuacaaguuauguauaaaaugugacaaccuggauucuccaacauaucccccaguuuauuuucauauauagaccaagaucaaaccagaaguuguaggaaauagaggaauccacuuaucacuaaguaucucaggcacaguggcucacgccuguaaucccagcacucugggaggccaaggcaggcagaucgccuaagugcaggaguuugagaccagccuggccaacauggcgaaaccccgucucuacuaaaaauacaaaaaaauuagccagacgugguggugugcgccuguaauuccagcuacuugggaggcugaggcaggagaauugcuugaaccugggagguggagguugcagugagccaggaucacgccacugcauuccagcgugggagacagagugagacucuaucugagaaaaaaaauaaguaucugaaauguucauuuaauuuagaaauacuucauaaaauuuuuuguuugagaaggcaauggguuugaugauaggagaauauuucauggauucucuguaugucuuaauuuuaaaguaaauuugcauuuuauauauuguauuucuagcacagauuugcguuccaauuaucuucuuaauacuacaauugcugguguggaagaggcagauguuguucuucugguugguacaaacccacguuuugaggcaccacuguuuaaugcuagaauucgaaagagguugguaauaguauuuauucaagguuuaaaaauauuuauguaauuuuuuuguuuuauaugugaaaaauggcaucuuccuaauaguguuagugguagugagacuccaaaagauaacuggaagacaauuuuuuuuuuuuuuuuuggugggacggagucucacucugucacccaggcuggagugcaguggcaggaucucggcucugcaagcuccgccucgagaugggguuucaccauguuagccaggauggucucgauuuccugaccucgugauccgcccgccucagccucccaaagugcugggauuucaggugugagccacugcaccgagccuuuuuuuuuuuuuaauuuuuuuaauuuuuuagauuuuuaaaaaauuauuuuuauuuuuauuuuuuauuuuuuugucuuugagacagagucucgcuuugucgcccaggcuggauugcaguggugcgaucucggcucacuucaagcuccgccucccggguucacgccauucuccugccucagccucccgaguagcugggacuacaggcgcccgccccugcacccagcuuauuuuuuguauuuuuaguagagacgggguuucaccguggucucgaucuccugaccuugugauccgcccgccucagccucccaaagugcugggauuacaggugugagccaccgcgcccggccuuuuuaauuuuuuagagauggagccuugccauguugccaggcuagucucgagcuccuggguucaggccauccucccaccuuggccucccaaaguacugggauuacaggcaugaacugccacgcccaguugcaacaauuucuaauagguccguuuucuccucuccuugcgagucuuuuaaauuuacuuuauuagcuuuuuauuuugaaauaauucaagaugcuugaaauggucuuuguauaccauuuuguauauuguucacauagauuaacugauguuaacaucuugccauauuuguauuaugauucucaguguguguguauauauauauauauauauauacacacuacauauauaugugugugugaaucuaauuuucugaaucauuuggaaguuucugguggacauggugcccuuuuauaccuaaauucucagcguggauuuccugagaacaaggagcauucucuuaaauaaugaagaaauuuaggcugggcgugguggcucacgcuuguagucccaguacuuugggaggcugaggcagguggaucaccugaggucaggaguuugagaccagccugaccaacauggagaaacccaucucuacuaaaaauacaaaauuagccgggcaugguggcgcaugccuguaaucccagcuacuugggaggcugaggcagaagaaucgcuugaaccugggaagcgaagguuguggugagccaagaucaugccacuguacuccagccugggcaacaagagcaacacuccaucucaaaaaaaagaaauuuaguuuuuuugguuucugagaucucaguuucgggucacuguauccucugccuccuggguucaagcaauucuccugccucagcugccugaguagcugggaauacaggcauaugccaccacguccagcuaguuuuuguguuaggggucuugcucugccacacaggcuaagguauauuagcaugaucacaccucacugcagccuugaccuccugggcucaaaugaugcucccaccacaaccuccugaguagcugggacugcaggcaugcaccaccaugcccagcuaauuuuuuaaaauaccuuuuguagagacaggaucucccuauguugcccaggcuggucuugaacuccugagcucaaguguuccuccugccuuggccucugaaagugcugggaguaauagacauaagccacugcauccagccagaaauuuaguuuugauacaauauuauuucauaagccuacguuuauauuuaaauuucauugauuuuuuuuuucauaauuucuuuuauagcaauuuuuuuguuuccucaggauccauucuggagucauacauuacaauuaguuucaugacucuucuggucccuuuuuugacuuuuuuuuuuuuuuuuuuuuaagaacacaagccaguuauuuucuagcaugcuuucugucuuuuaaauuuacaucuuagagauuuauaaagaggguaaccauauaguuuauugucuaaacuacgggagugaaagagggaauuaauaauuacaucaggauaacagggaaaaaaaaaagcauuaucucagacaaaccagacuauauagucauugcacuuaugacuuuuuggaggaacuggagccauaguucccugcuguggagaauaaaugucaauaacaugguauauuuucaugaauuaugaaaauguuuaaauauccuuaauggauaauuaagagauaauugacccugucauguaaauacugcaaaauaaaaauuacagauuaauucuaaaauuaaaauuuuuuuaggccgggcacaguggcucaugcuuauaaucccagcacucugggaggcugaggcggguggaucaccugaggucaggaguucaagaccagucuggccaacauggugaaagccugccuucuacuaaaaauacaaaaauuagcugggcguagaggcaggugccuguaaucccagcuacuccggagggugaggcaggaaaauugcuggaacccgggagguggagcuugcagugagucgagauugcgccacagcacuccagccugggugacagagugagacucucucucaaaaauaaauaaauuaauaaauaaauaacuuuuauagcuggcuuacuagcauuucuuucuuuuuuuuuuuuuuaaauuuuuuauuuugagguggaguuuugcucuuguuacccaggcuggagugcaguggcccgaucucagcucgcugcaaccucuaccuccuggguucaagcgauucuccugccucagccucccaaguagcugggacuacaggcaugcgcuaccauguccagcuaauacuguauuuuuagaagagaugggguuucaccauguuggucaggcugguuucaaacuccugaccucaauuaauccaccugccuuagccuccuaaaguguugggauuuacaggugugagccacugcgccuggucuggauagcauuucuacacagcaaauuaaaucacugaauugccuuggcaugccuuuuugcaacacuguuuugaaagguacguaguaaaucauaucuguuaaauguauugucugugcuuuuaacauuuuguaauaguaaauagauguaucacuuaggauugaugagaccaguaacugcuuagcuuaguuauuuacuucuuaaaauguuguuuuuauuucagcuggcugcauaaugacuuaaaaguggcccuuauaggcaguccaguggaccucacuuacacauaugaccaccugggagacucccccaaaauucuucaagacauugcuucgggaagccauccauuuagccaggugcucucaacuuauguguaucuacucuuguugauuuuuaauuauuauuauuuaaacuuaacuguuuuuguaauaauccuauguaaguguuaaaacuuacaccagguugggcgcgguggcucacgccuguaaucccagcacuuugggaguccgaggcagguggaucaccugaggucaggaguucaagaccagacugggcaacacggugaaacccugucucuacuaaaauacaaaccaaaguuagcgugcgccuguaguaucagcuacuugggaggcugaagcaggagaauugcuugaacccaggaggcggagguugcagugagccaagauugugccacugcacuccagccugggcaacagagcgagacucugucccacccccaaaaaaacuuacaccaauacagaaaagaacaugaggaagaaaguaaaacauuaccuaaaauuccaccaccccaaaacagguauugauaaaacaucauaaucucuccauuuauguagagagcaaagcaagauggaugaauagucaaacaaaaaugagaucauacuguacaugcaguuuuuauuugccagaguuuaauuuucuugaaauuaucugaaaagaaaucaaaguaaaccugaaagaauugcacuuuuaacuucauuuaaaucuuucuuuauuacaaaaggaguuauuccuuaaaauuuuaccaguccuucuauuuuuguuucugagguacauguuuuuuucauuugaguucuuucuuuaauucauuuuguuguuggcuuuauuguuuugcuuuuccccaaagguggcucaugguugccuguauuccuugaguucuugcuugcuugagaaugucuauuccugaagagacagcuugucaggaugugaaauuccagggucagacuuuuuuuuccccccuuucugagcuuuauagacacugccuuuuguuagugaagaagcauguaaacuuuauuccuccgccccgccccaaacccuguccugauuaucuuuuuuuuucuuuuuccuuggcggggagacgaagucucgcucugucacccaggcuggagugcaguggcacgaucuuggcucauugcaaccucugccucccggguucauucuccugccuuagccucccgaguagcugggacuacaggcacgcaccaccacaccuggcuaauuuuuguauuuuuaguagagacgggguuucaccauauuggccaggcuggucuccaacuccugacuuugugguccacucgccuuggccucccaaagugcugggauucugauuaucauucuugaaauucaguaacuucaccaaaauaugucuuaaaggugaagacaucacuauaagacuauaggacagaauguacuuucagucuaaagauacaagguucucuuuauuuuagaauauauguguggugguggaggugauuaaaaaacuaaggaguuggccgggcaugguggcucacaucuguaaucccagcacuuugggaggcugagguggguggaucaccugaggucgggaguuugagaccagccugaccaacauggagaaacuccgucucuauuaaaaauacauaauuagcugggcaugguggugcaugcauaaucccagcuacucaggaggcugaggcaggagaaucgcuugaaccugagagguggagguuguggugagccaagauugcaccauugcacuccagccugggcaacaggagugaaacccugucucaaaaaaaaaagaaaaaaagaaagaaacuaaggaauuuccggccaggugcaguggcucacaccuguaaucccagcacuuugggaggccaagguguauggaucaccugaggucaggaguucgagaccagccuggccaacaugguuaaaccccgucucuacuaaaaauacaaaaauuagcuggguauggugaugggcaccuguaaucccagcuacucgggagccugaggguggagaaucgcuugaacccagaagacggagguugcagugagcucagaucaugccacugcacuccagccugggcgacagagcgagacuccaucucaaaaaaaaaaaaacaaaaaaaaaaccaacaacuaaaaacuaaggaguuucuguuugucacacaagggggucuggagguaggcacauugaaagcugaugcaggcugggugcgguggcucaugccuguaauuccaguacuuugggaggcugaggcgggcggaucacaaggucaggaguuugagaccagccugaccaccauggugaaaccccgcuucugcuuaaaaaaaaaaaaauacaaaaauuagccgguuguaguggccuguaaucccagcuacuugagaggcuggggcaagagaaucacuugaacccaggaggcagagguugcagugagcugagauugcgccauuggacuccagccugggugacagagugagacuccaucucaaaaaaacaaaaagaagaaagaaaaaaaaaaaaaagcugaugcaguuguccaagcauaucaucaaagagagccugccuuccugcuuugcugucgucagugcauuugcuugcucacaugugauuguguguguccuucuccuugugguuccaagaugguugcuucacuuacagucucagguguagggaagaaggugaugugcaagaggaugaaguagcaaagcacaacuuguuuauuuugaauagaaaaaaaauuaugauuaaaagaucaaaaauauuaaaaaauauuccgugaaaagucuuccuuucuccucucuaauucccauccccaugugauaggugacuacuauuuugagagaacguuuccuuuucuuuuuuucuuuuuucuuuuuuuuuugagacagagucuugcuguguccccaggcuggagugcaguacgguggcaugaucucggcucacugcaaccucagucugccagguucaagcgauucuugccucagccucccgaguaccugggacuacaggcgcacgccaccaugcccagcuaauuuuuuuauuuuuaguagagacaggguuucaccauguuggccaggauggucucaaucuccugaccucgugaucugcccgugucggccucccaaaguacugggauuacaggcgugagccacugugccuggccugagaacguuuuguucuauaauagauuuaaauacauuuuucauuaauucuguuaccuucauuaagaacucuugaugugguggcucacaccuguaaucccagcacuuugggaagccaaugcaggcaaaucaccugaggucaggagcaagaccagccugggcaaaauggugaaacccuaucucuacuaaaaaauacaaaaaaaccccaauuugcuuggcaugguggcgugugccaguaaucucagcuacuugggaggcugaggcaagauaauagcuugaaccugggagguggaggucacagugagccgagaucaugccacugcacuccagccugggcaacagaguaagacccugucucaaaagaaaaaaaaacaacucuugacaaugcaguugucgaaucuucuuuucuauauauguauuuuuaaggucucacuauguugcccaggcugcagugcaauggcagaauuguagcugacuguagccucaaacuccugggcuuaagcaguccucccaccuaagccuccccuguagcugggucugcaggcauacaccaccaugcccagcuaauuuuuauauuuuuuuguauagauggggcucauugugaugcccagucuggccucaaacuccuggccucaagcaauucucccaccucagccuucuaaaguguugggauuacaagcaugagccaaccuugccugguuuuucauaucuguguuuuuuuccuuuuuccauuuguuuuguauccuguacccugucuuuccuguccuuguauuuaaucauguuuucuuucuuuucugucuuuuuuuuuuguuuuugagauggucuggcucugucacccaugcuggagugcaauggugcugucuuggcucacugcagccaccacugggaccacaggugcacaccaccaugccuggccaauuuuuuguagagacgagguuuugccacguugcccaggcuguacuugaaccugugggcucaagucauccacccacuucggccucccagaguguugcgauuacaggccugagccacugcaccuggccuguuuaguuuuuuauuguuucuggaaugguauuuauuacuuguuugucuuccaguucuauccugaauucaaugaugaaaaucuccuuacuauauaauacucuacaguguugcuucuuugaguuuuuaagugagaaagaguguguuauuuuucauugucuuugagacuauuaaaaacuauuucucucaacuauucacauuuccuuggcaaauuccucuugugauuaauguauuccucuuuauaauauaucagcauaauuuccaugcugauucuuugauuguggccagcuauuuauugaagaaugacacaaaggaugggugggagaaugagacguguauucuauaacuuuacacguuuuguuuuguuuuguuuuugagacagagucucacucuguugcccagacggagugcaguggcacaaucuuggcccacugcaaccuccgccucccagguucaagcaauucucgugccucagccuccuguguagcuggggcuacagguacauaacaccgcaccugguuaauuuuuuuguauuuuuaguagagacgggguuucgccguguuggccaggcuggucucgaacuccuguccucaagugauccacccaccucagccucccaaaguguugggauuacaggcgugagccaccgugcccagccuauaacuuuacaucuuauuugcccaucuucugugaaauuuguaguuuccuuuacucuugggaugcauucuccuaguuuuugucauuuagaguuacuaugguuuaaaacaaagccuuaaaauuguagguauuuaacauugugaucuggugaucauugcuuucccugccuccuccucccuaucuguggcaugguaaguagauggaagauaguaggcaugauacuuaagcauaguuuuuccuauucuuuaauuaacaucugaaucucuggagagaaguuccccaauuuuucugggaccugcccauaguuauucugaccacaggauaauuugcuaggcuuuuuauucugaauaauuacuuuuagaaaacguguuuuagcugauacucaggcauauuucacaguagcauuggcaagaugcuuuggauuaaacuaaaucugguuguauaugugugucuguauguugggcuaacaaauugaagacauucauguuacaccuaagacuugggacaaccuauauuauagaggcaaauaugguuugguguucagcuuacuuguaauauuuuaaaaucaaaguuguuuuuuuuuuuaaauagguccuaaaggaagcuaaaaaaccaauggugguuuuaggcaguucugcacuccaaagaaaugauggagcagcaauucuugcagcuguuucuagcauugcacaaaagauucggaugacuagugguguuacuggugauuggaaaguuaugaauauccuucauagguuuguugaguaauugcuuuauauacuauaaauucaaguaauguuguguauauguauguguuccugauacacuguuaaauuuaauuuacaaacaacauuuagcaacauuaucccaguuacacaugugaaauauagaccuuuacucugugugagaagagcccgagaugauaaggaauauuuaaaauauuugaaauaacagugaguguugagaaaaaaagugaaguacuauaaaaauuguuauauuaguuacaccuugguucaaaaauugcaacaaguucuuuaauuaaaugauaaaaauguaagcuaauaugagaauucagcuaaaggauuucuuucuuucuuuuuuuuucuuuuuaauuauuuggcuuuuuguuuugagacagggucucaguacaguggcaugaucauaguccacugcagcccugacuuccugagcuccagcgauccucccaccccugccucccaaguauuaaauggcugaagcuacaggcgcaugccacaugcccagcuaauuuuuuguuuuuguagagauaaagucucacuauguugcccagguugaucucaaacuccugggcucaggcgauacuucugccucagccucccaaacugcugggauuauaagcgugagccacugcaccuagccuuuauuucaaaccauaucaauaaugcagguuuaauuuagguaaguugaaaagagacagauaugugcagaaauggaacugauccuuauucuacaauguguagauaauuauuacuauuuucaugcauuuucuucuaguuuuuuucuuuacccugcguaauauuuuauuuuauuuuuuugagaccagagucucacucuguugcccaaucugaaguacaguggcaugaucuuggcuuacugcagccucccccucccagguucaagcgauccuccugccucagccucccaaguaagcugggacuauuggcaugugccaccacaccuggcuaauuuuuuuauuuuauuauuauuauuauuauuauuuuugagaugaaguauugcucugucacccaggcuggagcacaguggcacgaucucggcucacugcaaccuccaucccugaaguucaagcaauucuccugccucagccuccugaguagcugggacuacaggcgcgugccacuaugccaggcuaauuuuuuguauuuuuaguagagacuggguuucaccguguuagccaggauggucucgaucuccugaccucaggcgaucugcccaccucagccuuccaaagugcugggauuacaggugugagccaccacgcccggccuaauuuuuuuguuuuuaguagagaugggauuucaccauguucgccaggcuggucucaaacuccugaccucaggugaucugccacccucggccucccaaagugcugggauuacagauacgagccacuucaccucacagcuguguaauauuuuuuaguuacauaggugaaauuauacugugaauacaauuuuguguccugguuucaauagguuuucauugccaaaugagaauuuccuacuauggucagaaauuuuuuucuagaaauuguuuguaaauaaaaauguuaauggcuaauugauaucaugaauauacuauaaauuuuuuuagccauuuucuucuuuuuaacauguauguugaugguaguuuuuaacuucuuaaauaauacagugauucacagauaccuuugcacuugaaauuaucuucuuaggauauauuucuaaaaguagaacuauuggggcacacaggauaaccauuucugagccuuucgaagcaugcuuccaacuuguuuuagguccucagaauggcuacuauuucuagauaguuaacaaauaccaagcuaaaccaaaacaacaacccugcuauucaaaguauauuuauuccagaccucuucuuuaaaagauuauuuugugcuuauaagaguaauauauauucguagaaaaaauuucuauaagguuuugguuuucucauuaugguuuuugcugaauuacaguuuaaugagugguuuucaauuucucccuuuucauuuuugaaauaaucugauuuuucuucuuugaauauauaugacuuaucauguuuuaugucuuacuuuauugaauaagaaucagacuuaaagcaauuacaguuggcauaaaauuucuagaauuauuucauucaauacuaugucauggagagacagagcguccuaagaaucugacauuucuuugguugccauucucaaaacaguaaaagacugcuguuucugguuuuagcaucuauuuuaaauggguaagaaugggauuuuuuggccaggugugguggcucacacccguaaucccagcacuuugggaggccaagacagguggaucaccugaggucaagaguucaagaccagccuggccaacauggugaaaccccaucucuacugaaaauacaaaaauuagccgggugugguggcaugugccuguagucccagcuacuugggaggcugaagaaggagaaucgcuugaauccaggaggcagagguuacagugagccgagaucacgccacugcgcuccagccugggcgacaaagugagacucuaucgccgagaaaaaaauaaaauaaaauaaaauggguuuuuugacauuguugaaaggaaauuauuccaaaaaucacauuuaauuuuuuacauugaaaauacugcaguuaugguaaaauuccauaauugcuuugcaggauugcaagucaaguagcugcuuuggaccuuggcuauaagccugggguggaagcaauucggaagaacccucccaaggugcuguuucuccugggagcagauggagguuguaucacacgacaggauuugccaaaggauuguuucauuauuuaucaagguaaguaucaccugugacaccagaaacaaaagagaguaguacauuauguauguuagaaaccauuuaguaauauauuuagugaacugaauguuuuccauuugagaauuuugccucccccacuccuccuccuuuuuuuuuaaacaaaccacaaguguuauuaguuacauaauugauacugcuuuuaagaauuauuaccugccgggugcgguggcucacaccuguaaucccagcacuuugggaggccagugcggguggaucaccugaggucaggaguucaagaccagccugaccaacaugguaaaacccugucuguacuaaaaacauaaaaauuagccgagcgugguggcgggcgccuguaaucccagcuacucgggaggcuaagacaggagaaucacuugaaccugggaggcagagguugcagugagccaagaucaugccauuguacuccagccuaggcaauaagagugacauucccucucaaaaaaaaaaaaaaaguuaaaccaaaauauaugaacuaaauccuguuccuugggugccguggcucaugcuguaaucccaccacuuugagaggcugaggcaggaggauuuguugagccuaggaguucuagaccagucugggcaacauagggagacccuguuucuacaaaaaauuuaaaaauuagcuaggcguguugcugcaugucugugaucccagcuacuuaggaggcugaggugggaggaucacuugaguucaggaguuugaggcugcaaugagccaugaucacgucacugcacuccagccugggugacagagcaauaaaaaauguuauuuuuaauaaaauuaaaaacaaaauaaacuaaaauccuguuuuuaguccuuuaagaaauaaucauuguugaguuuugauaugcguacuucauaacaucuucauacgcauauacaaaugugcacaaauuauauuaaacuauauauuauucuacgauuuucuuacacuugauucagauguuucuaaaggucuucuuuucugaauaacuuuuuucuucugccaguuguuauuaauggguggcaguguuuccaaauuuuucuguaguuuuucguuuaugccuuuuucaguauuacugucauauuccugucuuugcauccucccccauuucagucuacuuuaccaaauuucacaaacugguacaucugagcaguucuacuuuguaagcaucaguauacuuacuuggcuauuuuauauguguguauuauauuauacauauuuguauuugcauaaaauagucugagaagauacuuuuuuuucuuuaaaaaaaaaauuuuuuuuuuugagauagagucucacucugucacccaggcuggagugcaguggugugaucucggcucacugcagccccagccucacggguucaaacgauucucaugccucagcccucuugaguagcugggauuacaggcacacaccaccacauugggcuaauuuuuuuguauuuuuaguagagaugcaguuuugccauguuggccaggcuggacacaaacuccuggccucaagucaucuguccaccuuggccucccaaagugcugggaucacaggcaugagccaccacaccuggcccccaaaugcuuuaacaauaauuuucuuuggggccgggcgcgguggcucaugccuguaaucccagcacuuugggaggcugaggcggguggaucacaaggucaggagaucaagaccauccuggcuaaacacggugaaacccugucucuacuaaaaauacaaaaaauuagcugagugugguggcaggcaccuguagucccagcuacuugggaggcugagacagaagaauggcaugaacccaggaggcagagcuugcugugagccaagauugcaccacugcacuccagccugggcgacagagcgagacuccaucucaaaaaaauaauaauaauuuucuuugggaagggaguugaauuaggguugaggugggcuuuaauuuuuauuacuucacuacuguuucauuuuaguuuuaaaaacuuuugugacuuuacaaaaugggauuuaaaaugauauauacuaucuucauguacaguagaaaaucaguuuuuaauaaaauuuugguuuaccauuuuccaucuuugugcaggacaucauggugauguuggggcucccauagcugauguuauucucccaggagcugcuuacacagagaagucugcuacauaugucaacacugaggguagagcucagcagacuaagguagcagugacaccuccuggcuuggcaagagaagacuggaaaauuauaagagcacucucugagguauaauuucugagucauuucuuagugaugcuacuaaaggcauauuugauauuuuagccuguuagaaugauuuucaaagucaaggaagaugccagucugaaaugcagagaugauuugaauaauuucuauagaaaacauguauucagaaacaggaauucaagguuacagugagcucucauugcaccgcugcacuccagccugagggacagagcaagacccugucucuuaaaaaauaaaggaacuugaaauuggugcuuuuauuuuauuuuauuuauuuuugagacagaguuuuucucuguugcccaggcuggagugcaguggcgugaucucagcuuacugcaaccuccaccucccgggcgcaagcuuccugaguaacugggauuacacgcauguaccaccaagccuggcuaauuuuuauauuuuuaguagagaugggguuucgccauguuggccaggcuggucuugaacuccugggccucaagcaguccucccaccucggucucccgaagugcugggauuacaggugugagccacugcaccuggccugaaauuggugcuuuuauuguugaaaauuguugacuugucuuuugccugaaaauacaucuguuagcucuuuauugauguaaaaguaagcauccugacuuuuaaaauaauaacacauuguaaacuuuauguauuuuaauaacagguuagcaaaaacauuuggauuuagcauaguauugucucuucauuucauagagucacuaauguacugacagcugugaaugaauuagaauuuuugauauuuguguucccugcuuaacugcuuccuucauaaauguaugucuacuaauggacaccaauagguuuuucaguagugcugcauuauuucaccauaguuacaauuaucuauuauuugauauuuuuaaguauuaaagcuuuuuguuguuuuuggggaccugacauguuguagauugcuggaaugacucuuccauaugauacucuggaucaaguaaggaacagauuggaagaagucucuccuaaucuuguucgauaugaugauauugaaggggcuaauuacuuccagcaagcaaaugagcucucaaagguaacagcucgccuaugagcaguuuucauaauguuguaucuacugguguaacaguacuaguuuuccauauuauuguugaucucuucuuuuuugugcagcuagugaaccagcagcuucuugcugacccacuuguuccaccucagcuaacuauaaaagacuucuacaugacagguauguaauugucaacaugacucugccaaauacgaaagguaagaaguaaucagaucaccucauuugguguuauaauuccaauuugugauugauaguguuugcaauucuuaaucuuugaagguuuucaaacauuggaacuaacguaagcauauuuucugauucuacucuaguuuuuuuguuucugaaauguaagcaaaguuugaaaauccaagcaauuaauagauuuuaaauauaaaauuuugcuguuguaaggaaagucacuguguagcaauuuauggugaauuuuccaaaguggcaaauaacugcagguuuuucugagaauuauagguggaagaaucaaaacauuuaaaugugaaacauguuaaacagugcuucugauguaaauuguuaggaauguuuuuaaggaaugcagacaaacugaaacuuguuuauugcagauucuuagaacaguugauacaacaucuagguuaugagguaguuaauaguugauagauuauuuugacuaauuuucuaucuaaaagcacauagaacucuuaauuuuuuuauauaguuuguaucuaagauuuuuuaaauaaguauuuuaguuagauaauaaagauuaccuucauuguaaaauaauaccuaugcucaaaagcacaacaaaaaaucacuucuaugguauuuaucugcgaacuuaugaacacaaagaaggaaacaacagacacuguagucuacuugagaguggagagugggaggagggagaggugcagaaaagauaagucuuggguacugggcuuaauuccucggugaugaaguauucuguacaacaaaucccugugacaugaguuuacugguguaaaaagccuucacauguaccccugaaccuaaaaguuuuuuuuuuuuuaaaaaaagaaaaaucacuacccucccacuaucaagaaauaacuauaauuauuuuuaacauuuuagucacucuuccuccagggacauacauaugcauuauacacauauauauuauauuaauuaacuauuguuauuuauauguaauuauuacuguuuacauguacguguguguguguguguguguguauaauuuuugagaugagauuuuacucugucacccaggcugaagugcaguggcacaaucuuggcuugcugcaaccucugccuccugagcugaagugauccucccaccucagccuccucgguagcuaggacuauaggcgcauaccaccacauccagcuaauuuuuguauuuuuuguagagaugggguuucgccauguuacccaggcagaucucaaacuccuggacucaagcaguccacccaccucagccucccaaagugcugggacuacagaugugagccaccaccccuggccuauauauuuuuuagugaaacagaaggugagauuaggccuggugcaguggcucaugccuguaauuccagcauuuugggaggcugaggggggcagauggcuugaauccaggaguuucagaccagccugggcaacauagucagaucuggucucuuuaaaaaaaaaaaagugagauuauucacuuggggguugauagcuuuauugaaauauaauucauguacccuaaaauuuacucaugaaguggacaauucaauguauuuuaguacauaugcuguuuuguaaccuuuuucaauaauaguauuguacacauuuuuccuauauuuauuuauuuauuuauuuuuuugagacaagagucuugcucugucgcccaggcuagauugcaguggugugaucucggcucacugcaagcuccgccuccuagguucacacgauucuccugccucagacucccgaguagcugggacuacaggcauaugccacaacaccuggcuaauuuuuuguauuuuuaguagagaugggguuucacuguguuagccaggauggucucaaucuccugaccucgugauccaccugccucggccucccaaagugcugggauuacaggugugagccaccgcgccuggccuuuccuauguuuuuaauacuuuucuauaauuuuuuaauggcugcauacuggugcacugucuagcugcucuauaguuauuugauuguuuccagggauaguuauugaaagcauguggccaguaagggguuuaucguuggaaucuguugguuacauauaauuauauauacuugcauagggccuuauaaucuuuuuuccuccugaauaugugcaccauuaaaguuuuaguaugugcuuuuuaaaaaguuguauuaucaaaaugacauuuucuuaauaucuuucagauucaauuagcagagccucacagacaauggccaaaugugucaaagcugucacagagggugcccaggcaguagaggaaccauccauaugcugaagcuucuacuaggaucccaguuuugccgcagauaauuaauggacaacuguagugcagugauccuuuacagguuuauuucuuuguaaaaaaaaauaauaauaauuugaaucauguaauauuuaagguuauacuaugccuauuugaaaaugauauuaguuaucaacuuugcaguuugaaaaacauguauuguguguaaagguuaaauaacaaaacuaugcagaugcucuuaaaagcauugauaaccuuugugacgaacauaaagagauccuuaaauuaugaguuguuggcuuaucuucauaaauaauuugucuguaaaauggaugaaaugaaaagagguucaauuaaaaccuacuuuuuucuagugcuaaagaaaagauuuaagcaccuugucaagcuggguaaauaggaaaaauacauaaucaugcucagauauguaucuaggauaauuauaauuaauaauaaucauaguaacaauggcuaaugauaauuuagcuuuauuauaugugcuaagcacucugguuuuacaugcauuaucuucuuuuguucuugcuacaacccugugagauaguaguauuaucucauuuuacugaugaagacugaagccuagguauauuaaauagcuugcccaaggccacacagcaaaagucaccaacucaaaccuacuucuuauuuacuccaaagccuguuguucuuaacugcaacauauuauuucgucucauuaauguugauucuauagguuguuacuucuaaaaauuaguauugaguuuaauggugaacacauuuuucuauuuucucuugaaucugcuucuauaaugucauggugauuuauguggcuuuuuuuuuuuuauaaguuauacauguaugcauguauacuuaugagaccucccuuggaaugagggaggucucaagagauauaauuuagauucucauugauguucuguauucauuauccuaacaccaucuguaguguuaaaucaacuaaauuauuucagcaauaggagacaaaacaaccagcuuucauaauuuuuaauugucaaaaccaaaaggaaucagaauaaggaucacugagaauuuaaaaaaauaaaaaaggaaguaaaaauuuuaca

SEQ ID NO: 191117 - RNA, 42730 nt, Homo sapiens
aacagauuuacuuaaccacuggcaaaccacauuuccuuuuccagggcaauaacuuaaaauauuauguauuucccuuuguugcaaagagaggaaauacuucuuccuagacucagggcagcugugacccguccucccagagaaaucauuaaaccacaaggauucagacagagcccagagcccugaaaacuuuggccacgcacuuucccgcagcagccacaggcaccggcaacuucagagaggugagugcuugcuuugccccccaaagcuucacaccccgcgcaugccuugugucugagccaguauauuguaguuaagaaaaccaaccuaaaaaugcuuuguaucuggaucucuuuugaauucguauuuggcauauuaaaagugaagguuuauucaaauuagagauaaaacagaagcuguuccccacauuucuacagguaauuagaacuucggaaaucuuaguggaaaagauggagaacuaaguccuccgcagacuuucccacuaaguauccucaagaaucacuuucugcaucgggcaaaacagaauuagaagcaagaaucuagacaaggcuucguccucauuuagaagccuuuaagaauucucugcuuuaaguggaugaaaacgucccuguauggcuggguugccaugguuccucgcugugacccccagggcuacugagccugccaugugaguccauuucagucucuggaaaaagcuuugugugucuccagccucacaguuuaaccaaguaagggccuccuaagucuaaucuccaaugugacuacccugaagagccagcccuaagaaaggcauuuacacaagauagucaucacccuguaugacaggaggaaaaaaauugaagugucuuuguuuuucauaaaucagcuucuuuguaagaaaguguccuuuuguauaucucucuuccaaugcuuuuguuccggauagauuuuuuuuuucaaacaacaacaaaaagauuagaaugaucacugacaaaaauuaauaugacuugaugauauaauauucucccaaaugucuauuucuaaaauuucuaucaucagaguuuuuagauguuugggagaaaugugcuauuuaacgucaugcaagaaagagaaagaauaaugcuaaccuuaaugauaucaaaagaugaaaggccaaguuggcaaccccaauuuuucucaugggguugaugggaggggaggggaugacccacuuaaaaucgcccaaaccuuucucacuauuaaagcuucauuagauuaauauaaaucuucucuuuuacaauguaauaucuucaaaagaacaguuuucuaauagugauaguucaagcauuaguggagaaaugcuauuuguaugaaaugggagauccuaguccccagaauaauaugauagcggcauuguguaucuuccaucucugagcccaguuggcccuauagaccugcuugcacacauucuucugucaaaaaccuguugagaccaggcaugguggcccauaccuguaaucccggcauuuugggaggcugaggcaggaggauuacuugagcccaggaguuuaagaccugccugcgcaauacagugagacccugucucuauuuuuauuucgagauggagucuugcucugucgcccagacuggagugcaguggcacuaucuuggcucacugcaaccuccaccuccugguucaagcaggucuccugccucagccucccaaguagcuggggacuacaggugcacgccaccacuucuggcuaauuuuuguauuuuuaguagagacaggguuucaccauauuggucaggcuggucuugaacuccagaccucaggugauccacccaccuccaccucccaaagugcuaggauuacaggcaugagccaccgcacccagcuccugucucuauuuuuaaaaauaaaaauaauaugaaaagaaaccccuugaaauacuagccauaacagccuucagaaaauuugcaaaugguuuuuuagaaaguggcaaaacuguccagaaauccuucuaccuggcagaaguuuugcuaucccuuccccucauacacucaauucuauaaauaucucuuccaauaaggagauggauagcccaaugguuaaguuucuuaagauaaugguauuugaagucagaacgucuggagccaaaccccaacucugccacuuacacaaaaggcucucuuaauagaucuccaauuaacugacccaccagcuuaaccaaugcaccaaacagccuggcugguaucuacuauacccuuaaugcucagagguggcagguggcuuaucucuaguacaccugagcacuucagcuacuuuugcauaacagaucaacugcaagucaugccuuagggugucaaagggaagcucuucaaacauaccucaaacuauaaggcacauuugcagagauauuuuauuuauuauuccuuuuauuuauuguuucuuagacuaauuucaaagcuaagcaagcauauguuuuaauuguuuuaggugguggcuaaaacauaaaaaugcuuacacuuuccuggguuucaguguguacugugcuuaaacuaugcguggcacauaggacaauccuugaucaaugucauuucucuugucgcuuuucauauucuuugcuacucaaugguuccugcucuauagccaaaaauaaacucauguaaaguaaccaaaacuuccugagauucuccucaauaauggcuuuuacagaugaaauugugauuuuguggauuacagaacauaguauagacuauaguaaauacuaauacugcuaacgcaaaggaauggaaacuagcagagcucuacuaaguacccccuucacugacgacaucuauucauccggucucacaaaacacugaaaaauaugccaagauugaaucaagggauugcggguagguguggaagccuauacauucuuauagggcagagggauauuuguaguuugaaaaagugcacccccuacccccgaccuccaccgugagaauuccugcuuuagauuuccuagacuuggucuuuaacagcggaaaaaaacaaaauccugugcuucucuggcagcugaccuuucauggccuaacaaugugcaauuucagguaucacaugguugagcugaaguuagaccauacaaaaauaaagauagcggccaggugugguggcucacaccuguaaucccagcacuuugggaggccgaggcgggcggaucacgaggucaggagaucgagaccauccuggcuaacauggugaaaccccgucucuacuaaaauacaaaaaaaaauuagccgggcgugguggcgggcgccugcagucccagcuacucgggaggcuaaggcaggagaauggcguuaacccagaaggcggagcuugcagugagccgagaucgugccacugcacuccauccugggcaacagagcgagacuccgucucaaaaaaaaauaauaauaaaaaauaaaauuaaaaaaauaaagauagcuagccgucagagguaagcucaccacaucaaggcaugccuaccuucaagcuccaugcuucucaucccuugaauuuaugaauucugaguccugccucagguacacagaugugcccacaucugccaggcccacaaauggugaccagggauaaaaaucaaaccuuuaggccgggcacuuugggagaccgaggugggucagaaauucgagaccagccuggccaauguggugaaaccccgucucuaauaaaaauacagaaaaauuagcugggcaugguggcgcaugccuguaaucccagcuacuugggaggcugacgcaggauaauuccuugaacacgggaggcggagguugcagugaaccgugaucacaccacugcacuccagccugggcaacagcgagacuccgucucaaaaaaaaaaaaaaaaaaaaaaaaaaucaagucuuuaaggccaggcguggugguucaugccuguaaucccagcacuuugggagacugaggcggguggaucaccugaggucaggaauucaagacuagccgggccaacguggugaaaccccguaucuacuaaaaauacaaaaauuaaccgggcguggugguaggugccuguagucucagcuacuccagaggcugaggcaggagaaucacuugaaccugggaggcggagguugcagugagccgagauugugccauugcacuccagccugggcgacagagcgagacuccgacucaaaaaaaauaaauaaaaauaaauaaacguuaaaauucacacuuaaccaauaugugauuccaucucuucacuaucaggacacacugaaucacagaaaguaaaaucuccugaugagccuuauaccaugcauucgaagaacauuccaucucugcuaauuuaacuugccuuuucauaagcaaaagccuacccagacaaaggagggcugggugacccccauccauuaccgauuuucagucugcagcagaacagcuaguagcagugguuuccauucaaaaaacaaacuucuuacacaaacauaggcuggucgaaagaauuaauuuguacaguauguucauugcuuacuuuucuccaggauugcaugaugaauuuuuauggaggggggugggggaagggaagaaccacauucaaaacccaacaucauucuucucuacacugucauuucaaaagccagauaaaaguggaaugaggaaugcagccguucugaacaccacccuccauuucauucuggaaccgggaagguacacccaggcaugacaauagcuucucuccucacagaaauuuaacugguaagugcuuuccuguuuguuuuccucaaacugacacauuuacaguggaccugaugaggauuccugcagaugauuuauuuacaaaacagcauuugacuaacuaccagcuggcaaaaaaggaaaaggacuccugaucguuuacaaaaugcucugucugcagauucauauuuuuggucuuggcaaaaguguuuagggacgauccuacaggguucgcuacagcugcugauuaauccuaaaacacugcaagagagaaaaugagcauguugcuggggugggcggacaaagaacuuucaguaauuuucucagcuuuuaccuacauaauuacagcucauaaaucugucuuuuaaggaguugugaucuagaaauagucaaacaucauuuguggaaggcucacuguugagaaacuaguagaaaaaaaugguacuccgagaugaaagcugauauugcccucuuuagauuacaaggugggaaaaaaguuauaaauugaguuguaaugcagcuccccgccacuggcuccccauuuuuacgaugaaaggcuugugguuuguugggccuucccauuuguuuguuguuguugccuuuuugaaucucgcuaucaauuucuuguuagaauaauugguaucugggcucucccaacaagggguagauggcuaaaugcagggaagacugugggagacaaggguucagcuauucaauuauuccuuuucuagucagaaacugugagcaccaauugucuuuuaucuuuuccuccaaaagaaagcugaugaaaaccaaaucaaguuugauaacaggacuuucacuggcaauaaugcucuuaaauugccuuuuucacuuaaggcagacucauucacccaagaauccacaaaccuguuguuaaauuaauccgaugguaauuuugucuuguuaaaaaaaaaaaggccaagggaccuuuccugggucucaaguuauaaguaauuauucuuagugaauaauucucaucauauuuguacaucuuccagacacuagauuauuauguuuuucauggccuauuuuaugauuuuaucugauuuaagucauuuaguuuauaaaaggucauacauuuucuguuacuugacugcuaauugucaugucccugagauaaauauuuaauaacagaucauguuaaccagaaugauaaucauguaaaaaauaaaugaaguagaaaagauugaauaugcaaaacugauaauagauguguuacucugauggugagauuauagaugugucagggagaaaaaacuucuccuguucccucuuagauuuguuaucaggcaccagcaaaugaaauugacagaagaaagauuagcaagagaaaacaaaauuuaauuuuauguauguagauaugggcguucccaaguaaaugugacucagagguugcugagugagcuaugauugugccacugcauuccagccugggcaaccagaaccuaacccuagcuuaaaaaaaaaaaaaaaaaaaagugacucagauggguaguuagaauuuagggcuuauaugccaucuuuuuuucuuuuucuuuuuuuaauguguguguuuuuuuguuuuuuguuuuguuuuauauaugccaucuuaauaggagaauaggagaaauggaagagaagggcacuuacgggaaaacaagugauuuuuggaaacauaaauggguccuuaggagaacagacuggugauaugauaguuuuagugacaguaacuguucaggcaugguguggagacuucucaucucuggugauaagauauggccaggaguucgagaccagccuuuaguagagacucugucucuacuaaaaauacaaaaauuagccagaagugguggcaugugccuguagucccagcuauuugggaggcuaagacaggaaaauugcuugaacccgggaggcggaggcugcggugagcuaagaucgugccacugcacucuagccugggagacagagcaagacuccgucucaaaacacaaaacaaaacaaaaaauaacugaaugaauuggguauaguuccuccauguuaagugcuuuacguaacuggauacaguggagaccaauauucaaccaaaagugaucgcuauaaacacauaaacuaucaucauuaugaaagugcuugaggaacacucgugggugggucaggcaugggauaaaggcagaguuaaucugaaaaagaaaggaaaagaaaagccuucauggagaaugaguuugaaaggagguagacaaccuggcagcuugaaaaagguggagaauccaagcaggaauauauaugugccugcuugaauuuucauuaggaccaaauugucccuaggcaugaaaaauaauaaaauacaaaguugaauugacguuaaaucauugaaccuagaaaaaaauagcauauagauaugauauccuuaauuuuucacaaaacuuucucuuuaacgguuuauaaugauaaaccucuaauugaguggaaaaaucuggcaaugaaacauuuuacuuaauuguauaagugagaguugacagagcuuuuucuuuauucaguugugccauauaaaaaugcuauuugcaggccgggcacgguggcucaugcguguaauccgagcauuuugggaggcugaggcagacugaucaccugaguucgggaguuugagaccagccugaccaacauggagaaaccccgucucuacuaacaauacaaaaaaauuagcccagugugguggcacaugccuguaaccccagcuacuugggaagcugaggcaggagaaucgcuugaaccuggaaggcggagguugcaguaagccaagauugugccauugcacuccagccugggcaauaagagugaaacucugucucaaaaaaaaaaaaaagaguaaaaaugcuauuugcuauucacaauagcaaagaccuggaaucaaccuaacugcccaucaauaauagacuggauaaagaaaguguggcucauauacaccauggaauacugugcagccaugaaaaggaauuagaucauguccuuugcagggacauggauggagcuggaagccauuauccucagcagacuaauacaggaacagaaaacgaaacacagggccaggcaugguggcuuaggccuguaaucccagcacuuugggaggcugagcaggcagaucaccugagccuggccgacauggugaaaccccgucucuacuaaaaauacaaaaauuagccagucaugguggcgcacaccuguagucccagcuacuugggaggcugaggcacgagaauugcuugaaccugggaggcagagguugcagugagccgagauuaugccacugcccuccagucugggugacagagugagacucugucucugaaaaaaaaaaaaagaaagaaaagaaagaaaagggccgggcgcaguggcucacgccuguaaucccagcacuuugggaggccgaggcggguggaucaugaggucaggaaaucgagaccauccuggcuaacacagugaaacuccgucucuacuaaaaauacaaaaaauuagccgggcaucguggcgggcgccuguagucccagcuacucgggaggcugaggcaggagaauggcgugaacccgggaggcggagcuugcagugagccgagaucaugccacugcacuccagccugggcaacacagcaagacuccgucucaaaaaaaaaaaaaaaaaaagaaagaaaagaaaaccaaacacggcauguucucacuuauaaguaagaacugaaugaugagaacacauggacacguggggguaacaacacacugggggcaugugggagggcuaggggaaagagagcaucagaaagaauagcuaacggaugcugggcuuaauaccuaggugauggguugauucgugcagcaaaccacccugacacacauuuaccuauguaacaaaccuguacauccugcacuuguaucccagaacuuaaaauaaaaguugaaaaaacaaacaacaacaaaaaagugcuuuuuuuuuuuuuggagacagagucuuacucugucacccaggcugaagugcaguggcugcgaucucagcucacugcaaccucuaccuccuagguucaagcgauucucacacuucagccauuagaguagcugggauuacaggcguguaccaccaugccuggcuaauuuuuguauuuuuaguagaaacggaguuucaccauguuggccaggcuggucuccgacuccuggccucaaguuauccaaccacgucagccucccaaaguguucagauuacaggugugagucaccgagccuggcugugaccuugaccauuuuugaucuaacaaaauggcaguuucuuaugcuuugacauaaaaauggaucaaaauguaauaaaaauagaaggcugggccuaauggcccacaccuguagucccaacacuuuggguggccaagaugggaggauugcuugagcccaagaguucgagaccagccugggcaccguagugaguccuuguuucuaccaaaaauuuaagaauuagccaggcaugguagugcaugccuguagucccagcuacuuagggagcugaggcaggagguccuaguuacuuaggaagcugaggcaggaggauuguuggagccuggaagguggaggcugcaaugagaugugaucaugccacugcauucuagccugaaugacagagugagacccugccuggaaaaaaaaaaaaaguuacauauauuuauauauguaaauauuugucucauuuuauauaaauauuuguuuuguguauuucuacacauuaaaaccauaguaagcauaacauuuguuuguuuauuuuugaaacauggcucucucuguugcccaggcuggagugcaguaguacuaucacaguucacuguaaccucgaccuucugggcccaaguaauccucccacuucugaguagcuaggacucucaggcauauaccaccaugccuggcuacuuuuucgauuuuguagagacggaggucucauuauguuucccaggcugguuucaaacuccuggccucaagcaauccucccaucucugccucccaaaaggcagggauuacaggcaugagccaccacacccagccuaaacauaacauaguuuuguugauugaggaagcacuuccuucuucuuucacgagacauucauugagcaccuacugagcacucugcuccuugcugagauauaaggaugaguaaaaguuauuccuugcccuugauguucuuaguuuaguaagggagaugagcaccuuaacagauuauuacucagagagacugugugugcagguauuaagaaggaaggcccugccugggugugguggcuuacgucuguaaucccagcacuuugaggggccgaagugaguagaucaccugaggucaggaguucgagaccagccugaccaacauggagaaacugucucuacuaaaaauacaaaauuagcugagcaugguggcacaugccuguaaucucagcuacuugggauacugaggcagaagaaucgcuggaacccaggagccagagguugcggugagccgagaacacgccauuguacucuagcccaggcaacaacggcaaaacuccaucucaaaaaaaaaaaaaaaaaaaaaaaaaaaaaaaggcccugaggucagacagacccagauguuuagucuguucuucaccacuuuugcuaagugccaaagcucucuuagccuuguaggaauaauaacaguaccucccaggauucuugugagaguuaaaugugacaaugcaugugaaguugcuuagcauuguaccauacuuaacaaguacucaggaaaugcugaguauuacuauauguguuaagugcuauuuacauaauuagaugugguugguacuugcuuccuuugaguggaauuaggucaacugguuuuaauuauaagcaacaggccaggcauggugucucauaccuguaaucccagcacucugggaggccaaggcagguggaucaccuaaggucaggaguucgagaccagccuggccaacauggcgaaacccugucucuacuaaaaauacaaaauuagccaagugggguggcacaugcuuguugucccagcuacuccagaggcugaggcaggagaaucacuugaacccuguugcagugaaccaagaucaugccacugcacuccagccugggcaacagagcaagagacucugucucaaaaaaaaaaaaaaaaauuauaagcaacacaugacagugacaaugguuuauagugaacuuguuugcuccucauaccaguuuagagaaaaaucucaucaucuuuuccuagaaauggcaacuguugucagucagaagugcugguccaaggaaguggcugaacagauugaacacaccucucaggagugaggcuggcuuuucuacguccucaacauucuuuuaaugcuuuugauuaaaaaaaaaaaaaaaaaaggggcagggggacugaaacaggaacuaauggauuugaugauaaucaagaacucaaauucucuucuccaguucacguuugucuucucagacaaaauaguuauuuccaagaugcccgggcacgugaaugccuuuaucaaaaccuacugaauagucuuuccuucaauaaauacuauugagcccuacaguuugccaggcacugugcuaggcucugggaguaugaagguaagcaaaaccacagguugguggcggagacagacauucuugaaauaagccuccacauauguaguaacaguugcucuaagugaggagcuuagagcaggggcccugauuuaggcuagggcauagguuuuuggaggcagggaagaguucauuuagggaaguaacaucuaaaaguaccgcuuaccuuuuagaagagcucgcgauuuucucuuuaauuccaaaaccaccagcaaguuuaggagauaaaagcuuagucaaauaaauuuuugguuacuauauggaaaaugccauguugauauaaauuauuuguucuaucacccagcuguauugauaacauuaaacauggccuuuccauuuguuauugucccccaaugugacucucauuuuauuaacuguauucaaaauaaaaccauccaccuuuagaaugauuuuaucccuauuaacacacacauacaaaugcauacuuaauuacaguucuuuacauacaacaaacaaguugggaaaaauuuagaugguaaaaugaaaugguuucuuucuugucugggagagacuccuuguucuggaaugguauuucacagauaaauaugguguuucucuaugaucuuccuuuuggguuuuugguaguugaauggggaaggguguauuucagcacacacugaaaacugcuugucuuguaggaaggauuauaauacaccaaacaggccaggcgcaguggcucaugccuguaaucccagcacuuuaggaggccgaggcgggcagaucaccagaggucaggaguucgagaccagccugaccaacauggagaaaccccaucucuacuaaaaauacaaaauuagccgggcaugguggcauaugccuguaaucccagcuaguagggaggcugaggcaggagaaucgcuugaaccugggagguggagguugcggggagccgagaucacgccauugcacuccagccugggcaacaagagcgaaacuccaucucaaaaauaauaauaauaauaauaauaauacaccgaacacuguguaaaaguggcauuuucaccucacaccuaaaaucccaccacuuugggaggccaaggcaagaagaucacuugagcccaggaguucaagaccagccugagcaacauaauaagacccugucucuaccccaaauuuaaaaaaaaaaaaaauuagccgggugugguggugagcaccuguagucccagcuacugggaaggcugaggugggaggaccacuugaacccaggaguucgaggcugcagugagcuaugauugugcuagugcacucuagccuggagacagacucuguuuccaaaaaagaaagaaauaaagucguauuucgagacuuccucagaaauauguuagauuucccaaaaugcaguaaguuaaaaaaaaguuuagcuauuuuaacuuguuauuugaacauuuacaagaauaugcacacaucuuucagccuuaaauaaauaaaagauugauuuuugaaaauagagaccuguuuucuagguaugguaaguggaaucugcucagaaucacuggaugcucuuuacuaauuucccacauuaugaccacuucuuuuuaguuauuucucaagcaaucaguaaaugauauauucaucaaacuuaagagaguaaacaaaauguaucucuuccuaagaaaaacaacugauugcuucuuuagccaguuggauuacagcaggucagugagaucauagcaaguagccugauuauguuguacugauauucaucacaagaaaugaacuaaucuacacaaaucuuuugcugcaaaauaaauaaacuccuuugguggaacauuaucacaagaucagaauaugccacuuugucaaggauggaaugaacacagcguagcuuuacuguaacagcaggaaaccauuauuuuguggcucacagcagucuuucaguugauguuuucucucaggaugaaacccagauccaaaaugccaucaaaaguacccacaaaccgggugcgguggcucaugccuguaauccccgcuacucaggaggcugagggcagaggaauugcuugaacccgggagguugagguugcauugagccgagaucaugccacugcacucuggccugggcgacagagcgagacucugucucaaaaaaaacaaaaacaaaaacaaaaaacaaaaacggaaaacaguaaccacaaaugagcucucugauuagagccauugaucauuaaauuagcuagaagcccgagaauuugcuauguuucagcaaagucauguaagucaugugaaauauuucauaauacaauguaaugaaagaaucaaguaaagucauaacaaugauauugcacuuuuuuuuuuuuuuuuuuuuugagauggagucucgcucugucgcccaggcuggagugcaguggugcgaucucggcucacuguaagcuccgccucccggguucacaccauucuccugccucagccucccgaguagcugggacuacaaagaugcccgccaccacgcccggcuaauuuuuuguauuuuuaguaaagacgggguuucaccauguuagccaggauggucucgaucuccugaccucgugauccgcccgccucggacucccaaagugcugggauuacaggcgugagccacugcgcccggccugauauugcacauuuauugagcucuuacuaugauccagacacugagcuaugcccuaacauauauuaucuuuugucauucauacaauaaaccuagaacaguuuacucaugguuucuuccccaguucccuauaucaucgaugaaggaacaggagcugauuguaccaaaacacuuauaugguaagcuugaucaauguauuugauuuaguaucuaugcugggcugagaaaaacaugcaaagcaguaccuacaaauaagaaaacaggaaguaagcugggcaugguggcacaugccuggagucccagcuacuugggaggcugaggcuucccacgaccgccccucacauucauuaguucgcuagaucagaucggagaacucgggaaaauggcguacuuacaagacugcagguuuacuacaagggccagaacucaggaagagccggauggaagcgaugcacgggacaaggucugugggaaggggcgcggagcuuccaugcccucugggcgcgccaccauuuccaggaccuccguguguucaccagaccggaagcucugguuuuuacggaggcucauuacuuagucaugauugauuaaaccacuggccauuggaaauuaaugcaaucuccagcccccaguccuccccuggagguggaaguuggaagcugggaagcgggcuguggacacgauuuguaaugaaugcaagacaccgguguugggcugcuuuuuuuuuuuuuuuuuuuuuuuuugagacagagucucgcgcuuuucgcccaggcuggagugcaauggcgcgaucuuggcucacugcaaaccuccaccucccggauucaaggaguucuccugccucagccucccgaguagcugggauuacaggcaugcgccaccaugcccggcuaauuuuuuuuuuuuuuuuuguaguuuuagaagagacuggguuucaccauguuggucaggcuggucuugaacuccugaccucaaaugaucugcccgccucggccucccaaaugcugggauuacaggugugagccaccgugcccggccugggcucuuucaaacggagcaagguucaaguuugugccuacaaagggggccaaaacaggguuaucuaggagggaggaggucgaucugguagcaagaaagaacuaggguggaaggugaguuugggagguguccgcaauaggaaaggaaacgcgcuggaguggguacaguggauggaggggugacaggcuuugaggggcuggcagcagcugagguccacagugccacguguaccgagacacugagaggagcagaguucuccucuuuuguaguaagguaagccggccgccugaccuggauggcuugaaacccagccccccgccgcugccaccacccaccucccccauccccacccgaaugaggcgggcgcccugggcgaauagcuaugacgccauccagccuuaaccagguuagugcggaacgugguggcgcgccugcagccccagcuacucaagaggcugaagcaggagaauugcuugagcccaggagguugaaacugcagugaaccauuauugcgccacugcacuccagucugggcaacugagccagaccugucuuuuaaaaacaaagggaaaaaacacacacaaaaccaaggcugugauccuaugaucuuuagccaaucugacuccaccccguuucaaacagucuaaagauuauuuuaaaaaauauauuucauaccgucuucucucuauagccuccaugucaccccaucccuucaaaaaacuuaguagaaccuaacagaaccuuaggguuucagcgcuuacugaauuuuagacaucaacaaguccaaucacguguaaugucugauuuccugcuuaaaaccccucacuuuaagguugcaucauuaaacaucuccaaguaugagaaauguaccacccucugacauagcuuuacaguagaaugaaaucuccauaaguucuguguccuacucucucuccagggccuagaauacauaguaggugcugaauaaauaauucauuuaauuuaguuuuuaaauguuuaacaacuauaaucuuuaggaaauucugccuuacauugagcuaacauuagcgccccucaauuuuuugaagccaguuugaauaguucccucuuccaaaugccagcccuugggcauuugaaaaaauuguuacccugcucuuucuuuuccaggauaaauagcuuccaccaguuugcucaaugcuccucacaugauauaguuucucuccauccgguucccucuccucuggacauauuucaguuuaucauuguuucucuuaaacuguaauucccagaaaagaacacaguaccccuaggugcugucugaucaguucaaguagaauuggauaaacacucccccaauucuauuaagacagcccaagggcaaaguuacuuuuuuuuuuuuuuagcugucucaucccguuguugacucacauggagcucaaggucaaggagaaagguuguguuugggcagaaauuuagguuguuuaaaucacagaccaggucuucacagggcacuaauugugaugcccuuggugaaugguucaaaggaaauguauaugaaaagugguugugugggaccccgcugggguacacuacauuuacuuccuuuucauggugaaaaggcacuaaauaagccauuagucaauauuacguaucucuuuaauguagaauuaugaaauccauuuuaaggaaauaauucagggccugcaauuucugccuagacacauuaucugcuaggaaaaccuguuggagaagauuauuugcuuugcauggcaacuggcauaaaguucagggcagguguugcuuaacaagugaaugcugaccaggcaggguggcucacaccuauaaucccagcacucugggaggauuacuugaggucagaaguuugagaucagacuggccaacaugguaaaaccccaucgcugcaaaaaauacaaaaauuagccaggagugguggugggugccuguaaucucaguuacucaggaggcuacagugggaagaucccuugaguccaggaguuugaaguugcaguuagcuaugauugugccccuacacuccaacaugggagaaagagugagacccuaccgcuaaaaaauaacaguaaaaauaaaacgcaaggaagaaagaaaaggaaaaaacaugcuuugucugauuuugccuuguuagagaaaaucugugaugagaacaaaagauacagaaauuauucuaaaaguagaauuuuuaaaacaaaauuuucuuguaucagaugguuuuuuacuguguuccuuccaaguuccuugucagaaauaaacugccuauuagguacgauggcacaugccuguaaucccagcuacuccagaggcugaaagggaggaucucuuggggccaggagugcuagugcagccugggcaacauagcaagaucccaucucuauaaaaauaaauaaaaaggaaaagugcuuguguuauguuucagugaagguauauuguauuacugguauaagugucaagacauuuugugacuguuuucuugaauuugaauaccuggagauguacuuggcuuuugaauugucuaaaguauugagaccauagacagugcagauaugugccuauauccauccuuuguaugacccaccauucuuuuucuuucuuuggugagacggagauuuacucuuguugcccaggcuggagugcaauggcgccaucucggcucaccgcauccuccgccucccagguucaagugauucuccugucucagccucccgagcagcugggauuacaggcaugugucaccaggcccagcuaauuuuguauuuuuaguagagaugggguuucacuguguugcccaggcugaucucgaacuucugaccucaggugauccgcccgccucagccucccaaagugcugggauuacaggcaugagccacugcguccggccgacccaccauucuuaauggccuuuagaaggucacuuucauuucccucaaguacaagaccuuuguuucugggacagggugauuaauaucaacuaugaaagaaagauuaaguaaauuaaaaugacuuacuauacagcuauugguauauacucuucauguccagaagcaauuuacaauaugucaagaagugucucuacagugguucuugcccucucauuucuaccacugguuagagaauagguauguggaaaagaugucauagggccgggcacggugucucacgccuguaaucccagcacuuugggagggcgaggcagguggaucaccugagaccagccuggccaacaugacaaaaccccaucucuacuaaaaauacaaaaauuagccaggugugguggugggugccuguaauccuggcuacuugggagggugaggcaggagaauugcuugaacccaggaggcagagguugcagugagcugagauugagccacugcacuccagccugggagacagagcaagaggcuccauuucgggggaaaaaaaaaaaaaugccguaauacaaaauaggcuaagaauaaagaaaagagugcuuaaaauauguuuucuauuugaaggucauguauuuuaccauugaaccaggaucuuuucccuucccuccuuugccucuuucccucccggcauucuuucuugcgcaugugcucgcacucaugcucacucucucugucuucuuucucucucuuuaaaugagacagucucacucuguugcccaggcuggagugcaguagugcgaucuuggcucacugcaaccuccaccuccgaggcucaagcaauucucuugccucagccuccgaguagcugggauuauaguaggcaugugccaccacgcccagcuaauuuuuuguauuuuuaguggagaugggguuucaccauguuggccaggcuggucucgaacuccuggucucaaguaaucugcccaccugggccucccaaagugcugggauuacaggugugagccauugcacccagccucccucucucucaaggaaaaaagaggagaaaagaaaaggggguuugggcuauaugcacaaaugcucucucucucccuacauucuaguuaugugaacuuaaauaugaagaacuaguugggaaguggaaauucuauuucuucuaaaauucuacagcuguucugggcacugcugauguuuauaaccuucccucacagauguuacauuuuaugaacugugacucauuagggugguucuagcaucuuuagauggacagaaauccccaaaggcaggaugauuacauaagucugcuucacucaaaaccugaaauauuugaauagaauauuuccuggggggaaaagaaagcaguaagacuuugccauacuuucacgaaucagaaacacuaauaauuuuucuuuucugugggaggaaugagggagguacaauauucuuguuugggaagguuuuguuuucauuugcagaauguuuuuaauuuguauaggcuuuuugguuuggaccuugaucuauauuuuuguuccaaugugcaaaaaaccauuuacuggaagacauuguuugaauguccacucugugcaagggaccggauuuggugcuaguuugaggcauggagaguaauaaaagagcuagaauauacggugcugccaucuuugagcuucucaguuaggaaacaccaggggcagaaucauaaaaguuuagaauuagaugucaccuguauuuuccacaugagacaccuggggucccaauugggccacugacccacccaaaguuacauaguuagugauauucagagcuacauuuuagaaccaucucuccuaaguuccagugcuuuuucagcacacaggacugccaaauauccacggacuuaaacaggaucaaguguuacggcaggucagaacuaggauaaggcaauugaggcaaaauuuaacagggcaccaaaagccucaguaauuaaaauuaauggaaaauaauccaugauuaacaaaauaucaaauuuuuaaacaaagacaagguccuacgcugcucuuccauaacccagcuucgccugucucacccuaacgucaacccuccaucauacaaucugaacuuuuggguggaucaagggggaaaaccaacauggaaaauauuccacuggcuggaaucccuagauguguagagugagcuguccagguguucgaagauggaucacaaaccuuugugcacaacaguguauugagagaaaauggcugucauuuguuuuaauuaaaaagugauggcaguuuugaggguaaaacuacaaaaagaaagugagacuggguugagcaugguggcucacaccuguaaucccagcacuuugggaggccgagguggaaggauugcuugagcucaagaguucuagaccagccugggcaacauagcaagacaccaucucuacaaaaaaaauuuuauaauuacaaugaaauuuuuuaaaugaagcugaagaguaaaggggaaacucaagaugugauagugggucauaaccucuacagggcacugcucccauaaugaaccccauuccauucaagagcacugcuaggcagagcacaaaauggaauccccagaacccuacaaagggguuuaguuggagggcuuugauuacagcaagauacuggguuaaaauuuuucuuucccuguuuaauuuucuucucucucauccauguccugugccugaaguguuaaccagcaccuggauuugcaccauuugaaaguacccuugcccuuagaaaacccagaagaaaaaaaccuagaagcaaucacacugggucccagaagaaaggacaggcccuuggacaaaugcaguccuacagguucacauaggaguccuauaggucaccaagagagacugaaagggcaugugggacuuaaccagcucuggagcaguaaagaauaugcauuugggccgggcgcaguggcucacgccuguaaucccagcacuuugggaggccgacgcaggcagaucacgaggucaagagauugagaccagccuggccaauauggugaaaccccgucucuacuaaaaauacaaaaauuagcugggcgugguggugcgcaccuguagucccagcuacucggaaggcugaggcaguagaaaucacuugaacccaggagguggagguugcagugcgccgagaucacgccacugcacuccagccaaggcaacagagcaagacuuggucuaaaaaacaaacaaaaaaagaauaugcuuuuccugaguguccucucuucauuuauuccucagaauccagcugccagaggcuggaugagaguugguuuacaucuggcaauuugguucuuguaaagucauccugcagugacuuuaacaacagagucagaaccagcccgaggaacagagcagacucugggcaaauguggacuucugacguaguacuaaaauaaagcuaugauaaaagcucaaaauuaaaaacuguucuuacaaacuggcugcuccacugggccuggagguggaggugagaagaggggaguggugaggaagagucugagaaagaaucaaagucgcuuucuuuuccaugcaucguucugggcuuccuccuaucaagucauccuccucugcagggaagaaugguuuauuuuguguuuuguuuuguuuuuucauucagccacaggugcagcucuagaaaaggaauguagauuuauucucuaaauucagcaucgcucucuccugguuuaaacacuauuuauuuauuuauuuauuuuuauuuuuauuuauuuuuuugagacagagucucacugucgccuaggcuggaaugcagugguaugaucuuggcucacugcaaccugugccuccaggguuccagcgauucuccugccucgaccuccaaguagcucggauuacaggcgugugccaccacgcucagcuaauuuuuguauuuuuaguagagauaggguuucacugcguuugccaggcuggucucaaacuccugaacucaagugaucugcccaccucagccucccaaagugcugggauuacaggcaugagccaccacgccuggccugguuuaagcacuuuugaagaaggauucuugugccccaaaugccuggugguuaagaacauaggcauuuaccaauuuagauaagaaugcuaaucaugccacugaauaguuuuugggguuuuguuuguuuguuuguuuuugagauggaguuucacuccuguuccccaggcuguauugcaauggugugaucucggcucacugcaaccuccgccucccagguucaagggauucuucugccucagccucccgaguagcugggauuacaggcaugcgccacugcucccagcuaauuuuguauuuuuaguagagauggaguuucccuauguuggucaggcuggucucgaacucccaaccucaggugaucugccugccucggccucccaaagugcugggauuacaggcgugagccacugcgccuggccucugaagaguuuuuauaaauucuuuaauuuucuugauuuucagcuuccuaaucuguaaauagagaauaagagcucaaaaacgauauccauuaucauagagucuugcccuugaaggaugaugugaaaaguccacuuagugcaugagucagugccuucuggaguauccccagccagcagcauccaggcugugaucaaacucccuuagugcccacccaaugcaaugcauucugcuugcuugcuugcuuucuugguagacuuuuaacuuucuggauauuaaacagaugcaacgucuugcuucuaagucaaaauuuucuugacuauuaugccaacauuuucugcccuagcaucuucaaguaucugaagauagucaugaaacuccuuaaguccuccuuucucacugguuccuuaagcauuccaacaaagacuaauuucaaguccccuccaucacccugcagaguucuuucuuuugcacugcuuuuguuuuccaguggucucuccaauguccauuuugcagaacucaacaaacuguuccaaauauagauuggccaugagaaaauaguguugcaguugcuaccuuuguuuucauuaccauaaaauaauuuaaaaugucuaugaugcgucgggcaugguggcucaugccuguaaucccagcacuuugggaggcugaggcgggcagaucacgaggucaggagaucgagaccaucuuggcuaacacagugaaacuccgugucuacuaaaaauacaaaaaaaaauuagccaggcuuuguggcuggugccuguagucccagcuacuugggagccugaggcaggagaacggcgugaaccugggaggcagagcuugcagugagccgagauugugccacugcacuucagccugggcgauagagcgagacuccgucucaaaaaaaaaaaaaaaaaaaaaaaaaaagucuaugauggcccagugugguggcucaugccuguaaucccaacacuuugggagccugaggcggacagaucacuugaggccagggguucaagaucagccuggccgacauggugaaacccugucucuacuaaaaauacaaaaauuagccgggcguggcuacuugggagacugaggcaugagaacugcuuggaccugggagguagagguugcagugagccauauuacgccacugcacuccagccugggugacagagcgauauucugucaccaaaaaaaaaaaaaaaaagcccauaacgaaugucuuaaaccauuaaaucaucauaauaaugaaucuggcacccacauuguuuaguuguggucaacgagcaagucuuuuaaccugugcuuuaucuuuuaugucuacaucuuauccuauacuccuuuguaucuccuccuaggagaaaaaaaggcacaaauauuuucaagcauaaucuguacgaaugaaaggaaguucuagaauuguccuccucccccuccuuuugcugcuguguugaaacagcauuacuguugcuacaaaaacaaguuucccuucccuccccuucauugaguucauguauuaccucuccggauaaugaacaguauuguuuugugaaguggcugcaaucucaauauauucugcaaggucccugauuacuguucccuccccuuuaggagaaagccuucucuuucuuuaagagaggaaguaucuugauguaaauuaaaauaagaauacauugaccaccaauucaguuuccacccuaaacuggauauucucccuggacuucuaucaaugucacugacaaugagugauugagaaccaaaacaucuucagugccaaauaaugaugaaauagaaagcagagauacaggaguacaaauuuccaccauguuccccaguggaaauuuuggaaggcuaucuuggccugcagagaauucaggucaugauuaaauauucuagucucagacauagucauuuuuagccuuuaaaaaauauuuaaaccauggguaauaucuauuuaugagaaguuuuauaaucugguagguacccugcuaugaugcuugcuuccaaaaucaguccuuuguuacguuacgauacauaacauugcccagaagacacuaaagaggaugcaagcuuuaguucugacucuuuauauggaugaacauaucugcaacauaaacuaaacauuucagaucucuaacaguuguccagucacaugcccuacaaauguaaaguuacagaaguccugugccaucaagguuuccaaauucagugcccauauucuuccugauaaaaaguuacuuguauacacagaaaucucuuuuuaagaaaacacagcuggggccaggugugauguaaucccagcaccuugaaaagcugagccagguggaucaccugaggucaggauuucaaggccagccuggccaacauggugaaaccccgucucuaugaaaaauacaaaagcuaacugggcaugguggcggauaccuguaauccuagcuacucaggaggcugaggcaagagaaucacuugaacccaggagguggagguugcagugggccaagaucgugccauugcauuccagccugggugacagagcaagacuugguuucaaaaaaaaagaaaacacaguuggcccuccauaucugaguuucacagacgaaaaauauucagaagaaaaaaaaucaauggcuguauuuguacuaaacaugcccaggcuuuuuuucuuauuguuauccccuaaacaauacaacaacuauuuuuauagcauuuacauuguauuagauguuauaacuacucuaaagaggauuuaaaguauauggaaugaugugcauagguuauaugcaaauacuauacuauuuuauaucagggacuugagcauccuuggauuuugguaugugugggagguccugaaaccaauguccuguggauacugaaggauaacuguacuaauuuggagauuucucucuacuaugaucaagauuuucaaacauuacauugcugauuacauuacaucguuacauugugauucuuuccaagacuugagauaaaguuugggaagaaguuaccacuuguuucaguuuaugaaauagaaaaaaaaaaaagugguagagcaugagauaaagaccuagacuguauccuuauagcaaagguaaacaaggaguuuuuguuuugcuuuguuguguuuuguuguuguuguuuaagagacaggguucucacuauggucuugaagcccugaccucaagcaauccucccaccucagccucccaaaaugcuaggauuucaaacaugagccaccauguccaaccaaauaaacagaaaaauaaaaauaaaaauaaaaaauaauaaaauauaauugaaucaaaauucaaauaaaauuuauuuuauaaaauaaaauaauaaaauaaaaaauaaaaaaaaaauaaauaaauuuuuuuuuuuaaagagaacgccagucccgguagcucauuuuugcaauccuaguacacugggagguugaggugggcagaucacuugaaaucaggaguucgagaccagccugggcaacaugguaaaaccccaucucuacuaaaaaauacaaaaaguaggccuggcgcaguggcucaugccuguaaucccagcacuuugggaggccgaggugggaaaaucacgaggucagaaguucaagaccagccuggccaacauagugaaacuccaucucuacuaaaaaaaauacaaaaaauuagccaggugugguggugugcgccuguaaucccagcuacucaggaggcugaggcaggagaauagugugaacccgggaggcagagguugcagugaaccgagaucgcgccauugcacuccagccugggugacagagcgagacucuguaucaaaaaaaaaaaaaaaaaaaaauuaguugggcaugguggcacaugccucuguggucccagcugcugcggguggcugagguagaggauugcuugagcccugggaggucaaggcugcagugagccaacaucacaccacuacacuacagccuaggugacacagccagacccugucuaaaaaaaaaaaaaaaaagaaagagaaguaagagaaauauaguacuauacaguauaauauuuucucaccacucuuaaccagauauggugauaaacauggcauuuuggggcuagacacagggguccccaacucagaugccuucagaaggcagacauauaauaaugugugaacuccaugcagauucaguauuuuuuuuaacaaaguccacaaaacaaaacauguuuuugaaucucuacuuaaaaucuucucacccuucucaugaaguaacucaaagaagucccacucucucucucugccuuccccuuuauucucuacugcuuuuaaaaguccuaagcuaaaacuuguagguaaugaucaauaccuacaauuaucgagcaugcuuugugugccaggcacugagcuaaccacuuuuuaaggauuuccccaugugaacauuacagcaaccccaugaguuaggugcuauuacuauucccauuuuaacaaguaaggaaacagauuucuugguagcagguaauuuguccaugaucccacagccagaaacaggaaggacugggauuugagagcaggcagucuaauucuacaacccauagaccacgauauugccugauauuuacauuauacaucuguguuaauuaucuuaaagucuugcaaaggaauuaagccuaaaaguuucuuccuaaccuaaggauaaucauucacccccagcaaucaacagagccauacagauuauacaaguuagaacacuaauuucuggguggagcauuaaaacaacagguacauaaguaggcguugacuuccgguacaugugcuguguucucuuuucaaacugucaaagugaagcaugggggcugacaugcagaucaggcugcaaaugccuuuuaugacaagaauucgaucucagcaucgugaaaauagguaucauuaauuuccauuugauucaauuauucuuugaaaaggaaaaacuuucuuucuuucucccaaucucgcugccuuuaaaacugauaaaaacauuuguaucccuaaaauuaguucgcuuuucuguucaagguuuucaaugccaacucaagaaaaacguuauugugaagauuauaugcaauucagcuaagcuuccugaaagauucuauucauuucucaaaucaaugucuuucaaauacaucucccucaucucaauucucucacugucuaaggaccuuccaucuucgacuuccauugugguaacaggcuccugaaugauugucuuacuuccauucaaauucuuuuccaaaccaucuugcaaacugcuaccagaugaucuuuacaaaaacaaauauucugucacaucacuccuugcuacaaacauuuuuacaugcuuugggagcaauggaauaaaauccaaacccuuaagcaugacauucaaaggccuuugucaucagaacacucccauuuauguugucccuucucgagccaaaucagaauacuuucauucuuccuaauacaccaaagaauauugucauuugucuuaaugccuggcauuaaguaauaaaugacaugggaacuacagcuaggcaagcugcaucucuauuacaggauaagcuaugccagggguuggagugugaggguuguucuaccaccucccaacuggcagcagcaacaauaucaccacccaaccuucaauuuccaucuaaccucccuuugcuucccuugggugaauaaacagggucucuuuuuaacguguugcugugccucaacgccuuccaagcagagaucguucaucugaauggcaacaaaauacucuacugaugccaaacaucuugaguacauucugggguguaguauaguuuauguuugacaguggaaaauacugagcaaugucccaaauaccacccccuggggcaacacacacauauacauguuucaaaaaaucuuucuucccuaagaagacagcccuugaaaaacagcuugcugaccauauguuugcuaggucauggaucugugguuuuuacuggagaauuucucucuuguguccaucaauucuuucuauucauucuuuucuuuucuuuuuuuuuuuucuuuuuagaugaagucucacucuauugcccaggcuggagugcaguggcaccaucuuugcucauugcaaccuccaccuccugaguucaagcaauucuccucccucagccuccugaguagcugggacuacaggcacgcacaaccacacccaccuaauuuuucuauuuuuaguagagaugggguuucaccauguuggccaggcuggucuugaacuccugaccucaagugaucugccugccucagccucucaaagugcugggauuauaggcgugagccaccgcucccugccuuuucuauuccucccuguuauccggucagaagcaaaauacauguucccccaagggccccugugguguuaacaggagacacauucagagcuugaguucuuuuuaccagagugugugaggaacucuacacaggcaaccuacguagacagaguucacaauaucaaguccuucucucuguucaaaucagcuuagagccuaaacugccuuaagauucugugagguguacauuuuugcagugauccaugaaaaaccuaucuaacucaacaauacagaacaaaauuaaaccucucuucauucgccaaauguucugccagaaggaaucuuuguguuuuguccagguagaugaacaaaauguuucccucuauagccaaaccucaucuaaagccacauuuuaaaguuuaauguuacacaguucuaccagguguccuuccccaaaaucaucuggauuuuauagacuguuuauuauuacacuuucugccagaacucuugcaguaaaauuuauuuauucagaaaagaguuucagcuuugccaucuauuacaccugaauagaucagacacuagauuguuuaauucaauagguaguucuaugcuccacaaccacaugauuugccauuugaguaucuagguggaaguaacccaggaaugugauaacguggguccuccaagcagcugaaucccugcaguaaauaugucccuucacuuucuuuggaacauaaaccagagacuucauagagguucucugaacuuugcuucacaccaagcauuuuucacacauuuuuaagagacuuggguggcccuacauauaucccuguucacaauacagcuuggagguuaaguggcuacacaaacuuuuuaugaucauagagaccuuuauuagucuucauuucagucagaauuauuuauuugccuuucagcagcacauaugguuuaagacaaauacaguagcuauuucuucuuuucugucaagucgaaaagccuuauccuggcauuguuauugugcucuuccaaacugagaaaacuacauggacaucucaauggaaagucacugccauccaagaccacuugauccugcguguuuaaugauccucuuuauuuuaaaccuggauuuaaagaccuaaugcugcugggugugguggcucacaccuguaaucccagcauuuugggaggucaaaggggauggagcacuugaggucaggaguucaaggccagccuguccaacguggcaaaaccuugucucuacuaaaaauacaaaaauuagccaggugugguggcacacgccuguaaucccagcuacuugggaggcugaggcacaaagagcacuugauuuuucauacuugauucucgagugagaauugcuugaaucugggagguggagguugcagugacccaagauugcgccacuccacuccagccugaaugacagaaagagacucugucucaaaaauuaaaaaaagagaccuaauauccaccuacuaucugucuucauuuuugguuacugcccaccacagcuucuuucuauugcccagacaucccuccuauucaccucugauccuucauucacauccucccaucaucucucaaaaacuacuuguauauaugcauauguauauaugugugugcauguaucuauguuuaucuucacacggcuaaguugaggaaaaauuucccccauuuucuuuuugugucucuuuuuguccuuucuuucuuaucccaccaaaaauaaacagagaaauacaacacaacaugauugauuauacaguguaauaccacuuuuuaauaauuuaaagaaacaucucuauaggcccuuaaauuuaagucggcagaaaugcucaagguaguaagcuuucuuuguaaacacauuuuuccuuugagagcaccgauauuacuuugagauugcauuaucacacaguucauuuucacgaucuaaucuccacagauugggucugucaauuccuaccuguaagcugugcucugccccaaaguugcgcucaaccauguuucuaguucaaaguauaacuuagcagacaccugacccacuucuacuucauucuuuuuuuuauuuuauuuuuugagauggagucucauucuguugccagacuggagugcaguggugugaucucagcucacugcaaccuccgccuuacugcgccuggcuaauuuuuguguuuuuaguagagaugggguuuucccauguuggccaggcuggucucgaacuccuuaccucaagugaucugcccgucuuggccucccaaaauguugagauuacaggcaugagcuacugggccuggccuucauucucuuuuuuggaaaaaaauguauucuuauuuucauagaggcagggucuucacuguguugcccaggguggucuugaacuccugggcucaagcaguccccucgccucagccuccaaaagugcugggauuacaggugugggccccugugccuggccuacuucauuaucuaaucaggguaacuggguuacugccuagugagcuaugauucugccacugcucuccagccugggugacagagcaaaaccccugucuuaaaaaaaaaaaaaaaaaaaggcagcagagucuuaccagcagcaccucuuuaacccaccauagucaacugcaaaaccuccuucauguuaagucuucauggcuaaaaaggggauuuccuaaauagcucccuaaccauugcugggguaagaguuccuccucaaaaggccagcuucuuucccuuucuguccccucuaagggaagcuccccucucccuccuccagugagcuucugaagccauaaccauugugagaaauagcuccuaccucaaagacuucuuauaacaucuugucacaggaggugagcacugccagggcuccaccacagugcucaaagguagggccuagagaaguuauauuaguuaggauacauguucagcugcuuuaacaaaagcccauuccggccgggcgcgguggcucacaccuguaaucucagcacuuugagaggccgaggcaggcggaucacaaggucaggagaucgagaccauccuggcuaacacggugaaaccucaucccuacuaaaaacacaaaaaauuagccaggcaugguggugggcaccuguagucccagcuacucaggaggcugaggcaagagaauggcaugaaccugggagacagagcuugcagugagccaagauugcgccacugcacuccagccugggugacagugugagacuccaucaaaaaaaaaaaaaagcccauuccacagacccacacgguuuugugagaaaaaaauagcccaaaaggauuccaggagaauauuuucacuuaguaauccaaaggaggugguccagaaaaguagggcagcucuguuccacgaggucacccagggguccaaacuucuuuuugugaaaaaccauguuuucuucauuuacuuggugcaagguggcucaucacugcaucuauauucuagcccaugagaagaggaggaaaggggauguauaaggccuuggacucugguacagaaggcuccaaagucuggggguuauauuggacuucauuaagaaaacuguugguucugucuacaaaauauaccuagaaucuaaucauuucccaucaccuucacugcuaccaccuaauccaagccaccgucaucucuggccaggauuauugcaauaauuuucuaucuggucugcccauuucuuacuuguuugccccaccauuauaccuaacagucuauucucaacacagcagaaagagggaucuuucuauaacaaaaaucagauugcuuuuccccuuugcgaaaaucauucaaaggcugaaaagcaucuauaugauguaaccuccuacauucuuguugaauuuuuuuccuucuuuucuuccucuugcucgguuuucucauccugcccuagacauacuggcauccuuauugcuucuagaauauguuagacauacuucugccauagcaguggugccuggaacacucuugcuggaaauauccacgacuaauucccucaccucugucaagccuuugcaguuauuuuuucaacgagucuuucucagaccaccuuauugaaagcuaaaaccaggcugggugcaguggcuuaagccuguaauccuagcauuugggaugcugaggugggcagaucacuugaggucagaaguuugagacuagccuggccaacauggugaaaccccaucuguacuaaaaauaugaaaauuagcuggcugugguggcucacgccuguaaucccagcuacuuggaggcugaggcaggagaaucgcuggaacccaggaugugaagguugcagugagucgagaucaugccacugcacuccagccuaggcaacaaagcaagacugucuuaaagaaaagaaagaaagaaagaaaguuaaaaaccaccuucuauucccuuuauccuuuucaauuuuuucaucuuucuguaguacuuaccaucuuuuaauauacaauguaauuuuauaauauuacuuuuuuacuaucuaucccugccugguaaauauaaaaucuaagagggaagaaauaguugucugucuuauuuagugaaguaucucaaucagcuagaauagugccugaacaaugugagcaauuaacaaauauuggcugaaugaaugagugaucgggauucagaaauggugguugccacuccugaguuagucuuauggguuggaugguaacccuccucccccaccaaaaaaaagauauguugaaguccuaacccccauuaccucagacugugaccuuauuugaaauggggucuagguugggcacgguggcucacaccuguaaucccagcacuuugggaggccgaggcggcuggaucacgaggucaggaguuugagaccagccuggccaauauagugaaaccccgucuuuacuaaaaauaaaaaaauuagccguaugugguggcgcacaucuguagucccagcuacucaggaggcugaggcagaagaaucgcuugaaaccgggagacggagguugcagugaaccgagaucaugccacugcacucaagccuaggcaacaagagcgaaaccugucuuaaaaaaaaaaaaaagagagagagagagaaaugggguuuuuacagaggcaauagaauagaaaauagaaugagguauuagggugggcccuaauucaaaaugacugguguguuuauauaaaggggaaauuuagacagucacacagggagaaugcuaugugaagauguaggcagagaucagcguaacacauguacaagccaaggaaggccaaaguuugccagcaaaccacaagaagcuaggcaagagccauggaaaagauguuccaggacagcccucagaaggaaacaaccuugauuucagacuuagucuccagacugugagacaauacauuucuguugucuuaggccaaccaguuucuguugcuuuguuacagcagcccuaggaaaugaauacauuuagucucuagauauuugggaagguuuaaaugaggucuggaaacuuacuuagaucuggaaguaccugaaaacuguaaagcaguggccaaacaaguuauaauagguaaacaagaguaugucuucaaaaguuaacugugucuacucaaggacucaguaggacaguugcuaaguucugccguuucucuuuucuccacucuaucccuaccccucaccaucaucaucaaacaaaaacaucugcuguaagucuuaggggaauuccuaagcuccuauuucccauaaaggauucaggugagcaucaaccagcuguucuugaagcuuuuucuccaaggcugaacuacaccuuaaaucuaauguguucaucugcuuccuggaagauuaggaaccucucuggugcagggcuuucuguuugaagguguucuauucagauagaucacucauccucaaggcauacacacacacacguaaacauaccaguaucccacccuccaauccccugccccaacagaaugcggaagaagacgguugccuucaacaggcccugcgaugaucacacugucccagcagggucaauaaugacauuggaaggggaggcuccugacuuuuggugaggauagugguuagaagcuauuaggggucuuccaugggcuuuucuuuguuuggggaaugagauucuguuuaggguuuuauaaggugauucagaccaccccaugggccauauggcuucugaauugcuaacagccuaaaggaacagaucauaggcaccuguaagguaaggauguccuaguacacagaaaagacaaaguuuuagacuaagcugggaaggaucugacacuggggagagucagccaccagaaggaguaagugagagggcagagugagaucccaggccugaaagaauggggcagcaugacaggagccaauucuugcucacuggaauaggacacacgaaggaagggauuugguguccaggaauaagccaagauccugaugauagaacugugggucagccaggugcgguggcucacuccuguaaucgcagcacuuugggaggcugagacggguggaucacgaggucaggaguucaagaccagccuggccaagaaggugaaaccuuguuucuacuaaaaauacaaaaaaaauuagcggggcaugguggcaguuguaaucccaacuauucuggaggcugaggcaggagaaucacuugaacucgggggacaaagguugcaugagccgagaucacgccacugcacuccagccugggugacaaagugagacuccauccaaaaaaaaaaggaacugugggucaagguuggagagagucuggcagugacccugacuuaggggugaacucacaaaaucucaccugaaguuuuaaaauuaucuuugguuuggaaugggagccaaucauuucuuaagcaucuguuaaucaccugugauauauuaagguguacaaggcacuggggguacagccaugacaguccuuauucucaaagaguucacagucuaauagagaagaaauuaaaaauaaauuaaugacaacauaacguguuaagugugauaagacaaguaugacagaagggggaaugcuguagugguuaagagcucaggccauggguccaacagaucugacuuuagauccugacucugcaauugcagguugugugaucuugaguaaguuacuaagcuucuauaagcuucaguguuguuuguuaaaaaugagaccaauaauaguacaguugauccuugaacaacauggguuucaacugugcagauucacuuaggcauagauuuucucccucugccccuaccaccccgagacagcaagacucacccaucuucuucccccuccacaaccuacuuauuguaaagaugaugaggaugaagcccuuuaugaugguccacuuccacuuaauggcuaguaaauacauguuuucuuccuuaugguuuccuuuuuuuuuuuuuuuuuuuuuugagguggaguuuugcucuuguuacccaggcuggagugcagugguaugaucuuggcucacuaaaaccuccaccucccaguucaggcaauucuccugucucagccucccaagcagcugggauuacaggcaugcaccaccauacccggcuaauuuuguauuuuuaguagagacaggguuucaccaugucagucaggcuggucucgaauuccugaccuuagaugauucacccaccucggccucccgaagugcugggauuauaggcgugagccacugcucucagccccuuaugauuuccuaauaacauuuucuuuucacuggcuuacuuuauugcaagaauacguauauaauacauaaaacauacaaaauauguguuaauugauacuuuaugucauuaguaaggcuuuugaucaacagaaggcuauuaauaguuaaguuuugggggagucaaaaguuauaugcaagucaaguuuggugguauguuccuguagucucagcuacuuaggaggcugaguugggaggaauccuugagcucaggaauuugaauccagccugggcaacauagugauacucguuucuaaaaaaaaaaauaauagggccaggcaugguggcucacaccuguaaucccagcacuuugggagacugagaugggcagauuacuugaggucaggagaucaagacagccagccuggccaacauggugaaacucugucucuacuaaaaauacaaaaauuagccagcaugguggcaaaagccuguagucccagguacuugggaggcugagggaggagaaucacuugaaccuaggaggcagagguugcagugagccgagaucgcaccacugcacuccagccugggcaucagagugagagaguuggucucaauaauaauaauaaguccgggcaugguagcuuaugccuaaaaucccaauacaacacuuugggaggccaaggugggcggaucaccugacgucaggaguucaagaccagccuggccaacaaagugaaacaccaucucuacuauaaauauaaaaauuagcaaggcguggugacagacaccuguaaucccagcuauuagggaggcugaggcaggagaaucacuugaacccgggaggcggagguuacagugagacgagauuguaccacugcacuccagcuugggcaacagggcaagacucugucucaaaauaauaauaauaauaauaauaauaauaauaauaaugggcugggcacaguuacucacuccuguaauuccagcacucugggaggcugaggcaagagaaucacuuaaggccaagaguucaagaccagccugggcaacauaacaagaccccaucucuacaaaaauaaaaauaucagccaggcauggugauguacuucuguagucccagcuacuugggagguggaggugggagaaugacuugagccuaggaguuugaggcugcagugagcuaugauugugccacugcguucugaccugggugacaguggcagacuaugucucaauaacaacgaaaaguuuuauguaaauuuuuuuuacuguguguggggucagcgccucuaggcaccccccauguuuuucaagggucaccuguacuuacccacaauguaagaucuuuuuuuuuuuuuuaagagacaguuucucacuuuguuguccaggcuugucucaaacucuuaggcucaagcaauccuccugccuuggccucccaaagcacugggauuacaaguguauguaagauucuuaugaggaucaaauuagaucauacaugucuggcaucuaguaaauucucaauaacauugacuaucauuuuauuauaaauuguuuuaauaauaacaauaauaauuauuauaauuaucugcaggaagguaagucagaaaauguuucuaagaaagguggcauuugaauugaauauugaagaacaaaaaaguugcugggcuaggguugggaggaagggaauaaauugcuucuguuuuuugcccugccggauuucucagaagguuuuagguaggaugaugaauucagcgauagucaaauugaauuugagaugccugugagcaacacaggauguuuugaccucuuuauucuaacccuacuauaaucuaaaauuuuacauacuugccucauguaugauuguaacuccaugaaaugaauauaacuauuaaucuuuuuucugcuugaucuucauucaauacuacagauagaaauagcacaaaauaaaauggaagaagacagaguuacacacaguauacuuuugugcugauugaaaaacugacauucaagucuucuuaacccagaaaaacuggucuugauaagaaaaaaggcagaggggcagggcgcgguggcuuauuccuguaaucccagcacuuugggaggcccagguggguggaucacgaggucaagagaucgagaccauccuggccaacauggugaaacccugucucuacuaaaaauaccuggaggcugaggcaggagaaucacuugaacccgggagguggagguugcaaugagccgagauggcgccacugcacuccagccugguaacaagcaagacuccgucucaaaaaaaaaaaaaaaaaaaaaaggcugggugcgguggcucaugccuguaaucccagcacuuugggaggccaaggugggcgaaucaccggaagucgggaguucgagaccacccugaccaacauggagaaacccugucucuacuaaaaacacaaaaauuagcugggcguaguggcacaugccuguaauuccagcuacucgggaggcugaggcaggagaauugcuugaacccgggaggugagguugaggugagccaagaucacaccauugcacuccagccuggucaacaagagcaaaauucugucucaaaaaaaaaaaaaaaaaaaaaaaaaaaaaaaaaaaaagggacagggagcgggcacaaaauaaaacuuacuuugguagaaauuauaagagacaaaauuugguaugggcaaaaauaaaguaaaacugauuaauaaauccaaucuuuggccaggcacucuggcuuacaccuguaaucccagcacuuugggaggcugagauggguggaucacuugagaucaggaguuugagaccagccuggucaacauggugaaacccugucucuacuaaaaauacaaaaauuagccaggagugguagccagcaucuguaaucccaacuacucaggaggcucaaacaggagaauugcuugagcccaggaagcaaaggcuacagugagccgagaucgugccaugcauuccagccucuguaacgggagguugucucaaaaaaacaaacaaacaaacaaacaaaacaaaaauagaaggcugucucaaaaaaaaaucuaaucuuugucauaaauuauuauggaaaagaauuauuucaauaagauaaaaauuuaaauaaagcuuaauugcauucuguaggaaauuaauauagaaauuaaguggucauaaucaaauuuaauccaaaagcuaccuuuuggaugagaagccauccauauugauauaauucugauuacuauguuugcuuucauaaacauggacucaaaacauccuuggaugcaaaaucucaggucaaaaucuccagugacauccagauggauuggucuaggaaauaguaggaacucuuuaucuagaguuuaagaagucagggcaacaacaaauccagauuuuucaggaaaaaauuuguuuugaggugggguccugcucuguugcccaggcuggagugcaguggcuugaucauagcucgcugcagccucaaacuccugggcucaugcaauccucuugccuuggccuccugaguaguugggacuacagcaugagccacuagaucuggcuauuuuaaaaauuuauuuuuuguagagacagguuuuugcuauauuucccaggcuggucucaagcaaucucccugucucagccucccaaagugcugggauuacaggugugagccacugugucuggcugaaauacagauuuugaagcuaucacucuguaaguauuaauccguuuucuuuugcaucugccauaaaauaauaaugcauaguaggaaucuaauaaaugcuuguugaauucucucuagucagcccuacaagcauuacgaacugaagaauuauaaccguagagucauucauuuuaauuuagcaaguacuaaauacuuuacagaaaggaacucucaugcugggagaaugauaaucagagugaaacugaggcucaccaagacuugaacauauggaguauaaccacaaguccuaucaaaaaauauacuauauuugcuggguauaguugcucaugccuauaaucccagcacuuugggaggcugagguaggaggaucacuugagcccaggaguucaagaccagccugggcaacauagugagaccucaucucuacaaaaaauuuaaaaauuagcugggcauggucaugagcaccugugguccuaguuauugggguggcugagguaggaggcacuugagccuaggaggucaaggcugcagugagccaaaagcaugccauugcacuccagcuugggcaacagagugagacccugucucaaaaaaaagaaaaaauaauacuaugucugguccauaaccugaaauauuuuuaucuucacguuccuuaucauucacugaacuuuuauuuuucuuuuaaaauuuuuucuuucuuuuuaaauuugcuucuacagauuucuucauucuccauuuagcaaggucauggaagauuuggaggaaacauuauuugaagaauuugaaaacuauuccuaugaccuagacuauuacucucuggagucugauuuggaggagaaaguccagcugggaguuguucacugggucucccugguguuauauuguuuggcuuuuguucugggaauuccaggaaaugccaucgucauuugguucacgggguucaaguggaagaagacagucaccacucugugguuccucaaucuagccauugcggauuucauuuuucuucucuuucugccccuguacaucuccuauguggccaugaauuuccacuggcccuuuggcaucuggcugugcaaagccaauuccuucacugcccaguugaacauguuugccaguguuuuuuuccugacagugaucagccuggaccacuauauccacuugauccauccugucuuaucucaucggcaucgaacccucaagaacucucugauugucauuauauucaucuggcuuuuggcuucucuaauuggcgguccugcccuguacuuccgggacacuguggaguucaauaaucauacucuuugcuauaacaauuuucagaagcaugauccugaccucacuuugaucaggcaccauguucugacuugggugaaauuuaucauuggcuaucucuucccuuugcuaacaaugaguauuugcuacuugugucucaucuucaaggugaagaagcgaagcauccugaucuccaguaggcauuucuggacaauucugguugugguuguggccuuugugguuugcuggacuccuuaucaccuguuuagcauuugggagcucaccauucaccacaauagcuauucccaccaugugaugcaggcuggaaucccccucuccacugguuuggcauuccucaauaguugcuugaaccccauccuuuauguccuaauuaguaagaaguuccaagcucgcuuccgguccucaguugcugagauacucaaguacacacugugggaagucagcuguucuggcacagugagugaacagcucaggaacucagaaaccaagaaucugugucuccuggaaacagcucaauaaguuauuacuuuuccacaaaucaguauauggcuuuuuauguggguccucugacugaugcuuucagauuaaaauuguuuccaagauagagagccgacuccacuuucauaguuauuguuucuggucacuauauaggcaucacauuuuuguguggauaugaaacuuaggaaggauccucuugacuccuugugauguggcaauaaauuuuuuuuaaaaaacugaaaauacuuaggaaggauccgcauaauuuuuuucugcaacuuaaaugaaaugcaucauucuuguuaauuauaccauggugaauuaaucacuuuugaagcaauaucaguuauuuuuugaauaauaacuuuucuaaagccuuaagucuuaauauuaaauauaugauuagccaggcacgguggcugacaccuguaaucccagcacuuugggaggccaagguggggggauuacccgaggucaggaauucgagaccagccugaccaacauggagaaaccccgucucuacuaaaaauacaaaauuagccggucaugguggugcaugucugcaaacccagcuacucgggaggcugaagcaggagaaucacuugaaccugggaggcagagguuguggugagccaacaucacaccauugcacuccagccugggcaacaagaguaaaacucugucucaaaaauaaauaaauaaaauagauaaauaaauauaugauuaacuaauuuuaaaaauguuaaaauguauucuuaaauucauuuuaauuuuguacaauaaccugcuagacacauuuuuaaaaugcaacauguguacuuaauuucuuuauguaaucuauguauauacauuuaugaauuaaaguaauuguugguuaucuuaa

SEQ ID NO: 191118 - RNA, 18599 nt, Homo sapiens
acucguggguaacuugcuuuugggagccagcgguauggcgucgggcugcaagauuggcccguccauccucaacagcgaccuggccaauuuaggggccgagugccuccggaugcuagacucuggggccgauuaucugcaccuggacguaauggacggguaacuccuccgggcuccggucgggcuugccgcgcggcggggcggaucagugcaccuuuauugacugcuuguuggauguaccgcgucccuguaccaccgagcgccucacucugaacgcgaugcuagaaggggugugggguaggagcccuggaggcucuagcaggagcagaaccgacgcgguauccuggguugcggccgggucccaaaccucaguuccuccccuccccccacguaacguguggucuuccaucacuuaggacccggaagcgaccuaaaucuuuaggacauuucuucacuuucagcuagagaaacugaggcccaaggggagaagcaugacuugcccaagcucauauagcuaguuaguggcaaagcuggggaaacagacuucucuaacgauuuaaguuggcaccugcgguuagguucccgaguucugccacuugcuggguuaccuuggacaagccacuaaccucauugagcuucaguuucauaauuugaaaaauggaacuacuaacagaaccuaccgcuuaggcaucuuggaagaugaaaugagcgaguacaugagaaguuuacagugccuggcguauauuaaguucucuauaauuguuaauuacaucauuauuacaauucugauuuuccugucuauuuucucuucaggcacccugcucuucagggaggucaguuuuuuguaaguaauuuuuaagcaccguaguuacagcacauaauauuguuuggagucaggauauuaguuucugaaguugguuacagaaugaggaaacaaccccagagaaagcaguaagacucccucaagauuacagaagauugugacagacuugcaacuuggcucuuccuagguuugccaaguaguucucugagccccacuguuaacugacuauaaaaaucauaaauaccauuaucuugaguggggauggaaaaauaaauuuauuuuaaauagguaaaaacccuguguucccucauucaguuugcaaauugguguuauuuucuaaaggugaugauuuccuuuucuuuuuaauguuaaucuggcuuugaagaguuuuaucuuccauugcucuaugugguuaaauguauuguuucucuuuggcauuuuacccaguuaccuuaggaguccacccaacugauaaugacaaaacuuugaccauagaguacuaaaaauaauaggccaaauguguaaaaaguuuaguaaauauuaccucucacaaagguuggcuuuuaauuggccauuauauguaauuauacuuauauacuuuauuuuugacaucuuugcuugaaagcccuaaacugucacagguaauaauacccugagugucuaccucaaagguaaguagcuacauuuuugugccugagaaaauaccuagagggucacaggauggaacagcuauguguauauuugugagucuauuugagcaauuugguuuuaauuaaacuauguuugaguaaguuaaugguuggggaaaguaauuguuucgguucaccagucaggauuauuaaugauaaccauaguagcaauguuuaugagcacuugacuguuucuguucuggaguuuuuuugugaauuaacucaaacaaccguuugaaauuggugguguuauuaccaccagcauuugacagcgaggaauugggcacagagagguuaagucaucugccaguggucucauaacuaggaaaugguggagccaggguuggaagcaaugcaacagcuuguguugucucaaaugaaaugcuuucugugguuccuaggcuuacagggaaugacuaagacauuguuuggccucaaaaaagcaacuaauaauuuguguauuuauuucuguuaacuguauacuuauuuuuguuaacuuauuucaugucucuccugcuacccuauaagcuuccugaaagccaaguuuaucuucuuuuugcucaccuauauauucuuugcuggaaaagcaccauaaggugcuuaguuauuguuggccgaaugaaugaauagcuuaaucauaauaggagaagucucucagaagucacuuuuguccccuugcagcucuauggcagacugagcucaguaaggcaaaguauuuaccauggaucagaguuuugggaacaaaaaaauaaaaaaugaaguauuuguuuuuuauugauuccucuuccccuuugccaggagauacuuugguuuggaaaaacugaauucugcauacacaauuuuaaaauuauuucccuuuuaaucuucucuacuuucugaguuaagagcuguuucuauuccccuuuugcaaaggaggaaaccaguguagggagauucagcuucuucccugaugucucaccagauucagcagagccuggcagaguuggugccagugccccuacgugaugugcuguggugucuacuaggcuagggcuaugaaagugggcuguggacuccuuuuugaaauguggccagccacaaugucccuucccucccaggacugccuucguguuuuuuuuuuccuggccccuuuuaaaaaucucauccaacauuacacuuuggaugugcuuauuguuuucuagucuccuccccacuaagaccuccaauuucuccccugauuacaacugaauuucuucauuuagaaagucagaaaccagucuggggaauacuguggaagguggagcacuagcaugacuggauaugugaaacaaaggacaaguggauucucugggggaaaaaaacccuagaaaacacauaaaugcaucaugacaggacagugacuagaauguguucauccuaaccaugggaacagagcaaagaauuaauuucuaaauucgcuaccaggauuuaaaacugggacgauuucacauuaauacugcauuucugacuuuugggggaaaaaaaaaaacaguucaaagacuugcuagcacugggcccucagucuuaccaggugacaugcgcuggagcugacaggggcagccucaccuuuagucaugugggguguacuucauuuggccccuuucccuaucugcucuguuuugcucuuugauguuaccuaacucucagcagcauugaguuugugauuccugauucacaggaagauuguguucuaguuacaguccuguaccuuuuauagcaacucuaauccuccucuuaccaucuuugccuuguugggagauaggguaaauggcuugaucugucugcaguagauuguguuagaauuacguaaguaaagcuuaggagugaugauggaacaugagagagaaaauuguauccuuguauuacaaaaaauuauaguguaauuccaguaagucccuggaagaaagggauaccuuuuuauuuuauuuuauuucuuucacacuuaacuaacuccaggaaauaacuuaaaggaaaaagaggcagaauaagauaaugaugaagcagacuuuuuagugaaguuucucucuguuaagugaaauaauuaaguguuuuccaagcuggucuguuaacucccucuggcauuuguucaaaauucagauucccgguccucuuuggagucaguaggcugagguagagacuguaaauacauuagaacugcucucaugguuacuguuuggcaaauuugggacacccugacuucgugcuuaggauuguagccccuuuuuguuauggcuuagcguagccuuuggguuuuuuuuugagacuacugaugcauucuuguucuuccaauauacuucgugaaccuagugcauugaauugauuuucaaaagcacaaauuaagucacguaacuuugggguuaguauuuuuauacguuuuguuuagguuuucccaaaaaaguaaaaguguauuuuuuuugguucuuuuauuuacucgggaggugguuauuauacuuuuauuuucauaauaaaugaaaccuacuguuaagacaacgaaacuauuucccagacuacacagcaaauuaaaagaacaguaugugaaauucagaucuuuaauuccagaauuguaaaacauucaauaggccuuacugccugcuucugugacccuuauuucaaguucuaaguaaacacaugcaucuuauccacagcccugacaaucauugcucaggcaaauguuagaaucacuuuuuuaaugauagaaauuaaaccuccaaagaccaagguguuauugagugaaagugucuguucccauccaccuuaugugucccucucagauguguccugaauccuuaccucucucucuugaaucucuucuccgcuagacuuuuuccccuuguuuguuucguuuguugucauuauagggacagaugagcauaguaguuaagagucuggacuuuguagccauagugccuauguuuaauuccugccuccagcacuuacugguugugugaccuugggccucuguuccucaucuguaaaauacaguuaauaaaaguaccuaccucauaggguuguugugagguuuuaaugauuuaauauacagaaagucuuuagaacuguguguggcccacauauaaguuugguuuuuauuagcacucauucuaccugucaucuaacugugagaccuuaaacauaguuuguauuuuaacuccccucccacacaccuaaucauuuaacagauccaaucaguuuugccugucuugucauucuuaguguuccuugccacuuaccaaguggcaauugcagucaccuacccucuuguaauuuauuucccauccuaucuuauuuauuaauauuucucacuuuaagaucuuacuucauauuuacagcaggacaaaaguccagacacugagcuuggcauuugacaccuuuaaugugauacuaccaaccucccaucuuuuuuuuacacuagccaaaguuggucaauaccacucuccacgucuuugacuguaacuugcuuauuucugcuuuugcuucauuuucagccuuuguuucuuuucccaucuuuauaaauccuauuuuguaaaucucaugaacuucuuucuuaacguucucuaauacuugcucuuauuuuauguauguuuuaucuauaaucacguuaccugccuguuauuguauagcuuuucuuguaauccucauauaggauaauaccugcugcuuuaacaaagcccagauuucaguagcuuagcauucuaguuucucauucauaaaagaguucagugugaguguuauuccauucuguggcucuuccauucuguaagggcuuuguuggcagaaggguaaaguggcaauaggaaaggaauucuccuuaaccuucugagcucugcagugacacacuacuugcacucacagucugguggugagagucacaugagccacuuggauguaaagggaacugggaacugggauguaaagucacaugggccacuugaauauaaagggaacugggaaugaaaagguuugacugaguugacaucccacugacaacuauacgauagcaguaggguugugaauucuggugagucauucauuagcugucaaucucugucauaggaacuguagcguauuuccuuuacaaaacaguauucugaagcaccuaguaugguacuugcauauaggggauuuuuuuuguuuguuuuuguuuuuuuuuuuuuuuuuuuuugagauggagucuugcucuguugcccaggcuggagugcaguggcgugaucucagcucacuacagucuccaccuccuggguacaagcgaucuuccugccucagccuccugaguaucugggauuauagacgcacgccaccacacccagcuaauuuuuauauuuuuaguagagacggaguuucaccauguuggccaggcuggucuugaacaccugcccuugugaucugccaccuuguucucccaaagugcugggauuacaggugugagccaccaugcccggccccgguuuuguuaaagauuuaagugaacuagugauagaacaaaaagauuaacuggaguaggguaaaggauaaguaccgugggucugguagacuugauuuguuuuuguuuuuguuuucguuuuugagguaagucucgcuuugucgcccaggcuggaauacaguggcacgaucuuggcucacugcacccuccaccucccagauucaaacgauucuccugccucagccugccuagaagcugggauuacaggugcaugccaccacucccagcuaauuuuuguauuuuuaguagagacaggguuucacuauguuggccaggcuggucuugaacuccugaccucaagugaucugcccgccucagccucccaaaguauugggguuacaggcgugagccacugugccuggcugguagacuuaauuugaauccacuuccacaaauuauuaacugaguuacuuaaggauuuuauuuaucuugugcucuucaaaggggauaauaauagcaucuacuuuguaaggcugucgugaagaugaaaugaaguaaauuacgaugcuuggcauguaguaaacccucggugaaagguggucguuacuaauaaacacaucauguuucuuuauuagucaucuuuaagaaaguuuaaagaaacugucauuuagugccuugugauagaagugauuagaaguagccacaggccuccugagauagacuaggauucaggagaucaauauuagaguccagaacuuacuaacuagugugugacuugggcaagucauaaagccugaggguuucugauuuuaucaucucuccauuucuacuugucaugggucgugaauuacggagucaaaucauuaugaaaauauaugugacgugauuuguugaaaugucaaggagacauugccuaguaaaaccaaaaugacccauuauuuuuaguauuauuuaauacugaugauuaaguauuaaauugaaaaacauugcagacaauccccucaaccugugucagaauucauauugagagagauacagaaacugaauugaaaacauuuucagaguagauuuuguuugucuuguaggcauuuuguucccaacaucaccuuuggucacccugugguagaaagccuucgaaagcagcuaggccaggacccuuucuuugguaaguggguguuacgccaucugaagcuggauguguugcucaaguaaaggaaaacuggaugguugauuuuaacuuccaaguucaucuggcacccuuuccccaacuuuccuauccugggucuucauuggccugacuccaguaacaagccaaacuucuuccugccucugggccuuggcuaaucugcauggaaagguaguagcuuggcuggcugccucaucuuugggccucaagucauuugucauuuccucagagaggccuuuuugagcguccucucccaaauuaaccuuuauccaauuaucuuaucaccuguugauuuuccucugagaacuuccuuugaucugcgauuacuuuuauuagacuauaaacucucugagggcggggauugaauccaguuuguuuacugugguuuuccuaaagcuaagcauagacaugaucagggcucaguguaauuguuaagugaauuuaugaaucaguugauuuaugguccagaagccauuuauuuugugcaaauuggagcuuucuacaaguggugccuaaauauucacuccaauguccuaguacaauguaaauuaagauuuuuaagauuacuuaguggccuacaagugauuuauguuaaguuagcaaugucucaccugccagaucucuuaaacaugagaaauuuuacacauuuuuauaaauaguguuauuuauuuuuuucuuuuuuuuaaaauagagacugaguuucgccauguuucccgggcuagucucaaacuccugggcucaagcaauccaccugccuuggccucccaaagugcuaggauuacaggcuugagccaccagccuagccauaaauaguuuuuuuaacguagcuuacaauuuaguagaacuuagauucuuuuuaaucagcauauugcugaccaguuuuaugaaggacucugugcuguucacuaugguagucauaagccacauguagcuauuaaaauuaaauaaacuuaaguucaugaccagaauggccaacauggugaaacccugucucuacuaaaaauucaaaaauuaaucaggcgugguggcaaacaccuauaaucccagcuacucaggaggcugaggcaugagaaucacuugaaccugggagguggagauuguagugagcugaggucauuccacugcacuccagccugagugacagugugacacuccaugucaaaaaaaaaaaauuuuuuuuaaauuaaauaacauaaacuuaaaaauucgguuucuuauucacguuaaucacauugcaagucuucaguagucacauauuguacagugcagcuaugggacauuuccaauaucacagaaaauucuguugaauauagucuccagccucuguguaggaucuaucuacuuugaguucaccaaagaaaauguacauuauuaccucauuuauguggcaugaggaaacaauguuccaccaauauauucaccauuuugaaauuuccauauaaugggauauaguccucugauuaucuaaacuuucuuuuaagccaugauuagcuuauauagcagauaccgugacuuuuccuaugaauuacgguuguucucaugaccaugagagguagaugaaauaaauagcauuguuuucucccacuguacaaccaauggccagaauccucgcuucuggcuugcuugugugaauuuuuuuaaugcuugcuuuuuuuccccuuuucgcucccuuuuauuugggcucccauugucacaccauacuauugucuauaucccuuccugucagugccuuuccuuuuagcaauccuguguugcugccaccacacacaaucugcuuuuucuucuuguuuuuaauuuguugauaaacuugcuaauuaaucuuucuagaauuuggucuaaaagauaaaugaacuccauucacuuuaauguuuggguuuugugacccuuguuuuuugguuuuucgcuuuuuguuguuguuguuguuguugcuuuaagagacagacuccgucuauuacccaggcaagaguacagugguacagucauagcucacugcauccuugaacuccugggcucaagcaauccucccgccacagcuauagcuaagacuacaggugugugccaccacaaccggcuauuuuuuuuuuuuuuuuuuuuuuuuacuuuuuguagagaugggaucucccuguauugcccaggcuaaucuugaaugcuugggcucaagccauccuccugccuuggcuucccaaaguguugugauaguagguguaagucacugagcccgacuaccuuuguuuuuuauauugagaaacauuuguuuaauucuuggauuuugguuguuggauaauugauacaugaauguauucuaggaccuagauuacauguuguguuguauauguaacgcuaacauucuuaacuguucaguuuucauauugaguagaaauaaaugucuaagaaauacagugaugggaaaagucuguuccuguuauugucuaaaucagugauccucaaguauguuguauaaggacccacacaaauccuuaagacccuuucgggucauccaugagaguauaucaaaacuauuuucauaauccuaagaaauuauuugccauuauuucuacugaugguacaaaaacauugaugaguuaguuugcuggugccuuaaccaacucaaggcagggacuguaucaggaguuauucuucaucaucaugcauuugcaauaaauauccuugaugaagcaguagaaauuaauaaaucuuggucccugaauacaugccuuuuuaauauuuuguguggcaaaguaggaagugcauauaaagugcuugugcugcauugcugcauacuggaacauaaugguuuucucaaggaaaaccacuugcaccauagaggugugaucugaacuagcugcuuuccuccagaacacuauguuuguuugaaagaacaacugacagaucaacuaugguuuuucagaccuggcuauuuuaaugacauuuaaaaaauauuaacuaaaugaggcugucucuucaaggaaagauaccuugucaguuuuuguucccaaaauuagaauuuuaaaaaacuuguguaucuuaccacucuggguuugauagcgucccaacaguuaacaagcuuuucugaugagaucuguaguuauuuuaccaaaugugauuuugggguacuauggaaugaaaucugucacuauuuguaagauguguguaacucaguaaaucaguacuuaaaagacccauucaaaauacaagacaaacaauggguuuuaauguaacaaagaaugaaaagcucauugauaggguuuacagagugcacacugcagcuaaccuuuauaaaauuaccacccagcacauuuaagauaggcuaggcuaagcuaugauguuugguguguuagguauauuaaaugcaguuagagauaacaguauuuucaauuuagauugaguuaauugggauguaaccccauuguaaguuacagaacaucuguauuacaacagauuagauacagaacagaugugagaauauaggugucuucuguuaagccagacacugaaaacuugcaaaaauguaaaacaaauaauaccacucuuaauuaauagguaauagaguuauccuuuuuuuuuuuuuuuuugagacagucuugcucugucacccaggcuagagugcagugguggccuucauaccucacugaagccucagucuugaugggcuccagcaguccucccaccucaccucuccccuccaguagcugggacugcaggggcacacuaccaugccuagcuaauuauucuguuguuguugagaaggagucuuacuauguugcccaggauggucucaaacugggcucaagccauccucccuccucagccuccuaagauuauaggugugagccaccaaacccgccaaaaauuacaugcuuuaaaaugucuuaguuugaauuucucauacauuaaauaucuauaaauauaauccauaucaacagaaguuucuuggggucuuuaauaauuuuuaagaguguaaacuccugggcucaagcaauccacuugccuuggccucccaaagugccaggauuacaggcuugagccaccgcaccuagccauauauaguguuuuuuuaauguaacuuagaauuuaauagaccuuagauucuuuuuaaucagcauauuguugaccaaguuuaugaauaauagauuaugauuauaauagaugauagaaugauugggaauugcugaucuaauguuaacuaugcacagauuugcugaaccauugacucccugaacaccauagaacuucuccauugaggguugcuagugguuacuggaugcuagagguugaguaaggaugacauagcuagcagucugguaacuuaaggaaugaauagaguagguuuuuuuguuuuuuguuuuuuuuuugagauggagucucgcucugucgcccaggcuggagugcaguggagcgaucucggcugacugcaagcuccgccuccuggauucacgcuguucugccucagccucucgaguagcugggauuacaggcgcccgccaccacgcccagcuaauuuuuuuguauuuuuaguagagaugggguuucaccguguuagccaggauggucucgaucuccugaccucgugauccacccgccuuggccucccaaagugcugggguuacaggcgugagccaccgcgcccggccuggaguagguauuuuaaaccggcuugaauuuuccuuguuuaugaugcaaagaauaagaaacaccagauuuaauacauuuuuuuaagaauaaaguuuuaccuauuaaaauauguucuaauuuaggccgggugugguggcccauaccuauaaucccugcacuucgggaagccagcgucagaggaucacuuguggccagaaguucgagaccagccugggaaacagugagaacucaucucuauuaaaaaaaaaaaaguucucauacaauuacuuuugcuggauuagaaauacaaacguuaaucuugacuuuauuagucaagcuuuauacuuucuuuuucugacuuuuuuuuuucaaggcuuuauuguauuucauaauuguucugaaauguuagaauuuuuuucuuaaauauagcuuggcuguuucagaaaugugcuuccucuagcaaaauaaaaaacuuaaaaccucuccucacuaccaucuaucaaacacaggauucuucacaguguuauuucuugguuuagcuuguuuuaagcugcccucuccuucuuaugaaaugcuauuauguuuuaaaucaagaucuuuaagaaggccaugcccauuuucaccuuauguguuuauaugaaucaagcuuuagaauuaggaugaauaucagguuucuugcagucaacauguccuucccccuaaauuuguucuugcagucuugccucucaauuaauggcaguuccguucuucuaguugauaaggucaaaauccuugaugccaucuuuauuuuccucucaucuaucuauccauggaggauccucuuauccuccacaucucaucuauccucagcucucuuugcucuuauuuaagaacauauccaucccgaauugcugccaucauuuuucaccuggguuauugcuaucguagcuuccucagucgauaguaucuugucacuucacuguggugguuuuucccaguggccugcagaaugcugaaggguuucuccucaccacaugcuucccugaccucugacugguguaucuccuuccccaggcacaccagccauauuaacugccaaccuagugugcauuuuacuuacuuauuuuguuuauuguuugacucucgcauuaagaauguaaucccuaugacaggagaguuucauguuuuugcucuaacccuaggaccuagaauaauuaaugaugcagcaauagcucgauaaauugaaagaauaaaugaaaaggaucacuuaauuuuuccuagaggaaacuaguuugcauggauaguaugacuuauucuuuaaguuuuuuagaguggcauuuccuggaccuggaccuagauuuccugauuuuuagauguuaacuuuuuauauacagcacuguaugcuuuuugugggaaaauaguguuuuuuguaaaugaauuuaaauaaauccuugucuucaaaauaagaggaaacuaccuauacugaauuagaacuauuuaaauaaugauuugugugauggccaaagaguucuuaucagaaguggcaaaaacuacauacagguuggcuuccaauaacaugagccagguauuuuucaguaauauuuugaagugucuuuucuuucuagacaugcacaugaugguguccaagccagaacaguggguaaagccaauggcuguagcaggagccaaucaguacaccuuucaucucgaggcuacugagaacccaggggcuuugauuaaagacauucgggagaaugggaugaagguaagaaaucgugaugagaguguuuuguaacauucacucucaguugggaagauuugcgggaaacaggaaauuuucucuuuuuuugauacagucuugcucugucacccaggcugaagugcaguggcacagucagggcccauugcagguaaagaauaccuuacuuaagcagcuguucuucagcuaugaugccaggauuuaacuucuuugucacauagcauuuauguauuccacuaaaguuuucugaaagcuacugcuuguugaaaauacuuacauuuaauagucuuguuaacuuuuaaaaaauaagaacagauauuucuacugggccugcuaugccacaauaauauaauacagaaguaauuguaaaugugauauagcauauuugugucuguuacagguuggccuugccaucaaaccaggaaccucaguugaguauuuggcaccaugggcuaaucagauagauauggccuugguuaugacaguggaaccgggguuuggagggcagaaauucauggaagauaugaugccaaagguaaaagaaguauuugauuuuggggugaggcuuuuacaguguguucauucaguaagcauuuauugaaaggcuuguauauuuaggcauaaccuguucugaaggugaggagauggggaugcuuacagaucauucuaauacaguauaauaaaugcuguaauagauuucugauuuggaaaucagagaaguauuacaucuuuaucuugaaauuuucucuuucuuugagacaaagucuugcucugucaccugggcuggaaugcaguaauucaauuaggguucauugcagccuugaccuccuggacucaagagauccuccugccucggcccccugaguagcuaggacuacaggugcauaccaccaugcccggcuaauucuuacacauuuuaguagagaggaggucucacuacguacccaggcuggucuugaacuccugggcuuaagcuguccucccaccuuggucugccaaaguguugggauuacagguggcagccaaccacgccuggaagucuugaaauuuccuuuugaaacuauuaucucuaacuuuuagaucucuuggaaguugucauugacuauugaggauuugucugucuuguuuacaugacagucucugcaaagacaauacagauugcuguuugccaaauagaacaaagcuugcuauuaaaaaccaaguguuccccaguaauauguuguauugguauaguuauugugugagacaauuggaguuuuaauugcuaauauuugcuguuggauuuuuuuguuugauugucccccacccccacccccaccaacauacccacuuuaggaguuacuuauuuccucauguauauaucuagguucacugguugaggacccaguucccaucuuuggauauagaggucgaugguggaguagguccugacacuguccauaaaugugcagaggugagauugcucuucaacuaugacuagaccaauuucccgucaaauaugucuccaggacauugucucaugggccagcgauucccucugugguuccuaaguugacuuucuuucuuggaaaaguauuuuuuguucacauguacaacuaggaaaauaaacagccauaaguggauaugcuuuuuuuuuuuuuuuuuuuuuuucuuuuucugagacagucucucuuuguggcccagauuggagugcaguggcgugaucucugcucacugcaaucucugccugccggguucaagcgauucuccugccucagccuccugaguagcugggauuacagguaccugccaccaugcuuggcuaauuuuuuuauuuuuaguagagacaggguuucacuauguuggccaggcuggucucaaacuccugaccucaagugaccugccugccucggccucccaaaguguugggauuacagaugugagccauggcgucuggcccguaaguggauauucuaaaaucacauaaauuguuaaaauuguaaauccugguuuucucaggaaggcugaagaaaguucuuuuuuauaaaagaauauguugaauuucagcccuuuggaagaucauuaaguuucacggccuuggaagugagaaauuuuuccaaaauacggaauuaaaagguacuaccaaggggggaaaauagauaaaucuaauugaccuaauuauuacauuauucuuuagaaccuacauauuauuuaguuguuccuuguaagaacuugcuagaaccauuuuugaugaaaaucuaggccugauaccucuuuggcuaucuguauagaaguaaaaacuuuuuuuuacuuuuuuuuuuuuuucagauagcuagucuagcauagucaggcuccugaggaugccagcccuucugguagcacugcaagugauuaaagcuuacaugacugcuuuucuuccacagugugauguaucuacuuccagguucuuguauaacugccacacguuucugcuugauauauaccuaucaaaagcuugacaguaguaaauacuuaugcaggaggggcuggccagaugaugagugagcucauauccuuuugaucgcuuguggaauugcuuuguacuaaacugugcuuugccaguauacuauuccugcuuuuaugccagagguagcaaauuuuuugugugaaaaaucagaccuuggcgaugaccuuaaacagcaggauaugaagaacucccacaagcuuagcguuccaauaauggaacacuaggcauaaauggguuaacugaagagaauauuugcaguguuaacccuauaaaacucaccuuuauaauuucugugaggaauauuguuagaaauguugucauacaugaagugacacuaucugucuggaaaaauuuuccucagccugugguucucccacuucucccucuuuguucuagcaaugaaucacaaaacagauuggguuuccauccuugaaucagauccuaggaagaucagaguuaaauuuggacccaauuuuuuagcuuuucuuuuucaauuucuuugcuuccauauuuaaauguaucuuaaaaacuuuuuuaaagccacuucaaaaccauucugaaaugcaaugaaguauaaagagacauucuauuuuuugacacaaaaacgagaacucacuuaauuuugccguaguuuauggauaauuuuacauuuuuagcaauaauuguccuuucacacucacaaauucauauaaauauaauucaaagaauaaaaguguuuuuuuaguaacuguagaggcauuggugcauauugggaaaaaccuuaguggacuugaggaguaaaggcuuuuaaaccuuaucuaaaggucgcaaagauaccauguagauuauuaagaguugguuuaccagaaaggucaaugauuucuuagacacauuuaaaaauagucugacauccucaucugugaacauuuuaaauuuuucuuauugaacuagauugcuuaagucugcuuaaucucaaaguggcucucauaugauugaaauguugacagaugcaaggguagacacucuaguccaggaauucuguuuuagguuuuucuacauuuuccuuugaggcauaaccuaacuguuuacuucuuccaggcaggagcuaacaugauugugucuggcagugcuauuaugaggagugaagaccccagaucugugaucaaucuauuaagaaauguuugcucagaagcugcucagaaacguucucuugaucggugaaaccauaaggagcccaguguuccuguucaugaaaucucccuuuuacuggaaaacaggaauauugacuaccaaaucacaaugcaauugaagccguacugcuuuuuugagcaguuauucauuccagugauuaaaacugauugugcagaauauucuaagaggucagaaauugguguguauaacuacauuuuuagugaugcaauuuauugauuagugaguaagauacuguuuuuauugagagauuugauuuuuauaaaguaaaaauacggcugcauuaggguuacaaacagaaaagugucuuaaugucuaaggagggcauauuagcuacacuacaaaaacaaauuuugucuguacuucugaaaagaauuuuguuguuucucagcuguuuuccaaaagcaaaggaagucuuuaugguuuuuuucuauuucauguuauugugauuuguuuauaaguuuggguggggugcauaccauauucuugguucuuaaaaucuaucacuuuucaccuuacacuugaugugugaaaacuauaaaaacaaugugugaaacccagggguucuaaaauacaagcauagauuuuaucaggguguuuugucaaagcagguuauucagugauuccuccccaccauucuuaagaacguuaaauaaugcuguuguguuagcucugaguagaaaggaaaaaguaaaaccucuguuuggagguaauauuggguugaauucugacugccccuuucuagcuggaccuuuaacaaaucacccaaucuuuuuuguguuucucuaaagucauuuauacauuaaauguaauuauagcaacugugggguucuguugagaauuaagagcuaacacuauauauguaaaguuuccaguacuagucccagaauuuagaauaugcucaacacaaaguaaacagcauuauauaaguuuauauuuuugugaguuauaaaguacuuugauauauucucauuaaaucuguaaaucaccucuauaaguaagugguaauaauaaagcagauauuuuuguccccauuuaaaaaaugaagaaauuaaugcuuaauagggugguacccuggaaaggaucugggaagugguagaauuucuggucuguacuuuuacaaauggagcccuugggagguggguuagguaaaagaagcuuuuuacuuaacguugucuuauuuccagucuaauuuuacgcuguagcagaaccagauggcugagaaaauucuggaacuauggaucuugaccccaaggauauauuauuuuauuccaagaaagaucagguaggcgaaaagaugacaggauacagagucaauccauaaacuaaauauuuauaacuguucugaauuauacagagucuaaaaauaugugucagcuacuucauuccuguaaauacucuugcuguguuauaaauauggcaagaaauaaacaugaccaauaucaau

SEQ ID NO: 191119 - RNA, 150617 nt, Homo sapiens
uuauauuuuugugaguuauaaaguacuuugauauauucucauuaaaucuguaaaucaccucuauaaguaagugguaauaauaaagcagauauuuuuguccccauuuaaaaaaugaagaaauuaaugcuuaauagggugguacccuggaaaggaucugggaagugguagaauuucuggucuguacuuuuacaaauggagcccuugggagguggguuagguaaaagaagcuuuuuacuuaacguugucuuauuuccagucuaauuuuacgcuguagcagaaccagauggcugagaaaauucuggaacuauggaucuugaccccaaggauauauuauuuuauuccaagaaagaucagguaggcgaaaagaugacaggauacagagucaauccauaaacuaaauauuuauaacuguucugaauuauacagagucuaaaaauaugugucagcuacuucauuccuguaaauacucuugcuguguuauaaauauggcaagaaauaaacaugaccaauaucaauagacuucuugaggcuacuauaaguuuugagaaauaagguucaaaaaauaagaaugcuaacacuuaagcacagacuagagcuugcuuggguuucuuccugcauuacaagguaaaaauuuguuaauguuuguuuuuauucagcuugggaaagcuuugugccaugaauacgucgcauuuaauaacaagcaacacacggcauauagaaauaacuuuaauuaaaaaacuuacauagaagauuauaauaucagacgugacaaagauuugaguuuauuugccuggacaacuuggguuugucuggcuuuuguuuucuuuuucuuuaaaaauaaauguacaguaaaacuacaagcaaaaguuugucaguauugaauugaauuuuuuaccccuuaaaaggacuaguauaauuuccaaucucuaacaaaaacuuagugucaaaucucacagauaaggccaaauggccaauauuuucaguuauguggguaguacaacuugaguaaccuuuuuuacaugacaaaaagugaguuauauaaauuguccucaacuuucacauaggaaaaaaaugguuuaauagcuucaaaaggaauuuucuuucauguauacucuucaguauccaauauugaagcuuuguucuuugaaaaauuuuaauuuccaaucuaggaugcaagcaagaauauauguuuauuugaauagaguaagcuauggcaaagaaugaccaaauuagcuagaaauagaaaucagccagaauuaacuaauuucuugcuaaucuagaaauacaaucaucuuuuuuuuuuuuuucaaauuuuauacugauagggcuuuacuguuuguggcucauuuuaaaacuggugucuucucuucaugagacacauuaauugguaaaacucaaauugaguuuucaaagaugugauaguauuaaagugcaccaauauuugacucaaauuugcuugcuuuauuuuguuaggaguaaacagaaaguagccuguguuuagucccaaagauagcagugauuuugaauaaaggaguuuuguguugccuggauauaugaauuucuguaaauaacuucuguugguuaaacauguuaaaacaacaacaacaacaacaaaaaacuucugucucuauauucaggacguucagaugucuuuuauuaguggaaaccuguguuuuaucuauucugcagcuuacauuucauaggguaguucauacaugcauuuccaaggggagugggucauugccaguguuuuaaaaacuacauagggguguguguguguguguauguuuauuuuauacacacauauuuguauauucuaauauauuacuaaggcaauuuuaaugaauuaccauguauauaaaaaaauagcugucacuuggcacacagguuuguauguauguguauauauauauguauguauguaugguguggguacauagucuuaaaaauuacccaguaaugugauuugacaucaaguugcagcaauuaauaucuugguguuuguaaguaaguugcaugauaaacacaaaugacuaccacuugucuguagaugaaaaucugguuacccuuaugguuccagaaggaaaaacagacuuaucuugccuguuucauaaacagcauaaaagauuaauacaugcagaacaugcucuuauucuggaggggaugggggauccagaacagggcuuuauuuccucccaucuuuccuacauuuacauaguuuucuuaaccuguucccugucaccuauuuuuuuuaacauuaguaaguccuagaccaaagguuuuguauucuuccauuccaucugacugcuuuuuuggaugguggccauucucugguacacugguaccgaagauuucaccauggaaagcugugcuugaccuuucaaccugauccuuuuuuucaucuugacauaauaaggcugccaugucuucacccuucaguggaaaagcccgucguucccaccacaaagacugaaaggggaaaaauuuucaguuaaguuucaacuaacuuguuuuguuuaaauucaucuaacaaguaaucuguacaugucuauauuguaauaauuguucuguucuuuagcacauaaauguacaauuuuucauuucaacuuaaauagcaacucaaaauggaauauauugagaauuguugagugacuuuugggauuuauuucuuuacuuugccucugccaagaagaggaaaugcugccauaggcaguggucuucauuuccgaccuaagaguacuuugggaaaguguucuuagguuugauauacuucuacaguaucuucauuuucauuauuaaagguaccuauuaacuuuuucuuuccugagcuuucugcaacuugccuauuaauucuauaaucuccauuccauucuagaucuaguucuuuuucaguaucuauuuaggaagaaagguguaagaacuuuauggaugcaguguuagaaagcagucccuuuaaaguaggaacugggucuguggugaggcauguaaaaaucuuaagauaugaggagaaagaaauagcagcuaacuuuggccauguagcaggugcuauucuucauuaaucagguuuguuucguaaugaaacuuugauaguacuuccacucucuaauagauaaauaaguacuuggaaguucguauugacuuguuacacaaggugauuauaguuaguaguggacacaaaaugcugcaauacagaucuucuauaccuaacuuauugaauuuguuauguaaugauguaauaaacuuaauuuuuuucaaguaguuucuacaaacaaguaguuaaaagucaaggaaugggaaguuuaaucauacauauuacacuuaccuugguuucuugacuuugauuuaaagaagguaagccauaugcacacagauccugguucucugaaggaagcccaggaggacuugcagcagcacauugcugacugcuacugaaguuauuaggguauucuuucaaaagcaaguccuguccuucaacauuuuuacuguaagcucuagcaagaaaaucaggaaaacacaauuauuuuuuauuuuuugaggucuugaaaauuuaugaacaacccaagguaucacugagucaaguuaacuugguaacuuuaaacaguuuugcccaaagauuuuuaaaaauuccccuggugcuauuuauuauuuucauacucagaggaugaaauaguacuuuaugaaauauuuuaccgaauuauaacaguuguggggggaggguuauucuuguuuuuuauuuggguuugcuuuugucuuuugucugacuaauuaaaugaaagaugcuccuuaacuaaagugacuaccagacuucacacaaucuugccuuuuugaguuuuggcuauuuuaaaaaugaucaaauguauaauaaauauaaaauaggaauuuucucauauauauaauaauuaugucugauuuauuuccccuucccucaaagcucauuuguguuucuaaaaguauuuuagacuuuuugcauuuuagauuaaacagguuucuugagaaauuuuuuauuuuuuuaaagaaaaacauauuuuggaaguagugauguuaaaauggauuaccuaaacuccaguccccagugugagguccauuauuaaaguagauugaaaugaccuacuuuauauauacagagaauuuucacauuauuuguuaguuaaauccauuccugaggcugacaacauaagagaggaaaauacagaaacuaauuucaucauuauauaauuagcucaaauauauuuugaauacaagcucauucuauguaguauuuuacuucuggugcacaauagcugauguuacaacagcauguuuuccuuuuuacuggucucacccaaaauucaugcagagguuuuguucauuucacauggauucuauggcuugggguuuuaaauuuguaaccugccugcuguuucuucugugccacuugcuuugcucccauagugaccaccuggcuugcucucucucuucauauuuuuugugccuuagggagaagacuucaucagaaagaucuucuaucuggaauuagaaauaaagauuuuuguuuuaaucagaaacauuuugaaauauaagaucaggcugggcacgguggcucacgccuguaaucccaacacuuuggaaggccgagguggguggaucacgaggucaggaguucaagaccagccuggccaagauggugaaaucccgucucuacuaaaaaauacaaaaauuagcugggcaugguggcaggcgccuguaaucacagcuacucgggaggcugaggcagagaauugcuugaacgcgggaggcggagguugcagugagccaagaucgugccacugcacuccagccugggugacagggcgagacucugucucaaaaaaagaaauauaagaucagguuucaaagaguuucucauguagaaaacaguaggaagcaaacuaaaauaaaugcuaucuguguaaguugagagaacaaauguuaugagaugaacuccaaauuccuguaaaaggggagucaaaauuuuuuaaaaauuauuucauuauuguuauuuuuagacacgggucucugucgcccaggcuguagugagugcaguggugcagucauagcucacugcagccuugaacuucugggcucaagcaauccucccaccucaaaaaacuuaaaaauacuuguuuccuauugguucauauuugaagacuucgguaggcuacagaugaguucguaauacuuuccauuugccauagcuuaguaccaguagucuuaauguuuuauucauucaggaguuuuuauggaucguccauuguggaguacauacuauucuaagaagauguuaauaucagauaaaaguaaaacuaauaaucuuagacaagucagcauuaauuuaaugaaugacuuaucuagguuuugaaccuggaauacuaccuuaguuaggguguuuaagaauuuggguuucuuggcuaggaucauucagaaguaaggaagaauacauuagaagaggaaagggcauuagaagguaaauuuuaguaguugaaaaacaugaccacuggacauagaaagauuguuacuugacagaaaccaagugucuucaacagugucaucuucuagagaccaucaccuuggaauuaguuugguuauacaguauuuuucccuauaaucuuaucuugauauaauuuuauccauaccuauucacaaccccuuaccugcaauuccaaaauccaaaaaucugcaaaaacaaauuuuucauaauucauuuggugacauagccugaucugaaaugaugugaggcuauuuuuaguguuuauccaacucaacuaugaauauuucacuacagaaacauuaaugucugauuacuuuuacgcccgagacucuacagguauuacgugauauguuuaccacauuacuuuuuuaaaguccaaaauuuucuaaaccgaagagcaaauugguccuaagauucugaaaauggcauuuaaacuuaaauaaugagugagacuaaucucaugcagaaaaauauaauuaauacugacaaugaauguggauauucacguaaauucaguaucucaaaaacucauaaacaaaugcuauauuuucuuuuggcuuuuuuuucuuuuugaaacggagucuugcucuguugcccaggcuggagugcaguggugcgaucucggcucauugcaagcuccgccucccggguucacgcuauucuccugccucagccucccaaguagcugggacuacaggugcccaccaccacgcccgacuaauuuuuuuguauuuuuaguagagacgggguuucaccguguuagcuaggauggucuccaucuccugaccucgugauccgcccgucuuggccucccaaagugcugggauuacaggcauuagccaccgcgcccggccuuggcuuuuuaaauuauuguguauuucuauauuaugcugguagucaaauuugcacaaaacauuuuucgaauauucuuuuaaaagaacuuccuuuucauaagugaaaagaaaaaaaucaguguaaguuaaagggcuuauauauuccuuuaguucccugaaugucaaaguaagcagguuucauaauacauaaugugcaauuaucccauuaaaugaaaggcagcuuaccucuucuuugccuaaauuauauucauccaaaggcugaagaacaaccauccuccagcuguugaagauaaaaaccaauuuuaaacagcuuuuauuuauuuaaauguggcaauuuuauacucagcacagcuaaauguauuaguguuuccuuggcacuuccaugguucaaauuguuguauuuuaauacuuaauuuuuuaaaagaaaaacauuuguauuaugagaaaaggacaaaagagaaaaugagacuuuauuuuuggccuuauggugaauagucuguucuguauagcugcauuuuauacauaauaauuauguacugacugaagucagugguacgcugauaaacuggccuggccaaaaaguaacagagaaggaaaaaaacccugguuuguauguuugccaauuucuuuggugugaaaauaccuaccauagccccuuuugagccaucaguaguuuaauaacuggcucacagaagucuucuauauuuaacuaucugcucagccagcuagcuccagccuaccauugcaaguugaaauauauuuuugcuauagaacgucauagccacaaauguuauuacuuaugcaacaaguauccacagauugaguucucauauaacucuucuagaauauuaugcucuuaauaccucaaaguaauuaugaaguaguaaaagaaaugaaauuagaauagagauguauagcaauugacugaaauugucacccaccugucucuguuugcagccuuuucugucucuacuuccuggugucauuuauauucuuaagaagcugcauucaugauuucuaaaaaguuuggcuaacguuacugccaguagggagcagaucuguguauggcauucagggaccuccacaaaucuggaccuaacuuugucucuagccuuccauuaucaaucuggaccuaacuuuguuuuuagccuuccauuaucaaccugcacaaaacaguaucuggcuaagccuuacacacuuguccugugccuuuguugucguaucccuauguaaauaccuucuccaccuucccauuccuucauggaugacuucccagaccuucccacucaucuuuugaauguguuuauugcugacuuggcaaugcaucaaaaucuuuuuuuuuuuuuuuuuuuuuuggucacagguauuacugucuuacagugugaauaccccaugaaaacguagaacucuuugcaacuuaugucacaccuguaucuucaagggcaaggauuauuuguugcuauaguuuuuaugucacuaaaguaccuuuuagugucauauacauaguagauaacacuggauaauaauaauaaaaaagacuaagaaugcuaaaguagucuaggaauuccuaaaucuuaauaaaaacugagaaauaaaguugugauacuauauaacacuuaaggcacgaguaauuuuuuuuucaccguuuccccuccauggcuaugaaggaacugggagaaggaugcuccuuucauuaauuaaaauucuucacuuugaaaauuuaaguuuauuagggaaggaaggaagaaaaauaugaagauguaaguauacauaccuuggaguaaguauuuccuuauauuggaguuucucuaauuuagcuggggcuacuaaugacaugggaaucacaauguuaucuaugucauaagagcucucacuucucaaucuccgucgugcaguauucugcaaaacaggauuacaguagauuuacaguacugucuaguuacuuguaaugauacccuccuuucaucaguuauguaaauauggcaguacacguuacauaauuuuuguaaauacauuguuauaaagucugacuaaaaaauguuaagaaaaccaaaaaauaaaacauuuuucuaucuuuuguaaaucagaacaaucucuugguagauguguaauguguauuuaugugugcaagcauacaagcuuauuuuuaagaccacaaaaaauaggucuuaaaugcaaaacucuuuaucagaaaagaccaacauacaucacccuaaaugucaaugaaaaugaucaguaaccacuuuuuauuaggaaaggcagugaaacauuuuuggucagcccuucaguauacucuucauuuaugcauuccugguuccugaguuucggaauucauuucuaaacccucccaccuuuugaccucucuauucccuggccagauaacaaaaaaacaaacaaacaaacaaaaaacaggacaagaacaagaaaguccugaauucucauuaguaagacuuuauuuagcuuaauauguuaaggaauagagaugaucaugauaauguuuaaauuuuuaacacauaaaaagaagcuauaaccaaauauuaaugaacuuuuagcuucauaguuaaaaauaaguuguaugaaucaaauauauuguuuucuaacaagauaguuauaaaugucuguuaauaugugcuaguaaggcuguuauagauuagcaaaauauaaauuauuuucaaaaucagguguuuuuauuuuuaaagcuauuuuagaguucaacauauggaaaaaccuacucgugaugaauucuggauucuugauaaaacguugacauuggaaacagcaguaaaauugcuaugggauccugauucuguguguugaaaaucagauucuucaaguuuaguucuuucuccugccauggaaagaaccauugaauguuacacauuaaacaagucuaauaucauuagaauuacuuuccuaauuagaugacaggugauugauuccuuguuuuguguguguguguuuaaauucguguauuagaaaacaaaaaaggaaaugaaaaaagaggagccuuacuugcagucaugccacaaguuauuuccauuuucuggggcuuuggcaguuuuuaucgaauauauuucuuauuguucccugaauaaucccucaucucaucccuuuauucuuguuuccugugacuccuauucauaguugaaccaccagaacuaucuuaauuuucuuaucuaaucucauuuuucauaucugacuuuuuauccuaauuuaugugagguaucuguccuuggucuucugaacacucuuaauuuuuugaaaaaauucugcuauuauaaguacauguuuccgaaaguacuuguucucugguacucuuuuuuuaaaacagcauccuguucuuguuucauagaugaaauuucucauaucucucaggauauugauuagaaguuuacuucuguuaguauuuucuguauaucuuccaaguucuuuuuuuuuuuuuuuccuguuuugguucccaguuacuguguguguguguguguguaguaaauauauauauguaugcguuuacuuacugcccuuauuuuaguacaaguguuuuaaaaugagaauauuuccugcauaauauaaaaucuaauacccaguccauauuuaaauaucuccauuuguuaaaaaaaaguccuuuauagcuaguuucuucagauaaggaucuauauauaaaaauuggccauugucuccuagguuucuuauagucuagaauaaaucauuuuucauuacauugacuuuugacaggcuggaccagauguccuacccuuuuggaauugucuaguuauuuauuuguaguaugacauuucuuuauuuuauuccuguauguacaucaaacuugaaguuagaucuaaagugucagucaauuuaagugaaacauuuuauaucuuagguaauguauacuucauguugcaucuuauuagauguuuuuaaagcuuuauauauauauauaaguugaaucuuguugacuuucucaaaauccugaggaaucugcagugcaucaacaucuccacaguagguaccauaaaugguuaacaguuucuguaaggcaacuuugcacuagccuauuuugagcauagaacacaacuuugaagauuaaaucccauccagggacugauugguagaagacaacuagucagggaacauaggagggaaauacuuaauugccauaaaguggguagauaccaguccacaaauaauucuaaauuaacuacgaauaugcuguuucauguuuguagacucauagauguuuuguguuauuaguggcuguucuggauuauaaacucccaugagagguuauuuuaaaaucagaauuuuuaauuuuuaauauuuaucacuacugcuuauauccucacuuuaaccuaccuaaugcuguuucacucaaaugucuuuucuuucuucccuguaacaguugugcagaagauucugaccuuauuugaggcuuacauauaggugaauauccauuucuccauugauucagaguacuauguacuaaaacaaaugaaaaggaaauauuaaguuuuaguuccuuaacacagacagugaacaugucaaucuguuuuuauuuguaacugcagaauuuuaagauaccaguucaaaauuacagauaaacauaaauaccaagacacacaacuccaacuaaaaacauccccaggaauuuccaguuucuuauauuuucuccauuuuuuugagggggaugaaaagggaagaugaucuguucucaaagucuuccaaauuacagaaacuugauagagugaggauuggcucagauauauaaaucuuggcgaucagaaucuuuaaguucuugcuuaccuuuaaaucuggaaauaaguugggaccaaguaagauucaacauggucagacuagacugugcgagcaagaaccagaaucauuuaauaucucugaugccuuaguugcaucaucuguaaaauagggauaauagcagcgaccuuggauaaugauuacaugaguuuauuccuguaguaguaaguaaaagugucugaugugauaagugugcaguaaauguuagcguuaucaugauuguauaucugaacccccuuauuuccagccuuggucuaacaaccaaauuggcuucuuuuuuugaaagguuuggagauguggaaaggaguggaaaaagaaauauguaagcugaagugccaaacucacacugaaauaaagggcauggccuaccagcugacaaggagugucugguuucaagauggcaaaugacccuaaacaugauagacaaauacguuuuacauagguacaugcacagauaggcacauauaaauccacauuugcaagcaaaaaguggaaccuguaaagcagaauuucugaggaaucucuaaaagacuaauacuauauggaauuugaagaggaaacccagagcagaagcacauagugaaguacugccacaaagaugugugacgccacuaaaggugcucuagacccacaagaaaggaaaacugggagcaggacaacuaucuggauauugacugcacaugccaauaucucagucagacuaacagaaucagagcuuuaggcagagaaaugaaugguuggagagagaaggcaaugcccaggugcccugcuuugaaaugucccgcccauccccaaauuagucugaaaauuucaaauguuguauaaauucccuucccaucaaaagugucccauaaacagcagugguagaagaguuuuaacugaguaucacagcuucaaugaugaguauagaaaacuccaaaaaucugaauaccaacacaaucaaaaaagagguacaaaccacaaguggaagaaccaucucaagaaauaaugaagcauucauggaauacagauuagcaacucuuuaaaacaguauugccaagagaaacagguaagaggcccucuggagaaaugucagaaauagaaaauguaauuguucaaauguuaaaaucaucacuaggcuaagaaacagaauggacacagcugaaaaucaaaaucagggucuggaagaggaauuccauaacuugauggaacagagugauagaaaauauggagggaaaaagaccgcaaugggguaacaagaugagacuagaaagagugaaaaggagggaauaguugaagaagugauagcugaaguguuuuccagaaucaauauuaaacccuaagauuucaacgaugcacuugcaugucaaacagcaaaugaaaaaucauaaaugcaucacagaugauaauacccugaaaguuauuaauacaagaaaacagcauggcaggaguaaucuaaacguacuaaaaugguaacuagaauugugagagguggauuuuaaaauguauguguguguuaaaacguguguagguguuaaaaguguccauucuuuuaauaacauuuugcuguagcauuuaagcaaaucauagacaauuaacguuucucuuauuuucuacaagcaauucuccacucuucugaaaacaucaaauuuugugaaggaaucaacuuucacaaaaguugauuuuuuuuuugagacggagucucgcucugucucccaggcuggagugcaguggcgcgaucucggcucacugcaaacuccgccucccggguucacgccauucuccugccucagccucccgaguagcugggacuacagguggcugccaccacgcccggcuauuuuuuuuuuuuuuuuguauuuuuaguagagacgggguuucaccguguuauccaggauggucucgaucuccucaccucgugauccgcccgccucagccucccaaagugcugggauuacaggcgugagccaccgcgcccggccaaaaguugauuuuuaaauuaaauuuuauucaaauguuuuuuucacauuuauuuuccuucuaauucguuacugucuuguaagguuuucauggacccuugaaaccguaggaaauguaugacaauucuacacauccucuucaccuguucuauugauaaaccucccagccuuucaguucuugcucucccaauccucuccuagaguucauccuaagaucacacuuucauagcauuucucauauauccugucuuuacuuccuucccuuuuauucauccaacaacaacuuuacagagaaccaauuacauggcaagcauuauucuaaacccuagguaagcaaaacuaggauuuguagcagcccuugucguuuacagguguuaaggaaugcaauuguaaugugauaggaaaauauucauuucaguugugaaacuacaugauguuacugagaauguauaagagugcuaguaagagcucuaggaaaggcuuccccagaugaagugacagacuccaaauaugaacagaaauagcugauagcuaggggaaggaggagaauagcauguacaauggcccaagggaacaggacaaauuugggaacugaacagcuauguacuguagaguaaggaagcauggugagaaagaaucaugagggaggagccagccuauguagauagggcuuuaagguguuaagaauauuccuucucgaaugauuuaaagggaugggguggggagcaggugugacauuagauuugcauuuugaggaggucacugccuacagugauuaaagggaaaaauggauuaaaagucuauuucagcaguauagauaagagaucauguuggacugugagaguagucgaaggcacaaaaggaacucaaacacauaagaucauauugacaacuuggcaauugguuuagaccaaguuggaggaagugugggugacaaagacugagcucuauguuucuggcuugcuuguguggguuauggugcuauuguuccuccucuuccaucuaucugagaccuaauuucagaauuacagaaaacuugaaauagaacaaaaaauuucuguauacccuuuucugaaaucccccaaauguuaacaucguaucacauuugcuuuaccuccuucuuucagaccacaaaugaaauuuaguugcugacaugaugccccuuuagcccuaaauacaucaauguguauuucucaaaacaaaggacauucucuuauguagccaugcaguucaguaccauuagcuaaucuauagaccuuauucagauuucaccaauaucucuauaauguuauuuacagauaauuucaacuauucauugcagauggcauugcaguugucagaucucauuaaggucuuauaucugaaacaguuccacugucuuccauaacuuucauaacuuugaacauuuugguaaguauaaacccuuaaauugguuuugucugguauuccucaugauuaaacuagucauccauucacuuuucaacccacuacaguuuggcuuuucucugcuuguugccugaaaucagcaaugccauuguaaacugccaaaucuaauggaccauacaggauaaauccaagcaaagaucugucuacugccuucacacaacuuacccuacaggaaugccaaguuauuuguagauauuuguuguuguuuguuuguuuugagaugaagucucacucuguuacccaggcuggagugcaguggcgccauuucggcucacuacacgucugccuccuggguucaagugauucuugugccucagccucccgaguagcugggaccacaggugugcaccaccacccucagcuagccuuuguauuuuuaguacagacgggguuucaccauguugccaaggcuggucuuaaacuccugaccucaggugauccaccugccucagccucccaaagugguaggauuacaggcgugagccacugugccuggccuuauuuauagauauuugaauauaucauacugugucaugucuccaugacaagacauauguuuguuuuuguuauuuaaagacuuguuacucaguaugggccaacagcaucugaaucaccugggaccuuguuagaaaugcagaauuucaggucccauuccagacuuacuaaaucagacucugcauucuaacaauauccccgaaguaacuugcuuacauuuuaaaguuugagaagcacuaaucuggaacgcuccacccuucuuucucuguaaauuccaauuaaguagucgaagcugcacuuaggcaucaccaacuuucuggaguuccucuccuugcccauuucucaucucccugaaccucucuuuuucugccuucuaaguaguuacauacuccuuauuuauaucuucuuuauauaauuucuuuuuaagauagagucucacucugucacccaagcuggagugcagugaugcgaucauugcucauugcagccucaagcuccugggcucaagcaauccuccugcuucagccuccuaagucccugggacuacaggcaugcaccaccaugccugccuaauuuuuauauuuuuuguagagacaggguuuuaccauguugcccaggcuggucuugaacuccugggcucaagcgaucccccuaccucagccucccaaagugcugggauuacaagcaugagccaccacacucagccuucaaagguauuuaucaucuauguccauuauacuauauaauaguuauuugugucuuccuccauuacauuauaauuuugacuuccuguaauucaccuuugauucuucagcacuuaauagucugccuggcacuaagugcucaauaaauucugaacucaaaucacuaacagcaaaagaaaaauuaaugaccagcuauuuaagacagauauauaggaugaaauuucucauuacauuauuuaugcauuccccuuaauugugugccuaacacguuuaacugccuuauuuuauuuuuuuacaaacagggucucacuuugucacccacccugaggugcagugguguaacuauggcucacugcagccucaaccucccaggcucggaugauccuccugccucagccucccaaguagcuaggacaacaggugcacgccaccaugcccagcuaauuuuuguauuuuuuguagagaugggguuucacuauauuucccaggcuggucuugaacucugggcucaagcgauccuccugccucagccucccuaagugcugggauuacaggugugggccaccgcaccugaccugccuuauuuuuuuuaaaucaaauaguagaacaacauuaaaagaaauauaauuaucuaaucucuaauagcauauauuuucauauuugcauacucuuucagucaauaacguuuuauauuucauauguauuucaaguaugaaaucauaauuuuaauuaaaugcauacuuauauuuuuaucacauacucuauuacuuuuucagaugguuauauaacauuccgugauuagaaacaauguucuuuagcuauuuccuagcuguuggccaugauacuuaucaucauaaugauaaugcuauuagagacauucuuaaaauaaucaucuucauggaugcauuuuuuucccuuuugaaaacaaucuagucucgggacaaauuccaacaagugaaaucgcaucauuaaaagguaacugcacauaauacuuauauuuuucuguauuucuuuaggcuuuucccccuaagcauagauaacuguucuucauccuuggugccuucaucuuuuuucucuuuaauuuuuacuguggaaaauuuucaaauaaacacaaaggagacuagaauaaugaacucccguauaccuauccuuccgucucagcagugaacaacuuauaaccaaucuuguuucaucucucccaccaacauuuuugcuagaguauuuaaaagcaaaucccagacaugucuuuucaucuacauauauguuagugugaaucucuaacaaacugaaaaaguacgucuggguuuauguaaccacaaugcauuauuacaaguagcaaaauuaacaauaauucauuaauaucuaacagcuaguccauguucaaauuucucuguuucaaaaauuauaugugugucuauaaacagcaggcuuauucaaaucaaucucaacaagguccauacauugcauuugauugauauaacaauaaauauuucuacacgacuauaauuuuaccagauauagaaguaaaauauuuuuauccuuuuauaucacaacauucuuugauaaguagguuuccauccuuauaugaacuuuuaagauauuuuuuaaggcuguauauuccacuguaauguauuuaaccauaucccuauuaugcuuuucaaguuguugcuaauuuuucauuaucacaaaaacauguuaagaugaauacaguugcgaaaaaagcuuucauauuuaggauuagacuagauucuuggaaauggaauaguugggucagaaugcaggguuaacaguccaguaaacauuuauugggaauagguacaaaauaaacaagggaguuuuuaagccacacugaacuuauaaaaaaauacguaguuuaaacgccuuguaaugcauuuugcagagcuccucaaaaggcuuguaucaauucuuaauauccaagauauuugagggugcuauuuuuacuauaguugugccaaaauugaugauuauaauguuuaaaaucauuaauguugcaggcaaaaguaguaaauauuugcauagugucugacuauaagcucaguuaauauuauuuucauuauuaucaucaaguacacuuacuuuuucuuguuauucuuuuaagacauucauuuuuaacauuuaacuuuuuaauccaacugaaauguauuuuaauguucauccaccuuaaauuuguuuuaaagugcuuuaugaguuagugauaucaguuuuuaauucuuccaaagagucguuauuuaaugccuuugauuacaaaggaaacuuaguuauauagagcauggcuccaagccagacugcuuggguuugaauucuggcucuuuuauuacucaacuguaauuuggggaagauuagucaaggagaauaguaauaccuaccuuauagaauuauacagacuuaaauaauuaaguaauauaaagcccuucaaucagugcugacauauaaaugaugcuucauaagaauuuguuguuguugucauuauuauuuauugacuaagccauuuuaucaacaugguaggaaauaccaccuucugucucuaggcuuuuuuuaagcucccuugaucugccuucuaucagaaccaccauguuuuagugauuauaacuucauaguccugcuauuaaucuucuaaaaauguaauuggcuauucaacauuuucugucugagauaaacuuccagaauaacuucguuccaauaauaccucugauucugauuaggauuauauucuacuuguaaauuaauuuggggaaaauugacaacuuuaguuaugauacugucuucugacaggaacaggauauuucucuccauauaggaauguccucauguuucucacugaacuuuugaaguaguccucauguagguacucguuaaguuugauuaaaaauacuuuauauuuucauugucaauaugucuaacagaauuuauuccuuuacauaggcuaucuaguuacuauugguacuuauaaaagcugcugauuuuuauaaauuuauuuuauaauaagaccccaguucuaacagguauucauuugacucgaguuuuugagguagauuauuucauguagaaauaauuuaucuuaaauuuauaugacuuuucugauguuuagauuuuaacuuuguagauaaucaaaauauguuguuuucuuucuucuucuaauugcuuccaagcauagaacucacccacauuuacagaacucauaaacauuucauuauaauuuccucaaguuuuauuuuguaguuuuaauguuuuauguacaauucuuggaauuaacuagaacuuauucugauucauagcauuaaaugaguauguaaaagaauuuuacugggaaagacucucuccaugagaaccaaugguucuccacuuucccacuaauauacaauucuucccugauauauaaucaacuauagaguuuacuucauugaucuauuuucuuaaauauaaacaaaauagauucuacauuauuauagauuuuugucauguuuccauaugugcuugggcuagauuuucucuaaacuuuuuauaauaauuccuuuuauauuuuccccuguuuagucuucccauugugcuuuagaauuauuuuaaguuaaacaaauucuaugagaacuucgaguuacauuacauuaaucauaugaacuauuaggaagaauuuauauauuuauugaucuuaccauacagaaaugcuguuucuccacauuuauuuaaauuuuuauuauauuuaucaguaauaguucauaauuacaauucaauagguaucgcacauuucauguuaagauuguucuuguauuuuauguguacaugaguuguaaaaagugaguauuaaaaauuaaggauuuucauguauucuuuucuuagauuuuauuuuucuuagaaugcaaaaauaguaaguauaaagacauaaaaaggcauauagaguacaagaacuguaaaugugacauaccaggugauggagauaugauauauucaucuacaaauuuauuuucagcaagauugccuuuuauuucagucuuuuuuaacaguguuucaaagugaaaaugaagaggcacaucuggaaaaauaaaauaaaaaagguauuuucaaauaccacucuuuguaauacuaggauuacagauuguaacauuaaaauugcuuucuuucuauaaauagcacauaagcuuaagaaaauaagcaaaaguuugagauguaacaacuaucggaagugacaaaauacucuuuccaagcauguugguagcaguauuuuagaaauuacugguuaggugcacuuaaucaacaaauuaaaaagcuaacagagaaacaacuucaugaacuuccuaaaauaguacauaagaugaacaguaauuauaaguauuaauaaauacuauucacagaugaauggaaacaaauauacccaagaagucuuuaagaaaaccuacacccaaaucuggcugacucuaaauccauuccaucccaucccuacaaacuuugcauuugaaauaaugaagcuuccaaaaaauuacaugcuuuuaacgucuugggagaaaaccacuauaagucagaugcaaccuuuuaugaaaacaucaaaguucacauucccuuaauuuaccauauuauauaucacaaugaauauacuuuuauaaagauuaaaaccuauugacaagcuaguuuuguuuuuaaauagaggcuuggagacuuucaauuuacuauguuuauauucuguacucucacaaccaaagaggaguuaagcaaugaaguaguuaugcuucacauuuacuaaagguuuuuucuuucagccaagaaugaaaaaacaaaaucaucuuaaaaagcauuuauuaagagacaccuaacuuuuccuugagaacauauuuuauaaagcaguugauaauagugaaaauuuggcuacugaaagaagguacuuuaaggaaacucauuugaauacauaaaugaggauagacccagaaagggccuagauuuuauuuuuuauuuguuuuuauucuugagacagggacuggcucuguugcccaggcuggagugcaguagcaugauucuggcccacuacauucucaaucuccugggcgcaagcaauccucccaccucagccucucaaguagcugagacuacgggugcacaacuccaugccuggcuaauuagaaaauucuuuucuuuagagacaaagucuuauuauguucccagacuggucuugaacucuugagcucaagcaguccucccaccucagccucccaaaguguugggauuacaggcaugagccacugugcccaccuggcugggucuggauuuuaaacagaaaaaaaugaucucuucuucaaauaauguaucuuaguggcagauccauacucagguguggaaaaauaugcaaaacaaaaauuaguucaugaguaucaucauggaguuuguaccaagggacagagguaagaugaguuugaaucuugauauuaugaucauaugaaaauuaggugacaaaaugaaaaugggaauaaaaacuaaauauucuccuuuaaaaugcuccuuaaacauuucaggauucugauauuuuccaauuaccugaacauaaauuuguugcauuuguuucuccaaagcaauauuauacuuaugaggagaguaucaccaauucuaccacuguucuuugcaauuugugggaaaacaugaucuaacaagaaaagguccuuguucggucuaugugccuuucuuaauacccgcacgugaccugucagcuuuuguaaaaauauuucauugcuuugaaacauuaccuuucaguuguuuuaaacuagaaugcgaguaccuugagggauuuauuuguauuuauacuccuagcauuuauuuaguacuuacauauaguagguauugagauuuuuauugaauguaagaaggaauggauaucaugaaauaguagauaaacaaucuaaucucauuuauuagagggggcauaagagucuuaggauaaagaguauuuauaccagcucucaggguuaugucaucagagaaauauauuugcuaauaagaaaacaggcaguaaaguaauggugaguaguuugguucuggagaaugacuaccucaaauucuggcucaucauuuauuagccgaguaaucuuggaugaguaguaucacgaagcuuaguuuucucauauguaagaugaacagaacaaagauaucuauucucauggaguugugggaauuaaacaagaaaauguaaugugcuuaauauauacaaggcucaguauaugcuaagacuaaauguuagcuacauuauuauuguuauauggauuauuauuuuaucauauuauuaagguuuccucaaauauagaauaaaauaguucuuguuaaaaacuuaaaucaagguaaugguguagcuaagaaaccacucuacuacugauaaaaacuaaauugagauucagggcagggagacagguucaaaacauagugcuuuacaaauaaaucagucccuugauuuugagaauuuaaaagaccaucagaaccauaagcggaaaauggaacaaaagcuaaguugagauaucccccaguaaagaagaaccggagauaaccaaugugagggauguuuucuuucuccccuaaauauuuacuuuaguuccaauauagacaagaguguaaagguuccacaaaaaucaagaacugaaaauuuaaaaccaccuagaguaauccuagcauuuuugggagguugaggugggaggaucacgugaggcuagaaguucaagaccagccugggcaauauagugagaccccaucucuacaaaaaaauuuaaaaauuagcuggguauggugucaugcacccaaguaguuccagcuacuugggaggcugaggugggaggauuacuugagcccaggaggucaaggcugcagugagcuauguucacgccacuauacuccagccugugcaacagugcaagacccugucucaaaacaaaacaaaacaaaacaaaacacuuuagagauguaaggauguauaagccucauuuacucaguuauaaaguacagauacucuugagguugacuauacuuauagguacgcaguuuucuucccucugcauugagaaauucaaugcagauuauaaauggagaaauauuuuaugacagggaaaccuccauguauaacagcacauuagaaaaagaacacugaauuaccauuacucagaaacauuucaacagcacagccauguuaccaauaaaaugcucaaaauuuaacaagauaaaaaccuaguaauuucccaaaguaaaucaaguugguuuagaaggaauuaaagaaucaacuuacacagauagaacauuaaccgugcaugugacuagauuaauuccucuacaacaaauuuaauugucaaggcauugcuuaguucuaauaucuacugaaaaaaaauugauaaaauaagauuuauuagauucucuguauuuagaggauuagauuucaguacagaaaauaucguuacuuagaaauuguuacaaggaggcuuaccugauggcaaugauagaacagaauggaaagaggaaucuaacucugauacauguucucuuaauagguaagacuccgaauuguguucauagcuacuccaaguugaagcugauugcaggcaaggcauuuguguaguguuuaaaaaugcuguuucuuuugaaggcaaagucugcaaggaaaaaccguauuagaauaucacagccaaagcauccauaaauggcauaucucuacauuuauuuagguuaucuuuaaauaaaauuuuccaguucuacaaaaaguuuuacaaauauuuugcuagauguuuucccaauuaacuuuaauauuuauuaauucaaucauaaaagggauguaaaaauauaauuaacuuuuauauauugaauauucuacaacuuugcuauaaacuuucuuuuucuaauaauauauagcuucuucuagucuuugauuaucuaaacauacuagcugggaaugauaacuguaauuuuuuuccuucaauccuacuaguuuuuuuuuuagggaguuccaaccaugcuggauggguucaccaauucaauaaugaauaaaaaugaucaaaggagacauauguguuuuguuccugauuguaaugggaaugcuuuuaauuuaucacaauaagaaugauauggauugcaggguuuguuuuuuuuugggggggguaugguucuuuaucagaauauauuccuagcuugccaaaagaacuugaaaaaaaauauauuaauguugaauuuaaucauaugcuuuuuuugaaccuaauaaaaugauuacaugacuuuucuucuguacucuauuauaaagugacaaauugcauuaacagauuuuauuuuuuauuuuauuuuuuugagacagucucgcucuguugcucagacuagagugcaguggcaggaucucggcucacugcaacuucugccucccggguucaagcgauucuccugccucagccuccugaguaacugggauuacaggcacgugccacugcgcccagcuacuuuuuguauuuuuaguggagacagggcuucaccaguuggccaggcuggucucgaacuccugaccucaagugauucagccugccuccaucucccaaagugcugggauuacaggugugagucacugcaccuggccacauuaaccgauuuuuaacaugucaaaccaagcuaagguuauucuugaauaauccugcuaggaguuuaucaaguuuauuaaccucuucaaggagccaguaacuggacuuguucacuuucuauauugugugcauguuuuauauuucauugauuccuacuuugcuuuaagauuaaucaaauauuuucuuaaauuuuucccaucucuuaauuuuaauuuauuuauucuuuuauuuucuuuuagugguuuccauagagauuacaaugugcauccuuagccagcuggccuuuacaguauaauacaaauuauuccuuuuaccauuucccuggaaauacuaggacauuagaacuccauuuacucuccuguuuuugcauuaccauuguuaggcauuuuaauucuauauauauuuaugaccucacaauauauugguguuauuguuuguaucaucaacauucaugaauaccacccauauauuuaucucaucucauugcucauagcucuuuccuacaguucccuacuuccaugugggaucauauuacuucucccuuugcuacuaucauaguguagguuugcuuucuccgaauucucucaguuuuuacuugucugaaacauuugcaucuuaccacuuuuaaagauauuuuuaugaauacagaauucuggguuggcuauuuuuuuucaguacuuuaaggauacuuucauucuucugguucucauuauuucuggugauuaguuagcucuagguuuuauuacugcccccacuugaaagcaaugugccuuuuuugcucuggcugcuuuuaauauuuucucugugucuuuacuuuuuuagcaggcuuaccauaagauucugucuugguccauucagacugcuaugacaaaauaccauagacuagguaaauaauagaaauuuacuucucacaguucuggggacuaaaaaguacuagaucaaagugcuggcagauuuagugucugacaaaggucuacuuucucacugauaagauggcuguaaccucaaaugauggaaggaagagcuuucugggguuccuuuuauaagggcacuaauuccauuaaugaccucaugaccuauuaacuucccaaaggcccuauccaaauaacaucacauugggaauuagguuucuacauaugaguuuugggggagacucauucagucuauagcauugcauccaagccccccaaaauacauguccuucucacaugcaaaauauuucauuccaucccagcagcccaaaaaucuuaacucauuccagcaucaacuaaaaaauuccaaaguccaaaaucucaucuaaauaucaucuaaaucagauaugggugagacucaagguguacaauucauccugaggcugugaaccucuaaaaccaacauauuacaugcuuccaaaauacuauggugggagaggcauaggauagauauuccuauuccaaaauaaaggaauaggaaagaagaaagaaaugacagguuuugagcaaaccaacccaacacggcaaauuccauuaaaccugaaggcuccagaauaaccuucuucugcuugaugcuuugccuuccagacccaguaggcuauggucccaucuccacagcuauuggcugcagucccaagcuuguggcucuuccaggugguuauucugccucugccauucaaggugacuuggggucaagggccuguggcucuccuaggcuagaaucaugcaugaguggcuuugccacacauagccuaagccauggcucccuaaguguuggcagagacuguguagacaccaccaaaaucuaccaccugugcugccuacaggguuggccaucacagccuaaacuauaucaggcccaccagagccacacuuuagagaagccagugguggggagcagaacccauaauguacgguucuauugggcagugcaugcugagaggucucacaggcucagguggcuccauauuugaaacuucuuugcccgaagggacuuugcacucugggccuaugcugggaggggcagccuccauuaucucuaaauugccuucagggccauucuucuauugucuuggagaauaucuccuggcuucuguagagagggcugauugauacuaaucucuuuaucaaaaggcuccuuggccauacccucaguguuuucuccaaagcaggcuuucucuuucuuuacaauaugaauaggcuaagacuuuuguaaaucuuuuaaguucugcuuucuuuuugauuaacaguuccucuuguagucauuucuucuggcacucuaucauaagcagucagaaggaggaaccagguugguccuucagcaauuuucuaagagauuuuuucagccaaauaaccaauuucauugcuugcaauuucuaccuuccacaagacacuagaacaugaauacaauuucaccaagcucuuugccacuuuauaacaaggaucacuuuuccucuaguuuccaauaacauguuccucauuuccaucugagguuuuaucagaauggcuuuaaugucuguauuucuacuaacacucuguucaggauuauuuaggcauucucuaaauaaaaugcauuuaaaggcauuccuuuuaaauaaucauuuaauaguuuuucccaucuaaauccaguaucagaaucacuugaguaucugucucuauugucuguuuuuccucuugaauuuuggucauguaguccuuuucaccaugcuuacuaaucuuugauucaaugacagaugguauguuuuaaaaaccacauagguuccaaaggaugcgaucuuucucuaguggggguucucuauccccacuacuagcuagauaaaauagagacuucucuccuuaaucugagaguaugagcaguuaaaucuggguugcagcccuaguaugauucauacauaugauuugccccucaagguuuucaaccaaauauuugauuuauuuuauagaauuauccccagucauccagaccucuaaucuuaagaguauacugaacaaugccacccugcuuauaagggacuuuugccauuuauguguuaagcauccugcucugugcagccucaguauucaucaaauguucugaggaaaacauuggucaaaaaugcucugaagugaaaacuggccaugugcuucaugccuccuaaaacaucaccaaaagcauccccauaacuaucauuacuggcauuugcauccaauuuaaaaauuccugccagagcuucaggguaauagugguugcagaagccagcuucuggagaccuaaguuagacuuucuccucuaaccuuuauuuuuauuaauucuuuuuucauauuuuccauuuauuauuucucucugugcugucuuuuguguaauuuuauuaagcuugaucuuucaacgcaauucugucuuuagcucugucuauacccuuuuuaaucauauuagcaauuuucugauguauuuuccuuaaaaaaaauuaaacuuacuuauuuuuacauuuuguauggauaauucuaauauuugaaguuauuuuguaggaauauguguguguauauauguguguauauauauauacacacacacauacauauacacauuuuagagagauuuauuuuguauauucauaugcaugcauauauuaauacauacguguaugguuuuguuuuuguuuguucauuucuacugacucucaucauguggccuuaguguuguguguucugugauuuuuuuuuucuuauugggaauucauuuuuguugaaauuuuguucaugggacauuuggaagcuucuguugagaguuuauuccccuagaaaggaugucuauuugucugagccagccaucuagaacuacuguucuaaccuauuuuaaaacccaauucuuaucuucaaaacaaaaacaaaaacacuugaguagcaugauuucaaacuucaaaaauaaaagaggccugacuuauuauaaauucuaugcaggcacucuauuuucccuuuccaaccacagcccaaggcuaagaaaggcaaguucucugcaucucuguacaguagaucugaguucuaguucacccauucacaaagucuauagccggccauuggagacucuuggcuuuaugaaggauuucuaaaaugacuccucacaucuuccagguuuuugccuccagucacucucaggaauauaaaauaaaaacuucuauggaguuuaauuggaaaauauucauaagaaagcuucagaauucaaugggucacuuauuucucuggauucuuaguauguuucucuuccacccccccaccccuccacccaccacacuucucuuuccucucccuuucucuuauucugaggauuuuuuuuuaaccagaugauuuauguauuauacaaaauauucuuuauauuuuacauucuauuuugugguaccuggagguuuuucuaugguaauguuccuaccauaccacuggagucagaagugcagaauuggaccuagcaacugaaaggucacucugaccuuuaaaaaauuguuucagggaggcugaggugggaggaucacuagagcccaggaguuugaguccaaagugggcaacauagugagacccuauuuuuaaaagaaaaauuuucuuucaauaaaaugauuuuguuggcugccauacuauaguaggaaauuagaagcuaaaauaagaaacuagacauuauaguguuucucaaggaaugcaaugugugacagaugaucacagacacuuucaaacuuguugugagaaaagauauuaaguaauagcuacaauuggaguugcuauuaaaaaaucaguuuugauaguagaaaaggcauuuucauuucugcccaugaaggagaacagcuauaggacugaugucaaacaacuguuuucagaacuuggacaauaggcagcacaugaguguuaucucugggaaaugaacaacaaaugaggugauccucuaaaucuaccaguuuguugcauggugguauauacccagacuuuggcacaaaggagguggcucaaguagggaguagcagucuagcugacuggcagagacagauguuugaguuggggaaggacgaggcagcugucauuugcagaacagaaugccagaaaagaaguuaagccuagaaaggcuccagaaauccucacagggugucuuucaaucuuuugcuaaauaauaaucuauguaugcauagagugaaacaacaccaggcaaauuuaagaacaauuaauuccagggggcagaaaaaaggcauaagaaaagaacaaaaaacaugggagaaauaaaaaacaaauggcaagauggucaauuuaaaccuaacccuaucaaaauuacaucaaguauaaauggucuaagcacuucuaauuaaaaggcagaaacuucagauuggauaaaaaagccacacccaaauauauaacauccacaagaaaaccacuuuaaauauaaaguaauagguaaaagcaaaaguauagagcagacauaccacucaagcacuagucguuagauugcugaagcagcuauauaaauauaguagucucccuuaucugcaggggauacaguggaugccuaaaacuuugaagaguggcaggugcgugguucacaccuauaaucccagcauuuugagaggccauggcaggaggauagcuugagcccaaggaguucaagaccagccuggggcaacauagugagaccaucucuacagaaaaaaaaaaaaaaaaaaaaaauuagcugggcacaguggcacacaccuauauucccagguacuugggaggcagaggugcaggaucacuugagcccaggagguuggggcugcagagaacugugauuguaccacacuccacuccagggcucaagugauccucccaccucagccuccugaguagcugggacuauaggugcacaccaccacacccagcuaauuuuuguauuuuuuuguagagacaggguuuccccauguuucccaggcuggucucaaacuccugcgaccagcccaaagugcugggauuacaagaaugagccaccauauccagcccauacacucuuuucaagugugcauggaauguacaugaugaacauuccauggcaggaggaucacuugagccuuuaacauaucuuaauauuuaaaucuacauaaauacuauugcuauggagaacucauucugggcccauuuguuuauacuugagcuaguucccacauacuuuauaacuguuaagucaguaucugguaguccugucuacccuccuucccuucucuucauggaccuuuauuuguccauauucacuuuugaauguuaaguuuccaaaauagacagcugguauuuugacuaagauuaccuuaaauucaggaaacuggaugucucccacuuuuaagucuuuauauccuauauaaaaguuuuaaauuuguuuccauaguagucauauauauauauagucaauucucagaaaauugacaguaugcuuuugggaauguaccuuguuuuuuaauauauuuuuaauugguuauuacuaauguggaaaaauaguauuaguucuaauaauuuauugauucuguuggauuuucuaugaaauuacuucaugugaaaauaaugacaguuuuauuucacccuuacaaucaaaaaaauuuuccuucagaacuuuggagacauuauucuauuuucaucuggagucauuaaugagaauuucaauggcaauuucauucuuacccauuauaggucauaguuugcuuuuguuagcuguuuucccuucgaagcuuuaacaucuuaucuucuagauauucagaaauuucaugagaaucuguuuaggagugggcuguuuauuuaauucacaaugcucaaaaguuugugggccuuaucaaacugaagacaucaugucuucuuuuuggcuguggaaauagucauguauaauuucucuuuguguucugggagauuuauuugacucuauuuucuaguucuuauacuaaaaaauuuuaauuauagcuauuuuauuuuaaauuucuuucuuucuucuuuccuuuuuuuuuuuuuuuuugagacaagguauugcucugucacccacgguggagagugguggcacaaucuaucaagacucacugcagccucuacugccuggcucaagcaauccucccaccuuauccucuagaguagcugggacuagagguggauaccaccauaccuggaucauuuuuaaauuuucuguagagacaguaucucacuauguugccuaggcugguuuuaacuccugggcuuaagagauccuccuacuucagccucccaaagugcugggguuacaggccugagccaccacacuaggccuuauuuuaaauuucuaaaggcacuuuuuuuuuguuuguuuguuucaugauuguuucuuuaguacaacaggcugcccuggaaguuauugucuguucuuugaauuauuaauuucuaccaaggucagcuauauucuccuucuugcugauggcuuuuccuuaauauguuuaaugacucagaaauacuggaaaugcuuuaacucuaaaucucugugugguuuguucccuccucacuucaaucaagucucuaaucuaacgucaguuauuccagaaaggacuucugacucuccuaucuaaaauaaacuccuuuuuccuagaauuuucuaucuccuuacuuuaguucuauuuuuuuccccaaagcacagcauuaguuaacauuuacacuuuuucucucaauuaaauauaaguucuaugaagguaggaacccuuucugucauguucaccacaguaucuccaaugccuaggcacuguguggcacacgguagguacuuaauauuucuuuacuagaagauaggaggagggaaggaagaaaagaaagaaggaaagacauaauaaguaggcuauucuaaauaguuguauaugccucugcuauuguacaugaggcucuauuuccucaauaggaguccuuccuaaauggaaagacaauaaauuuugcauacaucagcuuugcacauaugaacuggacuugucaacuuggcgggcuuaaccugguggaauucugcaucucucaagucucauucauguuaagcagaugcuaacuaaccuuaugcucaucaauaugaaagggaagcaugaaugauagcauacuaagaacuauagccauuuaaaugcaauguguauaaugcuuuuaucagguaacuucaaguuuauuuaaaggccugaagggaagauaaugguccauuuuuuuuggucauaggugaaguaucauuuggauuacaauggacuguuuugucuuuucaaacuucuccugaacaaguaauauugggcaauaaaauaaucucuagugaaaacaaacaggccagaugugguggcucaugccuguaaucacaacacuuugggaggccgagguggccagaucauuugagaucaggaguucgagaccagccuggccaacauggugagaccuugucucuacuaaaaauacaaaaauaagcuagacauuguggcaggcaccuguaaucucagcuacuugaggggcugaggcaggagaauugcuugaaccugggaggcgaaggcuacagugagcugagaucacaccacugcacucuagcgugggaaauaaaccgagauucaugucaacacaaacaaacagaaaaaaaauacaagauaauuauuuuguaacucaagaaaaauuuuaaauucugacucaaaacccaaaaaguauaaugaaaagguugauaaauucaaucacauuaaaaaacaaauaacuucugcauagaaagaaaacauuaauuaaagagaaaagacaaacugugaaaaaaagucauaaaaaacaaagggcaaauuuccuuaauauauauguauauaucagaaaaaauguaauaaaauauaauuuuccuaauauagauaaagagcuccuacaaaucaauaugaaaaaggcaacaaauccucaacagaaaaaugggcaaaggauauaguuagucaguuuacagaaagaaaauauaauggcucuuaaacauaugcaaagaugguccagaucuaacucauauuaaaauaaauguaaauugaaacuagacggccgggcaugguggcucacaccuguaaucccagcacuuugggaggccgaggccaguggaucacaaggucaggagauugagaccauccuggcuaacacggugaaaccccaucucuaauuaaaaaaaaaauacaaaaaauuagcugggcgugguggcgggcgccuguagucccagcuacuugggaggcugaggcaagagaauggcgugaacucaggaggcggagcuuccagugagccaagaucacaccacuguacuccagccugggcaacagagcgagacuccaucucaaaaaaaaaaaaaaaaaaaugguaacuagacuauaacaccauuuuuuaccuauuguauuggcaaaaaagcccaaaauuuuaauaauuuacuguguuauaaagauguuggcaaacaggcagccucaugcauugcuggugggaauguaauuugguucaauucuauugagggcaauuuggcaaaaaaaauuaaaauuuauaaauguacaaacucuuugucccagcaauucaacuucugggauucuaagagauauacucacaaacauguggacugaacuuccucaacaugauaaagggcaugaaaaacucacaguuuauaucauacucagugaugaagacuaaaagcucuccaagaucugguacugauauucaacauugcacuagaaguucuagccacagcaauuaggcaagaaaaagaaauaaaaagggaagaaggaaggguaggaaagggaaaaaggaggggaaaggaagggaagggggaaaggaagggaaaugggaaaaggaaagacaaaaaggagaaagaagaagaagaaagaaaauacuauuuguagacaacauguuccuagauacagaaaaccccaaagaacaaacaaaguuacuacagcuauuaaaugaauucagaaaaauuguagaguacaaaaucaguaguacauaaaaaucaguuguguuucuauguaucagugauacgguuuggcuguguccccacccagaucucaucuugaauuguaguucccauaauccccacaugucaugggagggacccagugggagguaauugaaucauagggguaguuacccccaugcugcuguucuugugaauucucacgagaugguuuuauaaggggcuuuuuccccuuugcuugguauuucuucuugccgccacgugaagaaguacauguuugcuuccccuucuuccaugauuguaaguuuccugaagccuccccagccaugcugaacuguaagucaaaccucuuuccuuuauaaaagacccagucuuggauauguccuuacagcagugugagaacggacuaacacaguaaauugguacugcaaagagugaggugcugcuaucaggaugccggaaaauguggaagugacuuuggaacuggguaacaggaagagacugaaacaguuuagagggcccagaagagaacagaaaaauauggguaaguuuggaacuuccuagaggcuuggaggcucacaagacagguagaugugggaaaguuuggaacuucccagagaauugcugaauggcuuucaugaaaaugcugauagagauauggacaaugaaguccaggcugaggugaucucagauggagaugaggaacuuguugacaacuggaauaaaggugauucuugcccuguguuagaaaagagacuggcaacauuuuacuccuggccaagagaucuguggaacuuugaacuugagaaagaugaucuagaguaucugguggaagaaauuucuaaguggcaaagcauucaagaggaagcagagcauaaaaguuuggaaaauuugcagccugacaaugcaguagaaaagaaaaacccauuuaccagagagaaauucaagccugcugcagaaaucugcauaaguaacaaggagcagaauguuaaucaccaagacaauggggaaaauguuuccaccucaugucagcaacauucauggcagccccucccaucacaggccuggagacuuaggaggaaaaaugguuucgugggcugcgcccaggaccccccugcucugugcagccuugggguguggugccugcaucccagcugcuucaguuccagccauggcuaaaaggggccaagguacagcucaggccauuacuucagagggugcaagcccuaagccuuggcagcuuacgugugguguugagcaugugguguugagccuguguagaagucaagaacugagguuugggaaccuucgccuagccaucgugcacagccucucuuagcuaauuucuguuccuccauucucuccccgcugcaaauugcacuguaaaaggaaccaaauuaaucuuucaaaaguaauacuuuuaucauuucacuccuccacaccaaaaccaucacugauucccugauguugugcuaaucaccgaaucauuaucaucaucaacgucauucacauuugaugaggauuuauaugccaggcacugagcuaaauaucuuuuuuugagacagagucucgcucugucacccaggcuggagugcagugguaugaucucgguucacugcagccucugccucccugguucaagcaauucuugugccucagccucccaaguagcugggguuacaggcaugcaccaccauguccagcuaauuuuuauauuuuuaguagagauagaguuucaccauguuggccaggcugcucucgaacuccugaccucaagugaucugccugcuuuagccucccaaagauuggauuacagccaugagccaucgugccaggccucaguuaaguaucuuucaaauguauuuucuuauuuaauaucaacacaccucuagaagguagccuuuuucuucuuuucuucauugcugauucagcuaaugucuuaauuuagagcugucccugugucccaaagcagacgccaaggcaaagauuguuuaauaucaauggucacaaauuucuucaaucccuguguguaugccccuuugcugaaauuuccccuuugcuguaaauuccaucccuguguguaugccccuauuucuccaucccuuugaauuugggcugaccaagucacuugcuuuguccuauagaaugcaguggaaauuauguuguuuaagaucuggugggcugggugugguauuucacaccuguaaucccagcacuuugugaggccaaggugggcagaucccuugaggccaggaauucgagaccagccuggccaacauggugaaaucccaucucuacuaaaaauacaaaaauuaggugggcauggugggacuugccugcaaucccagcuacucaagaggcugaagcaugagaaucacuugaacccuggaggcagagguugcagugagccaagaucguugacacugcacuccagccugggagagaaagugagagucuuucucaaaaaaacaaacaauagggccgggcgcuguggcucacgccuguaaucccaguacuuugggaggcugagacaggcagaucaugaggucaggagauugagaccauccuggguaacauggugaaacccugucucuacuaaaaauacaaaaaauuagccgggcgugguggcaggcacauguagucccagcuacucgggaggcugaggcaggaaaauggcaugaacccggguguugcgggaagccaggaacccugaauggagggaccggcugaagccauggcagaagaacguggauugugaagauuucauggacauuuauuaguuccccaaauuaauacuuuuauaauuucuuacgccugucuuuaccacaaucuccgaacauaaauugugaagauuucauggacacuuaucacuuccccaaucaauacccuugugauuuccuaugcuugucuuuacuuuaaucucuuaaucccgucaucuucguaagcugaggaggauguacaucaccucaggacccugugaugauugcauuaacugcacaaauuguuuguagagcauguguguuugaacaauaugaaaucuggguaccuugaaaaaagaacaggaugacagcaauguucagggaacaagagagauaaccuuaaacucugacugccagugagccaaggcggaacagagccauauuucucuucuuucaaaagcaaaugggagaaauaucgcugaauucuuuuucucagcaaggaacaucccugagaaagagaaugcgucccugaggguaggccucugaaauggccgcuucagggggcggcugacuuuuauggucgaagcuguggggaugaaauaagccccagucucccguagcacucccaggcuuauuaggaugaggaaauucccaccuaauaaauuuugguccgacugguugucugcucucaaacccugucuccugauaagauguuaucaaugacaaugcgugcccgaaacuucauuagcaauuuuaauuucacccugguccugugguccugugaucucgcccugccuccauuugccuugugauaucuuauuagcuugugaagcaugugaucucugugacccacacccuauucguacaguccccucuccuuuugaaaaucacuaauaaaaacuugcugcuuuuggccaggcgcaguggcucaugccuguaaucccagcacuuuaggaggcugaggcagguggaucacgaggucaggagaucgagcccauccuggcuaacauggugaaaccccgucucuacuaaaaauauuuuuaaaaaauuagccgggcgugguggcgggcgccuguagucccagcuacucgggagguugaggcaggagaauggugugaacccgggaggcgcaauuugcagugagcugagaucgcgccacugcacuccagccugggagacagagcgagacuccgucucaaaaaaaaaaaaaaaaaaaccuugcugguuuuacggcucagggggcaucacggaaccugccaacaugugguaucucccccggacacccagcuuuaaaauuucucucuuuuguacucuuucccuuuauuucucagaccggcugacacuuagggaaaacagaaaagaaccuacaugaaauaucgggggugaauuuugcccaauaucuggcugaauuucccccauacccaggagguggagcuugcagugaccugagaccacgucacugcacuccagccugggugacagagcgagacuccgucucaaaaaaaaaaaaaaaaaaagaucuggagccuaggcuucaagaggcauguaacuuccuccuugucauauuggagcacuguccugaggugccauggaaggaagccauucuagcuaaugcagcaugagaggccacaaugagaacugaguugccccaaccaacagccagcaccaccugccagaagagcaagugagucccacuuccgccagcacagcuggcccuccagcugaauguagccauaugaugguaguccuauuuuuauggaugaggaaaacaaaguaguaaguaauuugcacaguacugcacacuauuaaguagaacaaggauuacaauccaguaugaaaccacuaaaaugugcugcuucccuacaaaaaauaacuucuagacucuuuaauuugguagcuuccaaauuuaucugcaauuauauaaagcauauuuucucacaggaauauguuauacaugcuauaaauuuaucucuccagucaaccuauagaagucccuggaguacagaauuguuacagcaagguaagaaaauccucaacuaagauaauucccauugucuaaagcagaugcuccaguagguguggcauggaagaaagaguuggcuucccagcagcauaaaaauacuacuuaaguaacuuuuuuuuuuuuugagauagugcaauggcaugaucucagcugacugcaaccuccaccucccggguucaagcgauucuccugccucagccucccaaauagcugggauuacaggcacgugucaccacgccuggcuaauuuuuuguauuuuuaguagaaaugggguuucaccaaguuagccagguuggucucgaauuccugaccucaggugauccacccaccucggccucccaaagugcuaggauuacaggcgugagcuaucaugcccagcuuccaguaagaauuuaaauuucuaugagaugauaucuuuauuuuucuuuaaaaucuucuauuauuuguucaaaaaaguggccugcauucacauaaaguuuacauaccuaaucauucacauuuuaaaaaggaaaugaaaacuuucaaaugaaauuauuauauguaccuuaauucguaccacuggauuauuuuauuaaaccacucagcauuaugauuugagaaucuaugaaauaacaaugaugauacagacuacaaacacuacuuuugcaaaucugccauaggagacagauaaaagaucacagaugaacaaauuaaaauaggaauaguucugccuuauuucauaaagguuauaauauucauuauuaauguuacuucaauuuauacauguuaggucacuacagcuguuuucauaaauaugaaauggcuuguggauuacaugcuaaaauucauaaaaaaugaaaaaauuauccugcucaaaauaguuucccacccaacauuccauaaucuuaauaaugugaccauuuugaauuuaauuuacuacuucugcaagaccagcgucuugauaugcaaauagcguucuucagaguaacaguaucauugguaaacagcuuaccagagauuagcaggucaacuagugacaaaacaggccaguuauauuuguauggaaauaagaagaggaaaagaaaagagcuggguaauuugaagaauaccaugagaaaacaggaagcauacauaacaucacuagauaccagaggggugggaaccaccaugauggggauaauacaagauaagugaguguccugcaaauaaaguuucauucauuuaaaacuucugcccaguucauguuucuaauauuuauaucacauugauuuauuuauuauugcucaagggcugcaacuauuaauagagaagaaguaaucaccacugcuacuccccacccccaauauggaggagggugauugggagcaugaccaaauaaaacucugggcuuuucccuaccuucaaccaaccauuucuacuuuuauuaauuucauauaaaauaaccucugaucuaagugauugaauacacuucuugacuuauucuuacucaaacaauuagguuuauuaacuaaaaucuuauaauacaauaaguagacugcccuaacucaaaauauaauuauuguaacuauuagcuuccuauauaaacaauuuguauguccaauuaccuacaacccgcuucuauagaaaguguauuaggaauucuaaucuuggaugccagaggccucuguucaccauucccagugggaaagagaacuuccuuugccaggaguuaaucaggguggcuucuguugucuaaggcugagacaucaauaguauagggccuaacguugcacagcaacuggguauaaagacuaucaagaaggagcugaagaagcauauuaugaucagauaaacauuuuuaaauuauuaauugcaagugaaauuuuaaagaaugcuauuagcuacauuuauauuuuaagaauuauacuagaguauuauucugaaaaacauuuucacaucuagcuaugccuaccaguguauuuucuggaucuaaagauacaucuauauucuagguagauaaagcaacauuaucaagcacaaagaagcauagauucuccaagcauaaacuaaaguguaccaguaaugaauaaaguggcuuagacagcaaaagauaugauucucuuagaauaagaaagccaaacauucuuaaacagccuuagaaacuacgugaaguuuuaacaauuguuuauaugggcuagucauagaaagaaacagucugaaaaacucauaaaagauucaaaucagauguagaaaucaagcuuaugaaagauguaguguuaagauucggcauuaacauuuaagagaaaacuaccaaauuuguauuuauauucauuuaaauagugcuaaauauguguaucuucucauuccacuuuguacuucaguuucucuaaguaaaaugggguaugaauaucaaauuaaaaauauauuuaaagcauuuagaaguugauaugguuuaguuguguccccacccaaaucucaucuugaauucccauguguugugggagggaccgggagauguaaucgaaucaugggggugggucuuuccugugcuguucuugugauagugaauaagucucaugagaucugaugguuuuaaaaagagaagauacccuguacaagcugucuucucuugucugcugccaugugagacgcaccuuucaccuugugcggugauugugaggcaucaccagccacguggaaccguagucuauuaaaucucuuuuuuccucccagucucggguaugucuuuaucagcagugugaaaacggauuaauacaguaaauugguaucaauagaguagagcgcugcuuagaagauacccaaaaauguggaagcgacuuuggaacugggagguuggaacagcuuggaaggcucagaaaacagaaaagugugggaaaguuuggaacucccuagagauuuguuggauggcuuugaccaaaauacugaucaugauauggacaaugaaauccaggcugagguagucucagauggagauaaggaacuuguugggaacuggagcaaaggugacucauuauguuucagcaaagagacugguggcauuuugucccugcccuagagaucuauagaacuuugaacuugagagagaugauuuaggguaucugguggaagaaauuucuaagcagcaaaguauucaagaggugacuugggugcuguuaaagguguucaguuuuaaaagggaaacagcauaaaauuuggaaacguugcagccugacgauacaauagaaaaauccuauuuucugaggagaaauucaagcuggcugcagaaaguugcauaaguaaugaggggccaaauguuaauccccaagacaauggagaaaaugucuccacugcaugucagaggucuucauagcagccccucccaucacaggcccagaggccuaggaagaaaaagugauuuugugggcugggcccagggucgcugugcugugugcagccuaggaacuuggugcccugugucccagcugcuccagucauggcugaaaagggucaauguagagcucaggcuguggcuucagagggugcaagccccaaaccuuggcaguuuccaugugguguugagccugcaagugcauagaagucaagagguuugggaccucugucuagauuucagaagauguauggaaacgccuggauguccaggcagaaauuugcugcagggguagagugcucauggagaaccucugcuaggggagugcagaagggaaauguggggucagagcccccacaaacagccccuacuggggcaccaccuaguggagcugugagaagagggucauuguccuucagacucuagaaugguagaucugcagacagcuugcacugugugcccggaaaagcugcagacacuagacgccagacugugaaagcagccaggaagggggcuauacucugcaaagccacaggagcccaaggccaugggagcccaccucuugcaucagugugaccugggugugagacauagagucaaagagaucauucuggagcuuuaauauuugacugcccugcuggauuuuggacuuguauggggccuguagcccccuuuuuuuuuuggccaauuuuucccauuuggaauggccauauuuacccaaugacuguacccucauuguaucuaugaaguaaccaaccugcuuuugauuuuacaggcucauaggcgaaagggaauugccuuauuucgaaugagacuuuggacuguggacuucugaguugaugcugaaaugaguuaagacuuugggggacugcugggaaggcaugauugguuuugaaaugugaggacgugagauuugggagggguugggguggaaugauaugguuuggcuguguccucacucaaaucucaucuugaauucccacauguugugggagggaucggugggagguaauugacucacggggccaagucuugcuguucuugugauagugaauaagucucacaagaucugaugguuuuaaaaagaggaguuccccugcacaaguucucucucuuugccuacugccaucuacguuaagacaugacuugcuccuccuugccuuccaccaugauugcaagguauccccagccauguagaacuguaaguccauuaaauccuuuuuccuguauaaauuacccaguuucagguaugucuuuaucagcagcaugaauauggacuaauacagaaauuaaaaugaugccugacacauaauugcuuaauaaauauuagcuauuauuauuugacauuaucauuaguguuguaaaaugagcaaagucaaguaaaaaugcauaacaaucuaugcuuuuuauuaauccugucuagcaaaggaaucauaaccucugcaaauaauuauucuaaauaauuauuccuaucaguuuaccucuaccucuuccaucuuacugcucuaguagaaaaauuaggccagggcaguggcucauaccuguaauccuagcacuuuggaaggcuaaugcaggaggaucauuuuuugagcccaggaguucaagacaagccuaggcaacauagaaagacccugucucuacaaaaaauuuaaaauuaccuggguguggcaguacaugcuuguaccagcuacuugggaggcugaggugggaggacugcuugagccugggaggucgaggcugcagugagcuaugaucguaccaccacacuccaggcugggugacacagugugaccucaucccucccccaccaaaaaaaaaaaaaaaaaaaaacacaggaaaaaaaauuaguguaacacuuccuuacaaaaaaguggaguauagaaggaguacauuacgaacucauagagcuagcuaagguuucuaggcagaaugugcaaagggccaaaugguuucauuuaauugccuaugauaaaguauggaugguguaggaugaucuuaaaaagaagcuguuaggccaagcaugauggcuuacgucuguaaucucagcacuuuggguagguggaucaccugagguuaggaguucgagaccagcauggccaacguggugaaaccccaucucuacuaaaaauacaaaaacagcccuguguggugguggugccuguaauccuagcuauuggggaggcugaggcaggaaaaucacuugaccucggaggcggagguugcagugagccgagaucgcaccacuguacuccagccuggaugacagagcacgacucugucucaaaaaaaaaaaaaaaaaaaaaaaaaagaaucuguuacauuuucaagcagaaguuagagaaaacagagccaguacuuccccauucaaaaauaagacuguuucucauuuccagcuacuccacacaccaaaagguucucacaguuagacaugguaucaguaaaagaucaaauccagggaacugccaguaaaacuguggccucagugucaagaucuaaggaugagacuguaagacccuucauuaacaccucagaaagguuugucuaccucucaauugaggugccuggacaugauuuuuuuuuuuuuuuuuuuuuuuugauacagaguuuugcucugccauccaggcuagagugcaguggcaugaucucggcucacggcaaccuccgccucccagguucaagggauucuccugccucagccucccaaguagcugggauuacagaugcgcaccaccacgcccggcuaauauuuguauuuuuagaagaguagggguuucaccauguuggccaggcuggucucgaacuccugaccucaggugauccaccugccucagucucccaaagugcugggauaacaggcauuugagccacugcacccagccauggacaugauucuugaugaugaguuccaagacuucaagccugagccuaaugccauaauggguugagacaucaggggucuuggaaggaagguguucaaugguuuuuacauaugaaagagggaaccagaggauggacuguaguaguuuucaauuacagccccaaugaaccaugacucccaguauucuugcccuuguauagucccuccuaaauuaaauccuacacuguaucacuuuaauaaauuaaacagaaaaacacugugcuaguuguaggauuaagucuuaagaagaacuccuagcuucuauauuugcauuuugggaggcacagagagugaaggaagcccagcuauuccagcccauccaagcauccagauggcuaaccccagucacaaucuuacuacaacuguaggagagaccuuaggcaaggcugaagaauaacuacuuagguaauccacagaaucaugaaagauaauagaaaaugguuuuaaaucacuacguuuggggauagucugucaugcaacaauagauggccaaaacaacggggauaggcuacucugaaugugcagcauggggcacaugcccacuucuauggcaaagauauacagcauaaugaauuuuuacauagguauaugcccugguaaccaccaccaaggguaugacacauuuccaacucaaaaaccuacacggugucacuuuguugccuaggguggucuugaacuccugggcucaagugauccucccccaucagccuucccaaaguguugggauuacaggcaucggccaccacaccaggccuguucucacuucuuucacucaacauauugucugggagauacaucuuuguuguuuuaucaguaguccauccuuuuuauugcuguauaaauauaccacaauucugcugguggcauuuagauuacuuuguauuuggggcuuuaaugaguaaagcuguuaugagcccugugaugguuaauuuuaugugucagguugacuaggugaauggaugcccagaaagcugguaaaacauuauuucuaggugugucugugaggguguuuuccaaacagauuaacauuugaaucaguugacugaguagagaagaucacccucaccuaaucugaugauagcacgaauaaaacaaaaaggcagaggaagggcaaauucccuuucuucuuaagcugggacauucaucuucucuggccuucagugagacaucagugcuccuggaucucuggccuuuagacuccaggacuuaauaccaggcauccuccucccccugguucuagggcuccagccuuggacugaauuacaccacuggauuuccuaguucuccagcuggcagacagcauauuaugaaacuucuuggucuccauaaucaaucaugugagccaauucccauaauaaaucuucucuuauauaucuauauauauucuauugcucucuuucuccggagagccuuuguguguauauguauucauuauuccuggaugaguuccuaagaguggaauugcuggauuauaagaauagauguauguuagucugggugcagugguacacgccuguaaucccagcacuuugagaggccaaggugggcagauacuugagcucagaaguuugagaccagccugggcaauaugacgaaaccccaucucugcaaaaaauauaaaggaaaaauuggccaggcaugggggcaugugccagucaucucagcuacuccggaggcugagguggggguauuguuugagagcuugagcccuggagguugaggcugcagugagcugagaucacuuaacugcacugcacuccagccugagugacagagugagacccugucuccaaaaaaaaaaaaaaaaaaaaaaaaaaaauugauguaguauuaauugcauuuccuugauaagcaaugauuuuaaacacauuuucauauguuuauuggccauuuggauauccucuuuuacaaaagaucuguucaagucuuaugcauauuuuuauuuuauuuuauuuuuauuuauuuauuuagagauggagucuugcucuguugcccaggcuggagugcaguggcacaaucucagcucacugcaaccuccgccuccuggguucaagcaauuuuccugccucagccucccaaguagcugggauuacaggcgccugccaccacacccggcuaauuuuuguauuuuuaguagagaugagguuucaccauguuggccaggcuggucucaaacuccugaccucgugauccaucugccucagacucccaaagugcugggauuacaggcgugagccaccgcgcccggcugcauauuuuuuauuuaaaaaauuuauugugguaaaauacauauaacaaaaguuaccacuuuacuauuuuaaaguauguaacuguauuuaugccuauuuuuaauuaaguuaucucuuuuuucuuguuuuuuuuagccauuuaaaaauauauacauauauucaggauauaaaaucuuuguugaauauauacacacccacacacacagagaaugcaaaucucuucagucaguguguacucuauugucuuaaugcugucuuugaugaaaauuaguucauaauuaacaaagcccaaauuagcaguauuuucugauuagugauauuuguauccuguuuaagaagucagccaccccgaggacaugaagacauucuccuguguuuucuucuagaaguuuauuguuuuccugucacauuuaggucugauuuaccuuccuuuuuauuggcggguaauaaguguuugcaacugaguuguucuaucagugcauuuccugccuguaaaauuuugggggucugacaaccuuuuucauuuugucucgucuuugccccuuuugguuuaagcugguaguguugcuucagguauaaaauucucaaaaucuuugugggauucucacauaugucaagggaauccaugucauuaagacaggaguguucucucaaaauucuuucuggauaaccuuaucucuguuccuggcuucugcuuagaugauugauuggauccaugaguuacauaccuaaccuucccagcaaaaguuugucucugcucuggguaauccccagagcaagcuauaucacuuuuuguaauagccugagaauuuuccaaaucaucaaagcucugguugcuuuuaaccuaacagcuccuuacucacuuuaucucuuuccucucauauucuacucuaaaaagcaaggagaaaccagauaacaaauccuacacuuuacuuggaaauuuccucagcuaaauauccaaguucauugcuuaaaaguucuauuuuccaccucacaguagaauauaauucagccaaguuuucugccacuuuauaacaaggauagccuucccuccaguuucuaauaacgugucccccauuuccuucugaaacuucacugaaggcaccuuuaacauucauguuucuagcaaauucuguucaugaugauauacauauucucuaagauaacagcagcuuugucuuucauuuuccucauuuccuucugagcucucacaaaaccuaggcuuuucccuaucauggaccuuaaaauucuuccagccuuugcucauuacccaguuccaaagccacuuccaccauuaaguauuuguuacaucagcaccuuacuuccuggcaccaaacucuguauaaguuuccuaggacugccauaauaaauuaccauaaggugagugauuuaaagcaacagaaauuaauucucucauaguugugaaggacaaguaugaaauugauguguuggcagggcuacacucccucugauggcucuaggggagaauccuuccuugacucauucaguuucuguggcuccuggcauucuuuuuuuaaaauuaaauuaaauuuaaauuuuacuuuuucugccaacaccuugauuuuaacuuauuuauuuauugccccugacauucuuuuuuuuuuuuuuuuuuuuuuuuuuuuuuuuuuuuuuuuuuuuuuuuuuuuuuuuugagacagagucucacucugucacccaggcuggagugcagugguaggaucucugcucacgguaaccucugcuuucuggguucaagcaauucuccugucucagccucccgaguagcugggauuacaggcaccugccaccacacccggcuaacuuuuguauuuuuaguagagacaggguuucaccauguuggucaggcugguuuggaacuccugaccucaaaugauccgccuuccucagccucccaaagugcugagauuacaggcgugagccacugugucugcuuggccccugacauucuuuaacuuguggaagcauaacucaaaucucugccuucaucuucauauagccuucucugugucucaaaucucuuucuccguucuuuuuuuuuuuuuuuuuuuuuuuugagauggagucucaaucugucacccaggcuggagugcaguggcgcgaucuccgcucacugcaagcuccgccucccggguucaugccauucuccugccucagcccccgaguagcugggacuacaggcgcccgccacaacgcccagcuaauuuuuuguauuuuuuaguagagaugggguuucaccauguuagccaggauggucuagaucuccugaccucgugauccgcccgccucggccucccaaagugcugggauuacaggcgugagccacugcgcccagcccucuccuuucucuuauaaggacgccaaucacuggauuuaggacccauucuaaauucaaaaugaucucauuucaggauccuuaauugcaacuacaaagaccuuacuaacaaaaauguccacuguauuaguuugcuaggugugucauaacaaaaugccacaacugaguggcugaaauaacaguucuggaggcuggaagucaaaucaagaugucagcaggauugguuucuuuuaaggacuaagaggaagacucugcuaggccuauccucuaucuucugguguuugcucuguuauauguauauguaauauguauuuuaccacaauaaaaauuuuuuuaaauaaaacauauguagccgggugcaguggcucacgccuguaaucccagcacuuugggaggcugaggcggguggaucacgaggucagaaguuugagaccagccuggccaacauggugaaaccucaucucuacuaaaaauaccaaaauuagccgggugugguggcgggcaccuguaaucccagcuacuugggaggcugaggcaggaaaacugcuugaacccgggaggcggagguugcagugagcugagauugugccagugcacuccagccugggcaacagaguaacaccaaucuuugguguuccuuggcuuguagaagugucauucugaccucaacuuucauguuuauguggcauucauccuguaugcaugcaucugugucuaaauucccccuuuucauuuuuauuuuuuuaauuauuuauuuagagacagagucucacucugucacccaggcuggagugcaguggcaugaucucagcucgcugcaaccuccgcgucucagguucaagcgauucucaugcuucagccuccuaaguagcugggacuacaggcacaaaccaugaugccuggcuaauuuuuguauuuuuuaguagagacgggauuuugccauguuggccaggcugguuucaaacuccugaccucaggugauccaccccccucggccucccaaaguguugggauuacaggcaugagcugccaugcccgaccaaaguuaccccuuuuuauaaggacaucagucauauuggauuagggcccacccugauuacuucaucuuaacuaauugcaucuuuaaugacccaauuuccaaauuaggucauauucuaaggugcuagcuguuagaacgucaauauaagaguucuuagggacacaguucaacccauaacaguuacauuccuaggaaccaggaguuaggacauagacauaucuuucaggguggugguggggagacacaauucugcccacuacagcguuuguuuuugcuuuucaauauuuuaaauauuucacuccccucucuuuuugguugcacauggcugguaccauuccagaagggaaguuuauuuauuauauacaauggaugccuuagccauuuuacccuuaauauuucaauguguauuucauagaauaaggauauuuucuuacauaacugcaaaaacaauaauauucagggaauucaacauuaauaaaauauuuugucuaaucuaccaucaauagucuaguuuccucaauugucccaauaauuuuuuuucccuugaaaagaauucugcucuagaucauauauucauuuaguugucauguaucuuuuuagugucucuuucaaucuaaaacaaguccuuagccuuucuuggcuuucaugacauugacauuuuuaaaagaauacuggccaguuguuuuuuaauacuguaugucugauuuuggcuuugucugauauuuacucaugauuaaauucagguuauacauuucuagucagaauacuacacaguguuauccucccucacaggugacaguaguuuugaucacucaggcaaaguauuguuuguuucuguauauauaguuacuauaugcccccuggcaacuggcaggaggcacuuuaagacagcaguccccaacuuuuuuggcaacagggaccaguuucauguaaagcaauuuuuccacagacaggagauuggggguguaggagauggggagaugguuucaggaugaaacuguuccacuucaaaucaucaggcuuuagauucucauaaggagcacacaaccuacauaccucagaugcacaguucacaauaggguuugaguucccgugaguucccgccacugaucugacaggaggcagagcucaggcgguaaugcucgcucagcugcugcucaccuccugcugugugaccuauuucuaacaugccacggaccaguacuggucugugaccaggggacuggggaccccugcuuuaagaucaugcaaaucuuguuccucaucaaaccucuccucaauccugaccccagaguuauacccauuaaugauucuuguccaaucaaucuuuacuaugaugauugcaaaaugauucucuaauuugacuguuuauuccacauuuauuaaucagcauccuagcauauggaaaaguuuuccuuuucaccaauuuaucuaucaucaguauggacucaugaguuccuauuuuuucaaugguucaauauuguccuuauuuauuuugaugccaaauaguccuagauuuggccacuaggggccucuucaagcuagcuucuguguucuuucaacaugucuuuaucauuuuuuuaaacacuuccuugcuuucuguuaacauuacgauguuccaggauaaucauaccuuuucuuccccagcccuggagaccagccauuucuccagaaauccccgauuccuuuuaguaggaaaugguauuagaaaacaaaauaugaguuccagacauacugauuacuuaucaggauaagucugagucuacaucugugcuguccaguuugguagcaauuacccauguguggcuacuuaaauuaaaauaaaaacaaaauaaauuaaauauucaggaugggcacaguagcucacaccuguaaucccagcacuuugggaggcuaaggcaggaggaucacuugagcccaggaguucaagaccagccugggcaacauagcgagaugucuaaaaaaaaaaauggaaaagaaaaaaaaaacucaguuccucaauuacauaagccauguuucaugugcucaauagcuacaugugucuaggagcuaccauauuggacaguauagauuuauagagcauuugaaucauuacagaaaguucuaugguucucaagacuuuccauaaagaaaaaaaagaaaguucuaugggauauggaauaucacuauucuagaccacugcaguaggcaaaucuaggaaacacacaaacacacacacacacacacacacacacacacacaguuccaauucucuauugccuuuuaaauauuuuccuauguuccacuucguuaauucuuuaacacauuaaacaauuauuuacugagcacauucuaucagacagguacucuucaaggcccugcagaucuggaaauaaaaagauacagccccuauucucugaaaacauaacacacuuuuuucugaaaagucagaaaagaaaugauuauaaaauaguauaauaaauuccagcucagcaagguuaaaacagggugcuauaacaauauauauaccauucugggcaugucaaggaaggcuuccugagagaaaugacauuuaaauuaaguuuagaaagguaaauaauuauuggggugacaauaugggagauaagcugaggguaacagaauuugcuauucuccaucacuuuuuucaucuuuguuccaauuauucacuuaaaauccuuucuuucucuucaccauaaccuucaaaacucugcuugucuuucaaaacccaucuuuucuauauauuuccuaauaccucuaaccuuauaaacccugaaauauacugucuuuacugacuucuggcucacaaaagguuugguuuauuuuuguugcuauaaauguuuauaaaaagaacaugggcuuuggaaucagauuuacugccucagccucccuaguggaugggauuacaggcaccgccaccacgcugggcaaauuuuuguauuuuucacgcugggcuaauuuuuguauuuuuaguagagaugggguuucgccauguuggccaggccagucucgaacucuugaccucaagugaucccucugccuuggccucccaaaguacugggauuacaggaauaagccaccgugccgggcaggaaaagucuuucaaugaaagcuaauuugucagaauccacauuccuauuuauaacuggacccugauaaaagagcuuaaaauuguuuccuaauaaaacaaagcaucuuuauuuuaauaaacauauuuaaauagauaacguaaugauaaucagaaacaauauuaaauaguaguaucaauaauuucuuuccuuugauauauuaagaaaucuaacguuaauugucagggggaagcauauccagcaagaacuagagauaacuuauuuugcuuuucaucacagcugguuuagaaguacacuaaaggaaguauacccauuauuuuguucacacaugaaaaauauguuuuacaaaaugaauguuucuaaugaaguauacuuaauuuguaaaaauuguaagcaugagcaucuaaaacuguauugcuuauguucuagaagaaggaaaaggagcacucaacaagauuaauaaauaucaaaccuaaaaaggaaagcaacguuacuucuuccaaaauaacugacagcugugcagauuuucuucuucugagcaaacauuuauggacaaauauguaguacauuuguguuacccucuuaucuuugacaguacauuuuaaaaaucaucuugacauuucauuuucucucaaauuaguuuaggcauaauagaucuuuaaaaaaacuggggaugugagaaguuucagaguacacugcuugcaauguuuaaaaaauuacuaaagcccacuuuaguauuauuaauaucuacuauaucauuuuuaaacuauauuuguaaguuuucuacauguaauuauucaaaauaaguguuaugcuaaauaacaaucuacaucuucucaugcaugaaauaugcugauggugaaucuuugaucauguuuucuucccaaaggcagccuuaccuguggaguccaauaaaaaguagggcucaaucuguacaguuuucguuuguggaaacucugaaguggccuuguucgggcugauguacucaugaaagucaaggaugaagauuucagucuuguccugucuuuucucuuuuucuuacugugcuucugguuaaguaaccagcuacuggaggaagacagcucaucuaaauucucugaugcacugaaaugccaugaaauaauuagggcgugggaagggaauaaaacaaaacaaaacaaacaaaaaagacaaagaaaacuaaauguaaauugccuugaucuauuaugacagaaaaguauuaauuuuaaccaauuuugugguaacaauugguaaaauauuuuguauuaacgggaaauuacauauucaaguugugaaaaccaucuuuacaucuauuuucuccugcaaaacaaauauaccauaaguuagaaaaugcucaugaguuuacuaguguaauguaauugcucauuguaaaacaauaauucaugucaauuacaguauuuuaacuauuuacacaaaauucuuuuuguguaugaugaaaauacauagauuacagguuuuuaaaagaacuaaagucaucacuccauuauuaguuucuguuuuuuuuguuuuuuguuuuuuguuuuuuugagauggagucucacucagcugcccaggcuggagugcaguggugcgaucucgguucacugcaaccaucgucuccugguuucaagugauucuccugucucagcuucccaaguaucuaagauuauaggcaccugccaucaugccugcuaccugcuaguuuucauauuuuaguagagaugggguuucaccauguuggccaggcuggucuugaacuccugaccucaggugauccgcccaucuuggccucccaaagugcugggauuacaggcaugagccacugcaccuggcuauuaguugcucuuauauaagcacuacauauuaauaacauuucagugaauuuugaaacagagcuguaacccuacuacauuuuagcauuuuuuaaaaauuuccaauguuacagaaacaacaacuauaaaauaaugaaauagaucaccuaagcuacacaugaaaagagcauaauuuuauauuuauucuuuauauuauuuuuuaaaaauuauauuuaaauauuucaaauauuuuacaauaucagaacaucaggaggaugauaacccucguugccacauaaauuuaacuucauuuauacuaucauauuauauauacaauaauuaagcuuuucaggcccuacaagguaccaauuuuaaccuuaguuauguagacaaaagcuagucaauuuaguauucuaauauuaacaaaugaaucugcuauuaugugauacugcuguucaauauauaaguucuaaauaugcuauuugguucaaguagaauugguguuuaccaguaaauauaaaauaugguuuuucuauagcaguauuguuuuugaaucauauuuauggcuacuauaaaauauuauauuagcuuguggauaaaguaaauaauucaagaaugcuuuacauaguaauaagaaaccagaaauaaaggugucugaauggcuuguguugguaaaacuaaauaaaauaauuaaauauggcauuuggugacuaucauacauucaacaaauacguaauugauuaugcacuacuggccagaccaauauagaaaaaaggaguugaugacaacuaccucacuuuuaaaauauuaagucuccagagagcucuagcaagaaugcuuuaagucucgguaaauaaaagguucuaaaaaucuuucaucauguugauggcuaggaaagauuuaggguauaaugcuucucucaaauuaacagguccaaucucacagcuagauuuuauuuucugucauaucaagggggagcagaaggcauacaggagagccaauaugaaguuaggcacugaacaggcuaaguggcuagcauagaagugagucgaggucaagaagaagacagguuucaguagguagcuggcauuagaggcaguuaagucaggagauguaggauccaggaaguuaggaguagauccagcaccaaaagagguucuuuguccagcaagucagaagcacauuuaggcagaacuuacacuggcucuuaaaagacauugcucaaggaugugucuagggaaaauuaaaagcuuauuccagagccugagaccuacuuaacuaacuuuuaccacuauuuacaacuccaguuguuaaugagauguuagcuuuccccuccccauggaaggcuuagcccaaagaagaugagcccucaucuuaugaaaugaaaggacacaacuucugaacuggcuagaggcucauaggcuggcuuaaagauaauuggaaagcuuaucuuugugucacuaaauguuauacagucaugugucacuuaacaauggggauaccuucugagaaaugcaucguuagguuauuuuuuauuugugugaacaccauugaguguacuuacacaaaccuagaugguaaagccuauuacacaccuaggcuauaugguauagccucuugcuccuaggcuacaaaccuguaaaacauguuaccauacugaaugcuguaggcaacuguaacaugauagacaugguaaguauuaguguaucuaaacauagaaaaaguaaugcauugcucuacaacauuaucauaguuacaaugucacuagauaauagaaauuuuucagcuucauuauaaucuuaugggaccacuguuguauaugugguccuucguugacuagaaacaucauuauguggugcauuacaguauacaauuuuuaaauuucuaagggggcuaacauauuaccagaggaaaaaaaguucaguuuuauuucuuuucuuauguucccaucugcaggcaaauuauccuuagauucuaacacuuucuaauuaauaagaauucuugcaaaguaucaucaacaucuauccucaaauaaaugaauacauggaaauuuaaagaugugagauauguuuauuucacuacuaaucaaugugcaaacugcauauucucaucaaagcuaauguaguacaaaaucauuuccauaaauaauggaugaagguuauuguaaaugguuauuguaaaccacugauaaauucacuuauuucacacauuaacaauaaugagacggcccaaucaauuaaccucauugaaagcaaaacaugaggaaaauccugagaaaauuuugaggaagacaacacaagccugauccugugccucuguaaucuaaugcuuuuuccccaggagaugaugauucagguaauuaaguauugacuaaaauaggaaccuaaugauaucuguaagacaaggauaucauuaauaaaucaauauaagaaaccaucaucacacgacauucuuuuaaaaaaaaauaagguuuaucucuuuuuaaaaaucuuucuuucuuuuuuacagacaggguuuccuucuguugcccaggcuggaaggcaguagaacaauuguagcucacugcagccucaaacuccugggcucaagggauccuccugccucagcuuucugaguaacuaggacuacaggugugcaccacaacuccugccuagaugacaguccuuaaaaaauuuuuuuaaagucauaauaagaagaggagaagguccagaagaaaaagaauauuucaauaaaugauaaagcuuaguguucccacugagauuaaaguguaucuaugaaacccuagaaacugaggaugcaacaggccaccaucaaauauuguuguagaauaauuaucaaaauauaauuaucggcugggcgcaguggcucacaccuguaauuccagcacuuugggaggccaaggcgggaggaucacuugaggucaggaguucgagaccagccuggccaacauaauuaaaccccaucucuacuaaaaauacaaaaauuagcuggcccugguggcccauaccuauaauccuagcuacucuggaggcugaggcaggagaaucgcuugaaccugggaggcagagguugcagugagcugagauugagccccuguagccugggcaacagagugagacucugucucaaaaaaaaaaaauauguauguguauauauauauauauauauauauauauauauauauauauauauauauauauauguauguguguauauauauauauauauguauguguguauauauauauauauauauauauaugguuaucauuguacuucuaaaaaagcaagcuuacaagugggagagaaccagcugaagcaauacauuccuuuuuuuuuuuuuuagauuucuaacuggaagcuggagaauaauaaaaaucuuccaaaugauguaguuuagauccuuuggguugcaggcauauaacauaacuuguucugaaaaggaauuaaauaauugaggauggggaaguagugagaguggguuucaggcuuauaccuuucuauauuucccuggccuccucccuaauccaagcuaucuuguaccaggguuacucaauagccuugaaaguggucucccucauccacauuuuccccucuagucccuucuauaccaauuauuuggaaagaacaaucugauccugucauaccugcccugccacccuacaacacacacacacgcgugcacacacacacacacacacacacacacacugcuuaaaaucuuccaacauccucccauugcucuugaaagacuuaaauccuuaaucuuuuaaaaggcccugauaggucuggccucuuccauaguucucuugccucaucuugcaugaugcuuucccuugucucaucuugcaugaugcuuucccuuguucucuguguucugagaaagaaaacaaauuuuuaaucugagaaauucaagucccuuuaaauuaccaggcccagagaagcauuaaaaugugacauggcaugccuauaguucuggcuacucagcaggcugaggcaggaggaucucuugagccuaggagucugaauccagccugggcaacaaagcgagaccuuuucuacaaaaauaaaaaauaaacaaacaaaaaugugacagcagucaugucuugcuccccgcuugagcuaaauaccuaacucuugaagccacuugcuaugugggcuguagacuaacugacaccaaguagccaaaacauaccauacacuagacaccuuaacaaacuauaguucaacaacauauagccaauuaguaaucaauguuacuuuuguaaaccaguaagaauucaugucaaacauaaauuuguaucagccccuuuuguggucuuagacaaagucccuugucccuuuuugccuuaucugcuuguggcugggcaugguggcucaugccuguaaucccagcacuuugggaggcugaagcagguggaucacuuggggccaggaguuugagaccagccuggccaacauggugaaacccugucuguaccaaaaauacaaaaaucagccaggcgugguggugcaugccuguagucccagcuacuugggagccugaggcaugagaaucgcgugaaccagggaggugaagguugcagugagccaagacugugccacugcacuccagccugggcaacaggguaagacugugucucagaaaaacaaaacaaacaaacaaaaaaacaccugcuuguaacaaggccaaauggagcacuucccaauguuucccaggcugcaguccucaaccuugacccaaauaaagucucuauauuaauucugccucauuuucuuuccuuagguugacauuuccaaccauacugcuuccuuucuuuauaaauaauucacacuucauacuguauaagaucuacauguuauuuuugcuuccuagaaucuucacacauccucuucacuacauaauuuccaauaaucaucuaacucucagauccaaagucaguuccuuggggaaguuuucuagcuccugcaugaucucccuccaaagacuaggucaaauucccugagcucugaaaggugagcacucacuguucaccucuccuuccuagcauuuucauagugauaauuuuauauuuauuugcaugauuaucugauuaaucugucuuccuuucuagacugucaguagugcagagacugugucuauuuuguuuauccuugcaucagaaauuccugauauuaugccuuacauauagcagauacaccaugauuauuuguugagggaauggagaaauacuguacauacacauauguugucagguuuaucauuccagcccuggguuuaguacagcauaugcauaacacacacuacaccuaaauaauuaguuuggugaauaaguaaauguuaaacauuuuagucuaagagccaaagaagcucuauuaaauagaaggcuacaagacaacuuuaaaaaaagauauauauuuccacugccuugaaguuuccuucuaaaucugacucuuugguuuacaaaguuaggguuuuuuguuuuucagagagaaucucauucugucucccaggcuggagugcaucugguaugaacacagcucacagcagugucaaccuucuuggcucaagugaugcuccugccucaggccucugaguagcugggacuacaggugcaugccaccaugccuggcuaauuuuuuauguuccauacagacagagucucgucaaauuucuuggaugguuuggaacuccugggcucaagcgauccuuccgucucagccucccaaagugcauauuccauuuugaugaaauacuguaaugcugauaauuuguaaggaugcauuuaccauccaaucagaaagauuacaacaugauagaugacugcuuuggaaaaugcugcuacuuaaugauaugugauaaaaaugcuuuuagacauuuggaaucuaagacauguacuaaacuacauucagcacucgaugucaagcacaggaaaagaaaauucaaagaucuucagcauaggagugugaaagauccauauccuuaagauauccucaaaagccaggaauuacucauaguaagaaggucauaauuaaaaauuucccuuguauaccaggacaaugauuaacugaagagcuauacuuuauggaaaaauagacgaauaccagcacaugcuaaacuaauggccuccaucuuuucauauuaccacuucauggugcauauguccugcccuuugcuucaaaauacacuauggagccaaggaaacuaaguucaaggaauagcagcaaauagggacuuauucaacauacaauuuaaaacuauuguuuuaagucagugguuucuaacauuucccccacauucacaccauucucaaauuaaacuacuuaaguaaaaguagaaauaaacucugaagaaaauuagaaugugcauucucacagagauuaugauaguuuccuaggugucccccuccacccauaaaacuauacacaaaugcccacacccacuaaacuggguugaauagugucuccucaaagcucaugucuacccagaaccucagaauguaacauuauuuggaaauacuuggcaaaugugauuaguuaagaugaggacacacuggaugaggaugagcccuaaaucaaaucagugauuuccuuacaagaagagacacacaaagaaugccauguaaagauagaggcagaguuuggagugauguguguaugucuuacaaggaaagucaaggaacugcaggcaaccaccagaagcuaggaagaggcaaagaaggauucccuagaaccuucacaggaaguaugaucuugacaccuuaauuuugaacuucuagccuccagaacuguguaauaagaaacaccuguuauuuuaagccacaaaauuaguggcuuaaaauacagcggcccuaggaaacuaauauauccauaaacauaugcaccuaagaaucauaguuauugcaugacuuguaaucucuauuucaaguuucuccuuuuccaguuggaaguccuuugaugaauucaaccuauuguaacuaagguaggcagcaaccuuuuccauacuuucccuacuacacaaaguccugccaauaucugaauuuauuaccuccuuuauccuugauaguacugggagauacgaaugcaucacauauucagauaacccaauggcauuuaggauggcaguaaucaaauuuggguggaucacgagguuaggagaucgagaccauccuggcuaacacggugaaaccccgucucuacuaaacauacaaaaaaauuagccgggcgagguggugggcaucuguagucccagcuacuugggaggcugaggcaggaaaauggcaugaacccgggaggcagagcuugcagugagccgagaucaugccacugcacuccagcccugggcgacagagugagacuccaucucaaaaaaaaaaaaaaaaaaaaguaagaaacuaauaaaaaauaagacuuaaacuuaauaggaggauuauuuauccuccaauuggcaaaaguaaauaccucucucaaaugaucaaauagaucaagaucuggcauugccugguauagagaaaacaguuccuagaccauuucccuuacucuggguaauaaguagagaaacuacaucucuuacucaaaaauggaagucucuucaacucuaacaauaagaaaauguguuguaguacacuguaaaaugacauucuuuaaaaauaagauguaguaucuaaaaaaauuaaggcugggcgcaguggcucaugccuguaaucccagcacuuugggaggccgacacaagcagauugccugaggucaggaguucgagaccagccuggccagcauggugaaaccccgucucuacuaaaaauacaaaaauuugccaggugugauggcgggcaccuguaauccuagcuguucaggaggcugaagcaggaaaaucgcuugaacccaggaaauggagguugcagugagccgagaucgcaccacugcacuccagucugggcaacaagagcgagacuccgucuuagaaagaaaaauuaagauccaucuuacuguagguacugaagugggaaauaacuauuuuaaguauaaaaagcuucagauauaauauuaacugaaaaagauauaaaauuacuucuaauagaucuaaacuaugaaaagacuauauuaaaaagauggcaagaaaauauacucugagcaauauagugauuucuuuuuuuuuucucucucuuuuuugagacacagucucacuuugucgccaggcuggagugcauuggcacgaucucggcucacugcaaccuccggcucccaggaucaagcaauucuccugccucagccucccaaguagcugggacuacagguaugugccaccacgccgagguaauuuuuguuuuuaguagagaugggguuucaccauguuggccaggauggucucgaucucuugaccucaugauccacccgccucggccucccaaagugcugggauuacaggcauaagccaccaugcccagccuuuuuuuuucucuuuuauuaggaugucuaauacauuuugaaauggcuauugaaaauaaaagagacuuaggagacauaauaaccaaauguaauuuauggacuucggauacagguuuuaacaaauuaaucauaaaaagauaauuuugagacaagcagaaauuugaauauggauagagaauuucaagacuaacaaauuaugguuaacaguauuaaaugugauaauaaagugguagguauguuaaaaggcuuaucaaugaaauauaaagaacuauuuauaguuaaaauaacaaucacuagaaacugcuuuacaaaugccuagaaaaagaaagugugucaggaaaaggaauaacaaaagaauuagcaaaauuuugaaaacuguuaaagcugagaauauguggguucacuuuacuaugcuuucuauaugucugaaguuuuccacaauaagaguagaugggggaaaauaccaauuauuacagaacuaucugucauucuuaucucuggcucuuaacuuaaagugggacuuuuuaacacauaaaggcaaagagacgaggaaaccaauaugauagccauacuuuucuaccugauaauugagacauaaaguuugucaaauauuugucugaucugaggcacuuacagauaauuucuauuuuauauuuuaaggaaaacaaaaauacaaaaaaacuugaauaaaagcugaaauauuuuucaaaaucccaucuucucaacagaaauauaguuuucauuuauacccuucacaucuuuuuucuauaaaaucauacuguacuauaauuuuaguguccgcauuuuuccacuuaauauuucaauauaagcauguuuccauaugauuauauauuuucuacauacauaauuuuguauaguuacaugauauuagaucuagugguuguaccacaauuuauuaauauauucacuuauauaauauuagguuuuaggcuuauauuagaguuauaaaggaaaaaguaaacuauguauauauuuauuguaauuaaauauuuauuaauaauuauuauauauaauauugucauucacaggaauccaaaauuauacugaaaacaucaacuuagaauaugcuucuaacaaacaauguuuucucauaauugagaagugacuauugaaaauauugaggguaaaaaauuuacuuuuuaugugauuaguuugccagccuaacugcaguuuuucaauuaugauauccaauuaagaaaggauaguugcaugucacaugagauaauuaucauuaguagaaauaaauagcauggcaauaauucaucggaauuuaauuucaugucauauucugggacucauuaaagcaaaaacaaaacaaacaaugacaaaaaucuagacacuauuucaaguaggaauucacuuucucaaagauaauaccccaugggauaaacaaggauuaauuuauaacauuuuaucuucauuuuagaguaugagaucugaaaaccaaaaacuaucccuaugauaauaaaauguaaugcuucauuuguuugaagacucaaucuucuuaguugcacaguuccuggugagucaucugagaccauacugccaagauuaauaaagcuaaaaaaaaaaaaaacucuugacacuuuucuaggcgauauuguuauuaaauaaaagauaggaguuaguaaucaauaaauagcaagugugcaaacaugcccugggaaauaauuaaccagguaaguuuacuuuaaaugcacugugaggacagaucauuaccauuaauacuuaaaauuaugaagaauucauauuuaaguaugaguuaauacuuaaauacuuaagagaauuauaucaaacaaaaguucuauaugauccacaaaaauuaguauauagaaugaggcuaaccuuuaaaaauuaaaaauuuaaauuucuucuaaccuaauuauauacaagaauuaugauauaaugugauauaaagcuauaauaagcaugcuuuauuagaagaacuguaacauuucauuuaugaguuuccuuaucuggcaacaucaacuauauauauagaauguagcugaaauguuuaaaaggccuuuaaauaacaaaaagagaucucaguaaguuuaugcaugaaaguucacuccuguuccuuuuuuuauuuuuuauuuuauuuuuuuuuuuuugagacaggaucuugcucugucaccuaggcuggagugcaguggcauggucacggcucacugcagcccugaccuccugggaccaagcaauccucccaccucagcgucccaagcagcugagaccacaugcaucaacacaucuggcucacuuuuuuaauuuuuguagacauggagucuuccuauguugcccaagcuggauuugaacugcuggugauccuccugcaucagccucucaaauuauuggaauuaacaggcaugagccaucaugccuggccauccucuuguugcuuuuaagagaggccuucucucuuacagauuuuuuuaaauaucucuuauuacagagacaucuaugucaucuaucacauugguuaucugauuuucuaguccagagucaaauuaggaagagaagcagaacugcaggagacagccacgaaagcaacaaauagaauaucaaucugacuauagggaagaaaaaauacguuaaguacaaaauauuccuuaugaaugcugaguaugggcaagaaaucaugaacaacauuucauucauucaacaaauauuaauucaugcccaugaugugacucucugauccaaguacuaaggaaaacaacaguucaguaagauagaccaaaaaauucuuacucuccugaagcuuauguucaaguccaggaagacagauaauaagcacguaaaaaauuaacaaaauaacaucacauuuguuaccucauuugaucuucacaacacaacccagaaaacaggcuguucucauucuaucuaauucagauugccgugcaggaucaauacuaccaauuggucaauuugggauugaaccgugaucuaauuccaaaguaauauucuuaacaauaaaaauuuucuucauagcacuugaucaagguuuaaaauuauacauuugugugaucauuuagguggugucauuuuuuuuucacaacuagacuuuauaucacaaagauagaaauuccaucugguuuuguucauuaucauauaccugguauccaauccaaaugccuggcacacagaagucacucaguagguacuaguuaauuauucagugaauuguuuuauagauauacagcuauuuaucucaguaaccccugagaauguuaucaugguggugaaccugaguuaucaaaaaaauuaaguucagcucuuucccaucuuacaagauggcaggugaaaaaguugagaagccggauacuaaggagaagaagccugaaggcaagaaggcugacacuaguggcaaggugaaaagggguaacuucaaggcuaaaaauccaaaggccgaaauccugucaauugucagaagaauuggcagauaugccugaucugcuauguauucuaggaaagacaugcauaaaaggaaauacucacccaaugaauccaagauugaaaacagaaagagguucuugcagccauuagaaaaucaguuggcggugacaagaacagugguacccaggugauuaaacuucacaaauugccuugauauuaucuuagggaagacgugccuugaaagcuguugagccacagcaaauaacugcaagccaguuagcaugugagaaaacugcaagccagcucccaggagcacucugaucauccucacuggccgccacagaggcaagaaggugauuuuccugaagcaggugggcauuggcuuguuaccuguaacuggaucucugguccucagucgaguuccucuacgaggaacacaccagaaaucugccaucgccaccuccacaaaaauugcucucagcaauaugaaauccucaaacaucauacugaugcuuacuuuaagaagcagcagcuguggaagcccagccaucaggaaggugggguuuucaacaccaaaaaagagacauaugaaauuacagaguaguguaagguugaucaggaagcuguggaccugcaaauguuaccaacaaucaaagcuauuccucaguuccagggcuaccugcaaucuguguuugcccugaugaauggaauuuacccucacaaauggguguccuaaauuucuuaagcagaaucucauuaaaugacugauacauuuuggggagaaaauuaaguucaauaccacccaaagaaggcaauguguaauacauuuuauuuaaacaauucuucccaaacaguuuaauugaaaaaguuuuuggaacuuaaguggaauccacaaucaucuuacugucacggauaccucuuuccauauaguuucuaggguaggguuugaagucacuaagacacauugaguacaguaauuucucucuauuuaccaguucucuugauuuaggcuaacaaaauuauuacauccaaaagagcaaaacagugauguuauaaagauauacauauuagguuggauuggaacccuuauguuuuuacuguguauuuguuugaaaaaauagaauuccuuaaaauaaauauuuaaaauggaagaauauuaacacuaguaacuacuuuagaaaauacguuccauuaaauuuaaaauaaagaagugagguguaaagagauuaacacaccugcccaagucacaaaaugucuaaguaaacaaaauauauaaaaguuguguauucucauaacuacuuugcccugaaaccacuaaauuauaaaaacacuacaauugauuaaaaauaaaaaguuaaaaucuuuuuggggggaggggcaugggggagauuaaaugucccaagauggucuuuugaggagauagauuuuuguaugagaauaaaacccaaagguguguuuaugcuaauuuuuagagugcuugauuuaguuacggagucccaaaggcaaguagaccaaaggcaagaaagaaaacaacuucccaagagaugacggaaaaauagugccucauugacuucuaguaacuguauaaugaaugucuuuaguaacagcuggccuacugugccaucuacacaguugugugcaaagggauaccuacaaaugcccucaaauccuuauccuaauucaggccacacuaaagcacuuuuuuuaaagaguaagaauagcugaaucaacgacuaguauacuaucuaagauaagaaauaaauaagacuauaucuaaaaguuuaauauacuuuauguccucacauuacaauaucaauggcuaacauuauuaggcuguuucuuaugugccagguuuuguucugaguuuuuauaaauguuuuauaaaaguucugaguuucauuuacuucucacacaaccauauacugucucccaauaucugguaugcuuacuguaagacauacauuugaacucuuggucagugaucuguugaguagcauacuacauuuuaacaggcccaacauuuacccuuuaagauaauauuauuguagaacuuggauuagaggggacacugagugauugucaaauguggguuaagacuauaaauuuuuuggaacagagaauauaaauauuuaggcaccacaauaauuuuuaaaaucauguaaaacaaaguauauauuaucacaguaaauuaccaaauguccugcuuuguuguuuuugggggguuuuugagacagggucucacucugucaccaaggcuggagggcaaguggcaugaucauggcucacugcagccucaacuguccuggcucaagagauccucagcuuccugaauagcugggacuacagguguguaccaccaugcccagcuaauuuuaaaaaaauuuugaagagauggggucucacuauauugucuaggcuggucucaaacucccgggcucaagccauucuccugccuuagccucccaaagucuugggauuacaggcaugagccaccaugcccagccguguuauuuuuaaauauaucuuuuuaccuauaucuauaaacauucugcaacuuccuauuauuauauugcuacuauaauaucuaauguuuguauuaauuuacacguuucagcucaguguguaccucaaaauucacaacuaauuuucaggucacagaggacaauuaacuguagcuauugguccuuuccuuuagacauuuuucauugccuucuaaaaguauguaagaugacuuuuaucaggaaagacagaauagacaucugagauuaagacagauuugacagauaaaggguaaggauuauuaacucaacaacuagaucaguacccaucaccaaauuuuaagguaacaugaaauaagauuuaauucuuuuuguuuccauaccaacaaacuaaauaucacauuccugugggacuagucaaauuuuguucauagguuuaggaugaauaaugucauuuaaguauuuuuucagaacuaugaaggcaaaugugaccuccuaugugacuauuuucuauuuauccuuuuugaaguauauaguuuauauccuauuuucuuaaccuuuuaaaaaaaugaaauauaagauacauaugcauaaguacuuaaagcauuuaucucauguuuagcuuguaaauaugaagcaauaacuccccuuacucuuccacuuucccauaaccaccacucacaggucaagaaacagagcauuagcacucaggaaaugcccccucuuaugugaagcucuucuauuauacuuaauuuaggaauaaugaaagcuaaaucaguacuuuuuuacugagauccugaauaauucaagcaccucagugcaaucugaaucgauuuccuccuucugaccucuauguuauugcuguuauagacuuuuuuuagccccacaaaacauauuuuacuacuguucacuuacacaugcccauaugguuacuuaccauuuuauuuguucuugaacccuucuucaucccaauuuuccauccagauaauauacuacugcccaaaguauauccuuuauguuuagagucuacuagucuacucucccagccuugguuugucucaaaauguuuguccuucacacucagacuugaaagaugauuucucuguguauagaguuucuagguaaacaguuauuuccuuucaacauacuaaugguaccauuccacuguacucuggcuccuguuauuacuauugagaagucagcuauccgucuaacuauguuucaauuaagauuaugucuuucucccacuucugguugcuuuuggacauuccauuuaucuuuguuuuuucacauuuccuauauguccagagguagauuucuuuuuaguuguccugauccaaaaucuguguuuggcuuccugaauguggugucuuucaacaguucaaguaauuuuucagucacucucucuucaaauauugcuucuauuucuuucuauagugcuucuuccacaucuccaacuaagugucauauuagaccuucacacuauauucucuacauuuuaaaaugacucuucuguauuuuccauuguuucauaucuuuugcuacauuuuggaacuuuucuucuaauacuucuucuaugucacacauucucucuucaacuguguccaguuugcugcagaaaccacuuacuuaguuauuauauucaguauuuuucagaagucuuauuuagccuuuuuccaaaugugcuuauguaacuugauauaguuuguucccugcuggcauuuuaagccuaucuuuuauuucuauaaucaggcuaccauuuuaaagucaucaguguuugguaauucuaauaucugaaaacuuuaugaucuuuuuuugcugucuguugugcacuccuuauucuuacucuucuugcucugucuccuuauauguuugauuauauuugccuguuuguuaaucccugcccuuggcaaauuauucaugaggauuucccuaggcuaaaaaaggugccuuccuccagaggaaaucugcauuugccucugccauuccagaaccacuuaaaacuagggaucucuuggaucacucauugaugcaaacuuggauugaaaauccauguaaaaagucuccaccaugaucagaacaucucaaagauagguuuuuuguuuuuuuuuuuuaaucuucugcucugcuuagccccaaggcaaaucucccuguggucccuagugguggggaaagggaaacaguuuuacuuccaauguaccuuuacuguaauggcauaggcccugaaagagaauggucucuacuaaauacaaagauuuuauuucaucuuccugccaugggcagagccaagggcuuugaccuauguucauuuuugcuguuguuguuguuguuguuuuugagacagagucucacucugucacccaggcugaagggcaguggcacgaucuuggcucacugcaaccucagccuccuggauucaggagauucucgugccucagccucccaaguaguugggacuacaggcaugcaccaucacacccagcuaauuuuuguauuuuuaguagaggcgggguuuugccacguuggccaggcuggucuugaacucguggccucaagccauuugcccaucucggccucccaaagugcugggauuacaggcaugaggaaucucaacuggccugauuuaucuucuuaucauuccacaaucuauuaaaucuucagcuugauuuugcuggauuugguuuuaguuucucuccucccuucccccaaaagauaucaaaacuucaauuuaauuuugucuaaauuuagccucaaaaaaagcagacugcugugcuuugcuuacuuuuugagcucuggcuuucucucagcuuuuggcuuggcaauuaauauuugcuaauuucuaauuuuugaaauaaacaaaauuuaaaaauagaauuaucacauaauccagcaauuucacuucuagaauacccaaaacaauuaaaagcagggacucaaacagauauuuguucauccauguuaauagcagccuuauucacaauagccaagggacagaagcaaucaaauaucuauccacagaucaaauguugucuauauaaaaauagaauauuauucagccuuaaaaagggaauuuuaacacacaggcuauaauguagauaaauuuugauauuaugcuaaguacaauaaguuugucacaaaaggacaaacacuaugugaucccacuuauacgguaccuagaguagucaaauucauauagaagguaaagugguaguggccaggagcugaaagcaaggaagaaugggaaguauuguuuaguggauauagaguuucaguuugagaaaauaaaaaaaauucugaagauggauggugaugaugauuacacaacauuuugauuguauuuaaugccauuaaacuuacauuuaaaaauaguuaaaaugguaaauuuuuguuauguauguuuuauaauuuugaaaaauacuuaugaguuuucuuaccugcccauuuauuauaaauacauaaauaguauuuauaugcuuccgagaaguauuuauaugcuuaacaaggacaucuucagaaagugcuuugugguuuaagugucaagucugaaauaccauuaaauagacuaagcccuuacuccuaaaaaccuuugaaucugaaagauguuuucuucauauacaacuaugugaaggaaaaauaacaaagguauuggaaaauagcaagauauaagaaauaaaauuaggccucauuugauauucuacucccagugucaaaaggcucauagagauccauuucacauuacuucaauccagauaucuuugaaucaaagcuguuucauauaaugcuauaauauaaaauuguaucuccgauuaauuuuaaaaaucuauaguaauauucucaaacaugaguaacauuaaaaaacuaaaauuuguagaauuucacuacuauguacuuauuuuauagaaaguucaauuagagaauauuuuaaaaguucaauucuuaacuaguuuuauaagcauuaauuaaguacuuuucauuauaaacauauuuauaguuaagggauuaaaaaaaaaaaauucuuagaaaccacuaacacccuuuccuagggguagauuacucaggcuccaaaaacaaaggggagaggagaggaggggagggaaaaugagaaggaauaagggaaaaggaaaaauguuuuacuugucaaagcuccucaggcuccuuuaacuagucuuaacuagucuauaaucaccucagauuaacuagucuauaaucuuaaccagucuauaaucaccucagaaacaagugcauccacacauaucuuaaucuauuucaugcuacucuuaaggaacaggcauauuuuuuccuguaauaagaucccuccauaacuuugugauaagguguuuucuacauuucucaccuguagcuccuuccuuucccuuuauuuuaauaaagaugcuuaaauuuccuccaucuuaaaaacaaaauauuuucugugacuuuguaugucccuuuuauuauagccuuuaaaaucaguggccuugaaggguaaucuugacccccucucucuacuucuucuccaauucucuuacuaauucacucuuaccucuuucuccaucaugcucuugucaaagucucucuugccaaagucucaacacauuacugacaaaaccaacagauauuuucaguacucucuuuggcauacgaaacaauagaccacguuuccucaaaauuugcuacuuuuccuucaguguuauuauuauucuuaucugcaauauagucugguuucuauguuucugguuaaauagauuuauagauuuuuuaauacauauuaucacaaauuguggaaucuuuacaaaacauuuuaaugaaaucaggagucaggaguaucccccaaaaucguuuguuuuacaugguaguuugcugguuaucugguaacaaagcacuuauaaagagcuauuaaacuuaaagauaaauuaugcauuuuagauaacuaucaacuguucuaaauuugaucacuuucucuuugauaaaaaguagagaaaguauuacauuaucuagcaaauguuagaaaauaaauaccuuuccuucaaggaaaauaugauauuuugacaacaaaugggaaaauaaaugcuuuuugaaacacacauuauguaccaacuauuuuaaaaagaguucauuguugccaaaaauguaauuaauuaaaacacguaucagcacacuucaaaaaacgugaagaacaaaauuuuugucugcuuuuaaaucuaucaaaacauuuucauagguuuugaacuuguuaaaaacuuucaaaagcaaaccuuuucaauuagguuguagcaacaacuaauugacaugaggaaagacaguauucaguagcugauuccaacaaaaaccuuugaacuacuaguagacagaauuaaaaaauguaauuuaguaaacauggccaauuuuccauuucuuucauuuggaucuacauaucuuuaugagguaucuuuuucaaguguaacaguuauuaaaagccaguauucaaacaacuacacacaauuccauuuuuauuacauaauauuuuauuaaguaguuacauguuucaccaaccagacugugaguuauucacaagugaagacuucugucuucauauuugugucccuaggacuugacuauguggcauacaauaaauaauuaugcaaucaaugcuuugcaaaugaaugaccagaaauacaggcaaguauauuaaaaugaaaauucacaaacacaugaacacacacauguaacuauguguguaacuguguaguacuugauuagguaaacaaaguauuaucuaaaaugggauuagccccaaaucacaaugcuuauacaccaauuugauguguuuuauggggcagcuuaaaauacauucaccuacauuaugacuuuccuaauuaggauacguucucauaaaugaaaauaucauaguuauccuauacaauauguaagaaucuuuacguucaacauguuuuaucacugauaugaggaaugaauauaaagucgagaaaaaauaaagcaaaaccaauagaacuguucccacaauagaacaauggauacauaacucaacauaaauaaaauaguaaaaguauuaaagauuagauguucaaaauaaccaauuagaaauaaaaaucaaaugucagcuuuuuauuuuuuauuauuuauuuauuuauuuuuuuggagacagagucuugcucuguugcccaggcuggagugcaguggugugaucuuggcucacugcaaccuccaucucccagguucaagugauucuugugccucaggcucuugaguagcugguacuacaggagcacaccaccacgcccggcuaauuuuuuguauuuuuaguagagacgggguuucuccauguuggccaggcugaucucgaacuccugagcucaugaaaucugcccaccucagcuuuuuauuuuaagacuuuguuuacauccacuaauuucacaaagaauuugauggcuacuuagcauaauuuucaccaugcuauaaauuuucauuuuaugcuauauuagaaaguuauuaaaauaauaaauuauauaauuuuuaacacaaauauuucccaaaauuacacuuaguucucuaugguaauuaaagcaaagaagccaacauuccaauuuuaucugaaaaaaauuagacaaugcacacauaaaaugauauucuauugguaugucuucuaauuuuaucuucaaaaggaaaaguucuaagagaaaaggaaacaaagcacaacaaaugcuguucccaaaaaaggacuaagauucauaguguauauauuuuugcuaauauagauaaauuguuaauguuuauaggaguuauuaauuauaguaaaaaaaauuuaccuuauauaaagcuaaaauacaaaaugauuaaaacuuaagcugaaucuaaugggugauagcuaccaauguucugugccuaaacuauaucuagggucuuuuuuccucaaaaugcacugcaacgacagcauggagcucaagaauacaaaagguacaaaguggaagguauauuaaauaaggcaguacuucuacagcaaauguuaucaccacuauucuuuuuuuaagaaacauuaugaaacuucccagaaaucucucucccucauuccuagauuuaucauuaccuuaauuguguaaauuuaauauuaucaaaaaaugcauccaugguauauugauuguacucuaguagccccuaauguacaaaaaaaguagcuauaauacuuaaaauaucaaaacaaaaucaaaauaagauaaaauaggcaaaguugaauuuaaaagcuaagcuauuccauugauaccuaccuccuguaaaugccauuagccagacauuuauggcuacaggauuuggaagagaggggugaugaaguuggggacaaguugagaggggcaaucaaacuguugaugaucucagucaacugugcacucugcaaggaaacagucaaccuuuuacuacugcuaagcaagaaaugugaguuaaagcucagaugcauagugccaauuaauccuuaacuucucaugacacacauguuuuuauuuuaguaaauguuuuauuugacaaagacaauuuauacaacugauuuuuccauuuauuacaaauaaaucuauacuuuaaguacccauucuuuuccauauccuuuuuuuauuauuguuccuucaucuacccaucccaucaucuaacacauuugaacccagcuaacagccuuuauauaauauuacccuugaggcaggaaaauuaauaauuaaaaaucacagauacaauuuauuaagugccuacuaugugccaggcauuauauuaggcaccacacauagaauauuucaaucuuuacaacuaaccagcaaagaagauaauauuagagguacugacaucacuauuauuaauaacagaacagaugaguaaauucuagcaaagaaaaaaagauuaaguagcuugaucaagggcuauaaagcugguaugaaauagaacuaggauucaaauucaggccuaaaucuaacaacacacuguuucucaauauuuuuccuaauucacaaauaucagaguuuuuuuuuuagcaccuaagauuucacugacauuugucccagacuuaaauauauguaauaaauauuaaauuauauaauauguauaaauauuauucucaaaacaaucacaauuauaauaagcaaaggccacauaaaaaggaauaguacauuucuacaaaagaaugacaacuauuuucauuacaccuguaauccacguucaucauagaagaacuggaaaauauagagacauuuuaaaaaugaaaagagagucaucuguaaucauacuucaaagagaaaaccagagcuaacauuuagguauauauuucuccuuccacacugaguuuucugaguauauguaagcaugaguguacauucaacaugaacacauauacuuuuaauuaaauuaugcuacaucaauuuucuaaaaccugguuuucccacuuaauauagugugaccaacuuuuuaaaaaauacagacguaguucaacauuuucaauacugcaagauacucuauugugaaauaaagggguauaugaaauaauuauuuuagaaugcuucauuuguaugaaacuaauaacaugcuauuagaagugagacuaaauaauagaauaaaauuaggccuaauauuuuaucccuucaaaaaaucuuucaugagaaagaccuugaaauguuuucaccauuuauuuugaagauaguaugcaccuaaugaugucauuuuaaaaauuauuacucaguuuuuagauuaaagcucauuuuuaaaaucaccaauagaaauggauucuuuauccauuuagcaaguaaucauuagucaugcaaauaaauucugaaguaucucacaucuuccgguuggaaacacuaaaacauuccugucauuguuccaccuccaaaaaacaucaucuaaaaucuuuuaagccacuggacgucgcuaauuggauauaugugaauaaugggccaggaagggggaaauuacaaucccuaucuuuacccuaagaaucagccuauucuggccccauaaaaucucacauacccgagucauauggggaauagaaaagucacagagaaaaugugaauaagaaaaguaaaauuaagagaagcguaauuugaacucugaaaacaaaaacuaaucaacuguaaguuaaaacacuagcuauucauaacaagauuuauaauguaaauacaccaguagcaaauucauuuuaaaucaccuaaaguagaaguccccaacccccgggcugcugauggguaccuguccauggccuguuagaaaccaggcugcacagcaggaggugggcagagggccagcaagaauuaccaccugagcuccgccuccugucagaccacccacagcauuagauucucauagcagcgcgaaccauacugugaagugcaccugcaagggaucuagguugcugcuccuuauaagacucuaaugccugaugaucugagguggaacaguuucaucucaaaaccauccccccauccccacccugcggaaaaauugucuucuacaaaaccaguaccucaugccaaacacguugggaacagcugaccuaaaguacuaaaaacaagguauuaauacuuuucaauuuaugaacuacauauuaucuaacaaugcaagcauuuauuaauacuaugaaucaauguuauuuuuuaaaugauagucuacaacucaauagugccuuuauauuuuaacuuccaacucuaacaaaacuacuuuagucaagccaaaagauuaugagugaacaguuauauaucaguagauuauccuaagaaaaccaugcauaauaaugggcuugccauaccuaccacuuaacucacuccuagacuaucuuccucaacaaguuuuuuuguuuguuucagacagugucucguucugucauccaggcuagagugcaguggugccaucuggcucacugcaaucucugccaccugggcucaagugauccuuccaccucagccuccugaguagcuaggacuacaggugugugccaccaaggccagcuacuuuuuguauuuuuuguagagacagggucucccuguguugcccaggcuggucucaaacuccugggcucaagcaaucugcccaccuuggucucccaaagugcugggauuacaggcaugagcuaccaugcccggccaccaaguauuuaaaaacaacuuaagcuuuuaaaacuuggccuauaaaaagcauuauuaccacauuucaagaacaaaugacuuguucauaggcaauuuauuaacaaccucuacaaguaauugcugcugcccuuucugcaucuuuuacuucugcucucuuuacauagagccauuacugcucucacaacucuugguucccuauacuaucaaaggcccugacaguuucaucagcaaugagaccuaaaaugauacccaggaccagcuucaugggcauguaaccugugcaccaggcugagcgcagauggaggcuaugcuugcuuagugcucugcugucacugucuuuaaauucauaacuguuuuuaacaaagggcuccacaacuucauuuuacacuaggaucugcaaauuaggcaguucugaugucaucucagguccaaccuaaaaaaacuggggauaucaaggagaaaggaaaaaguacaagaaaucucuuuuagaaaugaaaauaucuuagaauuaauuuaaacagauuacaauuuccaaugaauaaguagugaccuaaagaugguaaaaguagauuugacuguguaagcaaaugaauuacucuagaaugugaaacaacuaggaucaaaccgaacaaggguugauccuauaggaugaggggagggaaaagaaagaggaaagugggaauauagaaauauaacaaaaacuaauuuaaaucaaugcuuauauggucaagugcauuauaauuugacaucagauaauuaccaaacagcuuucuaaauugcaaaauauucauaagugcuuugauuaugcauuccaauuaagaaaaacucugggcaauuauaaauuuaacaaauacaggguggaagaaauuauaccauauuuugguuuaucaggaauaagacaguaaccuguauuuaguuacuuccuuguaugucagaaaaacucaggaaaauuagaugcaagcaggcaugaaucuguauaauuucccagaggaacaauguaaugaugcaacuauggugaagaauggcucagcuuuaaaguaaaaaaguccuagauucagcuuucuacauauggcuagccaguuuucccagcaccacuuauuaaauaggggaucuuuuccccauuucuuguuuuugucagguuuggcaaagaucagaugguuguagaugugugguauuauuucugagagcucuguucuguuccacuggucuauaucucuguuuugguaccaguaccaugcuguuuagccuuguaguauaguuuaaagucagguagcguacugccuccagcuuuguucuuuuggcuuaggacugucuuggcaaugcgggcucuuuugugguaacuggaucccuuccuuacaccuuauacaaaaauuaauucaagauggauuaaagacuuaaauauuagaccuaaaaccauaaaaacccuagaagaaaaccuaggcaauaccauucaggacauaggcaugggcaaggacuucaugucuaaaacaccacaagcaauggcaacaaaagccaaaauugacaaaugggaucuaauuaaacuaaagagcuucugcacagcaaaagaaacuaccaucagagugaacaggcaaccuacagaaugggagaaaauuuuugcaaucuaccuaucugacaaagggcuaauauccaaaaucuacaaagaacucaaacaaauuuacgagaaaaaaacaaacaaccccaucaacaagugggcgaaggauaugaauagacacuucucaagagaagacauuuaugcaaccaacagacacgugaaaaaaugcucaucaucacuggccaucagagaaaugcauaucaaaaccacaaugagauaccaucucacaccaguuagaauggugaucauuaacaagucaggaaacaacaggugcuagagaggauguggagaaauaggaacacuuuuacacugcuggugggacuauaaacuaguucaaccauuguggaagacaguguggcgauuccucgaggaucuagaacuagaaauaccauuugacccagccaucccauuacuggguauauacccaaaggauuauaaaucaugcugcuauaaagacacauguacacguaugcuuauugaggcacuauucacaauagcaaagacuuggaaccaacccaaauguccaucaaugauagacuggauuaagaaaaugugacauauauacaccauggaauacuauguagccauaaaaaaggaugaguucauguccuuuguagggacauggaugaagcugguaaccaucauucugagcaaacuaucacaaggacgaaaaaccaaacaccgcauauucucacucauaggugggaaaugaacaaugagaagaacacuuggacacaggaagggggacaucacacaccggggccugucauggggugggggaaggggggagggauagcauuaggagauagaccuaauguaaaugacgaguuaaugggugcagcacaccaacauggcacauguauacauauguaacaaaccugcacguugugcacauguacccuagaacuuaaaguauaauaauaauaaaaaaaaguccuagaaacugaguuuguuuaagagccacuaaagucuaaaucaaaauaaauuguuggauuuccaaggacagauacaggauagacuggccagaauaauuaagcuuguggaguuauccacaauagaauuuagauaccaaggaaggcuuuggaaucaaaguaauuguuaggagcuuucuugacuuuccauuuacauaaucauuuuuuaugaacaaauccauauuccaauauuaucuuucacuaaaaaucuuguucaauaaauuagucaaacaaccauucagacauauuaacugguacaauuguucucucuccuugaaaaaaauccaaugauaaacaauuuuguuagaaaaaggauuuucuaaucccuguaaaaauaaauuaucauccuauagccauaccaauuccauuacuuuacauauuauauuuaaauaauuuaaauuauauugguauuauaauggagacuggucauaugucaaauauuuuaauuguauuuaaugccagauggccuaguuuaauaacacauaugccaggaagauacacauauaaugauguuuauuugaauaguuuacaaaaucaaugaaaagucauuucauaccacugauauccuuacuuugacuuuaccuguuuuucgauguuucgaagaaguaaaguagggcugcuuggugacauuucaaaaucuuguuccgguacaggaucuugacacuccuggggaaccugaggauucccuagaauguuuagugaagcugcuuggucugcaaauugcauuuguuuuuucaaaauaucuuuuggaagcugacauucuucuaggaccacuauccccuagacaaaaaacaaugagaaaguugaaaugaaaacaaacuuauuauuaagccaccuuuaaugcuacaaugcacuugaaucuaugcuuccacuuaucucuuggaauucagaaaauauaaacuugauaguuuaacucuguaaagaacuggcugguuuaaaacacauguagcuaaaauaacauguaugguugauagguuggacuuguaaaauauuuucuuaacuuaaauacaugcaguuuuuuucuaauugguuuuaauuauuggcauuaaaagcaugacauauuaaaauaaaaaaaggcauauuauacacagaacauggacauuucagauugaaaucuagaauauuuccugauagaaucuccugauauuuucaucacuagcauugcuauuugugcuuuacauuugagcacucccaauuuuauaaauuaaaacaccaaauuuacaaacauccaaacaacaaucuaacucuauccuaacuccuuucagagcacccuaaggagcccugccccuguugcugucagccagcaaccagggauaggacugcaccacugagaaaaaguacucucuaggccaaucaaaguucccacugcuuucaggguagcuguguuaauaauaaagacacaagcuuucaacuuugaugggguauauucugaaauguaaggaacugggggaaugaauagggaucaaguugucucuguacucucugccuccuacucacaaacauacuuauuccucaacugguuugcucggcuuucuccuccauuccccagcuuccucacuccaacuguucucaacuuuagguuccucagaggcaauggagacaacagagaaagagaaaaaaggagugcaaaggcaugaucuuaaugguuucauaaucaguucccacuguaaaauuucuuuccuuccuaucuauucuaccacccuuccuccugaaaauaauacaguaauauauaccauauauauauuacacauacacagauauuauguuauauauauacugauauuacauauauuauauauuauauacacacacagguuuuacauauauaaauauauauauauauuugaaaaaaaauauauauauauauauuugaaacaugcuaauaaauuccuauaggcuaguuggaaaauuauuacacuccuaauguggcuaaaauacuauauuauuguaauaaaaaauaaacuaacauuaauauuagugugcauuauuucaaaaauggaaugaauuaaaugauugcugugggccaccuacaucaugcauaagucuuauuuauaagauggaaauugccuauagauaauaauguguuauauaugaguuuuaguuuacacuauguaauuuagagaauauauaacuuuagaaugcacauauucaguuaugguauuaaauguauauuuuauuauuuuguaguaaaauuuuugguaaaaguaguaaaugcgcuuuuuaaaaaaaucuacauuuugaauagugcuaacaugcugacuuuuccaaggagaaggggagccacuugaucccaauuacuguuuucuuagaaugaacaaauauggccgucaagaaaucugaagaaacaugcucaaaaguucuuauuucauuugguauuuaaaaaaauaaauuagauauaauagauaugguaucauuagucugaaaagcucuugagaguauccauucaaaauuucuacaagucuacacacaaaagguacaauuuaaaauguggaagccccuacugcaggauaacaaaagaaaucuaagagagaaaccauuugauauagccaguguucucccaagaaaaauauuucaauuuuuuucugaaggugagaagaaucuguugucuuauuagaaaguuugaagcagggagaagaggaaauuucaaaccuacucucacuagguuucuccacaaguaccugcaugucaaagaaacacaaguuccaccuuaucaauuuaacugcaauugucuuugguuugauuccaguuuauaguaugggccagucuguauagauuagucugauaucagucuguauagauuagucugauuucagaauccauauuuauaaaucugcaucuaugggaaaacucuacucugaauuucaaaguucuauuuccaaaccuuuagaauacuaccuuucuauaaguacaaagccugcuauaguuaguuuaauaaagaauuauauuuuuaaaauucaaccagggaggcagggcauggugguuuacgccuguaauccuagcacuuugggagggugaggcagguggaucacuugaggccaggaguucaacaccagccuggccaacauagcaaaacccugucucuacuaacaguacaaaaauuggcugggcaucauggcacaugccuuuggucccagauacuugggaggcugaggcaaaagaauugcuugaacccaggaggaggagguugcagugagccgagaucgcaccacugcacuccagccugggugacagagacucugucaaaaaaaaaaaaaaaaauuaaaauucaaccagggagaccgucauagucaacuucauaaucuguuuuuuccuccauaaacuacuacccuggacaaaacuguuggagugugaggagaguggcccauucugauccaccacugccaagaauggagaggaaaggguugaauauuuauauuuaauccucuggggacacagcagagaguuucuguucuuaaaaaaauuaguaaaaggauauucugauauguaaaacaacauagauaagaaagacaaaaaauauuuuuagaaaaacgaguuacaacaacugaaacaagucaaaacucuagcauaagaugaaagcaaaucaacuguuucugagaagagaaauccugacaaugcagggucuucacagagaaaacacugugugaaaaaagaacugccucagcaacaucucuauuauucacauaaauucacuaaaguuaauuuuaaguaaaacuuuaaauaaaaaauuuaaaacacacaaaagguacaauuuaaaauguggaagccccuacugcaggauaacaaaagaaaucuaagagagaaaccauuugauauagccaguguucucccaagaaaaauauuucaauuuuuuucugagggugagaagaaucuguugucuuauuagaaaguuugaagcagggagaagaggaaauauaggaaucuguaauauguugacaaagcugucgcaagaaccaccaaaggauguugcuaauaacugcuuucuucuccucaaaaaaaaaauauauauauauauauuuuuuuuuuuugagacagagucuuguucuauugcccaggcuggagugcaguggcgcaaucuugacucacugcaagcucugccucccggguucacgccauucuccugccucagccuuccgaguagcugggacuacaggugcccgccaccacgcccggcuaauuuuuuaaaaaauauuuuuaguagagaugggguuucaccguguuagccaggauggucucaaucuccugaccuuguaauucgccugccucggccucccaaagugcugggauuacaggcuugagccaccaugccuggccuucuccucugaaaauuuaagcaaaguuuagaccauaagaagaaugguaaaggggcaaaugauguguuuucugacuuaaggcacaaacuagcacuuauugaaacaggauauuuacaaaacagcaucucucaaucucuuuccuuucccuuuaucucuaacuuaagugagaacaauuuuuuuuacauuuaaaauacauuaaacagaaaguucuauuucaagacaguacuggccauccuucucaauuuuuuucuuacaauaacucaagaagcuauaagagcaaggaaagugauguuuuucuuauauaauaacauuucaacuaaguugcauauaaacaacuaaacacuuugauuaauuccuaauaaauguaaugagaaacuacuaaaauaacaaaaacauuguauucuaauaaccuaauuuuguggcauguuccauaaaauaaacauaaugauauucuuaaaggaacaaagggccagauacacauuuauccugaauuaagaaaaagguaaggucauauaaguuauuacagggaaguuuauacgucuuuccuuaaaacaauuuauuccaguagauguugcaaucaagcuuuuaaaagaguuuaaacaagaaguauacaguacugcuuagaaaauauagaauauuaaaauauccuuucuuaaguuaaaggauuaugaaucagacugucuagauugaaauauaaaucuuauucaucaauguaacugcaaacccacuuucuuugaaauaucuaaauuguuuuauacuugacucauucuuagaacucuauuugcuauaaaaaacgugugaaauuauauccuuuauggaaaaugaucaaagaggagagauuaugcggugaucuugaaacgacuggguaauuguaaacugaaggcuccuguaaagauaacagugaacaaugagaaaaaguaacuaauaaacuuucaucaggaaacacuuagugaaugugguucccucaaaucucacagaacuaguaagccuaagguuuuaugucuauccuucuuccuaccuuccuauagacaccaccacuaauugcuaccaaguauuaaacauacuucaucacuuccuagcuuuuguuccuuuucuuguauaacacauacuuucugcuccuuuaaauaccauacuacuuugucauuccugaaaaugaucauguuguuucacaccuucaaaccuguaaaaaacgccuuuuucuaguuccauugguucaucaaaaaauuacuguucaucccccaaagucauacugagaugucacuuucuucucuuaauguuuucucugacccucugacccauaaguauucucucuauggcccuucaaauaucuuagaaaaacagguauucuacuuaaaguauaauuuuuuaaaaaaacagguauuaccgaauauauuacauauauugaaacgauuauagguuuuaucucccuuaccagaauauaaacucaugauagauagagccuaaaauuuauuaaucuuuguggaugugcagaccccuaggagaggcuaggcaaacuacaugguucaaggacucugaucccuucccuucucagcuuuuuccuuuucagaccuaucccuaucaaccuucaauauuagauuaucuccaggaugucuacaguaugaccauauagaauacuguuucccacaaaaacaagguuacaaauaaauauuuagcaauauuuagauugcauaagaacucauuuguaucgcugauucuuugggaaaaauagaucacaaugaacauucccacuuggaaauguaaagaauaaagaauauaugucagcuauuggucuauauuaaugcuaacauucugcuggaccaauauugugagagcuucuuacccuagguguauggcuuaauuaggcccuaauuugugcuuccuauuaaaggguucuuucuauucacuguucucuauggcuccugaaucagccugcuucuuucuuuuauauuaccuuccuugguaauauaaauuuaaaauuuauauugguaauauaaauauaaauauaaagcuucuuucuuuuauauuaccuuccuuggcaauaucaguaaauguuuuugacuucuuuaggaacugcaaagcucuuaaccugcuucuuguucauagaagguuggcguccuaaggacugguuuaagucuuggccaguaaaaggcuuuuuauaggccaagcuuguaauuucuuugguagaacucacucagaaacucagaaggcuucccaucucucuguuuucaggcaguuccauguacugacaaucacacccacaguucucugaugcauucucaaaggauauuucuuucacccucuaaccccuauaccuaccuacauacuccuuucucccguuccucuuucucugcuuccuuguggggauucucauaagcuauuaaguucugauggaaaauccacauucuuaaucuuccuccacugcacuaaguguaauuuuauccagcucaaagguuuugcagaggaugguauccuuagucugauauuuagcuccaaaucacuuugguccuuuauuauucaaagguuuucucaauccuaucucuuaucauauaaaguguagagagaggcaguuuugcuaacuucguaaggccuugaauuucuagaaaccuauuccuuuucauuuauguuuuuaaacagguuugaaaaugaccuaauuagaaauuaucaauaaaaagcauuaucacaaaguaaaagccaauguaaaagccaauauacaggacaaagucuaagcagaauauggucaaagacagaauuagcaaauuaaaagacaguaaagaauuccuugugguacagagagacaaaugagauuaaaaaauuaaagagugguuaagagacaugaaaaauuuguuugaaccucucaaucuaugagaauuucacaaaaauggaagagaaaaaaauugacaaacauacaauauuuggaugauaguagcagagaauaugcuagacuugaagaaagauguaacaccuuggacuaaacauggacucugggcugggugcaguggcuuauaccuguaaucucagcacuuuaagaggcugaggcuaagaagcugaggcagguggauagcuugagcccaggagcuugagaccagccugggcaacauggcgaaaccccaaacccaccaaaaauacaaaaauuagccaggugcgcuggugcauucuuguagucccaucuacccaggaagcugaggcgggaggaucgcuugagccugggaggucaaggcugcagugagccguaaucaugccacugcacuccagccuggccaacagagcaaggcccugucucaaaaauauaaaagaaauuaaaacaaaugaauguggacucugaaaaaaaaaaacaugucuacacuaaaacuuauagaugaauauauauagcagcauuauucauaauagccaaaaacuaaaacaaccuaaauuuccaugaccuaggaaacagauaaacaaauuauaguacaauccuacaauggaauacugcucaacaauaaaaaagaaaaaauuacuuauauauacagcaacaaagaugaaccuaaaagcauuaugcuaagugaaagagcaaaauagagauuaauguuuuauuauuugacuuauaugaaauucuagaaaaggcaaaacuauagcaauagaaaacagauuagugguugccagagaaaagagccugaaggaaagagauugaccgcaaagaggaaggaaugacauuuuugaagguuauagaaauguccuacauuaugaucauagugaugguuacaagaguagauauuugucaaaauucagugaacuguauaguuaaaaauguguacucugaguacuaagcaacauaaagacaauccuuugauaccuguuaguaagaaugcagaacaucaaauaaacaagaacaucuuuuuuuuucuuuuuuuuaacuuuuuuuaaaaaauuuuauuauuauuauacuuuaaguuuuaggguacaugugcacaacgugcagguuuguuacauauguauacaugcgccauguuggugugcugcacccauuaacucaucauuuagcauuagguauaccuccuaaagcucucgcugcccccuccccccaccccacaacagucccuggugugugauguuccccuuccuguguucauguguucucauuguucaauucccaccuaugagugagaacaugcgguguuugguuuuuuguccuugugauaguuugcugagaaugaugguuuccagcuucauccaugucccuacaaaggacaugaacucaucauuuuuuauggcugcauaguauuccaugguguauaugugucacauuuucuuaauccagacuaucguuguuggacauuuagguugguuccaagucuuugcuauugugaauagugccgcuauaaacauacauguacaugugucuucauagcagcaaccuaacaaaaacagcaauggggaaaggauucccucuuuaauaaauggugcugggaaaacuggcuagccauauguagaaaacugaaacuggaucccuuccuuacaccuuauacaacaagaacaucuuaaagguaccagauagaaaagacaguacccagaaaagaaaaauaaucacauugacaguagacuucuccucaguaucaaacaaaacaauaaaacacaucuuuaaagugcuaaagaaaaauaacugucaaacuagaauuuaacaccaaaguaaaauaccauuuaagagugaggguaaaaugaagauauucugagauguacaaagacacaaaguuuaaguguccagagacccaaaugucaaaaacuccuuucagugcaugucucuuauuucuuucuacuuuauuuuuuaauugacaaauaauaauuguauauauuuaugguauauauaaugauauuucaauacauaugauguauagugaucagaucaggguaauuagcauauccaucaccacaaauauuuaucguuucuauguguuggaacaggaaccaccaggaaucugucaccccaccuagacaccaccugcauuggcagaaucugucuaaugucauuacuucaaaaaucuggaguuuacugaagacuugcaaguucaaagggcaggcuuggacaguaaaugugcaguuaauuuucaucaauuuuagcucuuagcacaauagcagcuacccauccccacaccuagucccauggcaggcagccauucauacauuucugaagcaaucuauauacagccugcauaagucaggguaggggaaaaggacccuguucugcaaauauuagggaucuguguucugaucacugauugcaaccuuugaucacagagguacagacaaagaggcaaccauuguuguaguaccucccuccuuuuauugcaauucccuccuccucuggcagaaggccuuccuggggauuuaaagggccagcacccuuuaaaaaaaaauccucucuucauuuuucucuuuuccccuuuugggagccagacauuaaaagcaggacauuuuaaaacaacugcaccaauggggaaaauuagaaagcaacugggcauuuccaagaaaacgugcaggcucagaaaaaauaagauuuuaacuauacacuucaggcuuauucuugccacaccgacaaccuacaacaauagagaaaaacaaaauaauaaacaaaaaugauuuuaaaaguccugcagaaagggaaagaaucugauuuccauuauuagagucaaauguccaguuuccaaaaacaacaaaaaaaacaaaaagcauacaaugaaacaggaaaaauggagcauucaaaggaaaaaaaagaauaaacagaaacugucccugaaaacaggauggaagaucuauuagacaaagacuuuaaaacaacugucuuaaagaugcacaaaaggcuaaaaaaaugaugugaaaaagucaagaaaaagauguuaugaacaaaaugcaaacaucaauauggagauagaaaaccugaaaagaaaccaaacagaaauucuagagcugaaaaguauaauaacugaaaugaaaaauucacuagagguauucaaaggcaaaugugaacaggcaggaaaaacaucaaugaacuugaagccaggacaguaaaaauaaucaagugcaaagcauaaaaagaaaacagauuaaagaaaagugaacaaagucuaagggacacguggaacacuauuaaguggcccaacauauaaaugugggaguuccagaaaaagaagagaaagacaggcagagagaauauuugaagaaauaauggcuaaaaacuucccagauaugaugaaagacaugauuacaaauaucaaaagcugaaugagcuccaaauaagaugaauccaaagaguacuacaaagaaacauauuauaaucaaacuacugaaugacaaaaagaaagaaucuugaaagcggcaagagagaagcacaugcaagggauccuccguaauacuaucaguagccucuuaugauaaacuuuggagguccaaaggcaguuaggucaacauauucaaagcaaaaaacaaacaaaagaaaacaagacaaaauaacaacaacaacaacaacaaacccuggccaacccaaaauccuauucuauucgggaaaauuguccuucaaagguaaaaaaaauuaagacacucucaaguaaacaaaagcugagagagucauuuaccaguagaccuacucugcagaaaauacuuaaagaagucaugcaaggugaaaugaaagacguagauaguaacuuaaagcuguaugaugaaagaaaaaucucaaugaaguuaaauacaugcauaauuauaacagcuaguauuauuguaacacuaguuuguaacuccuugcuuucuacaugauuuaaauaacuaguacauuaaaaaaauauaauagauccaaagcuagacuugugguaacuuugguuugcagcuccacauuuuguuuucuacauaauuuaagaaacuaauauauuuaaaaugauuauuaauguaugcuuugggacacauuaguauaaggauauaauuuugugacaucaacaaccaaaaggggugggaacaaagcuguaaaggaaaugaguuuuuauauguuacuaaaguuaaacuggaauaaauucaaauuauaauguaauaacuuuaugagguuaaauguaauccccauaggcaaccacaaagaaaauaucuacagaauauauauaaaaggaaaugagaaagaaauuuaaacauuucagugucaaaaaauaaucaacuaaacauaacagaagacaguagugcaggaaaugaaaaacaaaaaagguauaagauauauagaaaauagcaaaaugacagaaguaagucuauccuuuuuaguaauuacguuaaguguaaauggauuaaacuccccaaaacacagaaauuagaauggauaaaaacacagaauccaacucuauacugucuacaagagauucaacuuaaguccaacgacacaaguaaguugaaaguggaaggauuuuuaaaaauuauauacaauaucagacaaaacagauuuuaaauuaaaaaagguuacgagagauaaggacauuauauauuaauaagacucuauaacaagauauaacaauuauaaacauuuaugaaaccaugccacaaagaguuaagaaaaccagucuaaauuccuauguuuauaggauaacagauaagaaaauaaacaacuuguugagauacugaaacucaaacuauaacccaaggaguaagaagucaguaacuagcaaaaauucuugaguuuguaggauagcagauaauuaaagacauaacccacugagacgccaaaacucucuaaccuugugagaacaagaguaaacuggcaaaaaucaguuaaaaccaaaauggcugacagaaguuugcacagaugaccuuacugacaucacagccuaaauuuacacugcauguuucauauuaacucccccugaauuugcacaugcaauccaugaguuagcaugaagcaauaacugcacaugcccaagaacuuuccaaaacuuuccuuuccuucuaccaaucaccuguuaaucccaauaucuacccccaaaucuauucuaauaaaaauguuaccauaaaaauagcaugagagaggggaggcagaacaagacggcugaauagaagccuccagcaauuguacccccacuaccucccaacauaggaacaccagauugaacacuauccacauaaaacagcaucuuuauaagagcuaaaagucagauugguuaccagcuuggccacagugggguaaagcaccaagcauuucuggaccuacccugguccagaggggagcccacuguccugaagggagagacucaggacuggcagcauucaccaaaagcugacugaagaagccuugggccuuuaguaaacauuggccguagacaggcaguacuugcuguggcccuggggcagugguggccaugggaagggacugcucugcuugaggaaagaggaaggaaggguagggaggacuuugucuugugacuuggucagcugcaguagaacacagcaccagguggagucccaagauggcaucucuagacccacccggggcuggggagaaaacuugccacccuuaagggaaggacacaagccuggguggauuugccaccugcugaugauagaacuuuugggccuugaggagacacagacgauagccagguaguggucacugcuggccuuaggugagaccagugcugugcugucuucggaucugacccugugcagucccagugguccuugugucacgccucuccuagcuccaagcagcucaguacagagggugagacuguguuucccugggggaaaguaagggaagagaacaggagucucugacugguaauccagagaaugcuuuuggaucuuacccgagacuacugaggucauaccucuaugaguccacaaaagaugcaguguuacuaaaguuggggauaugacugcagugaccaaugaauuagaucacaacacccaaggguguuucaauaucuagaaagcauucucaagaaggacugguacaaauuagugcagaugcaaagacuaauaaauaacuaacuuuucaauguccagacacagacgaacaucuaugaguauaaagaacacccaggaacacauggccucaccaaauggacuaaauagggcaccaaagaccaaugccagagagacagggaugugaccuuucagacgcagaacugaaaauagcuguuuugagaaagcucaaugaaaucuaagguaacacaagaaggaauucagaauccuaucagauaaauuuaaugaagaaauugaaacaguuaaaaagaaacaagcagaaauucuggagcugaaaaaugcaacugacauuaugaagaaugcacaagauagagucucuuaacagcaggauuaaucaaaaagaagaaaauuacugagcuugaagacaggcuaugugaaaauauaccucagaagagacaaaagaaaaaagaauaaaaaguaauaaagcacaccuaccagaucaaaaaaauagccucaaaagggcaaaccuaagauacuggccuuuaaggggaggaagagaaagagaucagcguagaaaguauauucaaauggauaauaacagagaacuucccaaaucuacaguaagaugccaauauucaaguacaagaagguuauagggcaccaagaaaauuuaauccaaagaaaaguaccucaagacauuuaauaaucaaacacccaaagggagggaauaaagaaaggauucaaaaagcagcaagagaaaagaaacaacauacaaaggagcuccaauaugucugguagcagacuucucaggggaaaccuuacaggugaggagugaguggcaugacauauuuaaagugcugaaagaaaaaaacuuuuauccuagaauaguauauccagcaaauauauccuucaagaugaacuuuucacuagacuaagaaaaaaaacagggaagauucaaauaaaauugcaaauaaaaaaggagacauuacaauggauacaacagaaauacaaaggauuauaagagacuauuaugaaaaaguauaaaccaacaagcugaacaaucuaaaaucaauaaacaaaucucuugauucauacagccuagcaagacuguauuauaaaaaaauagaaaauuuuggccaggcacgacggcucaugcccguaaucucagcacuuugggaggccgagacagguggaucaccugagguugggaguuugagacuagccugaccaacauggagaaaccccgucucuacuaaaaauacaaaaaaauuagccgggugugauggcgcaugccuguaaucccagcuacucaggaggcugaggcaggagaaucacuugaacccaggaggcagagguugcagugaggugagaucacgccauuguacuccagccugggcaacaaaagcgaaacuccaucucaaaaaaaaaaaaaaggaggggggcgggugcgguggcuuaugccuguaaucccagcacuuugggaggccgaggcggguggaucacuugaggucaggaguucaagaccagccugaccaacauggagaaaccuugucucuacuaaaaauauaaaauuagccaggcauggugguacaugccaguaaucccagcuacucgggaggcugaggcaggauaguugcuugaaucgggagguggaggucgcacugugagcucagaucgcaccauugcacuccagccugggcaacaagaaacuccauacuccaacucaaaaaaaaaaaaaaaaaacagaagaaaaaauagaaaauuuuaacaaaccaaaaaugaguaaggagauuaaaucacuaauaagucuuccauuauaccaagcaugguggcucguaccuguaaucccagcacuuuggaaggccagggcaggcagacugcuugagcucaggaguuugaguccagcuuggguacauggcaaaacccccaucucuacagaaaauacaaaauuuagccacaugugguggugugugccuguggucccaguuacuaaggcugagguggaaggacugcuugagcccaggagguugaggcugcagugagucgaaauugugccacuccacuccagguugggcaacagaguaagacccugucucaagagaaaaaaaaaaaaaaaguccucuauuaaagaaaagcccagagcugggugugguggcucaugccuguaaucccaacacuuagggaggacgaggcaggcagaucacgaggucaagagauugagacuauccuggcgaacauggugaaacccuaacaugaugaaacucugucucuacuaaaaauacaaaaauuagcugggcaugguggcgcgcaccuguaguugcagcuacucaggaggcugaggcaggagaaucucuugaaccugggaggcggagguugcagugagccaagaucgcaccacugcacuccagccuggugacagagcgaggcuccgucucgaaaaaaaagaaaaaaaagaaaaaaaaagaaaagcccaggacccaauggcuucacugcugaauuuuaccaaacacuuaaagaagaaguaguaucaauccuacucuaacuagucugaaaaauagaggggaaggaaauacuuucaaagucauucuacaaggacaguauuacugugauauuaaaacuagccaaaaccacauuuuuaaaaaagagaaaacuauaggcaaauaucccugauuauauugaugcagaaguccuuaacaaaaaauuagcaaaccaaauaacaacauauuaaaaauaucauuugucauaaucaaguaggaugcauuccaggggcgcaaagaugguucaacacacgcaaauuaaucaaucugauagaucauaucaacagaaagaaggacaaaauccauauggucauuucaauugaugcugaaacaguguuuaagaaaauucaacauccuucaugauaaaaaccuucaauaaauuggguauaaaggaacuuaccucaacacaauaaaagccauauaugauagacccacagcuaguaucuuaaugaaugggagagaaaacugaaaucuagaacguaacaaggaugcccacuuuuaccacugucauucaauauaauacuggaaaguuguagguagagcaauuagacaagagaaagaaauagaaggcaacccugaauaaccaaggcaauccuaagcaaaaagaacaaagcagaaggcaucaggcuacccaacuucaaacuauacuacagggcuauuggaaccaaaacagcaugguacucgaacaagaacagacacaaagaccaacagaacagaaaagggaacccagaaaugagaccacacaccuacaacugucugaucuucaacaaaccugaaagaaauaagcaauggggaaagaauucccuauucaguaaguggugcuggccaggcacgguggcucacaccuguaauccuagcaccaugggaggcucaggcagguggacugccucagcucaggaguucgagaccagccugggcaacacagugaaaccccaucucuacuaaaauacaaaaaaaauuagccaggcaugguggcaugugccuguagucccagcgacucaggaggcugaggcaggagaauugcuagaagccaggaggcggagguugcagugagcggagaucacgccacuguacuccagcuugggugacagggugagacuccgucuccaaagaaaaaaauaaaaauaaaaaaguggugcugggauaacuggcuagccauaugcaaagauugaaacuggacccccuccuuacaccacauacaaaaauuaauucaagauggauuaaagccuuaaauguaaaacccaaaauuauaaaaaugcuggaagacaaccuaagcaauaccauccaggacauaggcacaggcaacgauuucaugacaaagaugccaaaagcaacugcaacaaaagcaaaaauugacaaauguauacuaacuaaacuagagaguuucugcacagagaaagaaacuaucaacagaguaaacagacaaucuaaagaaugggagaaaauuuuugcaaacuaugcaucugacaaaggucuaauauucagcaucuaaaaggaacuuaaacaaauuuacaagaaauaaacaaacaaccccauaaaaaagugggcaaaggacaugaaaagacacuuuucaacagaagacauacaugcggccaaaaaucauaugaaaaaaagcucaacaucauugaucauuagagaaaugcaaaucaaaaccacaaugagauaccaucuaacuccagucagauggcuacuauuaaaaagucaaaaaauaacagauguuggcaagguuguggagaaaaaggaaugcuuuuacaccacuggugagagugaaauuaguucagccauuguggaagacaguguggcaauuccucaaagaccuaaagacagauauaccauuugacccagcaaucccauuacugaguauacacccaaaggaauauauaucauucuauuauaaagauacacacauguguacguuuauugcagcacuaugcacaauagcaaaggcauagaaucaacccgaaugcccaucaaugguagacugcauaaagcaaaugugguacacauacaccauggaauacuaugcagccauaaaaaacaaugagaucauguccuuugcagaaacacgaaugaagcuggaggccauuauccuuagcaaacuaacucaggaacagaaaaccaaauaucgcauguucucacuuauaagugggagcuaaaugaugagagaacaugaacacauagaggggaauaacacacacuggggccuuuuggagaauggagggugcgaggagggagaggaucaggaaaaacaacuaauggguacuaggcuuaauaccuggcugaugaaauaaucugaacaacaaaccccuaagacacaaguuuacccauguaacacacccgcacuuguaccccugaacuuaaaauaaaaguuuaaaaagaagaagaaauaaaacuuuuuggggggcaaauuuuuuaaaaaagaaaaagaaauaaagggcauccacaucagaaaggaagaagucaaauuauccuuguuugcacgugauaugaucuuguuuggaaaaaucuacagacuccacuaaaaaacuauuaaaacugauaaauaaauucaguaaguugcaggauacaaaaucagcauacaaaaaacaguagcauuucuauaugccaacagcauacaaucuagagaagaaaucaagaaagucaacucauuuacaguagauacaaauaaaacagaauaccuaggaauuaaccaaagaacugaaaguucucaacuaugaaaccuauaaaacauugaugaaagaaacugaagaggauacacacaaaaaggagauauuccauuuuugugaauuagaagaauuaauauuguuaaaauauccauaguacccaacgaaaucuacagauucaaugcaaucucuaucaaaguaccacugacauucuucacauaaauagaaaaaacaacccuaaaauuuauauggaaccacaaaagacccagaauagcuaaagcuguccugagcauaaagaacaaaauuggaagaaucacauuaacugacuucaaauuauacuacagagcuguauuaaucaaaacggcacaguacuggcauaaaaauagacacacagaccaacaaaacaguacggagaacccagaaacaaauccauacauauacaguuaacucauuuucaacaaaguugccaagaacuuggggaaaaaacagucuccaguaaauggugcuggaaagacugucuauccauaugcagaagaauaaaacuagacccccauuucuugccauauacaaaaaucaaaucaaaauauauuaaagacuuaaaucuaagaccucaaacuaugaaacuacuaaaagaaaacauuggaaaaacucuccaggacauuggacugggcaaagauuucuuaaguaauaccccacaagcacaggcaaccaaagaaaaaauggacaaaucaaauuaacacguuaacacaucauguuaaaaagccucugcauagcaaaagaaauaaucaacaaagugaagacacaacccacagaaugggcaaaaauauuugcaaacuaucugucugacaagggauuaauaaccagaauacauaaggugcucaaacaaaucaauagaaaaaaaaaaucuaauaaucugauugaaaaauagggaaaacauaugaauagaccuuucucaaaagaagacauacaaauggaaaacagguauaugaaaaagugcucaacauuguuuaucaucagagaaaugcaaaucaaaacuacaaugagcuaucaucucaccccaguuaaaauagcuucuauccaaaggucagggaauaaaacaugcuggcaaaguuguagagaaaaaggaaccacacugguggugggaauguauauucccaaccacuucagagaaaagcuuggagcuuccuugaaaaacuaaaacuagaacuauccuaugauccaaucuuacuccuaggcauauacccaaagaaaggauaucaguauauugaacagguaucugcacccuuauguuuauggcagcaguauucacaauaaccaagauuugaaaaccuaaguguccaucaacagacaaauggauaaagaaaauguuguacauauacaaaauggaguacuauacagugauaaaaaagacugagauccugucauuugcaacaacguggauggaacugaaggucauuauguuaagugaaauaagccaggcacagaaagacaaauugugcauguucucacuuguuuguaggagcuuaaaaaauuaaaacaauugaacucauggagauaguagaaugaugauuacuagagguugggaagggugggggagaauggggauggcuaauggguacaaaaauauaauuagagagaauaaauaagaucuaguauuugauagcacaacagggugacuacagucaacaauaacuuauuguacauuuaaaaauaauuaagaguauaauuggacaguuuauaacacaaagaaagaauaaguguuugaggugauggaugucccauuuacccugaucugauuauuaugcauuguauuccugugucaaaauaucucacguaccccauaaauauauacauccacuauguacccacaaaaguauuuuuuaaguuaaaaaaaaaaagcacaaggagacaguauuagagcuugacccuccagucuccuugucagucaacuugcaauauaaagcuuuucuucuuucaaaaaacucagugucauaguauugguuucuaaugcaucaggcaacauuuacacaucuaauaagagacaauuaaaacauaugaagcaaaaucugauagaauugcaaagaaaaaucaauaauucuaaaauaauaguuggauacuucuauaacucacucuuguuaagggacacaacaacuagauggaagauaaguaaggaaacagacaacuuaaacuacacaauaaaccaacuagauuuaacagauaucuaaagaacauucuacccaacaacaaccacauacaaauuuuucucaaguguacauggagcauuuucccagauggaccauauguuaggccaaauauuauaucucaacagauauaaaaagaaagauauaaaaauuaucuuuuccaaccacaaugaaaugaagugagaaaucauuaacagaaaacuggaaaaugcacaaauuuguguauauuaacacauuuuaaaacaaccaauagaucaaaguagaaauuacaagaaaaauuagaaaacaguuagaaauaaacgaaaaugaaaacaaaacauaccaaaauuuaugagaugcagugaaggcagugcuaaggggggaguuuauaguuauaaaugcuugacauuuaaaaaaaacaaaaaagaucucgaaauaacaaccuaauuuuacaaauuaagaaacuagaaaaagaagaacaauuuaaaccaaaagcuagcagaagaaaggaaauaauaaagauuaggguagagcuaaaacgaauaugaggauagaaaaacuagaaaaauuaucaaaacuaaaaguggauucuuugaaagcaucaacaaaaucgacaaaccuuuagcuagaugaacuaagaaaacaaagaaaaaagacucaaaauacuaaaaucagaaauaaagcuggggauguuauugcugaaucuaaagaaauaaaacagaugacaagagaguauuauuaauaauacuauaccaacaaauuaaauaaccuagauuacaugaacaaauuccuagaaacacaacacaacuuaagaagacuaaaucucaaagaaauagaaaauuugggcugggugugguggcucacaucuguaaucccagcacuuagggaggccaaggcaaguggaacaccugaggucaggaguuugagaccagccuggacaacauggugaaaucccgucucuacuaaaaauacaaaaauuagcuggaugugguggcgggugccuguaaucccagcuacucagggggcugaggcaggagaauugccugaacccaggaggcagagguugcagugagccgagauugcgccacggcacuccagccugggcaacaagagcaaaacuccaacucaaaagaaaagaaaagaaaagaaaauuugaauaggccuauauaacuaguaaggaaauuaaauuaguaaucaaaaaucucuugauaaaguaaagcccugaaucugaugacuucaaugcugaauucuacuaaauuuuuaaagaagaccaaauagcaauccuucucaaacuuuuccaaaaaaucaaagaggaaggaacacuucuuaauucauucugugaggccagcauuauccugaugccaaagccaggcaaagacacuauaagaaaauaaacuacagaucaauaucccuuguaaauacugauacagaagugaucaaccaaaaauuagcaagccaaauucaucaccauauuaacagguuuacaauccaugacugagugagauuuauuccaagugagauuuauucuuagaaugaaaggaugguucaguauuaaaaccgauuaauguaauacacaacauuaacagaaugaaggagaaagaaaacccuaucaucauuuuaauugaagaaaaggcauuugaaaaaauuguacaucuuuucaugauaaaaacagucagcaagguaggaaucaaagaaaacuaccuaaacauaauaaaagccacauaugaaaacccccugaaaaucacacucaaggguuaaagacugaaccauuucuccucuuaagaucaggaacaaggcaaaaaugcucacuuucaccacuucuauucaacacaguauuggaaguucuagacaaagcaauuaagcaagaaaaagaaauaaauggcauccaaacuguaaaagaaguuaaaugauuuguuuuaagaugauauaaucuuauauguagaaaacacuaaaaauuccuucaaaaauauguucaaauuaauaaauucagcagaguagcaagaucacacagaagucaggugcguuuuuuauacaccaacaaugaacaaucugcaaagaaagucacaaaaacaauuccacuuacaacagcaucaaaaagaauaaaacacuucagaauauaauagauagauaaccaaggaguugauagacuuguauaaacuacaaaacauugcugaaagaaauuaaagaagauauaaauaaauggaaacaaaucccauauucauggauuggaagacuuaauguuguuaagcuaucaaaacuacucaaagaaaucuagaguuucagugcaucccuaucuaaaucuccacaacucuuuuuauagacagaaaaaaaacuuauccuaaaggucauacaaaaucucaugagaccucaaagccaacacaaucucuaaaaaaacacaaaucuagaguugggcucgguggcccacaccuguaaucccagcauuuugggaagccaaggcaggcagaucacucugaggccaggaguucaagacuaaccuggccaacauggcaaaaucccgucucuacuaaaaauacaaaaauuuuagcugggcuugguggcacaugccuguaaucccagcuacucaggaggcugaggcaugagaaucacuugagccuggaagguggagguugcagugagcugauaucgugccauugcacuccagccuuggcaacauacugagacucugucucaaaaauauauauaaauaaauaacaaaucuggaagacucacguccugauuucaaaaauuauuacaaaacuacagaaaucaaaauaaugugauacuggccaggcauaguggcucaugccuauaauccuagcacuuugggaggcugaggugagaggauggcuugagcccaggaguucaagaccagccuggucuugaauauagugaaacucugucucuuuuuaaaaaaaaagaagaaaagaaauuaaaaacaaaaacaaaaaaacccaaugugguacuggcauaaagacagaccuauauuccaaugggauagaauagagaacccagaaauaaacccuaacauauauggucaaauguuuuuugacaaacuuuucaaggccauucaauggaaaaacagucuuuucaaccagguaaaacugaauaucugaaugaaaacaaaugaaacuggacccuuaccuaacaccacacacaaaaauuaacacaaaacggaucaaagcucucaauguaaaaccuaaaacuauaaaacucuaagaagaaauauaggguaagugcuucaugacauuagauuuagcaaugauuucuuagcuaugacaccaaaggcacagguaauaaaagaaaaaguagacaaaugggacuucagaaaaauuuugaaaauuugggcaggaaaagauaauaucaacagaguaaaaaugcaaugaacaaggcugagcacaggggcucacauuugucauaccagcacuuuuugagaggccaagaucaggggaucauuuaagucuaggaguucgagaccagccugggcaauagagggagaucccaucucuacaaaaaaucaaaaacuuagccaggcaugguggcacgagccucuagucucagcuacuugggagucugagguggaaggauugcuugagcccgggaggucaaggcugcagugagcagugaucacacuacugcacuccagccugggugacagaacaagacucugccucaaaaaaaaaaaaaaaaaaaaaaagcaacacauagaauaggaaaaaauauuuauaaaucauauaucugauaagaaauuaauaucuacuauauauugaauuaaaacgcaacaagaaaaaaacaagcaagcaacccaauucaaaaaugggcaaaggacuugaauaaguacuucuccaaagaagauauccaaaagccaagccaguagcacaugaaaugauguucaacaucauuaaucauuaggcaaaugcaaaucaaaacuaaaauaagauaccaucucacacucauuagggagguuacuauaaaauaaacagaaaauaaauguuagcgagaaucuggagaaaucugaaccuuguguacugcuggugggaauguuaacugguauagccacugugaaaaacaguaugguagauccacaaaaaaauuaaaaauaaaguucccauaugauccagcaauucaacuuguggguguuuaccccaaagaauugaaaacagggucucaaagagauauuuuuauauccauguucauagcauacucacaauagcuaaaaacuggaagcaacccaaguguccaucaacggaugaaugaauaaacaaaaugugguauauacauacaauaaauuauuagucuuaaaaaggaaagaaauucuaauaugcuacaauauuuaugaaacuugagaacauuaugcuagugaaauaagcuagccacaaaaagacaaaaacuuaugauucugcucauaugagguacuuaaaauagucaaaaucauaagagacagacauaguugccagggguugaggagagaggaaaguggacaguuauuauuuaauggguuuagagcuucaguuauaaaagguaaaaagaguuauggagauggauagcgacagaugcacaacauuacaaauguauuuaauaacacaacuauacacucaaaaaugguuaagauguuaagguuuuuauguauuuuaugauuuagaaauuugaaaacacguuuaucacuuauauuaacuggaauccaauaaggaaguucugaauugcucaaaaaguaugauaaaaugaucuuaaaauacaaaaaggcauuacaaaaauagcuucaauuuauaauaauauaucaaaaauuuuaacauaaacuggcuacauuuuuauaaaaccuuguaacaauuauuuuugugaucaaaugagaaggaaugaaaacauuaacaauuuuuaacaaaaguagaagaacacagacagacaauaccuuggaggcacgaauuugccugugaaugucuguuaguuguuggauuuugcauucuaggucugaaaucugagcuugaagccaaguccaucggcugccaacucgugcucugucuacaagccacuuccauucaguacuacaguuacugugaacaaaacaaacacuguuacucaaagcacaaaggcaaucaaguuucacaaacacugcuuaauaacuuccuuaacucccaucauaaaagcaaauuuccuuucuacaacauguaauuacaggaagagagaauggcagauugacuucuuaucaaagaaaaagauauaauuuuccuaccuuuccaccccacaaauaccuguuuucauuaaauauuacauacccuguaguaggauaauuccucugcuauucaauucuuuaucagugcagaaggucuuaaacagagauaaaccagcaaagaaaaggaaacaugaaugacaaugcaaacaccauguaaaaacuguuacauaaaacuuuuauacguaaguagaugucaaguaccagacaauccauuugaauggugcuaaaucuaaauccauguaauaaacuguagcauauucgauuuuacuauaaguaauuuuuauuuguuaaaauaggcaucguuauuagcuaauuauuuaaaucauuuuuuaaaagcuaucaaaaauuauaaaaaauauaaaugcucugcuacauuucaaauaagcauaccaaauauauagaccuuaaaauauuuaagauaaacuguuccuuaaaaaccugauuccuaggauucacaaccuacagaucacaaagaauuuacauaaagccuuucuuucaugcauauuuaaaaauaaggguugauuccuagcuccuccuaguaccucuugucauuuggcaagagcacuacagcuagagaaaaauuauuggggauuacgggugguauaugugugugauauuuaauuaggagaugcagauugcaaaaaaaaaaaaaaacugacagaaacugaagauauaacuguaggacaacaaugacuuaaugacaacauguaaacuuuauaaaaaacuuaucuaaaaauucauuuauugucaaaacccgcugacuguagaacgccaagagugaacccuaauguaaaugaugaucucugggugacaaugacguguuaauguagguucaucaauuguaacaaauacaccacucuguugugggauauuaacacugggaaagguuaugcauuuguagcauguaggaacaggggauaugugggaacucuuuguacuuuccauucaguuuugcugugaaccuaaaacugcucuaaaaaauaguuuauuaauuuuuuaaaaugcacuggaccauaauggaauaucuuucaaauaaucuuuaaacagagaaaauauuuauucuaagagaucauuugcugucagauaaacagaacacaauuauuauggcuuugcuauauagaauuuauucauuauaacaggauuuuacauuauaucaauguuucugaaaggccacuguuuuuaaggauucuaacugcauacaaugugauuaaagacaccauaugauuuaggauuucucuugguauuauuauuuauuguuuauagucauuacugugguuucauaaauuugacacuuaaaaaucacauuuuccuaacuguggacaaaauaaaauaccuauucaaaauauacuauucauaguuaacaguuagcaacacuaaaugccaaucacaaaaucagagaaggcaagcaugcuagcgcguagcauuuuacacaggugaggauaaaauguuuggauuuuaaaacaaaguggaaacuacuggcaaggugguaacaauuuuuuuuuuuuuuucaagaacuuuggcuacuagguggagaaagcacugcaguaggaaaugaaaaaaaagucaggaaaacaacuaagauguuaucuguaauaaucuggguguaguacagaucauugugaucucuaaauauuucacguaccgcccuacacuucccaggcuuaugcauuuauguuggagccauuugacuaguucugagcaaaugcgcuguaagcaaaagugacauugucauuuccaguucaccugaggaucuucaaaaccaguagugcagagaguauagcuacaagauggaggaggagaauagcccagaucacacuggacuuuauguaagccgcaguacaccucugcugugugaaaccauugagauuaggaugcuaauuuguaacucuaaauauagccuauucugacuaaaacacugaauauaaaaauggcuuugacugggaaggagaggggagacaaagauauguagauaaaagaauggauucaagguucauuuuaaaguugauaggacuugcagaaguauggcauagaagugagcuuagggcaaucaaagaugaucuuaaacauucuuuaaguuuugcuccaguuggaaaauuccccuauaauaugcaauuugguuuggcuauaauauugaugauuagugaauaaugaaauauaacagaaaaaaaugccauagaacucauauuauuguacuucugguaaagauauucugauacucaaguuaggauuacaaaaaucauuguuaugauguucauauacuagacuaaauuauacuaauauagaaaaauagcaauaccagauuaaauuuaaguaaaccaaaucgcaucggacgcuuugugauauaugaaauaaauuuucuuuuuuuuuuuuuuuaguuuugcugugucguccaggcuggagugcagcggugcgaucucuccucauugcaaccuccaccucccagguucaacggauucuugucccucagccuccugaguagcugggauuacaggcauguaccaccacacccaguuaauuguauuuuuaguagacacgggguuucacuacguuggcuaagcugggcuucaacuccuuuccucaagugaucuacccgccucggccucccaaagugcugggauuacaggcauaagccagaaagcccggccugaaauaaauuuucuguagaggguaacuuauccuacauuuuaacaggagugaauaaaacauguuugcuaugcuuauaagugguaaacaaaaauguuugcuuccuagaaaacauguuuuucuaaaaaaaauaagauuguuaauaauuaagauguuacagauaaauauauggcuaacuugcucaaacaagaucaacauguuauaccccaaagucaaacauuuuauguaaacaacuuauauaaucaauguuaaugguuuacauaacuuacaguguaaccaaauagcauauaacuaaugcaccagcauacucagagugucccaacuccccaguuagcauauaagccuggucugccacugacucccugaaucuuucuagagugugcaaaacugaucacagaccaccacaugcugaccauaauguggguucccuaucucuaguaaagaucaaagacauuggugaguggagaccaccuggacagugacagagaucacucauuccccagaaagguagcauuaugacuucaauucccauccuugcuugcuugcagccaccacuuaacuuuugcuaaaagaaaugaguacaagcuguuuaaacuuaagugguuuugaaugcaauuucucuugguacuaacugucaacaucacaaacuuacaucuuuguuuugaccuccugguaugaacucauuuggucaugaugaauuuuuacuguuugcuagacccuauuuguuauuucauuuaggauuuuucuuugcaucuauagucaaagaagauauggaucugcuguucucuugucauauuugguuuuggaaucaagcuaaugcuacccucauaaaacgagaagucuucucuccuccuugauuuucugaaggaauuuauguaggacuggaaugguuuauuccuugaguuucaaugaaauuaaucagugaagccaucugagccacaaguuuucuaugugggaaaguuuauaauuauuaauuuuucuuuuuaacguaagguuuuucagguuuucuauuucucauugugucaguuuggucauuugugucuuuuaagcgauuagccuauuuagcuuaaauuguugaauuuauugacauguacuuguucauaauacagucaucccuuaguauaaggauugguuccaggacccccugaggauaccaaaaucugcggaaauggucaagucccuuauauaaaaugauguacaugugcauauaagcuacauacacuccauuguauacuuuaauuucuagauugcuuauaauaucuaauacaauguaaauauugcuuauaauacauaauacaaaguuauuauacucuuuuuaauucauauuuuuuauuauugcauuauuuuauauuuuucuuggcuauuuccauuuauaguuaguugauacacagauacagaaccugggaauacagagaaugguuuguaucccccaauuauuccacaaugccagaacaucuauagugauauuuuuccuucuuccugcuauuaguauucuucuaaauaaucuugcuagaaguuuauaauucucuccauuguuuucauguuuuauauucugugaauauccacucuuuaucaucaccuuuuccuucuauuugcuuuggguuuaauuuaguauuauuuuuauugcuuuuuaaguaggagacuuagaccacagacuacacuauucuccuuuccuaauacaaacauguauagccauacagcauugcuucaguaauuuaguagcugcaucccucaaauucugauaugucauguuucuaauauuauucaguucaaaacauuuuauaguuucucuugugacuucuucauccacgaguuauuuggaaaugugugauuuaauuucuacauauuucagacccacauauuuaccauuucuuaacauuucuuuuuuccuuuauguaaaucuguuuuuacccaguaugauuuuccuucagccugaagaucaucuuuuaaaauuucuuuagugcguguauacugacaacuucucucuauuuuugcuuaucuggaaaugucauuuugucucuguuuuuuaaaauguuucacugggcagagaauuuuagacugacuuuuuuuccccaccuuucagcacuuuaaauauaucauuccauuuuucuggcuuacauaccuucuagugagaaguuagcagugauuuuuauuuauuaaccacuucuucugaaugacuauucccuuguuagcugaagucguuuuacauuucagauauuuuuagcuucugaacguucaaugguucuuuauauguucaauuucuuucauuauguucacauuuuccuuuuaaguccuugagcauauuuacaauagauauuuuaagcucuuugccaacuacuuucaugaucauuaucauuuccacaucaguuuccauuaauaauuuuucuccgcuucuuugcaugccuaauaguugaauacacacaugugcacauacauacacacaugucuaguagguuuuauauaaauacauauuuuaaggguacuaugauuauguuguuaauguguggauuuuguggucuuccuuaaagagugaugaauucuguucugacagguuauuauauuacuugcuguucaacuucauaaauuucagcuuacuuuaaagcuuuguuagagcauguguagaguagccacuacacuaaggcaguuaucaaauugagggagagguggauagucugaggaaaauaacuaguaaauuaauaagugcauaggcuuaacaacuaugacaaaaugagaucuuuggcugugguauuuucacauauaacugacaggaagaaaaagagaauggaaaccuacauuucggagggaacucgacuaggaaauacuaccauaagccuaacaaagacuaucccugggagccaaaucugcaccaauagaaagcagggugagaaugcaguggugucuccaauaagaguacacuaacacccauguuagauacagucacaaagaaucauagaccaagaguaauucccaaagagcaaggucagggacuaugaaggacaaaugacaagggagcuuaucucagaaagcaaaauuaagguccuagcaagaccuuacuccacugccagagcaagaagucuauuauuguaaggaacaggaacuaucauauauggcccauucuuuuuuuucccauugggaauuuuccuuguccuuuauaccaucauacaagaagcaagaggucaagaaaauuaggaaacuugucucuuaguuuauuggucaccacaucaugaugaaccacacagaaacccgauauagaggacuuuacccaaugaaugugacuuuggguuaucauccuugagaagaugguauguuuuaugaaugagaaagagguacauggacauuuggguagccaaagaggcaaacugaauagacuucuuguuuuccccuaauauccauccuccuauacuuuuuggauaauagagcuccuuggguuucagcugagcccucagcagcucagcuuagagaccuuauuucccagccuuacuugcaguuaggucugacuauacaacaaaguccuugaaaauaaaacgugagccaaaauuaugugcacaacuucuaggucuggccauuauaaaugauuggguuuaucauuaaaaaugacugaauauggaaaugaaaugaaguaccagugacucucaacaaugcaggcaagggcagcauccuaaggaacagcaaagcuaaaaggucucugcuaaacccuguaaagcauaucuaauucuugaccguuaaaugagagaaaaauaaauucuauauauuuauguugacuucuccuuguuauaaaagcuuaacauauaccuuaaauaacauauuccucccucgaaaauauuucaugcuauuaggaucauuugggcuaacaaguucucauuuaaaauguucauugucuuuaagaugagccuuacugacauacaaguuaauaacuuacauacucuaucaucaaguuguacacacacaauauagacacauauaugcacacauucaugaaguaaacaacaaacaaaaacaaaaaaauaaauauacaguugugaccucuagaaauucuggcaugaagauaaaccacauuaaaaagugcaguuuaggauguccaaggacuaucugagguuggaacuuaaaaaggguuccaaaaaggaagaauaaauggaguaaacacaucuugagaucuuaugcaauucugccuagaacucuggcagaaccuagugucaacugccuaaacugaaaauuucaguauuaauuaaaaauaauucauauaugggaugggcaaauuuagucuucuucucuuauuaucuauccucccaccccucaaagaaaaaaaagaaaaaaaaggagagauugggaaauauuuaugcauucuaucgcuaccacgccucuucucuuguauggaaagaauuuucaaaguuauagccuguaaaauagucuuaaauauguuuguaaaaucuuuguguaacaucaaacauugacaaauaaggacauauuuuuaaaagggaaauacuguaaauaaauguuaaacuaaucaaaacauuuauuugcuaaagaaacaauuucacuguucaauaagcauuguguguaugugugugcaugucucacuuuuguucaggaagccaggcaaccauguaauguuuucaaacugaacuguacacgggccuggaugaagaugcaaguaaaauccagcaagaguucuguacuccaaacccugcaauuacaaaccuacaucugcucaguggaaggaaaaucuuuuccuaaugcacacaaaugaguuaguaaugggccugcgaaacacuauaaugggcccugaaaagaaauaggauaaaaauuaaaacuaccuuuauuaaucaaaaaaaugacuaccacuaagccagaaucaaguacaggcauuccugcucuaacacaauauaugcacuucuguauaaccucauguucugcaaaauaaaaauaguuagacuuauugugaagauagugccagaccacacaauaccuaaggaacuuuuaaaucugagcccuaacaaaacaauaaugauuauuauaaaaauggaaaguuuccacuggcauuuguaccuaaaauaaagcaguccacauuuaaagcuucauauccugggucucuucuuuuuuugaugugcauccuugaagacauuaguucuaauagaaaccaguuuaauaaaaauuaaaaauaucuucuagagacagcauuuuucauuagucaauuucuuuuuaacacaagcaaaauaucuuuaaagcuuagucaacacagaaaaauguauagccaauaaaccagcaacuuacugagcuacaggaggauauuucuauaggacuuuuagcauuuuguuuagaucuucagcuacugcuaagaauuccucuuuaguugagaaaagcuugaccuugaucauuucaaaaugcuaacaaguuugaaguaaucuggaaacaacccacauuguggauacacacacaaaguguguaaaaaucuacauuauauugacaucauuccccuaaaugccaaauacgucacaaauuuacauuuuaaaaugcuguaacagaaugaauuacauacauuuuuaaaauauuacuagacauuaaaugaaaaauauuucugacaaucuuaaauauauuaugcaacauauuauuuuaaaugauccugaugcuuacaugcauaaauuugaaauauugcauuuccucagugcuaaagaugccauaaaauuuaaauacaaucaauuucauaacauaauucccuggggugggaaaauaauauaauauuaauucuauacaucuggccaggcacaguggcucaugccuguaauaccagcacuuugguaggccgaggcaggcagaucauuugagcugaggaguuugagaccagacuaagcagcacagcaaaaaccugucucuacaaaaaacagaaaaauuagccaggcaugguggugcauaccuguagucccagauacuugggaggcugaguuaagaaaaucacuugagcccaggagguugaggcugcaaugagccaucauugugccacugcacuccacccugggcaacagagcaagacucugacucaaaaaaaaaauuguacauaucuauauaagguacaucuauuagaaacauuaaaaugugauaaaaaugugcauuuuggaauccaagaagcauguuacaucgaaaguacaaauuuucaugagcugugauuuuuuuuuuacaacuaugaaaauuuauuuuauuuuuaaaaacagugcuaaucacagaaacagaaaaccaaauacugcauguucucacuuauaagugggggcuaaauauuggguaaacauagacauaaagauggcaacgauagacacuggggacuaauggaggggagaggaaggggguggguaaggguugaaaagcuaacuauuguauauuaugcucacuaccuggacaaugggaucaaucagaccccaaacuucaguaucauggaauauacacauguaacaagccugcauacauacccuguaaaucuaaaauaaaagauggcaguguuaaaaaaaguuaaugauaucaauucuauaaaaaaaacuuuuagaaauaauauuugcaguguuuagauuugucuaaggaagcuuaacauugggacuuacgcuuuuuaaaaaucuuuuuuagcuuuauuaagauucaaaugacaaaaauauuacauauuuaugguguacauauuuauauauuaacacaaugcuguccuauauguacacauuguauaagauuaaaccaugcuaauuaacauauccaucaucucauauacuuuuucuauggugggaacauuuaacauuuuuuaugguaacaacauugaaaauaucauaagucgaaaugcauugaauuggccaggugcaguggcucacaccuguauucccaucacuuugggaggcugaggcagauggaucaccuaaggucaggaguucaagaccagccuggacaacauggcgaaaccccgccucuacuaaaaauacaaaaaauagccaggugugguggcaggugucuguaaucccagcuacuggggaggcugaggcaggaggauugcucgaaccugggagguagagguugcagggagccaagaucgcaccacugcacuccagccugggcaacaaagcaagacuccaucucaaaacaaaacaaaacaaaacaaaaagaaaugcauucaauuaugucucaauaaacucaccuuaaaguugaaaaauuguaaguugagccaucauaagucagggacucaacacgguauguuauuauuaacuacagucacuaugcugaccaucuccagaacuuauuccuccuaacugacauccauaccuacacacacuacauuuuccuuauccauucaucugucaauggucaguuugauugcauacuuuggccacuguaaaugaguaucaacaugagagugcagguaucaacucaacauacugauuuaauuuccuuuugacauauacccagaaguaggauuauugggucauaugguaauucuauuuuaaauuuccagagaaaccuccuuacuauuuucuguaauaucugugcuuguuuacauucccacaguguacaagaguuuccuuuuaucuguauccucuccaacauuuguuauucuuuuucuuguaauagccauuuuaacaggugugagacgguaucucauuauaguuuuaauugguauuucccugaugauuagugauguugagcacuuucucaucuauguguuggccauuuguauaucuucuuuggaaaaagaaauugucuauucagguccuuugcccauuuccuuuuuuuuuuuuuuuuugagacagggucucuuucugucaccaaggcuggagugcagaggcgcaaucuuggcucacugcaaccucaaccuccugggcucgagugaucuucccaucucagucuccugaguggcuggaacugcaggugcacaccaccaugccuggcuaacuuuuguauuuuuuuguaaagacaagguuuugacauguuacccaagcuggucucaaauuccugagcucaagcgauccaccgggcuacaccuccuuggccacuuugcccauuuuuuaaucagguuauuuguuuucuuacuauugaguaauuuaacuuccauauguacuuuggaaauccucccuuuucagacguauaguuugcaaauauuuucucccauuucauagguugucucuucacucugcuguuucuuuugcugugucaaaccuuuuuaguuugaugcaauuucauuugucuauuuuugcuuuuguuaccugugcuuuggagugcauauccaaaaaauauuugccaacaucaaugucgagaagcuuuuucuguuuuauucaggucuuauguugaagucuuuaaucaccuuaaguugaugugggaauaaggaguaagauaaggguccaauuucauccuuugauauguagauaacccauuuucccaacacuguugaaaagacuaucccuuccucauugugugcccguggcaucuuuauuaaagaauaauuggccauaaaugcauggauuuauuucuaggcucucuauucuguuucauaggcauauguguguuuuuaauuccaguggcaugcuguuuugacuauuauaguuuucucaauguauuuugaagucagguaauguggugccuccagcuuuguucuuuuugcucaagauugcuuuggcucauggggucuugcuugguuuuacauaaauuuuugaauuuuuucccauuucuauggaaaaugccaguggaauuuugauaacaaugauauggaauuuguagauugcuuuggguuguauggacauuuuaacaacucuuccaauccgugaacacaggauguuuuuccauuuguuucuuuuuccauuuuuucauucauguuuaguuguugguguacauaucuuucaccaccaugguuaaauuuauuccuaaguauguuagcauuuuaaguaggaugguuuucuuuuggacagcuuaauauuaguguauagaaauaauacagaucuuuguagauugauuuuauauccugaaacgcuaauuaauuuauuucuaacauuguuuugauggggucuuuacacuuuucuuaucucuaagaugucaucagcaaagaaaauuuaacuucuuucccugauuuggauacuuuuuuaaaauuucuuuucuuuccucucuuccccucacucccuccuuccuuccucccuucccuuccccacuccucucuguuuucuuucuuuucuuucucucccuuucucuuuuucuuuuuucuuuucuuuccuuuuucucuuuuauuuauuuauuuuuaugccuaaugaaccuggcuagcaauuccaguauauguugaauagauuggucagaguaggugguaucaucugaacacuguguccucaaaauucauauguuaaaaccuaauucccaaugugauggccuuaagagggugagccuuuggagaugauuaggugauuaggcuccaccuuuaucaugagauuaauacucuuauaaaagaggccugaggaagcuuguucucccuaucuaccaugugagaacagagguagaagaugccaacaugaaggaaagaacaagcccucaccuaacacugaauccgcugacaacuuggccuuggacuucccagccuccagacuguaaaauaauuucuguuguuaauaaguuacugagucuaagguauuuucuuacaauagcccaagcagaugaaauggucgaggaaaagguaucaaguuuuugccacuaaauuggauguuaacugugagcuuaucauauauggccuuuauugguagagguacauuccuucgauaccuaaucuguugagagucugaauucugucaaauccuucuucugcaaauguauuaagaauguuuuuuguccuucauucuguuaaugugguguauccuacuuauugauuuguauauguggaaccauccuugcaucccagggauaaauuccacuugacuguggugaaugauccuuuuaauguguaguuaauucaguuuguuaguauuuuggcaaggauagugacaaaggacauuggccuauaaucuuuuuuuuuuuuuuucuuauaguguccuucucuggcuuugguaucagaguaaugcuggucucauaaaaugaguuugaaaguauucccuccuccucuucaauuuuuuuuuuaagaguuugaguacagugaagucaucaggugcugggcuuuccuuugaugggggacuuuauuacuguuuuaaucucuuuacuugcuauugguuaguuccaauuuucuauuucuucaugauucauguuagauucuaugugucuaggaauuuauacauuuuuagguuauccaauuuguuggcauagagauguugcauaauagucucuuaugauccauuauauuucugugguaucagcuguaaugucuccuuuuucauuucugauguuauauauuugggucuuuuuucauuucuuaaucuagcuaagguuugucaauucugcuuaucuuuucaaaaaaaccaacucuugguuucaucaaucuuuucuauuguuuuucuaauaucuucugcuuugaucuucauuauuuccuuucuuguacuaauuuugggauuaguuuguucuuuuucugcuuccuugaaguauaauguuguuugagaugacuuuuucaauguagguguuuauuguuacaaaauuuccuuauuagaacuccuuuugcugcaccccauaguuuuguaaacuguguuuccauuuucauuucucucaagauauuuuaaaauuucucuuuaaauuuagucauuaauccauuggcuuuucuugauuuccacauauuugugaauuuuccaaaauuccuccuguuacugauuucuaauuucauaugauuuuggcuggaaaaaauacuugauaugauuucaaucauuuugguuaagauuugucauguggccuaacauaugaucaauccugaagaauguucccuuacacuugaaaacaauguguauuacaauguuggauggaauguucuauauaucucuguuagguccauuuggccuaaacuauaguuccagcccaaugcuuccuuuugauuuugucuggaugauuuauccauuauugaaagugggguauuaaaguccccuacuauuauuguauugcagucuauuuuuuccuucacaucuauuaauauuugcuuuauauauuuagauucucugauauugguuacauauguuuauaauguaguauccucuuaauaaacuggccucuuuaucaauuauauacuuaccuuuuugucuuuuuuuacauguuuuggccuaaagugcauuuuuuuucugauauacauguagcuaccccugcucucuuuugguuuccauuugcauggaauaccauauuuuauuccuucacuuuuagucuguguguguccuuauacuggaagugagucucucacagggcacauacagcuagcugggucuuaaaaaaaauccauucacugacuauauauguuuuuaaauuggauaauuuaauccauuuauauccgaggcaauuguugauagguaaagguuuauuauugccuuuguguucacuguuuucuguuuucguuuuguuuuuaaugcagauccuuuguuccuuucuuccucucuugcugucuuccuuugugauuuggugauuuucuguaauuauaugccuggauuccuuucucuucaucuuuuguauaucuacuauagguuuuugcuuugugguuaccauuaggcuuaagaaagaacaauucauaguuauuaggagucuauuucaagcugauaauaacuucaaucucauauacaaacucucuauacuuuuauuccuccuauucuaugcuuuugauaucacaauuuacaucuuuucauauuguacauccuaugacaaauuauuguagcuauuauuuuaauagcuuugucuuuuaauuauaauaaaaacaagugauuuauacaccaccauuauuagaguauucugaauugacuauuaccagugaguuuuacacuuucauauguuuucauguuccuaauuagcauucuuuuucuuuucagccugaagaauucccuuuaccauuucuuguaaggcagaucuagugaugaugaacuuucucagauuuuguaugucuggaaaagucuucucucucccuuucugaaggacaguuuugcuggguuugguuuuuugguuggcagguuucuuucuuauuuucagcacuuugaauauaucaucccacacuuuccuggccuacuaaguuucugcuuagaaaugugcagauaacuuccugaggguucccuuguaugugaagauuuucucuugcuguuuucaauagucucucugugauuuuugacaguuugacuauaauauguuguaguguggucuuugguuugaaaaugacuggagaacuuugacucuccuuuaccccgaugugacuaucucuccccagauuugugacguuuucaaucauuauuucuuuaaaaauacuuucuaccccuucucucuucuacuuccuuaauugcuauaaugugaacauuagcucuguugaggauaucccauaaaucacacaggcuuucuucacuccuuuucauuauuuuuccuucucugacuggauauuuucaaauaaccuguauuugaguucacagauucuuucuucuguuugaucaauucugcucugaugcucucuauugccauuuuucacuuuguucaguuuauauucagcuccagaauuucugccuaguuaccuuuuuuuaaauaauuucaaucauucuguuaaacuccucauuuuauuuguguauuguuuuccugauuuuguugaauugccccucuguguucucugguaguuuacugagccaccuuaaaagaaucauuuugaauuaucugccaagauauucauagaucuucuauuucuuuaggauuaguuccuggaaaaguaucauguucuuuggugguuuuaugauucuuuggcuuuucacguugcuuguuacuuugcauuaaugucugcauaguugaugaagcagucaccuccuucugacuucauauacugguuucaguggagaaaaaaacuucuccuucaggugggugugaggacaccagcugggugcagugugacaguucugacuccaguaagggcauagcagcauaaucucuguacagcucuaucaacugauguuagcacugucaaagauuacaaggauccucagcagccacuguccacagcagcggcaaggguuauugggugcuccagucacgaagacugguggggucgguccuccucaucucuuuuucuccugccaggaaaguuguggccaguggaaucccucuuggcacugggucugacuugcaggugcauuugcagugguggcagcaaugguaucucauaugaggcauccaugaaacagccaacaauuuggguucuggagcaugagcauguguaggaaccauggcuccagggucuagggcugagguggcacccauauucagagugcagguuccaccauucccauguuaguaacaaugugcaagaugugacugcuuuuagaucagccagggggcugagauccaaagcagcagcacacacacagcuacaauguuucuggggucugaggcauggacucacucacugugguagaaguaguuucauagacacagaaaccacagcuccagggcgcaggauacagauuauuccauaaaggcagugguucuuguuucugaggcaugggcacacagggaauuacaaagguucugggguccaaggaguggucuaguauauugugaagaugucagaugucagaugucugaggcacagauguugaaagaguagcaaugcagccaauguucauagcaaagcaaccugggcuccaaggcuuggguugaggcuaguccacagccaugaugguucuuguguuugaggugagaguaugcauagugggacagagucugcaauguggguaugcggccauggagccaaggccugguguguggacauguauggggcaguggaagcucuggagucuggggcucaugucaggauugggagggugguggucccaguccuggaaaggcagcuccuucuuggugguggugguggggguagagggugcaaccacauccuccucuuuggggauccacaguggugaugacuguugaucaccucaauggcaaaagauacugauguuguggucaguggugacuaugguagcaccuaccauuugccugauaccgguagcccccacccuucuuuguuucuagccaucuccagaugucucagguaugccagucuccccagcuauccuuucugugcaguuauccucuggauuuuuguuuguucacuccacuauguugcuacaaauucauacuuaaacauuugagcccucccaaggcuacuuucauucauggaaagauaucuaguucuuguuuuuuguucgggagugaagacugguaucuccuacucgacuaucuugcuucuaucacucagcuuagcugugcuuucuugucaaaauuaggaaaacaaaggugaucguuuccgaugauaaauacaauuaacacuugcauaacuucugcaaaagggcuuuacuauucugguuucuccauauaggacauaaaugccaguuuguuucaucuaugaaggugguuuauuuuuaaauaaagguuauguagaacuuuuaagugacacauauuauauagaagucucgaagaaaauuauguuaugaucaccuguagaguuuucuaagcaauaugguccaagaggaugaguuucuccaccugauucugugagaaucaaggcaaucaaaacaguuauuuacuugaucauccucagauguguuggggugaagaagagaggauugugauucacugauuuauagcaagauuuaaagaaauucauacauauacaagcaaucugaugcuuuuuucauuaaaaacuucaacuuuauaauaauaucuuaauuuuuccuuugaaaacaaaacagcuuuuuuuucuuuucguuacguggauguugaaaaugacucagucaauuuaacuuuggccuaagccagcuaaagucuguagauauagaaguacagcuuaaaugggaguuaaaggaucugggcuaaaaucccagcuuugccauuaacuaacaacacugagagaaaaucuaguaaacacauagucuuuuaaacaucacguugcucaaaaaaaagccuuuuuaaaaacaaaugagcuuauuuuaauugaaguacuacuucccucaaagauguccacaugccacaguagacaauauuucuugcuugggcauggucgcucaugcugugauaccagcaauuugggaggccaaggcaggaagauagcuuaaggccaggaauucaagaccauccugggcaacauagcuaaaccuugucucuacaaaaaaauuuuaauacuuagccaaacaugauggcacauaucuguaguccuagcuacucaggcaggaaggaucccuugagcugaagaguucagacugcagugagcuaugacuaugccacuguacuccagccugggcaacagagugagaccuuuucccuaaaaauaaaaauaaaaauaaaauauuucuuuaccauuuuuagcuacuagucuguucacaauuacacuuuugaauuucugcccuuuacuuccauuccacuucucccacagaaaggaaaagguucuucauuuaaguauaauuugcaaauucccuagaauucacucaacuuuuuguuuuccuuauaaacaaaacaaaauucaacuucucucaucuaugucagacaugcagggaauaaaaaaagauaacaaauagaaaaacaaccugcaaacuccacauuauacaaauauuaaguuacucuuguuugcaauuaauaaugaaauguuuucagucucuuugcccuuugaaucuuggcacugaguuucuacuccuauuuauccaguuccucaaagggaaauacuggaucaccuugcuuuucaguucuuuuccuuuccauuggcaaagcaggaaagcaagcacaaaaccaugaguauucauuucuaugggucugcaaaaacuuaauuauuuucuauuuuuuaaucuggagucacccaacagcccuuacuaaacaucaacaauuccccuuuuuucuuuggugaaugccuuaaucuguugaaaagaauucccuuaaucaagucugcuuauuuacauaucuaaguaaaaacuuaaagaaaauuugaauauaugcugaccaauuuagggaaauagugggauuuuuuuuccccaacauuugaaacaauugugugaucuggaagauauugguagguuuccuggaauaagacaagcagcauuauuucuuccuuuuccacaacccuuggagaauuaaaacaugucugugucaaaaucuguguuuccccaaaaugcagccuggaaaaauguaacugaucaucauuccccaggaaaagaagaaaagaaaugcuagaauucuauggcucuaccaccagaugagaaauaacguaacuguagccaacuuuugucagcgacucacccacauccccucacauuuaaccaguucaguguucauggaccugacugggcuccuucaccaaauaaaaagaacauuggaggcaaaaauccauucaucuuacaguggaaggacuauaucuuaaaucuacaaaaaacauaaagucccucuauuaugcuuuccaaaggaaaagugacuuucuuuuacuucaaaugcauacuagccucucaaccaaaaguuauuauuaaaguccguuaguaauaucauuaugaauuaaagucaauuaguaauaucauuaugaacuaauuuauugccuacuacauuuuuggaggaaaaguaacaaagucaagcgaaauauauauuuaaaacaagaaugguaauuguaaugacuaaugugaauacuuuccaauuuucuaaaacaauuauauuccuucacagcuaacuuccugaucaauuuuuccuaucagggcuacuaacucaaagaaaaauagaaggcauauaauauuaauauaaucuaaaauuuuaagguaaauauaaugcauuuuacuuaucaacuuuaaaaauuacaaacacugaaaauuauaauaaaaucauuacuuuuaaauguccauauuuugguauauuucauuuauucagucauugaacauucauggggggagggggucuaugacguacaagauacaucuuguggcccauuuaauauuagaaacaaaggaaggaauggaaaaaacaucaaguaaacacaaugcaacuccacaaugaaauuuuuaaaaaccauauauagaagagagaaauuucagauugcuagccucaauguuuaugucuuuacaacuacauauacaaacacagaaauagucauucacucacucaacaaauaccaagcaaucauuaaacagaagacaauacuagccuauacgauaaaagaguaguacacuaauacucauguugcuuaaaauuaaguugaagucaacuuuaguauuuacuacucuggacuuauaauuuaagguaagaaaucaacauauucaauaaagacaaugaaaauuuguguuagcacuuauuaaaaauuuagaaccaaaaaaugcaucuguuuauuugguauuuuauguuuaaaguuucacucugaacuuuauacauuaaaaauacucaucuagauuugaaaaaucuuuucacaaacguagagaagaaaauaacaaaaauaaacuuaaaauaaacuuauaaggauauuuuaaauuuaaaaauguauuuaaugaccuaagauagaacugauuaauucuaauuuuaaaaagcagaaacuguuuuuauauucacaccaaaagauacaaauaaaguuaugucauuugcucucaauauuuagucaauuucaaaauuaauauaauguugaguacagucuuucccacaagaaaucuauuaguguuagcaaaaauauucaaaacaacauuuuguauuuaauguaugggaagauauaugaaaucaagaaauguugaauagauuucaaguauuaaagaaaaaccaaaaaaaaaaaccaaaacaauuaucaaauaauucagugaaauaaaaaauauaaagagcuguuacauaaauuuaguauuauugauuuguauagaucagaugaguuuaaccuuaaaacaaaguuuaugugaccucuaaaaugcagguggggcuuuaauaaccaaggcauuaaucauaauauuaagaggccaauaaugcaagaggccagaagccuaccuuaaugaacugauauuaaauuucuuagauacauuauuuucuuaaaauuuaugucuacagucucugaauccccucuagcugauuaugggaaaaagaaagacagcaggagaaauaaacuuuucaaaccagaacccaauuuuuuccagguuacuuuccuucaguuuaccucaauaaacuggcagaguuggugaaaaauaggagguacguuauuuaguaaaaaaaaauuuuuuuucuaucauuugaauuucaccauuucuguauauguuuuacacaaauuucuaaacuuaguguuuccucacuaaauucaagaaauaaauguaaaucuuaaaauguuuugaaaaaucaaaauugacaugccuuugagaagaaauuaucagaaaguuggcugggugcgguggcucaugccuguaaucccagcacuuugggaggccaaggucagcagauuaccugaggucaagagcuugagaccagcuugaccaacauggagaaacccuaucucuacuaaaaauacaaaauuagcugggcgugguggugcacaccuguaaucccagcuacuugggaggcugaagcaggagaaucgcuugaacccaggacguggagguugcagugagccgagaucgugccauugcacuccagcgugggcaacaagagcaaaacuccaucuuaaaaaaaaaaaaaaagaaaaaagaaaaagaaaaaaagaaauuaucagaaagugcaaagugugguaucuacccuuaauagggguugguugguuaagacuaacagauauauuagccaacugcauaggacaaaacacaauuuaaugacaaacuguauggcagacuaagcauuauaggaaaucaaugaagagacuacuaaugaaaauaacauaguucaaaacagucugaaaagacaaaauuuucuuccuuuuuuugauaugaguuuuacucccgucacacagacuggagugcaagggggugauacgggcucacugcaaccuccaccuccuggguucaagcaauucuccugccuuagccucccagguagcugggacuacaggugcacaccaccaugccgggcuaauuuuuguauuauauuuuuuguauagaugagguuuugccauguugcccaggcuggucucgaacuucuggguucaagcaaucuggccaccugggccuccgaaagugcugggauuacaggcgugagccaccaagcccugcccaaaaguuucuuauucuuguuucuagcuuaaaaaagacaaaucuuuccauuagcucuucucaacaacaaaaaaauuuacugaaugugcccacuacauuuuauuuaaauacuucacaagcauuguauauacaaaaauugguaaauuuucagacuucuuucagaacacauguaccuaauaauucuuguagcucuaaguaucagugaugcaauguugagaaaacagcauauuacaagagaauaaguauguguuuagagucauauauaugagcaaaauccuguuucugccccuuacuuggcuuuuuaaccauugguaaauuauuuaacccaugcugagucuguuucuucuuaagugaaauaaggauaacaacuaccugcuaggguuguugaaagaauuaaaugagauaucauauguuaaauaacuagcacaaugccagccagaaaaauaaucugcgcuuauuaacuacuauaaauuccacaugcaaacaaauuucaauuacagugauaucagaacacuagaagacccgaaugcuuacuuugcuuuauauuuuauuucucacuauaaaaacuaauauacugaucuucuauuucauaguaaauaucaauguguuuggcuucuaauucuguaauucucauuuauuuuugagaauuugaaaaaguuuauuuuuaacuuuuaaguucagggguacaagugcagguuuguuacauagauaaaucugugucaugcagguuuguuauacagauuauuucaucacccagguuuuaagccuagugcccauuaguuauuuuuccugauccucucccuccucccacccugcacccuuuaaaaagccccagugaguguugugccccuguauguauccaugugugacagacuucuuucccccaaaaugcuauauauacaaacaauaauucacaucaauuuggggacaguaauagauccccugaaaacuaaauuaaaaauuaugcuuuaucugaccauuucaacuaaaauuuagucaauuaaauaaaauuaaaaucucauuuccuuaguaucacuggccaaaucuuaaguguuaaauauccacauaagucuagugccuauuagauggcauagacauaaaagauuuccaacaucucagaaguuucuauuggacagaguuggucuguaguguuaucacggugugauaacugaaacuauuuuucucugcuuuuuauuauucaauaucgagauaccucucucucaaguacaugccccaaaaggcagagguugugaauauguugcucacaacugaaucuuagugucuagcacauaauaagcauucaauagauaucuuacagcugacauuauaguuuuguuuuaguuauacuaagcuagcaaaaacuaacugaauuguuaaaggucaguucugaaagcuaugaguacgaguagagaguuaaggaaaaaaaguaguaagucaacuuacauguacucucaacugauacacucccaaagacaaugagggcucccuaugugcagacuaaaguuuuuuaguuagauacacauauuaacuagaucacuuaaacaaagauuaggccuuguccacagccuauucaagaauagaaaauaugcuuauuuauagcucaauaauuucauuauuccuguauggguuuuuccuagauagaaaaguugaguaaauuuauuuuuaaauaguauguauauacucacacacaauaauuuaacaaacaaaacauuaaaaaaauucaacaaaaguuuuauaacauaaaagauuaugguggcuggaugugguggcucacgccucuaaucccagcacuuugggaggccgaggcggguggaucacaaggucaggaguucgagaccagccugaccaacauggugaaaccuugccucuacgaaaaauacaaaaauuagcugggugugguggcacacaccuguaaucccagcuacucaggaagcuaaagcaggaaaauuguuugaacccgggaggcggagguugcagugagccaggauugcaccacuacacuccagccugggcgacagagcgagacucugucucaaaaauaaaaauuaaaaaaaaaaaaaaagauuauagcauuaagauuuuagaaaaucuauuucuugucaacauaccuggaaacuaagauaauugcugcuauauauggaacagaaaauagucuaauaauaauuuugcacuuacacugccacauuuuuucuaaggguauauucauccaaaucgucaucagagcugcuaucaguugcaucggaauccaaacccucuucaacaugagacaacagcccuguagcagaaaaugcaaaucuuuggauuuccgcagcuguacaccgugcaaagccauuuuuugcaucaucccacaauuuauucucugcagucaauguguuaacuucuggcuuaauuucagugcauuuagguaaacuauuacccaaaauugugguagguucaugaaaugucuucauuuuggggaguugauguuucauagacaauuucaucugcugaccauagugcuuaacaacaugcuuugccaggagcaucugcaaauguuucugaguucuucuagccuggcuaaguaaaauuuucuguuugcuuacacaaugaaguaaacgagcauguacuuccuccucuuuuucagcagcugaagaacuaacaggcacauuugaguggccagguacaauuuucuuuugaguacagugcaauaaacccuuuuuaaucucagcaucaguaacuuuauccaaaagugcauucucuugauaccauuuacaguuuuguaguuguacuuuaucuacauuagugucuuugguuauauuugaauccagaauaauuuguacaucuuucaugcacuggcucgugguaucugauagaggcuccuuuuugaugaacucuucagaaugagaaagacagauuuuacugagcugaauguugcugccauuauacaguauguuuuucagcuuauugcaacugggcuccccuaauuucuuuuguuuauaauucucauuguguuuauuuaauguagaauuagaucucauuaaaaaaacagucugguaauguuuugaagacugaggggagccaaaauguuuuaaauucacaaaauuaguauuaagaguagguucaggaguuggaaauccaagcaucugagaaaaggugucucccuuuagcuuuucaucuacaguucugggacuuuccauguagagcaucuugucagacuccaugguacuuggcaaagaugaaaagcugauacccuuugcuguugccucccucagagcuggggucauggcgauuccuguagauaaguauuggaaaccuacaauaauguaaaaauaaauggucaaauaucuagaaaaaaauuuuaugcuuauacuuuuuucuaagggcaacauguucaauguuucugauuagaacaugaaggaacaaaacuccuccuucaucucccaacucccaacauuauuucaacaaagauuaagcuauucuucccucugacugggggccuaauagcuaaaaccccaauuaaagcuacacauugcuagcacauaauagguguucaacaaauauuuguggauguaauuacaucucagaauucuauuuuuugacaacauuuaauuacagucaaaagaaaaaaaaaaauccagccuauaaucugguaauaacaauagaaaaugugacucaauuguguacuuucagccaaaaauaagaauugcuuaucuuuauaaaauauaauaaauuuaucuaaacuucuauuccugaaauuaaucaucacagccugaacgguauuaauaacaagaacuaaaauauaauaaauaauguguaagaagaccuaagugaggccggacgugguggcucacaccuguaaucccaguacuuuggggugccgagguaggcggaucaccugagaucaggaguucgagaucagcauggccaacauggugaaacucugucucuacuaaaaauauaaaaauuagccgggcaugguggugggcaacuguaaucccagcuacuuaggaggcugaggcaggagaaucacuucaacccaggaggcagagguugcaguaagcagagaucacgccaaugcacuccagccugcaugacagaguaagacucugucucaaagaaaagaaaaagaugaccuaagugaacagaacuaaaaacauauaacuucacagcuguuaaaaauaugugauaguaaaaacuugccuaaugcaaugucuccucuaaacguaucugcaauuuuacccuuuucacaaaugaauaugcaucagaauaugcauuuacuccugccuagaaaauagcggagacagugucagauaaccgcuaaagauuuaucccauaauuaaacaaauuucauugcauauuaucaaaaguauaaauccauauauugauucgcagaaaaaggcaacccaguacccuuaaacauuaugaaggcugaauaguuuguaaaauaauuuuaugucauuaacaauuauaagcuuuuaaagauaccuaguauuuuguaaccugauaugccaaaauuuuuguuucaacacauaauaguugauagucauuuaaauggcacacucucauaguguauguccccaggugcuaguuauaacucuacuuccuuuauuccuacuuaaaaacacaaaaccaaaagcugauucuuuacaaaguccaacaaaaaugaucaagaagaaaauaaaagcacaacaauuucuauguaauuaaaaaaacgguuacuagcaaaaugacagacuaggagaaaauauuugcaacauauauaucagacaaauauuaguuaucuagacuauaggaggaauuccuacaaaugagcaaaagauagagcagucagguacuucacagaugaugacauccaaauggucauuaaacacagacuuaaucauacuaguaaugagaggaauauagauuaacaaaacaagagccuaguuuuccaaucaccaaacugauaaaaauuuuuuuuuucugaaaacaucacauacauaucaugagauguaagacuucucauaucuauugggaucauaaauugguucaguaauuugaccacaauguagaaaauguguuugucaaacacauuuuuaccaaaggguaauguucauaauggcaaaacauccuuucaaaacaaucuagaugucuaacaauaacaaaacagagaauaaaaugugauggaauacuauauugccauuaaaaaggaaugacuuaaaguaucaauacagaaagaccuuaaaaacaguaucaaguuaaaaauaaaaaagaacacuguaaaauauauauauaguauaguaccauauaaauauaacacaaacacaaaaccauaccauauauacguauacauuugugucuguuugcaagaauaaaaagugaaccagaaaaauaccuaccaaacuuguacuaguaguugcaucaaguuaaguuccaugaaacagaacuaaaagugauaguucaaggggauuugcauuuuaacuacaaaaucuuauuacuugaggggaaaagacuaaaugcaaaaugaauaaauguuaaugguuaauacugagugaaaaaaauuauagauguuugccuuuuuauguauacacuuuauuguauaaugucucaaaauguaauuucuauaugaguuucuguaugucucaaaauuuauacacuuuuauauaaugccucaaaaauaagcaaauagauucccauuuauccuaaaugcaaaaaaaaaaagaaaaaaaagaugguuuuuuucaguuuauacucuuuuauggaaauagaaaaacaauucuaaaacaagcuagcauuaggaaauuucuuccaagauucaaguuguuacuugaccaacucaaagaccuaugucuucuaaucaauaaacacccacaauaguauuuagugucuacauuguucucugagggaaacugcuuuaaucacgcuucuuguugauguuacagcacuccucaaaagauacuaaacuuuaucucccacaccacacaccugucccucucaaaaaucugaacagcguacuaugaauauaaccaaacuagcgagcagcagagacagaaggugaaauaucacaaggcaggaaaauucaucuuagucucuggauaaagauacggaaaagcuaaauauaacaaguagagaaaagacgugggugcaguggcucaugccuguaauacaagcacuuugggaagucaaggugaaggauugcuggagcccuggaguucgagaccagccugggcaacauaaggagacuucucuacaaauacuaaaaaauguccuagguguggcgacaugugccaguggucccagcuacuugagaggcuaaggcaggaagaucacuugagccuggacguugaagcugcagugagcugugauugcaccacugcccuccagccugagcaacagagcaaaacacugucacagaaaaaaaaaaaaaaaaaaaaaaaaaaaaagauacacauggcugggcacaguggcucaugccuauaaucccagcacucugggaggccuaagagguggaucguuugagcccaggacuuccagaccagccugggcaacaugaugaaauccaggcucugcaaaaaaaugauagugccauugcacuccagcuugagugacagagcaagacccugucaaaaaaaaagaaagcagauuaguauuuaagaaauacaauucguagcaaaaagagaaagggaaaaaaugcaaagauuaaaaguggcuaaggcccauuuaugguagagaacuagaauaaaacauauauacaaaaucucugggugagaucucuagggcuuaccgguaggacagguagcuuccaaaauaaccuuaauaauccccacccucuucguauucaugcccuuguuuaauccucuccuagaacagggacuggauuuaguaacucacuuuuaaugaaaauguagcagaggugauaagaugacuucugagauuagguaacaaagagacuguggcuuccaucuggccacccucucuuauucagggaagccagcugccauguuaugagcuagaaagacccacaugguauagaaaugaugucuccaaccaacauauagcaaagaaucugaggccugcuaacagccaugugagugaucugagaaacagauccuucccaguaaugccuuuagaugacuguugcccuagccaacaccuugauuaacaacagccuuaugagagaccuugagccagaggcacccagcuaagcuuacaugccuacauucuugacccacagcaauuaugaaauaacacguaauuuaagccacuaaauuuggggguaauauacuacacaguaauaaauaaugaauacacuuggauaugaagacuuuuaagcucuagucuaugaaaguccgggacauaucauagcucuuauucagggauuuccauuaaguccuucuguauucuauucccaaguguauccuuauaaaaaaaaaaaaaaaccuagccuaaguaagucucucuacuuugcaaccaaaagaaacuaaugaaaauagcuaugucuccuauaaauaaaaaagauuaaauuauguucaguauaguuuuagcacaaaauauaaguacauuucuuccaauuauuuaaauuaucuagauauauaaucauuuuacauaacaauguuucccaacugaauauucuaaacuaccacuucugacgaccuccauauuauauaaacaacuacacuuaucacuaacacuucuaagcucuauuaaaggcuuggauuuuugaacaguuuuguuaacuacuguauccucaacaugcaaaucuauuugacauacagaagaugcgcaacaaauaaccuggugagaaaaugagugguugccaguauauuuaaaauccaaaguuguccuuacgauagccuacaaaauugguauuaucagguuccugacuacuuugccuucuacaacucuuuccaugaauuacugcacuccagaaacaccggccucuaugcuguauuugaaacacaccaagcaagucucuugacacagugacuuuguguuugcuauucucucagccugaaacaauuuuuuacaaauaagauggcuggcucccucacuucauuuacuucugcucuaaggucaccucaucagaguccuucccugaccaauauauuuuaaauagcuucagccucuugguucaugacucuccauucccuuacacugcuuuauugcucuucauagcacuauugccaccugacauuauauuacauucuaggaaagaauguaguuuaagugcaagaacucaaugaucuaaucuccagcacuagaauaaugccuggcacacaguaauuaucauguauuuguugacuaaauucauaaauuaauugaucaugauauuuaaaggcauuucaggauuuugguacucacaaguaguaacaacaccuauuucaauuacuauuuuuuaauuguacaaaacaacaaaauauagaaaggauacuauguucaaguauggcuuauuucaugaacacaagacugguucaacauuaaagaaaacaacaggccgggcgcgguggcucacgccuauaaucccagcacuuugggaggccgaggcaggcggaucgagaccauccugacuaaaaaggugaaaccccgucucuacuaaaaauacaaaaaaaauagcuggguguggcggugggcaccuguagucccagcuauucgggaggcugaggcaggagaauggugugaacccgggagguggagcuugcagugagccgagaucacgccacugcacuccagccugggugacagagcgagacuccgucucaaaaaaaagaaaacaauaacuaaaauucaccauaucaauagacuaaagagaaaccauaugaugucaauaaauggagaaaaagcauuugacaaaauucaauauccauucaugagaaaaacucagcaaauuaggaaggagagggaaugucuuuaaucugauaaaaagcauguacacaaaugccuauagcucacaucauaauuaauggugaaagacugaauguuucugcccuaagacugggaaugaggcaagguagacauuucucaccacucauacucaauguuguacuggaggaccuaguuagugcuguagagcaagaaaaaaaaaagaaauaaaaagcacagauuagaaaguaaguaaaacugucucuauucacagaugacgugauuuucuacauagaaaaucccaagggauugaacuccucgacuaaugaauuuaauaaggcagcaaacacaaggucaaccuacaaaacucauuuauauuucuauaugcuagaaauaaaaaacuagaaauagaaauuuuuaaacaguaauaauuccaacaccugcaaaaaugcuuugguauaaaucuaaacacaagaugaugcacauggucuuuauacugaaaaauacaaaacacccauaaaaauaucaagaccuaaauagugcauuacacuauguucacagauaaaacuauucaauauuguuaugaugcuaauucuccucaaacugauuuauaaguuuagauacaaaaucuuggcaggacauuuugcugauaucuacaagcuaauucaaagauuuauaugaaaguuaaaggaaccagaauagccaaaacaauuuggaaaagaacaaaguugaaggauucacacaacuuaccaauuucuaguagacaagacaguguggcauuagcaaaaggaugaacacauauauggaaaaaaacagagcucaggaacagacccacgcacauacggccaauuuuuuuuuuuuuuuuuuuuugagacggaguuucacucugucgcccaggcuggagugcaauggcgugaucucggcucaccgcaaccuccgccucccagguugaagugauucucccgccucagccucccaaguagcugggauuacagguacccgccaucaugcccggcuaauuuuuguauuuuuguagagaugggguuucaccauguuggccaggcuggucuuaaacuccugaccucaggugaucugccuaccucagccucccaaagugcuaggauuacaggggugagccacugcgccuggccugauuauuuugacaaagauagcaaggcaauuaaauguagaaaccuuguuucuuaaaucauaucauucuaaacuaauuggacauccauagggaaaaaaaaaugaaacugaauacguauuucauaccuuauauaaaaauggucagaccuaucagaaugaaucaugagccuaaauguaaaaccuguaacuauacaacuucuagaaaaaauguuugugacacugcuuuaggcaaagcuuuuuuuagauaugacaccaaaagcauuauucacaaaaaguugcuaaauuggacuuccuaaaaauuaaauacuaaauaaacuuuuuaaaauaauuauuuaaaauagaacuguugggaaccucugacauauauauucagaagauaauguguucaagaguucguagaaauuagauguacauauuacugaaagucacugaguuuaucauucagauuaaugcugaauagugguuuugaccaugacauagcuuuaaauuuuauuuauuuuuuuagguauuauuucauuuauacagauaguaaacaauuuguucaaggcaaaaugaguaaggaggaauacugauuugaaaagcauaaaaauuuuuuaaaauuuuuauuuuaaaguuuguggguacaaagaugguguauauauuuaugggguagaugauggguaugcaugguggcucaugccugugauccuaguauuuugggaggccaaggcgggaggaucacuugagcccaggaguuugagaccagccugcguaauauggugagacccugucucuauuuaaaaaaaaaaaaaauauauauauauacacacacacacauauauuuuuauccaaaacuaauuggacguauccagcugauaugaagaauuggucuucauauccaaguguauucauuauuuauuacugucuaauauauuacccccaaauuuagugguucagguauauauauauauauauauauguauaucaauaaaaauuaaaaaauuaaagaacuuguuucaagacagagucaacaaugcuugacaaagacuuaacaggaauuaagggaaaggaaggaaucaaggaugacuccuagguuuuuagcuugagcaacuggguggucaguggugcuauuuucugaccuaagggagcagacuuggggaggaagaaaguugaagaagaaaaaaauaaaaauuucuguuuuggauauguuacuuuuuaagugucuuuuaaacauucaaguggaaacagcuauaaaaacaagucuggaguucaagcaagaauucauaauuagagagauuauuuugcagagucacuggcauauaaauaguauuuacccuagggaguggguauaagcaaagagaaaggagcccaggacaaaacguggggguuuacucacauuuacuugagcaaaggaagaggagcuauaaaagaggaaggacgcuaaaagaaaacugaaaagaucaucgagauaggaggaaauccagaaguguaugaaaucaagauaccaacguguuuagaaguguauaacauggucaguucugucaaaugcuaaacaggucaagcagaugaagauagcaaagccgauauuacuuuuuaaggaauguauugcuuuuaaaagguuacauauuaacuaaauauccaacuccagcagccucuagccauucuauccuaccuaagcagggaaaaacugagaagcacuagugaaguucacagcccagggcacaggcucauugaaagacagaccuuaucacuggaauacagaacaucuuuucuauccuuacaucuuauuaaaagccuauuuacuagaguuccuuuuacucagcacaucauguucagcuuucaagagaaaacgacaaggcacacuaaagggcaaacaacauaguuugaagagacagcaagcaucagaaccagauuuagauauggcaagaaugauggaauuacuagaccaggaauuuaaaacaacuaugauuaauaugcuaaggccucuaauggaaaaaacagacaacaugcaacaaaugacagguaauguaagaagagagauggaaauucuaaaaagagaauaaaaaugaaaugcuagaaaucaaaaacacugcaacaaaaauaaugucuuugaugggcuuaguagcagacuggaugugguggaagaaaguagcacuaagcuugaagauacagcaauagaaaccuccaaaacuaaaaaggaaagagaacaaagauggcaggggguuugaggaagaagagacuauccaaccaagaacugugggacaauuacaaaugguguaacauaugcauaaugggaauaccagaaggagaagagaaaaagaaaagaaaauugaaacaauaaugacuaagaauuucuccaaauuaaugucagacaccaaaccacauauccaggaagcucagagaacaccaaacuaucacuuaauaaaugaagaaauauauaaaauuauauuacaugaaauuuuauauacaauaguauacuuauaacaaaugauccauuuaaaaauuuuuacuagaaauuacuucaucacauauuuuccccaaauagaucaaaagcuacaugaaggcagguguuauguguucacucaucaucguauucuagaauauuuuauggcacauagcaggcucauaauaaauauuucuugaacaaauacuauccaaaaugguaaaauuauuuuaaaauuucaaggaagaagguucaugagauauauuuuauugugaaggagucucaaggcaaaaaaauuaggaaacauuaguauagaauguaacuguccaauagaaauaugaaguggcuacauauguaauuuuaaacuugcuacuacuagacauauuuuuaaaagaaacaugaaaaauuaaauuuaaugucaucauauauauaaaguaucauauaucaacauguaaucaauacauaaacaucuugauaagcuauuuucuauuccucuguaugugugccaagucuuguaaccagggaucaacuaucgacuacuauauuucagucccccaauuuuuuggccaaaucuauuguuuaauauuuuuaggcaccuauaguauucuaggcuuuauggaaaguuuauggaaaauaaauccucaaauagcuuucuaaaaagcaccuggaucuuccuauaaauacucaguuucuaauuauuuagguuuccaauuauacacauaauugggcaggaguauuuggauccuugcuaaaucuaagaaaugucuuuacaacuacuaaaauacuuuauuauauuacucuaggcaccaccaucaucuuugaugauuauuucuuucauauacacccaagauacuuaggaacaagaggucccuuuucuaaaagaauuuagucuaaugaugcagaacuucgaagaaccuagaaggaagaaaacuggaaaaaagaauuaaacuuuuugucacaacacacagaaaugaaaauaucaaacuuacagaauuuaagaagcaaaacuaaguuaugaaaauauaucaguccucuuucaaagaaagcaacuagauacauaaucuugauucugucaauagguaacaguucuagauaauccaaaaaccaacuauguuucuuggguauaaauuuuacuuuuauuuuuucuguuuuuuuuuuuuuguuuuuuuuuguuuugagauggagucucgccccgccaccuaggcuggagugcaauggcacaaucucagcucacugcaacuuccgcuuccuggguucaagcgauucuccugccccagccucccaaguagcugggauuacagaugcaugccaccaugcccagcuaauuuuuuguaucuuuaguagagaugggguuucaccauguuggccaggcuggucucgaacuccugaccucgugaucugcccaccaaagcacuggcauacuuuuacguuuuuacaacagaauuuucaacuuacauuccaauuuuacuaaaaaaaaaaccaaaaaacaaaaaacaaaaaaaauuccuuagcacaucagcagcccagaaauguuauggauggcaaaacaaaacaaaaaccagucuguuauaaaacuguuacagauagucuaucaaguaaauaauccuccaguaagcaauuccaaacucaguguaucuccgguuuuuuuaagaagucuuauuaaaaaacaccagagagaauuucaguaagacaagacaaagcuuauguuuuuaaauaauaaacauuuuuuaaaacuagaaagaaucaauuuuuuuguuuuugguuauauuaaauuuguuauaaauaaaauuaaucuaauaaaaacaaggggggauuguaaaguuaaaucuacaccauaaauucuaauuuuuagacuacaauuuaauccaaagaacaaucacugugaauuaaggcauuaguugcuauuaguugcucugaaauuauuauaaauaaaauuaaguuaaucugauaaaaacaauagguagacuguaaaguuaaaucuauaccauaaauucuaauuuugggucuacaauuuaauccaaagaacguucauugugaguuaaggaaagcaugaguuacuauuaguuguucugaaauuguguaacaguagucuccccuuaucagcuguuucacuuccaugguucgaguaaccuguggucaacugcaguccaaaaacaggugaguacaguaagguaagauauuuugagagcgagcaagaagagcacauucacauaacuuuuauguauaguuauaacuguucuacuacuguuguugcuaaucuuuuacuaugccuaauucauaaauucaacuugaucauauguauguaugguuagaaaaaaauaaaguauauauaggguuaaguacugucugcgauuucagguaccacuggggaucugaaacauauaccccaaaaauaaagauggacuacuguacuacaaauaaaaggucuugcccuguugucuccagacuuuccauuaggaguuuaaucuauauuuuuuaagauuucuaaaccauacauauuuaugaauuuagcauuaauuaaaugcaaucugaucccuuggacaucaugaaauacaguaaaagccaucauccucaaaaggugcauguacacagugagauaauuaccaagucaauaguuacugaguugguccagacaguuaauaaucagaccuuuacaaauuaauacauaggucacauauuucaaaaaauuuuugacaaacuuucuaaagaaaaauaaaaaauuugcuaaucuaaucucaacgcucagaguugaaacugauaaucuauauaagaaccacucuuccuccugagaaugugcauuaaagauuaaaggccaaaucugaauuccuauccccuaaaauacugcuccagauucugauuuauauucuagaaugcauacauauauuccauauaugccauggaaaauauccuauccaaaucugccccugaacauuaaauuuauucuuuuaacuggaaucuggauaaucccagcucucuuaaaugcagagcaaagaaacaaacuaggaaaacauuaucagaaagacagcagauuuauacuugaugcuuaaauaaagugaaaagacuaccaacaguauuuugagagaggggagaacccugaaguagggucaaauaauaaauuauuuccacacuugugaccuaaauguuucauauagcuaaccuaggccaauuacagaaagaaagaguagaaaaaagacaaauucuuuuagcaaaauaugagaaguuuuuaaacauuaucucuagacuauaaggagacuagaggaguacagucgugccacugcauuucagccugggugacagagagacacugucucuacaaaaauuuaaaaauaaauaaauaaaaaauauaugaggauucaaaguuacugaauuguagcagggaaaaguccaauuaaacaaacaaaaaaagaaugagcucacacugguacaguuuuauuccucaaaaauacaggaauuaauggaaaguaggaauacaaaauacaguguuguuuucaagauuucuucaugccacuuuacaggaauucucaauuuacugcaguaaacacugcaauaacuggcauaacuaggauucagucagcucaguacuuuauauucaaugauguuuuauaagcaagaacuucuuccacuuugaaaacuaugccuaaaaaggaauucucuuugaagacuaaaggaauuuaauuaaagauaaagccacuuggguggcuacauaacacaucaaacagaucauacuucaagcagaauuauuacuuuucacuuguaagugcaugacucauagucauuuuuuucuguguauaucgauuuggauccaaaaaucuacauguagaaguacacuaucacauuugcucagucuauauacuuuagcuucaauuuaacuucacaugaauaaacacugauuaaugaccuacugcugaauaaaaauuuguuuaaauaaaaacaacacacuugagaauugucuuggacuggaaacaaagccucaauauuauauaaaauaaacaaaaaguucauaaauauuuuuagaauauuaacaaagucucaauauuauuaaugaauuuucacguccauacagaaauguuucuaagaaccuaaaaauaacaucaaguauuuaaaauuuccauuaugaauagucuuuggauuuuuauuauagacuaucuacuggcaaguuuaauaguaccguuuuuauuaacauuugcuggguguuuaucccacaugauuagggaauaaggaguacaauucagugaaaaguccccauaaaacaacauuuaaaagaaaaagaaagguagaaaucucuuggaaauuauauaucuuccuugccuuucuaaauggaacauacuaaaaguaauguaagauuguauuuaugauucagggucaucaugauguaaauuauuccauuaaaguacuauaaugcaguaucagcuuuaaggauagcgauaugagagauaugcuuuaaaauuaguaaauuaguugcuaauuguccaauaaaugucacuccugcugcaagcagccccauuccuuucuguuuguaucuugaugaacccaaucaguaaacaacccuaagcauaauucuauaccugaagaaagcagcucucugccuccuucaacuaccaucuaauacuauauagacaaaauaaggguauggagagauuaucugaauacaugaaaaacaucaugaaaacaaggauuacauauuauuuauaagauuuaugugguagauuaaagggcauaaaggauccuauaggcaauaagaagugagcuaccaagaaccaucucaauaauaaaggaacuucagauagcaggcaucauuuuuugucaaacacaguaaaagcuacaagugaaacuacauugaucagugaaaccuuuacguuaauuucauagaagacagaugaaugaguaaaggaaaugaaauaaucuaagguaucaugauaaauggcaucaaaauuggaugaaguucuuggauaaugcagcaguugggcuaugagaaguuaauugaccuucugguagacaacugugaucagaucacugaggccucaccugaaugaaaaaguaguaaaaguuaugaauccaacaauaauaguauauuacuaacaauguacuaguaaacugaguaaaacaaaaagcaaaagacaauuuccugaucuuccauagauaaaaaagauaaauauuagcccacuggcaaguauuuauugagcacccacuaagugaucugcagcaugucaaacaugaaauauauuucuuucucucaagcacuuuacaauaaguuaaaaaauaaaagauacaucacagauuagagugaaaaaauuuaaaaugcaaauuaaagcaagguuuuuaguuuuaaagccuaauacuaggugauaaacaaagacauaaugggaggcacacacauaccacuagaucacuguaaaucaauacaacauucuguaauuuggugaugacauaagagccuuaaaaaacacacacacaaacaaacaacaaaaacagacucuuuggcccaguaauuccucuucuacaaaucuaagggggggaaauuucaaagguuuauguaaaaggauauugucuguagugaaauauacacuagcaaaaccagaaacaucccacauacgugccaacagaaaaaauuuaaaauaugauaguuacauggcgaaauguuaagcagcuauuaaaaauauuuuucaaagaauaaugauaugcgaaugucugaguuaaaugaaaauaccauguggucucaguuuuaggaaaaauacacauauaugcagacagaaauauuuaaaguacaaaauauuuauaguuuucuuauuugcacucaucuauuuuccaauuacuuuauaauaauaagauuuaacaaaauaaucgauuguuauuugcaaaggcgcaucaugaaacaaaauuaaaauguaaauguuaaaagucaaugugagagaauuggccuggauuaagaaguuucacauaaaaaauuacuccagacaguuugcgggagagaauaaucuauguagauuaaaaccaugaggaaaugguugcagacgcugacacugaucuaaguagguggaaacugagggagaaccaaagauaaugguuacaacagauuuuaaagauacucaaauauauucuauuucaugauuaauucauuguuuauauuuccccaacaugugggcuuuuaaaaaauucacuuuuguuauaaaaauaacacuacuuggcaauugguagagauuaggaaucacuuuuccuaauacaaggcauuucuucuuucuuacaaucucuuaagacagagaccauauuaugaaacuuuacaaaaacgaaacaaguuugacaucagagaggugacuaacccaaagaaauggcuaguuauuaagaacgggaaaggcagagaccacucacuguuaagccucuuucucaauacugaauuauuuuuagagucauuuuuuccuagucagaaauugccaguuuugucugcagugcucacuucacuuagguuuuguggcuaacaaaccugccccauccagcaauauuuaaaauuauuacugacccaaacucagaugaaguuaagcaaacuggcuaaagacgaaggaaguuugucuccuaaaccucgccagaacaugaauguccugaaguuuggggaaucaaaaacggaaugugcuuaccacaguucaaacaaaaaaacaaacaaaaacggacucucccagaguaagaaaacauuacaagaacguccauccagugccugcccucccgacugcaaagccagccucuuuccuuuccugugguuucugaaacggccaggauaccgccugguauuucuugcuaccaaacaccacgcaaucugacuuuuuccagcaagaccggucccuuccucagcacaccggugacacaaacuuggaagcaccgucccucaaaaauccccuagauucugcucuaucccaucuaacucuaaagcccaaaucuacguuuuccugaaagaaagugugaaauaaauaaaauaggggucucaucaaauccagugggcuccgccucagagccgccucaaaagagccgucaccacacccccaaugggugaggcucagccgaugaggcaagaggcggguccaggaaaccacguguucugccuucugcgcacgcgccagccaaaacaaaagggaggucugccaagccccaccccccacgugaccggcguccagguccgcccccaccccucccuagaccccuucccuccccagcugccaaggcuguuagguuuagccguuuaaauuuggcugcggucagacccccgcccuagagcgcgaucccgugccgagaccagaguccagcagcccagaggauucggggggcgaaggggcugccggucggucgccugacccgcaaguccacccggcagucuucuccccuccccgcgcugccgccguccccaagagggaagacccacccccgucaucccgccgcugagacgccggccacucgccugcuggggcgcccuggcuccccuccgccgccgcaccuucgguccggccguggugggggcugcugaggugaucucuagcugcccgcccgccucccccacccggggcgccgcugacucgucuccagagcgcgccccgcucccgccccggccgccgccgccgccgccgccgccgccgccgc

SEQ ID NO: 191120 - RNA, 43429 nt, Homo sapiens
uccgcccgcccgccucgaaugucccugagacccagaagggccugcgcucagcugcucuggcaccccgcugcagggauggccuccugggcuaagggcaggagcuaccuggcgccugguuugcugcagggccaaguggccaucgucaccggcggggccacgggcaucggaaaagccaucgugaaggagcuccuggagcuggguacgugagcgggccgcuggugcagagagguggcuguggugaccugggguaaccuggagacgggagccaggagcucucggcggggcugagggaguguggagcugcagagcaaagacggggcaggugugggcgaaauuacgaccaccagggagacagaagagagcagcucuuccuaaggaauuguggagccacucguuaaaaacugaagagaccacucaggccaaagagacugugccccagguaggcaguaagaagagcagugaaacaugcugugcaauuaguuuuauauucagauuuaaaauuaauccauucuauaugcuuaaugugagugauuaggaaacgugggaagacuucauuuaacuggaaaaaguugugaacauagugagucucucauaguaucuucucacaucucuuaaccacagcaaggaaauaugcugaauauuuaccuuaacuugggugaaggaaggccuuuguaaacacauaagugagggaauaaaccacaaaggagaacauaaaucaaucuaccuguaugaaaguguaaauccucauugaauuaaaaaaauauauaaaguuuaaaggcauaugaagaaaaauauuugcaacauaagauaaauuguuuguugguuuugagauagggucucacucuguugccuacgcuggucucgaacaccuggguucaagggauccuccugccuugccucugaguccuaaaguuuugggauuacaggcugagccacuagauucggccaacagccuuauacauaaagagcucuuacaaauaaagaaaaaauccaacacacugauagaaaaauuagacuaaugguauggacuaagcguuccaaaagaagaacuacagacaggcaagaaacauaugaaaaaauaaucaacuuuauugguaauaaaauaugaaacaguaagauuuaacuuuucuaacaaaauuuugaaauguugggaaaaauuaaaguguugaugcaggaaugagaaggcaggaauguaaauuauuacaaacuuucuggaaggcaauuuggaaaaaaagauccaaaaaccuucacaauguuuaugcucuaugacaguaauuccuuuuucaggaauuuaaggaaacggagucaagcaaagauuuucaugcaaggauguagucuugaguagugaaaaaauggaaauuaccuaaaaauccaauauaaggaaaauaguuaaaucaauaacaaugaaauauaaugcuuccguuuaaauaucuugcuauugguccuggcgcaguggcucacgccuguaauuccagcacuuugagaggccgaggcgggcagauaaccugaggucaggaguuugagaccagccuggccaacauggugaaacuccauuucuacuaaaaauacaaaccaggcaugguggcguacaccuguagucccagcuacuugggagguugaggcgcaagaaucgcuugaaccugggaggcagagguugcaaugagcugacgucaagccacugcacuccagccugggcaacagagcgagauuccaucucaauaaauaaauaaauaucuugcuauugaagacuuacuuggagaaaugcauaccauauuauugggaaaaguagaauucuaaaccuaauagcauuccaauuuuacuuuuuuuuuuuuuuugagauggaguuucgcucuuguugcccaggcuggagugcaguggcgccaucuuggcucacugcaaccuccgccuccuggguucaagcgauucuccugccucagccucccgaguaguugggauuacaggcacgcacuaccuugcuaggcuaauuuuguauuuuuaguagagaugggguuucuauauguuggucaggcuggucuccaacucccgaccucaggugauccgcccgccucggccucccaaaguacugggauuacaggcguaagccaccgugcccggcccaauuuuacuuuuaauaaaauauauacaugcagggccgggcacgguggcucaugccuguaaucccagcacuuugggaggccgaggcgggcagagcacaaggucaagaguucgagacuagccugggaaaacauggugaaaccucgucucuacuaagaauacaaaaauuagccaggcaugguggcgugugccuguaaucccagcuacucaggaggcugaggcaggagaauggcgugaacccgggaggcagagguuucagugagccaagaucgugccgcugcacuccagccugggcgacagagcaagacucaguaucaaaaaaaaaaaaaaguauuacauaugcaaaaauggacuggaaggaaguuuauaagauuuuuagccauuuuucugaaaauaauguuaauuaugaguaauuaaaauugucuucgucuuuuaaauauuuuuuaaugaacaucuaaauuaucuuugguuacgacuguguuuccaacaucuggcacaguaugaacuaaaaaaaaaaaaucuauguuuuuaguuaaaaaaaaaaaaaaaagcaaaaacauuuccuaguaaggccaugauguaaccucaucaccauuacugcccaguuuauucucaacaccaagcucuauccucuuucaggaauaucuguaagaaaaucagaaucaguuaucaauucaugcauaggucagauacuaggcuucucagcagauucguaggacccuaguccacuuugaaggauuuuuaauagauuuuuauguauuugaacuuucauccuguugcauaagugugcuauuugaacuuucauccuguugcauaagugugcuauuugaacuuucauccuguugcauaaauaugcauuggccaaaaacuacaccccuggaauaaggugauagacuauauuuuucuuaccacaaacuaaaacauuaggacauuggucuuguaaucuuuuggaagacaugaaucugucugagauucugaugaaagugguggcgugucuuuugagaaaaagacaucauauacuuaaaaauauauauacacaauuauuuuguuguauuggaaauggauuuccuucagugaaagaauauuaaaaaucuuuuucuuuuuuuuuuuuuuugagauggaguuucgcucugucgcccaggcuggaguacaguggcgcaaucucggcucacugcaaccuccaccucccagguucaagcaauucucugccucagccuccugagcaguauuuuuaauagagacgggguuuuaccacguuggccaggcuggucuugaacuccugaccuuaugauccaucccccuugaccucccaaagugcugugagccaccgggccuggccauaaaaaucauuuuuauaauuacuuuuuccucuuuauuuuuuuaugccagaaucaauggcuauuuccacgacauugucauauuuuuacuagagaugggguuuuggcauguuggccaggcuggucuugaacucggaccuccagugaucugcccgccucagccucccuaagugcuaggauuacaggcauggaggccccgcgccuagccuccaguuuucuuucuagucagaaggccacuguuuuuuguuuuugguuuugguuuuuuggugugaacuaugucuuuuuggcaugaacuuugaggcaugguuuuuaaaaugaugauauuuuugcuuuuuuuuuuuuuuaacgaaaaauacagguguuuucuuuuuuacuucauacuaugccagaugguaaccaaagauaauuuagauguucauuaaaaaauauuuaaaagacgaagacaauuuuaauuacucauaauuaacauuauuuucagaaaaauggcuaaaaaucuuacaaacuuccuuccaguccauuuuugcauguauaauccauauuuuuuuuuuuuuuuuuuuugagacggagucuugcucuguagcccaggcuggaguacaguggcacgaucuuggcucacugcaaccucugccucccagguucaagcgauucuucugccucagccuccugaguagcugggauuacaggcacaugccaccaugccuggcuaauuuuuguauucuuaguagagacaagguuucaccauguuugcccaggcuagucucgaacucuugaccuugugcucugcccgccucagccucccaaagugcugggauuacaggcgugagccacugcacccggcccugcauguauuuuuuuuugagauggaggucuugcucugucacccaggcuggagugcgguggcgcgaucuuggcucacugcaagcuccgccucccggguucaagccauucuccugccucagccucccuaguagcugggacuacaggcacccaccaccacacccggcuaaguuuuuguauuuuuaguagagacggggguuucaccguguuagccaggauggucucgaucucuugaccuugugcuccgccugccuuggccucccaaagugcugggauuacaggcgugagccucggcaccccggcaaauauuuuuuauuaaaaguaaaauugggccaggcgcgguggcucaugccuguaaucccagcacuuugggaggccgaggugggcggccaccugagguugggaguucgagaucagccugaccaacauauagaaaccccaucucuacuaaaaauacaaaauuagccaggcgagguggugcgugcguguaaucccaauuacucggaggcugaggcaggagaaucgcugaacccgggaggcagagguugcagugagcugagauggugccauugcacuccagccugggcaacaagagcgaaacuccaucucaaaaaaaaaaaaaaaaguaaaauuggaaugcuguuagguuuagaauucuauuuuucccaauaauaugguaugcauuucuccaaguaagucuucaauagcaagauauuuauuuauuuauugagauggaaucuugcuuuguugcccaggcuggagugcaguggcuugacagcagcucacugcaaccucugccucccagguucaagugauucuugugccucagccugccacguagcugggacuacaggugugugccaccaugccuggcuaauuuuuguguuuuuaguagagauggaguuuuacuauguuggccaggcuggucucgaacuccugaccucaaguuaucugccggccucggccucccaaagugcuggaauuacaggcgugagccacugcaccaggaacaauagcaagauauuuaaauggaagcauguauauuucauuguuauugauuuaacuauuucccucauauugaauuuuuagguaauuuccauuuuuucacuucucaagacuacauccuugcaugaaaaucuuugcuugacucuguuuccaaacauuguggcacaugugguggcauggcacaugcuuguagucccagcuacuugggaggcugacacaugagaauugcuugaacucugaaggcggagguugcagugagccgagaucacgccacugcaaucuggccugggugacagagugagauuccaucucaaaagaaaagagaagaaaaaaauuggcuaacauuuucuuuuuugcucaauuuggguuuauauaacaaugucuuucacuuccacaggauuuugacuuuuccuuuuucugagaggacacagaaagcuuuagcucacaaaagcaggauauuguaggcagaauuagaucuccuuuauaccuuugacaggugcuguuaggcagagagaaaccugauuucaucaaggaaaaccuagcaucgucaaguugaauucauaucagauguuuuuuuaucuucaaguuaaucauucacuuucuguuacuacaguagaacauaaauuagguauaguagauaaaaugcaauuaggaaaugccgguggaaauuaugacccaagacaacauuuuuucuugcucuagucuagucuaacuagccuguuaccaacaccagggaccaagaaggugcugaauaaauguaguauucugaguugaagauggaaagggaucaguaucagccuaagcaggaacgcagcauacuggggcuacaagccucugauguugaaagaacuccuuauccacaagcuacuucuauaccuauucuaagcaggucaguugagcuuucugcaucucucuagcuacauauaaacaaaaauaaagucuauugaaaugauuuagcaugaaaggcaaggauuauauauaauauuuuucuaguuuauuauaagguagcauaagagguuugcaauaaauuaaaacaguauagaaguguauaaaagaaaaaaaugagcuuuacccauucugcccuuuuucuaaauucccuuccuggugauuuucuacaaauuuaaugugcacauguauacacacguauauauauuuuguuuucuacaaaauugggaucacaguauucuuacugcucuguaaugguuuuuuuuccuacuuaaauaucuuguuuuuucuuuguuuuguuuuguuuuuuagagacaggaucuugcucugucacccaggcuagaguacaguagugucaucauagcucacugcagccucgaacuccugucugaaaugauucuccugccucaaccucccaaguaucuaaacuauaggcaugugccacaauguuuggcaauaaaaaaauuuuuuuagagacaaggucucauccaggauggucuugaacucaccacaagcgacucuccaaccuuagccucccaaauugcugggauuacaagcaugagucaccaugccuggcccauaucuuguguuuuucaaugguaguauuguagucauaucucauucauuuuaaagcugcauaguauuccauugugugggucuguaauaacuuauuuaaccauuuccugaauggccauuuagguuuuuauuuuacccagcauugcauuguuuuucccuguaauauguuugcacccuaguucaaguuugucuauaguggaaaguucuagcagugaaaguaaauggacuuguaaaguuguauuucagugcaucuuuacuuguaguagacaacuguccugaagucuugagguuucagauaguaacuaguuauaauuuaguaaacuucuauuuagauaauccaugugaaucauccuauuuauauucucaacauauuuuuuacucgaggucuuggacaaaguuaggcauuaaucaccuugguguucuuguuuucucucucucucucuuccuuccuuccuuccuuucuuccuuccuuccuuccuuccuuccuuccuuccuuccuuccuuccuuuuuuucuuucuuucucucucucuuucuuucuuuucuuucuuuucuuucuuuuucuuucuuucuugacacagucucacucugucacccaggcacaaucuugccucacugcaaccucugcccccagguucaagcaauucucguggcuuagucuccugaguagcugggauuacaggcgugugccuccaugcucagcuaauuuuuuuguauuuuuaguagaggugggguuucaccaugaugcccaggcuggucuugaaguccugaauacaagcgauccaccggccuuggccucccaaaguguugggauuacaggcaugagccacugcacccagccuagguaaaguuuuucaucccugcccuauagagccuaugcccuacucugggaacuagagcaaaaaauguguauguugaaggcagaaauaucaaagaaagaaguggguggaggaagugguggcuuguccuggggugcuuauuucucuccuuuccaucucacugauaagcucagcuauuucuccuaagugacagaaaccuaacugaguguuggauuagucuagaaguauauacagucaugugucacuuaacacagggaaaucuucugagaaauacauccuuaagugauuucaucauagugugaacaucauagagugguaggcaaaccuagaugguauagccuacuauauacaugguuuauauggucaauagccuauugcuucuaggcuccaaaccuguacgggagguuacuaugcugaaggcugcaggaaauaguaacacaaagguaaauaucuguggucuaaacauaucuaaacauacaaaagauauaauaaaaauaugguauuuuuauuauaaaauuauauaaaaacauacaaaagauauaauaaaaauaaaagauauaguaaaaauaugguauaaaauauaaaaaaugguacaccuguauagagcacuguauaggacacaggagcuuacgggacuggaaguugcucugggugaguuagugagggagugauaagugaaugugaaggccuaagacauuauuguuuacuauuguagaauuuauaaacacuguacacacaggcuaaacuaaauuuauaaaaaaauaaaguaauugcagcuaugacauuacaguggcuacagcaccacuggaugauaagaauguuuaacuuccacuuuaaucuuaugaggccacugccauacauguggucuaucauugaccaaaacauuguuauggggugugugacuguguuucaguuauuuuuccugcuggaagaagagggcccuccuggaaacaaaaggagaaaggaguaagcuucuccuaacaguauaacguauguuuuuguugcacauuauauauuuugauaaauuaaauuccauuuuaaaguuaggcaaggcuuacaaggaacuuauggugaaucuuuccaauuuuugcuuuauaaaacccucagauugcacacgagaauuuccaaaaguuguuaccauuuuuaguuuacuaaauuauaaccuaaacuuuaaacauaguuuuuaaaauugucuuauuuuguacaagcucuauggaaaacaguauggagauuucucaaagaauuaaaaauagaauugccauucaauucagcaaacccacuacuggguguuuacaaaggaaaauaaaucacuauaugaagaagacaccugcucuaguauguuuaucacagcacuauucauaguagcaaguuaagaaucaaccuaaguguccaucaguggaugauuggauaaagaaaauauguuauauauaccauggaauacuacucagccaugaaaaagaaugaaaucuugucuuuugcaggaacauggauagaacuggaggccuuuauccuaacuaaaauaauucagaaacaaggucaaauggugcauguucucacuuauaagugggagcuaaagaguggguacacauggacauacagaguagaauaacagacauuggagacucuaaaaggugggaggguagaagcaggggagugaggguugaaaaauuaccuguuggguacaguggccacuauucaggugauggauacacuaaaagccccauguaacaaaacuacacuuguccccccuacaucuauaaagauaagaaauaaaauaaagugccuuauuuucauaugcaguagcuagcuuaucuuauacaacuaaaauaguucaggccaaauggagagccuuuguacucugugccuuugugaacuuuauuuauuccaccuguauaugcuggacuguguguuagccuaacaaauagagcaauuacagggucccuaccucccaggggaugacagugaguggagcagacuguuaaauuaacagguaauuaugauacagugaaaugcuguauuagggugaaaacagccuauaacuguaucaccucacauagaauuuaacacugaaaaaccacugcaauccagccugggcaacacagugagaccucaucuuuaaaauauauauguaaaagaaccacuuaacaguucauagguagucuuugcuuuugcauggcauuguggcauuguaacaaugaucaugcaagcugaaaccauucaaagcaaaaauagucaaugggaaaaaguacaauuauuucaugaccuucaaaaauuuuugucaaaguggcacccaaacgggacuuucagggacaaacagagaccugaagggaccuaaagaggccugcagggacaaauagagauaaguagggauaaauagaaauagagguagaguuaaauagagacaaauagagaguuuugggcaaaagucaucuuaacuugcagggcguuacuguagccccaggaguuguugauuuugauugugaagaggaaauuccaguagugguaaugucacaagaacuuuggguuuuugaaccaggagaauauauugcacaacuauugcuuguucccuguaaguugcacccuucuccacgaagggagaagcgagggaaucaaggauuugaaaguacaacuaggagagagauuuaucuaucacaacccauaacauuuaauggacucaccuguacaguacaaauugaaggcuuaaugauuuuuuuucuuugcuauacuguugcacgagaaggaugagcuucaauuugcuuuccaugugccuucuguuaaucagagagagccugccucuccuuaucaaugagaaguuuaccccgugguaauuaaccaaagaggcagaagcugaguuacagcuuguggagcagaugcuuuggcaacggcaugccuccuggccacagccacaaaagccuuugcuucuguuuugguagauuuacugacguggggauaaggguacgcuugcguuuuugcaggagaugaacaaacugugugggugcccucaaggugugugcgaccacagaacgggagacuagagcgacccauggaucccaaccaugggcccgguucccccaguaugagcugaaugcgaagacggaaugaaccaccaaggcugcacauuuugcaauuaccugucucaauuaauucaaaaacaaaaagggagagauguugcaggcugaaagagugagggucgugaucaacucaguauaccgcuggaggguauaugagcaaacagcaaacuguucucauaaaugcagaauguuggcaaaugacaaacugcgucugccacccuugaaggaaugcugagggcagucacgacccaggcgcaaguguuucuugugaugaggcacaucugaagccuguuagcaauaaugugaaccugugaucaguuaagcagcugaccaaauguuaccugcuccucccugcucuuucuacccaauaaauacaaaaggccguaggagcucaagguugcugccuuuacucaguagaagcagggaacccucuucuucuuccccuggccccuuccuuuaaaacaguuucuuuuguuuuaaguuuucauuucugcguucauccuccuucguucagugucguaaugaccgucucaaauaguaaguaguaacaguaguaacugucguagugacggucucaaguaguaaccauggcagucugccacagagggacaugaaaaaaauaauaaaaguagaccaguuucacuggggagauguuggucaaagaguacaaaguuucauuuagacaggaggaauaaguucugaugaucuauugcacagcaugauggcuauaguuaguaaugcauuguguauuucaaaauuccgagaauaguggauuuagcucaaagugguucuuagcucaaagaaaugauaagaggugauagauacauuagccugauuucaucauuccacaauauauuuauauaucaaaauaucacauuuuaccccauagauguauaguuauuugucaguuaaaaauaaaaauuuaaaaaccucaguauugaaaauuaaacuguuuuauuuucaugugaagugugucgagucauucgauuagugcuugccuucucauuguauaccuuaugauauagagcaagcauuuuuuucuguaccuuguuaaauuauuguacuccuuucuauguuucgaucagcuuccaacauuuuauccuuuauacuuucaaugucaugaaauauuuccaaaaguuucuuuuuuuuuuuuuuuuuugacagagucuugcucuugucacccaggcuggggugcaauggcacgaucucagcucacuacaaccucugccuccuggguucaagcaauuuuccugccucagccuccggaguagcugggauuacaggcgcccaccaccacaccuggcuaauuuuuguauuuuuaguagaaaagggguuuugccauguuggucaagcuggucucgaacugcugaccuugugauccgcccaccucgaccucccaaagugcugggauuacagaagugagccaccaugccuggccccaaaagugucuuuaaucugaaguuuuuugugggcaucacuuccucugggauaucuucaucuucuuugucacaggcacuuuccucaugauguuaaguuugccuucaguaagaucuuuuggcuuucuguaguuucuagacuggcagcagugucacgcauuccccuuuuauaauuccccugacaugcauucuaauuucgcuuccaguguuacaaauuuucauuucuuggucucacuuuucauguuuguuggccaguccccccuuagaucauguguuuuuauaaaaugucacuuggguuucuuguugaaagaccaggaggugacacagcuauauuauuugcugucugagcucuucugaacugaagaagagaugcacagugggcauucacugauagacgcuggaagaaaugacaugauuaaucacugaucuugaugugcaucuguuauuuaugauuuguggguugaaaagcuagcaguaaaguuugcauuuuaugcaguuacaguuaauauaccaugguuguugaaauuugaaccauguuguugagagacuggugucuuuaagcuaagcuaacugaaaucagagcauauuggagcagagcaaaagaaggaccgucucuacuuccauuuccccuucuuagccauugugcuauuauucucaaggagaaggagggaaucauuuuauuucuacauauguuauaaaucuuacaauauguuguuauuauuuuugcuuugaacuauaccuuuaaagagaucugaauagaaacaagaaaagucuuuauauuuacucacauaauuacuauuucugcaacauagaccucaucucuacuaaaaaaaaaaaaaaaaaaaaaaaaaaauuggccagauauggugguguaugucuguggucccagcuacucgggaggcuggggugggaggaucaguggauccuggaaggucaaggcugcagugugccaagaucgccacugcacaccagccuaggcaacagaguaagacccugucucaaaaacaaacacacgaaccauuuuuaguucucuuucuucuucuguauauuuuuagauuuuuaucuggcaucauuuuccuucuacuugaaggacuuccuuucaucuuuuuuguagugcagaucaccuugaugaauucuuccagcuuucauaugugugaaaaagucuuuauuuugccaucauuuuugagagauauuuucacuggguuaagauuucuagguucaccaucuuuuucauugcuuuccauaccguaaagauguuucagugucuucuggcuugcauuguuucugaaagaagucuuuaucuuucuuguuguauacuuaauguguuguuuuucucuggcugcuuuuaagauuuuucucuucaucacuggucuauuuaauuauaucaucagugucauuucugguuccgguuuuuuuuuuuuuuuuuuuuuuugauauggagucuugcucugucacucaggcuggagugcaguggggcgaucucagcuccuguaacaucugccucccggguucaagcaauuauccugccucagccuccugaguagcugagauuacaggcacaugccaccaggacuggcuacuuuuuguauuuuuaguagagacaggguuucaccauguuggucaggcuggucucaaacuccugaccucaugaucggcccgccucagccucccaaagugcugggauuacaggugugagccacugcguccggccugggucuguuuuuauuaauugacuuuucuccuaauuaugugcugcuauuuuccuguuccuuggcaugccugguaguucuuuuuguuggaugccauauacugaauuugaccuugauggauguuggcuauuuuuauauucuuauaaauauucuuagacaggcgcaagagauugggaccacccuggccaacauggugaaaccccaucucuacuaaaaauacaaaaauuagccaggccugguggugcacgccuguagucgcagcuacuuggggggcugaggcaggagaaucacuugaacccgggagguggagguugcagugagcugagaucaugccacugcaccccagucuggcgacagagugagacuccgucucaaaaaaaaaaaagaaaaagaaaaaauauguauauauucuugagcuuuguucugggauacaguuaggucacuugaaaacaauuugauacucuaaaagaggcuugaucugagcagccuuuagucuauggugaauuuugccucacugcagaagccaucugcuucugcauauuuuaccgaaugccccgugaaagguuuuuuucuggugggcacacuaaccauucccagugcugugugagugccaggguuugaucucccugcccauuuuugguaguucuuuccucuuugauuuauucccaagcaucgauugguacucaggugaagauuccagagagacucugcagaucucuggaguucucgcucucuguauaucuuuucucccuauccccugggcaaucucacugccuuggcucccuagacucccaacuucaucucuuccgccagggagacuuuggucucugaauguguuccccucccuugcugcaguguagaaccuuucuccaggcagcaagcuggggcaauccaagggcucauguuugauuucacugucccagagaugaccauccagugcuacuagauguccagugccagaaaaccaucauuucauauauuuuguccaauuuuuuaguuauuucaggauggagggcaaauucaguuucuacuacuccaucuuguccagaagcaaaaauccuaauucagcuuuuuuuuaagacauaggaacacgcauggccaggugcagugacuugugccuguagucccagaacuuugggaggccaggugggaggauugcuuuagcccgggagaaguucaagguuacagugagcuaugaucaagccacugcacucuagccugagcaacagggugagaccuugacucuaaaauaaaaaauacuuuaaaaaauggaacacaugauauauuuuuucaauauuauuauuguuggaauuuggacaacucaugaaggcauauuuauuuguucccuggcgguuuacuuuucaagguguaauguggucauugcaucccaugaaggcauauuuauuuguucucuggcuguuucuccucagggaguaauguggucauugcaucccguaaguuggagagauugaagucugcggcagaugaacugcaggccaaccuaccucccacaaagcaggcacgagucauucccauacaaugcaacauccggaaugaggaggagguaauggagauauaucuguaucauuuauucauucauuguaauuugcaguaguguuucuuaaaccuggcuaugcuucagguucuccuauuguagcugucuuagaugaggcucacuagaagcagaggcugugaaagagauucucauguuaaugauuuacugagccggcgaauccuggagaaggagaggaagggaggcaagaaugugguccagcuaaagauggccuuuuguccuuuaagucuucauuuuuauuuuuauuuuuuugagacaaagucuuccucuguugcccaggcugaaaggcaguggcacuauaucggcucacugcaaccuacaccucccagguucaagcaauucuccugacucagccuccugaguagcugggacuauaggugcaugccaccaugcccagcuaauuuuuguauuuuucauaaagacggguuucaccguguuggccaggcuggucucaaacuucugaccucaggugaucugccugccucggccucccgaagugcuaggauuacaggugugagccaccgugccuugcccuuuaagucauuuuuuaauguucauuuuaaucugauuucaucacuguuuauucuggguugguagcugucaaauuaauauaugacagaggccugcccuacucaaggguguuccaggcccuuggauauaucuugucgucaaaauuacaguuuuagcuuugugaucuguggguauugggugcugguacauuacucauugguguaggauuuuuagucuuauucauugcugcauguucauucauuguggcacuuggagugacuguucacugugagagauugcaaacucugucuagagcaaucaaucaggcgagguagcaaguuaggcuauuaaacuuuuccuuuuaguaacuucuacuguucuucuuuaggugaauaauuuggucaaaucuaccuuagauacuuuugguaagaucaauuucuuggugaacaauggaggaggccaguuucuuuccccugcugaacacaucaguucuaagggauggcacgcugugcuugagaccaaccugacggguaccuucuacaugugcaaagcaggcaaguaccaucaguauccacaagucaacaugucuuuauuuagagaucucaggauuccuauuagggacucagaagccccaugucauuaacauuuauuggcuggauuuucucacuuacaacauaggaauguaaauugguacauuucaguauaguaauuuggcaauauuuauaaaauguggauauccuucaaucucaucauuuuauuucuuggaauuuauuaugagaaaauuauuaaugaucuguacauagauuuagcuauuaauuuguucauaaaauuggagaaaacucucacacuuacucuguuuuuaagaaugaaucuauuaaaucuuuuagcagaaccaauuaauaaauucagggagaauaccagagacagagucuguaugcucucuaacaacuaauuagcaugcauacauagucuuuggauuaaaggucauguuucgugggugguuaguacugaacuccugaguuggguaacucaagagauuuuguaaaaacuacccaaaucuucuuaugaugaaaaauacagaacaaguacaacccuaucucaaagggucuucaugccaacaugaauuaggcuuuauauucuuaguaucuacaagucagaggucuugcagacaucucuaccuaacuagcagaaucaaccucugucuaagucgugauacaaguuggguuguuccaguggaaaaacccagaaacaacagggcuugaauaugaguuuauuuuucucacauaaaaaguccagguagguaguguaaggauuauaugguaguuucauaaucauuaggaacugaagauccuucuuauugcuccacuguucuugaccugugguuuccauuucaugauucaagagggcugcuccaguucuugcuaucaaaucugcauuccagacaacaggaauggggaaaaaggguagugcucacccauuccuuuuaugggcaccaucuggaaguagcaccaugauguuugcucacauucgucagcuagaauucaguuaaaugaucauaccuagcuguaaaagaaacugggaaauagaguccuuaggugggcagcuaugugccuaaaacaaauucuauuucuauggaagaaagggagaaugaguauugggagacaucuaguggucucuaacccaagcuuuguaacucugugcuuucacuccuucuaacaggcaaaucagcaaugucuuaccaauccaagauaccuugcuaacaacugucaauuaaaagucuacagaauugaaauucagccaugauuuuuauuagccaaaacugaauuaaagaauacaaggcuggccgggcaugguggcucaugccuguaaucccagcacuuugggaggccgaggcgggcggauuaccugagcucaggaguuugagaccagccugggcaacacggugaaaccccgucucuacuaagauacaaaaaaaaagaaaaaaaauuagccaggcagcgugcaucuguagucccagcuacuugggaggcugaggcaggagaaucucuugaacccgagaggcggagguuguagugagccgagaucgugccacuguacuugagccugggugacaagagugagacucuguuucaaauaaauaaauaaaaaaaaaguaaaacaaauacaaggccuauuauuuuugcuuuuacuuauuuggggcuuuuaguuuuuacuuuucauaaguuauauuuuucuuuuuuuucuuuuugagacagagucucgcucugucacacaggcuggagugcaguggcgugaucucugcucacugcaaccuccaccuccuggguucaagcaauuuuccugccucagccucccaaguaguugggacuacaggcauucaccaccacaucuggcuaauuuuuauauuuuuaguagagacgggguuucaccauguuggccaggauggucuccaucuccugaccuugugauccacccaccucggccucccaaaaugcugggauuacaggcaugagccacugugcccagccauauuuuucuguaucuugaaaauaauagugaaaaacugaaaaccauguaaauauucuggaguaaaauauuaguugagugaaguuuuauacaucuauaugauaaagaacuaugcggcccuuaaaaauauugacauaaaaauguacucauuaacaugaaaaaauauugccagauaucacugccagaaaagcaaguuaugaaauauuuuauccaacauguucacauuucuguuaaaaaaaaguauguauuuaugugugcauauauaugaauagaaaugauucugaaaaaauuuauaccaaaauacagucguguuguuuaacaacagggauuuguucugagaaaugugucauuaggcaauuucauuguuguaugaacaucauggaguguaccuacacaaaccuagaugguauagccugcuacacaccuaggcuacaaaccuguauagcauguugcuguacugaauacuguaggcaauuguaacacaucaaguauuuguguaucucgacauagaaaaaguacaguaaaaaugugguauuauaaucuuaugggaccacuguuauauaugcaaucuguuuuugaccgaaacauuguugugacacaugacuguauugacauguaucaccuccaggaggcaaaauuacauauuauuuuuauuuuuuucuuugugcuucucugcccuuucuacuuuuucuaauaugaccauauauuacuuaugcaauuaaaaugauuuaaaagaugacugcccuaaagucccgacccagucuguuucagcuuguacccugggacacaauaugcuauuguuaaagaauugugaagaaaauccacauauaaauuauuggugaauuuggacuuuccuauagacuuuuauuguucauuuuacugauacaggaauuuuuaccccaauuuacuuuuggaaaaauguuggaucugugggaaaguugaagaaauaauacaauggauuucuguauaccuaucauuuagauucaugaagcauugccaggcgugauggcucaugccuguaaucucagcacuuuggaaggccgaggugggcggaucacuugaggucaggaguucgaaaccagccuggccaacauggggaaacccugucuccacuaaaaauacaaacauuagccgggagugguggugcauggcuauagucccagcuacuugggaggcugaggcaggagaauugcuugaaccugggagauggagguugcagugagcugggauggcgccuccaggcugggugacagagugagacucugucucaaaaaaaaaaaaaaaaaauucaccacgcacuaacauucccauuuacaugaucucucuuucucucucucucccucucuacaaucaugcacacacacacacauacucacacacacucguuuuaaauaaacaauuugaaaggaaauuacagauacaaagguacuuuguuuauauaucucuuaaauauaaacacauguuuucuauauaauuacaauaccauuauuacaccuaagaaaauucacaguaauucaauaaaaucacucauuauauaguccuuauugaaauuucccuaauuguuuucccagcuuuuaaaauccaagauguuuucaaauucauguauugcauuuuuuuaugucucuuuaguuucuuguacucuaaaaaaaauccauacuuuuuauauuucauaacagugacuuauagaauguuccaaauucuggauuucucuaauuguuuuguggugauuauauucacuuaaauauuucuggcaagaccccuucauauaugguauauauacuucuuacugcauuacaccuguaagucuguuguuaaggugauuuuacuauuggucaucuuaaauuuuuucgcuugucuaagauucugaccaccaaaccuuucuguuguaaagauacauuuuucuauuuguaaacuauaaguaaucuguggauaauacuuugagaccaugugaagauacuguuuuccuauguacuuuuauccaauggguuuagguuccuuuuuuuuuuuuuuuuuuuuuuuuuuuuuuuugagacaggguuucacucugucaccuggguuggagugcagugaugugaucguggcucacugcagccuccacccccugggcucaaucgauucuuccaccuccugaguagcuggagguacaggugcauacuaggcuacuaaccaccaugcucagcuaauuuuuuuuuuuuuuuuuuuuuuuuuuugguagagccggggucuccccuuguugccgaggcuggucucaaacuccugggcugaagccauccauccgccucugccucucaaagugcugggauauaggugugaggcacugcucccggcucauuccauuuuugauucuugcccgauucaguuucagaauuggaagaugcaaaaugaugauuuuaaaaauuuaugccuuauuuauuuauuaauuggcauucuuuuauaaagaugaguuuuuccuuuuuuucucaccuccuaagccuuacuauugaugaauggaauuuauuuuuauucaguauuucuaacccauuauugucauuuucucucugauguucuaguugaccagcuaaucuggcuucugugucuuuuugaaauggcucagaccuguuucuccaagaagaccuaguucccuuuaguagguaauaauaauuauuguuugcuuauuuauuuauuuacuuuuuggagagagagucuugcucugucacccaggcuggagaguagugguucaaggcugcauagcccacugcaaccuugaacuccuggggucaagcaauccuccccgcuucagccuaccgagcagcugcuacuauaggcacaugacaccaugccaggcuaauuuuuuaauuuuucauagagacagaguuuuucucuguugcccaggcuggucuugaacuccuggccuuaagugauccucucaccuugaccugccaaagugcugggauuacgggugugagccaccacuccuagccgggaaugauuuuuagaaggcgagauuuggguacuacauguguucacuacuacuggguuaucauuacuuguagacauuuucagaacuaggaaauaaauaaauauauguauauggugguauuuauccagaagcggaagguguguguagaauaauuuaaaugguuauucuccuuucuugugcuaaaaucaaaugguuuuauauguuuucauauauuuuucauauauguuuucaagcauauauaaauaauaaaauauuuaacaaugagguuaacaaaaaaguguaagacuuguaugccacaaacugccagacauugcugagagaaaucaaagaagauuuaaauaauguaaaaauauucaguguuuauggguuagaagguccaauauuguuaauguguuaguucuucccaaauugaucuguagauucagagcaaucccugucaauuuuuguagaaauuaacaaacugauccuaaacuacauauggagaugcagagggcccagaauagccaaaacaauuuugcaaaagaagaaaguuggaggacuuaaugcuucuugauugcaaagcuauuucuugauuuuaagacagugugguacugacauaggcuagauauauagaucaacaugauuauagucauuagggaaaugcaaauaaaaacuccagugugauaccacuucacacccacuagauggcuauuaucaaaaaaucagacagcaguggcguguagaaacuacaucccccaugcauuucugagaacaauguaaaauggggagggacacuuuggaaaaccauuuggcaguuucuuuaaaagcuaaacagaguuaacauaugaccacacaaagauuuguauucauaauugcuccaaaguggaacuauccaaauguuuaucagcugauaaguggauaaauaaaacauggcauauccacauaauggaauacuacucggcaaucaaaaaggaacuauuaacacauuacaacguggaugaaccucacaaacaugauucuaaguggaagaaguuagacacaaaagaccacguauugugugauucacuuuacauuagauuuucgaaaagguaaaggcaaaucuagagaaacagaaagaugaguguuuaccuggggauggguuaagcugcagaugggugugaaggaacuuuuuggggugauggaaagguucucaagcuggauugugguaaugguugcauaacuccguauauuuauuaaaagucauuacauugcacacuuaaaguagaugaauuuuaugauguauaaauuuuaccucagucaggcuuuuuauaaggaaauguaaauggacguguaaaacauaucaaacaggcagugugcugaaacaagguaucaggagggccaggauacuuuaaaaauuuaaugauugaguuugccucuauccugcaguuuacagcuccuggaugaaagagcauggaggaucuaucgucaauaucauugucccuacuaaagcuggauuuccauuagcuguguaagcguuuuuauauaguuuucuuucuaagucuuugaguuuugucuucugauugggggaagcauguuagggaacauuucuuaaaucaagaucauuaauaccuuuaaugagcugugauucuaacaguuaacauuuuauuuuauuugaacuuaaaauucaaaguacuucuaaaacauuuucauccagaugcggacugccagauuuaccaaggaaagggaaaauaguauuuguuuuuugucugauguucagauuaaacuggaugucuuguguuuucuugggcaacucuaaucccgaugugacuaaacuggccaucacugucuaggaauagcuuauuuguuaaaguauagaaaugaaacuaaucuguguuaauuuagauuugaauaccauuaauauagcuacuugauuuuacacaggacugcuaaguuguuccuccuaacagauaauccaggauuuuuucuccaaaaguuucuaagguuuugugccucugauuagccacucuguacacagacagcaugccuccuuuaugcaaauuuuaguacccugcucauuuccuggauuaugcagaacucccaaacauguauaggauaaaaauaaaauucaacuuggcuuaaguaaaaaucuagggcagugguucuccaaaaguggcuuccagaccagccacauccccaucacuugggagaaguuguuagcacagcaaauuauccagccccacaccagaucugcugcaagagaaacucugggggcagagcgcagccgucgugcaagcccuggaggggauccugguaccugcagagccacugcggaaagggcauguuagguucagccacaauguuagcaggaagcugccucuccuuuugguuuugcuuucuucaugucugcguacauucucaggcaggcugucucuagguguggcaaaaggcgaguacuagcaagaguuacaggucaacacucuagcuguucuuaacucuccagugagagagugccucucaagucaugccagcaaaaacaauauuaauggugccagcaggucccagagaggauacucauuaacugacccugccugguuauguguucagucauuaaccaaaaacuguagaaaugagguugcucugcuaugcauggucagccugaggaaugaggaacuguggucaucaucgcucagacauggacugagaacaggcaagagguacuuccucaaguggaaaucaaugugauguuacuaaaaacagaguaaaaaauggugugcaggccauugauaccacucuaccuucuuuuccugcucauuauucuuuacuaaauguauuuaccuauuuuagcaucuuggaagaaauaauucagauuguagguucuuucuggcauuucccauccucacaggcaacuaguguuaauaguuuugggggcauaucuuuuuccuacauuuuaaccacaaauuuaggaugcuauaaacacuauucuguaucuugauguucucaaaugaagcaaauauccuggagauauuuucuuaacagagucuaaagagauuucuucuuauuuuuuuauggcuaauaugccacuuuuauaaaccauaaguaaggaaugauuuguguaaccauuuuccaguuggugagcauuuggguuguuuccaaccuuuuguuauuaccaaaaccaaacuaaacaccugcaguaaguaacauuuucuguacaucagauaguguguagccuaaauugcaagagguauaauugcuaaguccaaagccaaaugccuuuguaauuuuaagagauauugccaaacugcccuuuagaaaaguuguaguuccuuuaugagugaaauguguccucuuucaugcauauguaagaaguaaugagaguuucuuuucuuaaaauacauuuuugaaaugaaaucacuggcuuuucugauauucgguuggcuagaaaaaaaacacagcuugucuuuaacauggaaaagaaguguuucagauacuucuugcuuuuguucucuuaagaaucguuuccuuuuccaguggccuucacacuuuggaccaugacucauaguaagaaauuuuacaucuugaccuaguaaacacauauguguauaugugucuauaggcaaaacaaaauucgugaagcaaacauucuuacuauguauugugcacucugauuuuucuuucuuuccuuuuuuuuuuuuuuuuuuucugagauggaguuuugcuccuguugcccaggcugaagugcaauggggcgaucuuggcucacugcaaccucugccuccuggguucaagugauucuuaugccucagccuccugaguagcugggguuguaggcacccaccaccacguccaguaguuuuuuguauuuuuaguagagacgggguuucaccauguuggucaggcuggucucgaacuccugaccucaggugauccaccugccucagccucccaaagugcugggauuacaggcaugagccaccacacccggcugauauuuucaauuuuauuguggucuacucuguuguauuuucuuuuuuuacacuugcugcuuauuacuugcuaauuuuauuucacuauuagcauuguguuguaauuuacaauuugaaagacauggcuuuagguauccucuacaauagaagaggaggaugaaugucagagauugagcacuccuuuuuuuuaaauuuuagcucucuuaagagacaaauugaaacuguuggcugucgcuuguuuacuugaccaguacagguacaugugcaagauacaucuggaaauacuaaaaugaaucagauaccauccacacucugagggagucuacaacuaguaggggagcaaagcaugaaaauaaucagcuagagagagaagguguuggauauuccaguaaagguauuugcaagugugcaagauaaaaggagcacagaggagggcagcauccaggcgacaugucucaaaggugaacucgaguuuggugacauaugaggaggagaaaggaaggcaagucaaugagacauuuacuguguaaagacacagaaauuugagacacuguggcacuuuugggaacuacaaauaauucuuugugaugaugggugguacggcuaaauggaaauuaauaccuuggaauggagugggagucacaaaaggccuuaacuaccagggagaggaguuugaagugcaucagggguuccuacacuagagccuguggcccuggggcucuggggcugugcauccaggagggcgcuuaaaucugcaggguuaucacaacuaaggcauuucuuuggaggaucuuuuuacucuuaaugguugagaaggaaaacauuuauauucaaguauguauuacaaagaaaagcucaagaaugaugaggauuugggagucauaguuugggggagcauuaucuaguuguccuuuuuugggaauauuuauguacuagguuuaguccuauuacaaguguuuuuuuuuguuuguuuguuuuuuuguuuuuuuguuuuuuuuuuuugagauggaauuuuguucuuguugcccaggcuggagugcaauggcacuaucgcagcucaccacaaccuccgccuccuggguucaggcgauucuccugccucagcuuccugaguagcugggauuacaggcaugcgucaccaugcccggcuaauuuaguauuuuuaauagagacgggguuucucuguguugcucaggguggucucgaacccccgaccucaggugaugugcccaccuuggccucucaaugugcugagauuacaggcgugagccacugugccuggccuacaaguuguuuuuacauuaagugucuuuuuuuuuuuuuuuuguaagacacagucucgcucuaucacccaggcuggagugcaguggugcaauuucugcucacugcagccuccgccucccggguucaagcaauucuccugacucagccucccauguagcugggauuacaggugcacgccacuaugcccggcuaacuuuuuguauuuuuaguagugacgggguuucacugugcuggccaggcuggucuugaacuccugaccuugugauccgccugccucggccucccagagugcugggauuacaggcgugagccaccacgccuggccuacauuaaguaucuuugaauaaccccaaauucauuuuuuaacuaaugaccaauuuacaacaucuaugacuguagaauuuggaauaacuugugaaguucaccguaauggaauuugacauauuugacucauauucugauuuugauuaauuuuuccaugggcaauagauauuuauuuuuucagaaaagaagucaguggggcuggaugcaguggcucacgccuguaaucccagcacuuugggaggcugagguggguagaucaccugaggucaggaguucgagaccagcaugggcaacauggugaaaccccaucucuacuaaaaauacaaaauuuagcuagguguggugucacacaccuguaaucuuagcuacucggggggcugagguaugagaaucacuugaaucugggagguagagguuggagugagacucuguacccccuccaaaaaaaaaaaaaaaaaaagaaagaaaaaagaacuuagugaccuuauuuaaccuacuaucucaguuauuuccuacuuuucuuuuuuuuuuuucuuuuuuuuuugagauggaguuucacucuuguugcccaaguuggagugcaauggugcgaucucggcucacugcaaccuccaccuccuggguuccagugauucuccugucucagccuccugaguagcugggauuacaggcaccugccaccaugcccagcuaaaauuuuuguauuuuuaguagaaacgggguuucaccauguuggccaggcuggucucgaacuccugaccucaugugauccaccugccucaaccucccaaagugcugggauuacaggcaugagccacugcacccagccuaucucagucauuucuuucauaagagucuaaaggucauccaaauagaacugggagaaaaacaauacaccaggaaguaacuugaaaaacacaaguuuaccaguugaaaaguguggauuaaaaaaauauauauuuuugcugauuucuuuaguaucuuuucaacauucugauuccuuccauuuuuuagggaagcuagagauugcauuuuuaagaggcaauagagaaggucuuuuucuacaaccuuagauaacaggcacugaaaaagaaaaauuacacaaauauagguugagcauccugaucugaaaacucaaaauccagaaugcuccaaaaucugaaaauuuuugagcaccaauaggaugcucaaaggaaaugcuuuuuggagcauuucagauuuuggauuuucagauuagggaugcuaaaccagguaguauaugcaaauauuccaaaaucugaacagauuuggccaggcccgguggcucacgucuguaaucccagcacuuugggaggccgaggcaggcagaucacgaggucaggagaucgagaccauccuggcuaacacggugaaacccccgucucuacuaaaaauacaaaaaacuagcugggcacgguggcgggugccuguagucccagcuacucgggaggcugaggcaggagaauggcgugaacccaggagguggagcuugcagugagccgagaucaugccacugcacuccagccugggugacagagugagacucccaucucaaaacaaaacaaaacaaaacaaaaucagaacagauuugaaauccaaagcacuucugguuccaagcauuuugaauaaggcauacucaauuuguaaaauguucaguugaggcugggugugcuggaucaugccuguaaucccagcacuuugggaggcugaggcgggcagaucaucugaggucaggaguuugagaccagccuggccaacaugcugaaaccccaucucuacuaaaaauacaaaaauuagccaggcgugauggcgcacuccuauaaacccagcuauucgggaggcugaggcaggagaaucacuugaacccaggaagcagagguugcagugagccgagaucaugccacugcauuccagccugggugacagagcgagacucugucugaaaaacacaaaaaacaaaaacagagcauucgugaacugugagacaguuggagucucugaaagagacaugagaaacagggacggaaaaaaauuugaagacacugggugaaaauuuuccaaauuugauaaaaacuguaaaccuauagaucgaagaagcucaacaaaccccaguacaagaaacaugaagaaaaguguacaaggcacaucauaaucauauugcugagaaccagugcuaaagagaaagucuuaaaagcagcuggaggaaaaagacacauuguauacagaagcagauuucucaucagcaccaaugcaaguuaaaaguuagugguguaacaucuuuaaagugccaacagaaaaaaccaugccaaccuggaauucuuuauccauugaaauaucuuucaaaaacaaagaugaauuaaagacuuuuucaaacauauaaaaucugcaagaauuaucaccagcagaccuaugcuaaaauaaauguuaaaggaaguccauuauuuacuaaauaaucuguuuuuuaccagcugauuucaaauaccuuugauugaaagaguuuuccuaauuaguuguauaaguuaauuuucucacauuaaauuauccuauauuugguuuugaggaucuugucauuagaaauucuaagccauggugucuaucuacacaagaccccauacuucauuuauuuuugagauggagucucauucuguugcccaggcuggagugcaguggugugauaacagcuuacugcaaacuccaucucccagggucaagcgauucuccugccucagccuccugaacagcugggauuacagauaccugccaccaugcccgguaauuuuuguauuuuuaguagagaugggguuucaccauguuggccaggcuggucuugaacucuugaccucaggugauccgcccgccuuggccucccaaagugcuaggauuauaggugugagccacugcaccuggccuccuuuguuauuuaaaaucgauguuaaaaauaaccacaggcuugaaauccuuaaaauuaccaauguguuuuccuuuguaaucaaaguucuuuaaaguauuccucuuacguagugauuuggggagccuuaucugggucuaugccaugugagauuugcuugaucaucagcuguggcuuggauuuaauauugaaggacauaguuuuuucuucguuguuuagacagaagcucaacaagacagacuccauagcaagaagucucuuguggaauucugucagguaguuggcacacuugugagcuugaugaacaagagaaauauucaacagaagcugauugucauguuuauguuuugucuuucaaaggcauucuggagcugcaagagcagguguuuacaaccucaccaaaucuuuagcuuuggaaugggccugcaguggaauacggaucaauuguguugccccuguagguaaacgaucuauauugaaauuuauugacaaauuaugcuuucugauuccauuugugauguugauagagguauuugguaauaagcaaguauagcauaaaagauugacuuuaaaacauagauaaaauggaaagccuaauuuucuuuuuuuuuuuuuuuuuuuuuugagauggagucucugucgcccaggccggagugcaguggcaugaucguggcucacuauaacuuccaccuccaaggcucaagugauucuugugccucagccuccuaaguagcugggacuacaggcacaagccaccaugcccagcuaauuuuuuggauuuuaguagagauggguuuucaccauauugcccuggguggucucgaacuccugagcucaggagaucuguucgccauggccucucaaagugcugggauuacagaugugagccaccgcacccggcccagaaggucuaauuaucauuauggaaguacucuuugauuuacagccagauugucaagaauguuaaaccagugauucuugauucuggcuuuuuuuuuuuuuuuuuagaaggagucuugcucuguugcccaggcuggagagcaguggcgugaucuuggcucacugcaaccucugccuccuggguucaagugauucuccugccucagccucccaaguagcugggacuacaggcaccugccaccaccccuggcuaauuuuuguauuuuuaguagagacgggguuucacuguguuagccagcguggucucgaucuccugacuucgugauccacccacgucugccucccaaaguacugggauuacaggcgugagccacugcgcccagccuaucuauagaucuuaucucuguaauaucaguagguguuaucugugccacucaaugaagacuaugcaugacugacuucaagcaugaaguuaguaaucucaucucugacaaagguguugcuacuaauauuaauucauguuugccuuccagagacuuuuuugguuaaaugaucaaauuuuaauacuucuagauuuuauccucuuuaaauaaaaggcaacauauuauguaauuggaaaccaauauaucucuccaguaucaguaucauuugaaguuauuaaaacugccacauuuucuaauuuuauuuuaacuucucuuuccgccccuucucuccauaauucaacaguuugaauccauuacaaauagcuguauccugugagauacaauuuuuuuuuuaaauguuugagacaaggucuugcuguguugccuaggcugaagugcgguagugcgaucacggcucacugcagccucgaacuccugggcgcaagcgauccucccaacucagccuccugaguagcugggaccacaggcagguaccaccaugcccagcuaauucuuuuuuauauuuuuuguagagacauagucucccuauuuugcccaggcuggucucaaacuccuaggcucacacaauccuccagcuucacccucgcaaagugcugggauuacaggcaugagccacugcaccuggccugggauacaguuuuugaguaauuuuccugaccuuagaaagccagugaaagauacauuuaaaaauuccuaaacaaugaaaaauuuaguuuauugguauuggacucaaaugcuuuauuugcgauuucaaucuagguaaaaagccaagaaaauauugcauuuuucuaagucucacguagccauugcccagucuucucuuguaaagcagagaagccaaauggaaacuaaaauagacagaguccccugucccauuguucccaguuaagugccucuuucauuuacuuacacaaucaugaccuucagaaaacaagucuuucaugaaaaaauccagggcaugguuaggaggaagaggaggucacaaaauaacuauucagaucauccauuuguggaugguggggacuguacuucuuugacaacauggaggaaauuuaauaucagcacuguuaacuuuuuuuugacuuaagcuacuuaauguuugaaaugccaguagaguaucuugauaucuuuauaauuaaaauuuaauauaauacacuuuauuuugucccuguuuuauuuuuaaacacagggaguuauuuauucccagacugcuguggagaacuaugguuccuggggacaaagcuucuuugaagggucuuuucagaaaauccccgcuaaacgaauugguguuccugaggagguaagguauauuuccagcauugauuagaauugcuguguguuauacuuuggaauuuguaauucagugucauuuuuaugcggucuggacgacauuauuucucccacugccagcagaacauuuccccuguucuuucuggcugucagggauauucugguugugcuuuggcuacugacagcaaucuguacuugagagugaaugugguauaaauuaauaacagcauuuuuuuuguuaguuuguuuuacuguauuuucagcuacauuauuuuauuacauggcauuuguugguacacaggacccuaagcaaauuagacaacuauggccauaugaaguuccacaugagauuucgguuaagguugaagucuguaaaaucagcagcuuuccaaacugccagcagcgguuuuuuuuuuuuuuuuuuuuuuugcuugagacaguguuucacucuguuacaggcuaaguauagugucacgaucauagcucacugcaggcuugaacucccaccuuggccucccaaagugcugggaugaugaugaugacgaugaugaagacgaugacuuuuuugacagagucucuuuguugcccaggcuggagugcaguggcgcgaucuuggcccacuggaacuuccaccuccuggguucaagcaauucuccugccccagccucccgaguagcuggaauuacagauguaugccaccacaccugacugauuuuuguguuuuuaguagaggcgaaguuucaccauguuggcuaggcuagucucgaacuacugaccuuaagugauacgcccaccucagccuccuaaagugcugggauuacaugugugagccgccacaccuagcuuugcaucagucuugaaaugcaauuuuuuuuuuuuuuuuuuuuuaagaaaacaaggccaggcgcaguggcucaugccuguaaucccagcacuuugggaggccgaggcaggcggaucacgaguucagaagaucgagaccauccuggcuaacacggugaaaccccgccucuacuaaaaauacaaaaaaauuacccgggugugguggcggacaccuguagucccagcuacuggggaggcugaggcaggagaauggugugaacccgggaggcggagcuugcagugagcugagauugcaccacugcacuccagccugggcgacagagcaagacucuaucucaaaaaauaaaauaaaauaaaauaaagaaaagaaaaggaugucuuucccacaauaauaaaaaugaaaauaacuaguaguaaacuuaccucuaaaugaaaaaaaaaaaaaaucaccugccuccuuagggcaguaggcagugcaucaguuucauaaaugaaaaaaacaaaacaaaacaaaaaaaccccuuuuucugugaagcagcaaaaagaccagauuaggggcauauaauauuccuugauggggagaaccaauuuuauuaaaaagucagguuucccuaaauuauaaauuuaauaucuuuugggaauuuaacacgcugauucuaucaaaaauauguaugcaaaaauugccaaaaauguuuugaaaaugaauaaugggaggauuacccuucaugguauaaugaaaccaugaagcuauauuuauuuauguacuguguauuuacauacuaugaagcuguauuuauuuacagcaucuggugcugguaaugaaacauauuaaaaauaguagaacagaacagauucuugaauuggaaccauaugugggaguuuauggagucaaaguagcauuucaaucuguaaggaaaggauaaaacacucagcaaaguguugggggcauuuggccguuuaguaauaaauuagacucccuauccuguauuauauacaaaauaacuuucagauuuauugaagugauaauuauaaaagcaagcccaugaaacucuuuaaaagaguuaucaugcuuagaacuagcuuuuauuaucaguuuggugaaugucuuuccagaaauguacuuugcaugcauuaaaaauuuguauuuguugacuuuuuuuuuuuuuuuccugagacgaaguuacacucuucuugcccaggcuggagugcgguggcacgaucucggcucaccacaaccucuaccuccuggguuuaagcgauucuccugccucagccuucagaguagcugggauuacaggcaugcgccaccacaccuggcuaguuuuguagagacaggguuucuucaugcuggucaggcuggucuugaacuccugaccucaggugauccaccugccucaaccucccaaagugcugggauuauaggcgugaacuaccacgccuggccuauuuauugacuuuuuuacgaaaacagaauuuacucuguguuauuuucugaaacuuguuauggguauacuauaauaucaucaaaucccauuaugauuuggauuuuauuuauauuuuuguucuugcaguaauucugcaaugaacauuaugaauauaaucauguacucuugggugaggggauauguuucuagaaacagaguuccugaaccaaaauagacuugcauuguauuuuggaagauacuguuaaaucaaacauuugaugagccauguuaaccaaggucuuuggauuuguauucugaaaacuaagaguaauauuuaaugaauuuuaaucaaggcaauuauauuacauuuuuauuuuugauagaauacuuugggaggcuaggcacaguggcucacaccuguaaucccaacacuuuggaagccuaaggcagguggaucacuugagguaggaguucaagaucagccuggccaacauggcgaaaccccgucuauacuaaaaaauacaaaaauuagccaagcaugguggcauaugccuguagucccaguuaccugggaggcugaagcaggacaauugcuugaacccgggacacggagguugcagugagcagagauugcgccacugcacuccagccugggugacagugagacgccuucucaaaaaaaaaaaaaaaaaaaauauauauauauauauauguauguauauauauauacuuuaugugguuuacauuaucuauauuugcuguauuagaaauuaaaaccaaaauuuaagaaauauuauuaauucauuuuaaaauaguaauaaaggaguacauguuaacauaaauaacauuuacuuuaaaauagcuacauuuaaaaaaagaaacaaaaacuuuuuuuuuuuuuuuugguucaagcgauucuccugccucagccuccugaguagcugggauuaacagucaugcaccagcaugcccagcuaauuuuuguauuuuuaguagagacaguguuucacuaagcuggccaugcugguucgaauuccuggccucaggugauccaccugccucggccucccaaaaugcugggauuacaggcgugagccaccgcgucuggccgguuuuuuguguuuuugagggagugugguuuacagauuguuagagguugugacuacuugggugggaugguuguugucuggauggcauuucagaaaggagcucauuggagcaagucucuuuuugaugcgcugacuuuaacaaacauguucauuggcugaguugucacuacuggaucaaacaggguuaaaaccagcucuguugcuuguuaccaugucucaguacaaucugccuuuucacaguaaugugggaccuuuuaaauagugaauucuauaccagcccuguccaguagaaauauacuaauagucacauuuguaauuuuaaacuuaccaggagccacauaaaguaaaaagaggugaaauuaauuuuaauaauauauuugacuuagccuaauacauccaaaacaucgucauuucaacauguaaucaacauggaaaauugagaugauuuucuucaucccucggagcauccaggauuaaugagauauuuuacauuauuuuucccauacucagucuucaaaauccaguguguguucuauacuuacagcacgucucaauuuggaccagucauacugaaaguguuugaguaggcgacuaugucuaauggccucguuuuagauagugcagcacuguacuagcugcugggaauacaaggauggagagaaggcuuggcugcucuccaagcucuuagagucucaaggagguauagccuugugaauauaggaccaggacugggaugaggcaagcaaggcauggacacaaaauuuaaggacccacucccucugagggaagauuuugcacuugugcaaaccugagagugaauaccuccuuaaaucuugcacccucgacaccuuauuugccucacccuaguccuggcccugccugggggccuuuuaaacugcagauucugggaccccaaccccagagcuuacaauugcaaugauccuggaaggaucuaggaaucugaagucucaguaagcaucccuagugauucuaaugcagguguuuuggaucaucacccuuugagaaacucugcuucuucccacagccucaagugagagcuccuuuacaagucagugaaauaacuuccuucuguuuggguugggaguagauguugcugaacucaucaguucccuauuugaauuuuuaaggaguacagugggagucugaagugccuuugguuuauuuuuauuuuuauuuuuuugaaauggagucucacucugccacccaagcuggaauguaguggugcagucuuggcucacugcaaccucuuaggcccacgcaaugcucccaccucagccuccuaaggagcugggaccacaggugcccgccacugugccuggcuaaguuuuugaaguuccucuuguagagagcuccuuugaauguguguugcugggcuuuuggccugacaggaccgcagacugaacaaaccagaaugcuaguuuauugcuaaacagacacauugacuauuucagggaccaaaacauaaaaggcacgagguagugauggaaaaugggguuguggaggacaaugaaaggcauggaaggaagugaauuguuugaaaugggaaagagcagagcugaagcacugaguucacuuauggcuucuugacgucauguagcuugcuugacaucgucuaaggcucccucauaccuugccaccuuuacccuagucaccuaccugauuucggugaugcucagguagaaagggaaauuguaggaaaaggaaguugucuauguacugugagguuguggugcacaugcacacacuguuggauucauguuacaaucaugggcuuugagaugccuuuacuggggaaugugaggcgguuagaaauggggaguauuugcuuuuaccuaugcacauguguguuucuguuuccaggucuccucuguggucugcuuccuacugucuccugcagcuuccuucaucacuggacagucgguggauguggaugggggccggagucucuauacucacucguaugagguaccaggugagcagcugaggaaugagcagucaccagcuuuaugcugugucauguucagggguuuaaaauuuauuauaaguaguuacuuaagagaugagggugcucucuuauagaacaucaaaauguacaaaauguuuauauucaugaugugauuuuuuuaaugaaauauuccuagucacagaaaauaucuaacuaucuauauuauggaacugagcuuuuugugcaugcauagguugguggaauuugaacccugaaaaauauucucaguauauguuucgaaagaggagacagaaaagaggcaagagcaugcuauaguuuuaaagauuuaauuccauuuuguuccuccaguaaauggcuuacauaucugagcagaagaaucaggccugcuaggugggguggggugcuauggugcuauuuugugcucucuuugagauauauauugaaugaaggcauaugaaauuucuguauucaucauuuuugauguacaaaaacagaaauuuggccggguaugguggcucaugccuguaaucccagcacuuugggaggcugaggcaaguggaucacuugaggucaggagauagagaccagccugguuaacacagugaaaccccgucucuacuaaaaauacaaaaaaauuagccaggcuugguggcgggugccuguagucccagcuacuugggaggcugaggcaggagaauggugugaacccgggaggcggagguugcagugagccgagauugugccacugcacucuagccugggcgacagagugagacucuuaucucaaaaaaaaauauauauauauacgcauacauauauauguauguguauauauauacauacauauauacguauguguauauauauauacacauacauauauacguauguguauauauauauacacauauacguauguauauauauauacacauauacguauguguauauauauauacacauauacguauguauauauauaacaguuagucgggugugguggcgggcaccuguagucucagcuacuugggaggcugagguaggagaaucacguaaacccaggaggcggagauugcagugagccaagaucaugccacugcacuccagcuugggagauaaaccaagacucugucucaagaaaaaaaaccagaaguuuuauaaguuuaaaucaaauauugauauuacaugcaaaugccuuuaugugugugugugucucaugacuagauaacagaacuuugcgguuugaaggguccuaaaagaucacaaaguccaguauccuaguuuuauaaacaacaaaacaaauccacagacguuaaaagguuuaucuaagcuaauaacucuaaaucacuccaaaaauguaguaaaggguauaaaaugcaaauguauugaauuucuguuguuaaagauaauuaaguggcuacuagcaaauuaauagaugguugauguaacccaggugaaucugaauuucauaucaaggacccagggucuacguacucuuucaggugcugacagucugaucaaggcuuaaggccuuuuuugcguuaauaaaugauugguguaugugagaggcgagcaaaaacucaaacugguuuuccucugcucucacaacacaacaaccauuagcacggaagacuucugugaccaguuguuugggguuacuucccccgcacagcaaccaagcaagcaguucugcagcagaccccagcugggcguccucucauucaguucugacacuggagauaggaucagaucccacaggcugagggcucagucccacaggaugcccccugcuuuggacaccaucacaagucugggccucuaaaacuucugacugacuagcuucaaguugggguucccacgacccccucuuuggguuggaguaauuugcuagagcagcucacacaacucaggaaaacacuucgauuuacugguuuaugauaaaggauauuacaggagauacagccgaaggggugcacagggcaaggcaugugagaaggggcacguagcuucuguguccuuuuuggccccaccaccugccaggaaccuucauguguucagcuaucuggaagcucuugaacccaguccuuuggguuuuuauggaggcuucauuacauaggcaugguugauuaaaccaucagccacuggugaucaacuuaaccuucagccccucuuaccuccccagagguugugggguggguaugggcugaaggucccaacccuguaaucaugccuuggucugucuggugaccagccccuauacugaagcuaacuaggggcugccagccaucagucaaucauuaacauauaagaacacaucacuuuggcgagucuaggauauuaggaguuguaugcgggagaugggguugaagaccaaauauauguuucacaauaucacaguauagaacuuuaauuuuacuuauuauuuuccccucccacauguauuucauuacuaauaacaucaauguggugauguccauaggauacuguaguuuuaagggucuugguuggaaagaagaaauaccuacaugguuuugccauauuguuuucugaaaaaaauuccaaguagugaggguggagagaaucuuuccacuucucucacaguagacuucagucacuauuucuuaucgcagguugcacuguuuuaccuuuagaagggaaagaaauuucaaauagcuucuuccuuaggccuucagugacaugauuuucuuuuguaauucuaacacuuuuuaucauuaaaaauauuuuuuucaguuuuugaggaaagcggguacaucuaucuuuuaagaauauacugccccccgaauaaugagauuauucagccuuucacuaugguguuuucuuuuaagauuggcagcuccaaggugagaaugccuaagauggaaacuuggcucuacccuuauuagccguaugauugugagaaaguuaauuucuauaagccucuauuuuguuccuguaugcagggacacauacaguauuuauuucauagagcuguugggaggauuaaauuagauaagggacuuuuucuuuucuuuuuuuuugagacagagucucacucuuguugcccaggcuggagugcagugacaugauuucggcucacugcaaucucugccucccagguucaagcaauucuccugccucaggauccagaguagcugggauuacaggugcccgacacuaugccccacuaauuuuuuuguaguuuuaguagagauggaguuucacuauguuggccaggcuagucucgaacuccugaccucaggugauccgccugccucggccucccaaagugcugggauuacaggcaugagccacugugccuggccuuagauaaugcacauuuaaaucccuaugucaggggcugggcaccauggcucacaccuguaaucucagcacuuugggaggcaaaggugggccaauugcuugaucccaggaauucaagaccagccugggcaaccuggcaaaacuccgucucaacaaaacauuuaaaaaauuagccuggcaugguggcaugugccuguacuugggaggcuuaggugggaggaucacuggagcccgggaagucgagguugcagugagccaugauugcacaacugcacuccagccuggcugacagagcaagacccugucucaaaaaauaaaaauuaaaaaaauaaagucauuugucgaauuggaugcuuuuagucacaacucaaaaugggcucaucaguaaaggaauucgcuggcacauaacugaaaaacagguaagacuugacuuaguagcucacugaucucaucaaggacaaguuuuuccccuguuuccuguuuuugccuccaugguguuggcucuaucuuaaggcaggcucuccucauugcaggauggcugccugcuguuucuauguguaaggcugauacuucuguguucauacccagaugcacagagagagggcuggaggagugacuuuguuccagaauuucuaacaaaauucugagauccacucuauauucgaucaacuuaugcaaauguccauuuccaaccaauaacuguggcgggguuauagugcacugacugacuuagcuuagaccacaugccuuggugccaagcuucccuggcaccuucuagaucguuaaauggaaacaagcuguuggaaagaagagauggggaccuggaugcuggagaggcaaguagcagugccugguacaaaguaaggacacuauuuuuaaauugugauuauuaaggagacacuauuuauugacgauccacaguaugcgaagcacugcacacauggugucauauuuaacccucacaacuuuaaaagguagauauuguuguauccuuuaauagaggaggaaacugaggcucaggaagagacaugugcccaaauucaggaaagcuaacguguggcagaccugagauucaaauugaagucuuuucucaaauguuugcccuaaggauuuauuuuuuggugcugagaaaaugugugaaccagggaaauuaacaagaggauuuggugggagugaagagggcaaaugagauuugcaagugacaggaggcuuuccacuucuuuaacagaucaugacaacuggcccaagggagcaggggaccuuucuguugucaaaaagaugaaggagaccuuuaaggagaaagcuaagcucugagcugaggaaacaagguguccuccaucccccagugccuucacaucuugaggauaugcuucuguacuuuuuaaaagcuuauaguugguauggaaaacauuuuucuuauuuuuaaguguuauuaauuauaucuauggaaaaacuauuccugaaauauauacagucuuaugucccaaucagagucuuuuaaccuaugauuuaaaaauguauaaguaacagaaauuaacauauuuuaaugacuuuacuuuuuauuucuaagaaaaguauuugaaaaauggaauaauuuuaaaucaaugauaauucuagggaucaugaacucccagaagauuuuauuauuuaauuguaaagguagaggccagacgcaguggcucacgccuguaauuccagcacuuugggaggccgagguaggcgggucaguugaggucaggaguucaagaccaggcuggccaacaugguaaaacccugucucuacugaaaaacaacaaaaacaaaaacacaaauuagucgggugugguggcacacaccuguagucccagguacuugggaggcugaggcaggaggaucgcuugaacccaggaagcagagguugcagugagcugagaucaugcuacugcaguccagccugggcuacagagugagacugcaucucaaaaaaaacccaaaaaacaaaaacaaacaacaacaacaaaauuauaaagguagaaaauaaaccuaaauugugucguaauuaagauuauuaaaauuagaauuauacaaugacuuauuuuugguggcaaauacuuuaggagcaauaaugccuuaugguaauuauugauguauaguuucuuuuguuuaugaagucaaauuuguauaaauucucuuaauucaaagaaaaaguuuuaugugauuua

SEQ ID NO: 191121 - RNA, 20918 nt, Homo sapiens
ggcccggccccgccccgcccgccggccgcggcaaagccgcauccucccggagcagaaccgcuccccgccggcuguccgcaaccuccgccagcgucggucccugggcaggugugggugagacugcucguucguuucuuuaaauuucgaugccauuggggaggguggaagggaaaugcaaaaaaaaaaaaagaagaagaaagaaacaagcagggugugcucuauuucaaaaauucaauccucagggcugaagcucucacgauuaauuaaaauuaaaucuccagugcagcuggaaaaagaaaggcugcugcucggcgcccucgcugcgcccgccugccggggucggacgucggcgaugcuguggcuccaggugcugugugccgcuggcugggaaggggagaaagggcaggcuuagcugagggggagaaaugcggcuuucagauccuuucauccuucgggagggagcccgggaaagagagugaaggggaagaggagaugcgguugcaguuuuccacagaaccaagagaauaaacgauuugaaaaaauaaacucaggcccaccuccgucucaccucccacuccccacccaagaaucaaggggaaagaucaucuuuaccagguuugagaccugauccauuucagcugagcugcauagcgaguccagaagaggaucuuuccuugaagggugcacgcuuccugcaagaugcaucuguagguguuugagaucauguccuguaguucauuccuugugcaggagggugagcccgcugaggauggggaaaauuucucgucuguguuauggugcccaguaacagugauuuauuauucagaucugcuccuuauuuuucaucuugcuucccgcucugaacccaccagagugagauuacaccuggacuggccuacugagacuucacccuaagaacuuggucgaaugugccaguugcuguggucuuaacaauccagaugggaugcuauuucuaaggcuguugucagaguguugcauuuuccccggacagguauuaaaauaauauaaaggcaaauaaaugccaucauccuuuuguuggaccuaccaccuaggauucacaaagccaauuggaaaugggucugguugacagaggaaucagaccaucacuuccuccaccaggucccacccaccagcgaggcugcaguucuuguuggacagcuacacuucccuguugcuccauccucuuguccuucucugaucucuuuuuagaaucacuucucccucuaucuuuguugcugacagauucaaaucuacacucguuaaagaaaggaauaaaucuccugguuaccauuugcuagauaguuuauccaggaaucacuuaacucuacuacuuaagucaauucuguaguuaggaccaaauuuuuaaaauuacaacgccaucaccuccuuuaaaacaaaguaaauucaaacaggaaagcucaaaguguuguugcagaaacauauaacuccucuugguuugaucccaaugacaagguguuuuuuuuuaaggaaaagaaauauugauucaguucugagggguaucuuauucaagagaaguccagacuuucuuucuuguggguggggacacuuuaaauucuuuuaaaugauaacuuuauugaagauauaacuuaacaugauuuaugcccuggucuggaccuauagauucuuagaggugugccagggugggucagugggaagcuggcugugcugcagcuuccguguggcugcugagcggacugagagugggauucugaugucuuccagugaaacagggacuggggccugcaaaccgguuaugccuacugaggaugacaaggugccauuccucagcugcaaggaaguugcaggaugaacagucagaaggcgauuuuucaugauccaggcagaaccugcaauuaagagagcuuuggggucucuucaagcgaucuuuuguuuaaaauuaggaggcaugaucucuuugccucugccucugaccucugucaggguuugaaaguccacuaauccgcuaaguuccaggccaaaaggccuggaagcagagcaauagaucugcugcuuggaagcucuuuguuuugaaauuuuaguucugccucugguugaggcaucucuuccgaaggcaaccacgccaugcugcacugaccacuccuuugguugaaucaaaugcugcucuucccugugcucugcgucacugcccucuuuguccuggggaaaaaggcauuccuguggccaagguccucccacacccccgaaccucuccccacagcucugucauaccccauuagcaaugacugccuucagcuucccaccccucccccaccccaucugccugguaacuuuauuuucuccccucugcaaagcagcugcuagcucagacugacaggggcuugugggauucucgacauuuagacucccagaaucucagugcugagagaaugucagugaagcaucugguccugccccuaccuugaagcaaaacuaccuagcaauugugccauaacaaggcauauaaaggagcuuauugaugucuuuuuauuaaacuucuccuuagucucaggcuuucacaaaaaauaagcuacuccugaguugcuaccacuucacccagucacuuaaaaagauuuaucgagcaucuauuuguuggccuacuucuaugguaccacuucauagggcuugaagucuaguagaagagcuaugcaauaaauaaguaaaagaaaaauaaauaaugacaaauguugguaagccuuacacaggaaacaagcuguugugauaaagaauaaugagaggcagagcagggagucaaguuuuuaguucgggugucaagaagggcucagaggaggaaacauuugaacaaggacucaaaaaaacaaaaacgggcacaggaagaggcgggguggagcagcagagcagcaagauagacagcaguuaagaagaccucaagcauuuggaagcauuuggugcucuugaggaagaaauacacagccagugugauuggagcauaguaccccuacuauggugguacagaugggguggcaggauggggagguccuuaggccacauggacuuccacauguauaacaguaggaaguuacaggaggauuuuaagcagaaaacagccugauuuucuuuuuuauuuuuauuuauuuauuugacauggagucuggcucuguaucccaggcuggagugcaguggcagcgaucucggcucacugcagccucugccucccagguucaaacaauucuccugccucagccuuccgagaagcugagacgacaggugcgcgcugccacgccugaccaucugauuuucuuuauguuuuaaaaagauguuucuggcuggguggcucaugccuggaaucccagcacuuugggaggugaaaccccaucucuacuaaaaauacaaaaauuagccgggugugguggcacacgccuguaaucucaucuacucgguaggagaaucaggugggggagguggggguugcaggaagcugagauugugccacugcaguccagccugggugacagagugagacucugucucaaaaaauuaaaaaaauuaaguaaaagauguugcuuacugcugagugaggaauugauuggaaggcagcaagaguggaagcuggaagauaggagcauuuuuuuuagaaccacaguuaagagacaguggccuccuagaccagaggggaagcaguggagaugggaaaguuggguggaugaauuuaagaauuaucugggccgggagcaguggcucacgccuguaaucccagcacuuugggaggccaaggcgggcggaucaccugagguugggaguucgagaccagccugaccaacauggagaaaccccuucucuacuaaaaaauacaaaauuaacugggcaugguugugcaugccuguaaucccagcuucucagaaggcugaggcaggagaaucgcuuaaacccaggaggcagaaguuguggugagcugagaucacgccauugcacuccagccaaggcaacaagagugaaacuccaucucaaaaaaaaaaaacaaaaacaaaaaaagaauuaucuggauaauuuuuuucaagaguggcuuaaaagcaguuauucuaagcacgaguuccagaguaugagcauguucuuaaaaaccuguuuucccuccuacaaugaccaagaguacagagcuaaugguugauugaagcuaacacucuguaauaucacauuuguaagaaucuuuuuuuuuuucugaggcagagucucacucuguugccccggcuggagugcgguggugugaucuuggcucacugcaaccucugccucccggguucaagcgauucuccuaccucagccuccggaguagcugagauuacaggugugugccaccaugccuggcuaauuuuuguauuuuuaguagaggggguuucaccauguuggccaaguuggucucaaacuccugaucucaagugauccaccugccucggccucccuaagugcuggaauuacaggcaugagccaccgugaccagccuguuaauaaucuuuagacuggaaguggaaguggaagaugggcacagcuuaacugccagagaaaagaacaaaguccucucucuucucucaagucuauugauuaaagccuuggaaauuggguaaaauuuucuuuuaaccucucucuugugaaaucuaaaaggaaggagaaauguuuagaaccugcuucucagaucaaauacuuacagcauaauaaaguauacaaaaauggggaagagaaucaagccuuucuuucuuaacaguuguuuaugucauauuucugguaagacauuuucucuucuguguccuaugaagucaacaaguacauacugacuuuguacuacauguccagcccugggguuuucccauuggugguuaagaagaagaguaagacaguuccuaaacucuagaaguuuguuaucuaccuagaaagaugaaugaaaacucaugaugccaucuauaaucuauacaaugauaugaaaugcugcauaauuaaguauuaaguguaugguucagauggcaaaugcuauuaaauuacaaauagaaggaggcaaaagaaagggaauagaaacuaauauuuaugaagugucagucacauauuaggcauuuuauacugggccauucauugaauucucaccacacaccugcaacacaggguuagggugggaggagaggacgugggggcugggguagucacagaaggggacgugagcgaaugagucugucuugagccaggcuugaaagauguggagaagcgugacaaagaugaagaaaccaacauaagcacauguguugaguagucacguugcaggaaagggaaggggaaaauugcuacugaauccuaggguggggugcaaauacggagagccucaaacaccagacaggccuucagauauauuuuagucaguaauggcaagacaaaauaaaaauauuguuuuguuuuguuuauuaaucaccauuaauaugguaaaaaaugguagaggaaugucuuccauuuuagaaugucuuccaguuuagaggaaguaguaugaaggcuguauucuggcauauggugguaguagaaauucaaaugaacaaauuaacaaaaagauuucauaggaaugacuagcaggacuuagagacuaauuauuauuagguauauggaaauauguccuuaauauaggaaauggguucaucaaagaacauucuagaaguuuauagaucuuugcauaaauguuggcggguaguauggcacaaugaaaauaacaugggcuuugaaauuagcaaaccugggugucaguuccagucccaccacuauacuagcuauguaagcuugagcaaauuucuccucuaaaugggaauaauaaagguaccuacuucacugguuugcugugaauauugaacaauacgauuauuguaaaguacuuagagcagcacuuggcacacaauaaacauccaauaaguuucuguuguuacuauuauucaguccaaguguccucuucugcaaaauaauacuugcuucauaaaauuguuguaccuaggcugguaugguggcucacaccuguaaucccagcacuuugggaggccgaggcagauggaucacuugaggucaggaguuggagacuagccuggccaacauggugaaacccugucuguacuaaaaguacaaaaauuaauugcacauggugguguaugccuguggucccagcuacucaggaggcagaggcacgaaaaucgcuugaaccuggaggcugagguugcagugagcugacauugcacaacugcacuccagccugggugaccaagcgagacucugucucaaaaaaaaaaaaaacaaacaggccgggugcaguggcucacgccuguaaucccagcacuuugggagaccgaggcgggcagaucacaaggucaggagaucgagaccauccuggcuaacacggugaaaccccgucucuacuaaaaaagaaauacaaaaaauuagccgggcgugguggugggcgccuguagucccagcuacucaagaggcugaggcaggagaauggcgugaacccgggaggcggagcuugcagugggcugagaucacgccacuacacuccagcuugggcgacagagcgagacuccgucucaaaacaaacaaacaaacagacaaaaauuguuguaccuagaacaacuaugcaauauauagcacauaguguugcuuaauaaauauuuacugaagcugggcacaguugcacaugacuguagucccagcuacucaggaggcugaggugagaggauugcuugagccuaggaguucaagucaagccugggcaacauagaaagaccccaucucuaaaaauaaaugaauacguaaauauuuuuugaauguguaauucagugagauaaugcauguacuguauaaucaacacagaaccuaccaaauuacacaaucgguaaauuccauaaauguugugguguuuccuucuuuaucccuuucuccuuuccuuucccccuucuccuuuuuucucgguaacacugagagguucucugcuguaaauaaagaugaguuugguuugaacaugcuuugcuaaauaauucaauuagaaaauauucgccaggcuauuggagauacaaucuugagaucuacauuugggcguucuuggcauagaagugguccuacagcugugugcaggaaggcuguauauuuuaacaagaggaacagagugugcuguugagaauagaggacaaugaauuaagaaucgggccuagaaaacacuggcaauuauggguuggagaaagcagauaagggagcaaaagaaacagaaggaagguuugagagguaaaagagaaugagaguagaaaguuaaaggaggugagggaagguucaagaaagauuugggaauuaguggaaucaacagcuuuggugugacaaggagaauaagaauggugaaguggucacugugaucacaucagggacuuucaagacuguuucucaccaaaaugaguggaucugucaucaaaugaaggagaaauaggguuuuggacagcaaacaacagaaccaaaaaaccaaaaaccaucagcuguucacugcagcuacuaccacuugacuacuucuauuuuuaauuuucauuuuauuuuauuuuacugauuuuauuuuugagacagagucucacucucucgcccagacuggaugcaguggcacgaucucagcucacugcaaccuccaccucccagguucaagcgauucuccugccucagccuccugaguagcugggauuacaggcgugcacaaccacgccaagcuacuuguauuuuuaguagagacaggguuucaccauguuggccaggcuggucuugaauuccugaccucaagugauccgcccaucuugcccuuccaaaaugcugggauuacgggcaugagccaccacaccuggccuugacuucuucuaaaucuugguggggaaauccuggacuuuagaguuaugcaaguauagaauuaaacccaaguucucucacugcuauauuuaacgcauugaaccuaauaggucaaguguggaaaauaagaccuaccugucaagcuuguugagagaugcaaguaagagaacaucuauaaagaguuuaccuuacagccugacacauaaggcucaauaaaugcuaauuuccuggccuauuucucaucuuugcaagugacuugcgcgugugcgugcgugcaugugugugugucuguguguguacagagguugggaguggggagaaagggcagaagauugcaggaugaacuggauaugaguggcuauaaacuauuugauagaaaagcuugguuggagaaaaaugagauuaucagagagaguaaaguggcaagguaaaguuauuuuuuucuagauaaggaacucugaguuugaaggcaaaggggaaagagccaguagaaggaaguuggagcuauuggagaaggaggaaaucaaagaugaggaagagauggggaucaagagucaaguugggguggucaaagaaaauaccuguuuucagaccacucaugcuggggaaggccagccacuguuguaaggacacucagauggcccauggagaggcccauguggagagaaacugagucagcauuacaugagugaaccaucuuggaagcagaucuagccucauucaagccuucagaugacugcagcccugacaucuuuagagaucuugaaacaaaaccagcuaagccacucucacacuucugacucagagaaacuauuuauaggaaucccacagaaauguugagaaaauucuauucacagaauacuaaaagguucagaaaccauaaaaacaaaaaaacacuuuuggaccuccaaauucuauaggcaggaagcagguagagaagacuacucaccacccagcuaaggcacucccaguuuauugacgcacauaauugugugagauaauaacuuuuuuauuguuuuaaaccuuuacuucuuggguaauuuguuacaucacaacagauaauucauauucuuguacugugacaucugauauauuccagacuugcaggaaacuaacaguaaaaaggauccccaaauuuaggaaaacacuguuuuuacaguagccuugauaacaaguagccaccagaacuaguuuuaaacauguucaaucaacaacugccuaagugaauacauuuuugaaagccaucaucagagugccagacccugauuggccaaaagucaacucacacuagugugaaagucagccaaacagggacagagccacucaccugauugacuuucagaaacaaaggacugacuggauggguuaauuuccaaaaacauguuugcugaguguuaugguaugguuuguuuuccccccaaauccauauguugaaauuucagcccccaaagugauggcauuaggugaggcuuuaugucaugacgguggaguccucaggaaugggauuagugcccccauaaaagagacccagaggcuaggcucaguggcucacaccuguaaucccagcacuuuggaaggccaaggcgggcggaucaugaguuugagagcagccuggccaauauggcgaaaccccaucucuacuaaaaauacaaaaauuagcugggcaugguggcgugugccuguagucccagcuaauugggaggcugaggcaggagaauugcuugaacuugggaggcagagguugcagugagccaagauugcgccacugcacuccagccuaugcgacagagugagacuccaucucaaaaaaaaaaaaaaaaaaaaaaagagagagacccagagagcuagucagcuccuucagccacgugaaaacacagugagaaggcaccaucuaugaaccagaaagugaguccuaccaaaccccuaaacuugaucuuggauuuuuugcucccagaacuguacaaaauaaauucuuguuguuuauaagcuaccuagucuaugguauuuucuuauggcagcccaaaugcacuaagacacugagggagauuguuguugaucaauugaacagguuuaaaacugguucuauugucuacuuaccaugacuacaaaauaacccaucuuuuccuaaguuugugggaauguuuuguagucucaaaggauaguguucuaauuguagggagaugaggaaaucauguuucaagguaaaucaaggacagugucucuguccugugacuacuguaaguagacauuggcugggcaccuuucuaaaaugagcugugccugaagcaaaaauagccccccuaaggugaauagccaggagcucacccuuuacauuucauauuucuugucuaagguuuuaaugggauguucaaaagucaucucucuuuuugccucugauaggauugucccucuccuccaucagccaacaagaugaccauguuuaucuuuuauauccccaagagacuccaaagcuucucuuagcuacuauuuucuguacuagucugucccugggcucaggaagcucuuccuguuaucuaacauuggccucucccauugugcccaaccaaaucaagagugucgaacacuacaccuuuuuauguuuuuuuuuaauuaaauuaauucuuuuuuugagugauucgcccgccuugaucucccaaagugcugggauuacaggcaugagccaccgcacuuggccacuuuuuaauguuuauaaggcccauuaauaagggucaucaucuccaugcauguguucacuuugcccugccacaucuuccuagagcaccacccccucaacaaagagagaggaaaagggaacaagaaguaugagauuugcaacuugccuucucacguguacucuuuaacauuucugucucccuucugaacaucuugguacaucuuuaaagaaggaguaaggaguacagaacauaaaccuucucccagcucugaagcucugguccuuuaaucuccucggggucucaaccccuaguuugaaaauucaugcuguauagaagggccaaagaaggcccuucacaagcugccucagaaaacaacagagagaaacagaugaucuaaguaggaaaacacgguggauuaggguggccucccaagcugugaucauugcaccuucaaguaaguacaaagugguuuguucagaggucauuccuaccauagaauuaccaugaugcagcuuucugagugucaguguauaagaggacuuggaccagggaaaacauuuuuguauuaaacauagacacuuagagaguagaauuacaaauguauguauauacacauuuguauauaaauauacauauguauaaguacauauauagauauacauauauauguauauccuggaacuuaacguaauaaugaaguguguguguguguguguguguguguguguguguguguauacauauaaaaucuucaccuggggguggauugcauucagccuccccauucaguuuccucuggguagagguccacuguccucuguguagaagccacuuugguagaagagcccuggucaagcucaucaaugcccaaggccugcucagcauucuaaugguuggauuaauuguccucuggagcuauuuaccuugggagggcucucuccccugcuucuuccuguguacauccuuguacuuuuagacaccucagccaaaugaaucuccugguccagaaagcuccauggauaagaauuuaaagauaauggcuuucauucugccccuaguacacccccuagacaaagucaggcagugaggacguagugaaaccugcccauuucauccuguggauccuaccacuaagauucucaauugugucgcugggugccugauuuauuccaggcauuggguuaagugcccaguuauaaaguuaauuuagauccaacaucugccaauccaauggaaagacaaagaaaaucaacagaggcuagaggaaauacugggugagagggcagcagaggagaacuccccugccuggagggggagaaaaagccauuccauugagcuuaaaauuuaccuaaauuuuagaaacauugaaaugagaaaaaaaaauauguauucuggcauuuuaagagauaugcuauacaguacuuccugucacaugguaauuaccaaagauauauaaauuugcuucaaaaugaauggagccuaguggaauucuagagccuaguggaauuuuugcuucuuucuucucuccacugccccacucccauccacugggccagaacacuagacauugggaacauuugaauacacaugagagaagaagcuuuauuauuggaaauaaagggauggcaaaugguguacauguggcaguaaaauaaggcucagagagcacugaaauacagugagggauuugggaguugggaacaaaaguaacagccaguaaccuggaguugcugaagaguguacagccucgaggaguguggggcggcaggguugugaguagaagcuugcgauucugaauaauaugcacaguuauuugaaaaguggggaauuuuuugguaaaucgcuuggaaacuuuuuauauccauagcggguaccacuauaguucauaaguuauuuuucacaguauaaaugccaauaauauugcauaacagcaggaccauuugccucuuucacuaggauuaaaacuggguauguuaaaagugcaugagaguauucuagcuaauaaaugaagaagucagagaaauggaauaucauuuuguaacccccaugauuuaauggguauagucaauggccauuaacgggcuguuaacuucacaaaaagagucaaccagacauuaggggacuucuaauggaaguacaaacaccaccucuaaaauuguccugccaaacaaaacaaaccaucaaccaaaaaaauuucaaugugaaauugaucaagacuuucuauuuagcuaucaacucauaacacagaguucagaggaacacacuguggggaugcaaucagcaaaacccaggcuaugagaaucugcaagauaaaugacccgcuuucuuuaacaaauaaguuaccaggaaaaaaaaaugaaggacagauauacagaccugcacuguccagaacagaaaguggagagacacuguuauuuuaagggggaaagugaagccucuccaccgcucuugcagcacgugauaggacacaucccaguaacuuuuugagauugugggcugacaagaagccaggagacagauuuccuuuacagaauagcaagguagacacaguuggugagguuguaccauuugaguggcuugcuuaauguuguauuuauccauuugaguauaguuuuaauguaugauucaauagccagaagucuggaauacuggucccagccaccuaugguucuuuuuucuuucuuuuuuuuuuuuuugacagagucucgcuccgucacccaggcuggagugcagugguacaaucucagcucaccaggcucaagcaauuuuccugccucagccuccuaaguagcugggauuacaggcacccaccacuacaaccagcuaauuuuuguauuuuuaguagagaugggguuuugccauguuggccaggcuggucucaaacuccugaccucaggugauccacccgccucggccucucaaagugcugggauuauaugcgugaaccacugugcccagccuaccugugguucuuaacucucaccuacugguaaggcuuccucacccaacuuccuuauacucugcaugcuccaacuagaggcugauuuauacacaaaaaucgguaacacaagcagacuaugcuaacuacuuauguauauaaaauaaagaaacaauaauuguugacuuucauaugaauaaggaaaaugcaaauuaugacaacaaugagauauaguauuccuucacauggguuuugccaaauauuauauguuuguauaaaugacaaaaauauuacuguagcaaaaguuuauucacugucuauuauaagagauuuagauugcauucccaaaauaaaguauugcaagaaguaaagggagaggaaggcuucugcuaaguugaggaucguuucccacauuccuguccaucucaccccauuugcuuccuguugauggcuuugcuuuccuaucuuucagguggaaugcauccuugggacaucuuugcauagccccaucuaggaagaaguucugugaugugugaacugugaguuuacucaaacaaguccaacucuuuauaagacauagguagacgucaggucuggaauggaagagccaacagcaguagaaggccagguccagcuuccaagcccccaccagggcucucucaggaaggcuguggcugcugcccuggcgcuggauggggaauccacaauggggcacaggaaaaagaagaggaaagagucacgcccagaauccaucaucaucuaccgcucagacaaugagaaaacagaugaggagcccggagaaucagaagguggagaucagccuaaagaggaggagggagaugauuuccuagacuauccuguggaugaugguaagucucucuagcccacuuguuuaaagccaugggaaggaaaccaaaagggcaucuuccagaacagacaggcauaugcucacuguccuauuucuucuuggugauacauuucuucuugcaauauuaccaccuuuuauuuauuuauuuugagacagagucuuguucugucacccaggcuggagugcaguggcaugaugucgccucacugcaacuuccaccuucuggguucaagugacuuuccugccucagccuccugaguagcugggacuacaggcaugugccaccaugccgggcuaguuuuuguauuuuuaguagagacuggguuucaccauguuguccagguuggucucgaacuccuggccucaagugauccaccugccucagccucccaaagugcugggauuauaggcaugagccacugaccuggugcaauauuacagucuucauucaacaaauggucaguauuuacugagcaccuauuacauuuuuuucuagaugauacagaaaucuccacccuuucagaauuccuaaugaaauggaagaggcugauuuauacgcaaaaacugguaacacaagcagacuaugcuaacuacuuaauguauguaaaauaaacaauaauuguugacuuucauaugaauaaagaaaauuaugagaaaauuugccagaagaaaaucauauggcaaauuaugacaacaaugagauauaguauuccuucacauguaggcuugccaaaaauuggguaaaaugugauuacaucaauaugagcaaauggauauacuucaugcaccuuagugaaaguggaagccgcuucaaccacuuuguggaggaaacuugucaacguuuauuaaauauuuaguaaaauucacaguucaaaacaugcauaccucaugacccagaaauucucaauaucuacuccaugaaacuuaugcccauguuauccuuguauaaggaggcauauauaagaacauuuguugaagcuaaugcaaccaugauguguuuguauuaagaauuauuguggaggcugggcacgguggcucacaccuauaaucccagcacuuugugaggccaaggcaggcagaucacguggggucaggacuuugagaccaacaacaggaguuugagacuggccaacauggugaaaccccgucucuacuaaaaauacaaaaauuagcagggugugcuggggcaugccugaggucccagcuacuucaaaggccgaggcacaagaauugcuuuaaccugggagguggagaaucuguguuucuagaaugcagagguugcagcaagucgaaauccugccacugcacuccagccugggugacagagcaagacaacaucucgaaaaaauaauaauaauuauuauuauugugcagccguagagagaugaggcagaucuauuuguguagauggauagaucucuaagacauaugcucacagugaacaagauaagcaauuucucugcucuccugcaguugaccuucagggaaagacagauagugaacaagucaacaaauaaaagauacuuucagguaguaguaugaguucuaaagaugacaaaaccaugcugaugggaagaugaguacugguggaggguggaagguggugggggagagacugcaugguugugaaaggcuucucugaggaggugacauuugaauugauccaaaugacaugagggagccaccaugaaaaguucuagggcagaguuuuuggaggagguggaacagcaagggcaaagccucugaggugagagcagcuuuggcccauuuauggaaaggaguuauuucaguguagggaguguaggagauaagagggaggauggugagaggaggacaggaagguaggcagaggcuggaucaugguggcccuugcaggucucgguaaagaguuugauauuuguuucaagugcaagaggaagucaauggaggacuuuuaagcaaagagacaucaucuuguuuauauuuguaaaagaucacucuggcuucucuauaaagaaugaauuauaaggguuaagacuggaugcugaugggagacuauugugucccugcagccucaguagcacuaauggagaaguucgggugauagcaggagaaagcuggagaagagaagcuggauucaggaugcaaucugaacuugcugauugaucagaggcagggagugagggaaagagaggaaucaauaaugacuccugggugauugacuggaaugacagggaggauagaugguggugguguuugcugugaugaagacugugaaaagacagggcuugggagacugcacauuccuuuucucuggguaaacagagucccugccacuauccagggcccugcucuuuagguggcuucaucuuaucucucaguuguggggcaaggaguccacagggcccaagguccaugccugccuaaaggcuguauuuucccauccccacccagacuucuaggguggccagcagauagcuauuugguucugugugggugcguuguguguguguguguguguguauguguggugugcggugugggugugguguaugugggggugugugcgcuguuugugugugucguaugguguguguguguaaugugugguguguguguggauaggcgugggugguaugguaugggggaguauaugguguacguaugugugcgugguauguaugugguauguguagugugguauguauggguaugugguguguguguagaauguguauauauguggugugugcauacggcauguggguggguauguguaguguauauauguggaauguguggggggcagcauuugugugcauguaugcuguguguauguguggugugugugauguguaugugugugugugguguguuauguguguauguugcauguaugugugauauguauggguaugugguguguauaugguauguguauguguuguaugugguauguguggggagguuguguguggcaugugugugguguauguguuauguaugguguuugguauaugugguguggguaugugguguguaugugguaugugugaugugcaugguguguggugugugguguguguaugggauaguguaguguguguaugugguacgugauugggagguggcauguguauguguguguaugguguguauguaguaugugagaggguguauguguaugguauaugugggaugcauguguguaugcgugcagccccuggaugugagggcuggaucaggcaugugaggggcccccucucagaaagcacagaacuaggcaugagaagggaaggugguggccguccaucaguccaguaucuucacagcacuuguuaccuagaaauaggaucaucauuugcaucaugucuguaucaaaguucgucacacuccuccgugccacagagauugugccaagauugaggccccaaaaagcggagagaguaggugaaaagcuuaaccugccucacaauuuuaucagggcccaggcacaaggacugagaguucaugugggagcaauaacaccaguggucacucucccgagggagacccacucaguccgccauugaaucacugacucaggacugugccagaugguguaaaaaaggcuacucuuguccucaugcccagccugggagggugcaacauggagaugcaaugcccacucuucugaucuugacucucaccuccuuuguacccugcagauauguggaaccugccucuggacagccgcuacgucaccuuaacugggaccaucacacgagggaagaaaaagggucagaugguggacauccaugucacauugacagagaaagagcugcaggaacugaccaaaccuaaagagucaucaagggaaacgacgccugaaggaagaauggccugccagaugggagcugaccgugggccccaugugguccucuggacgcugaucugccugccugugguuuucauccuuucuuuuguugucucuuucuacuacggcacuaucaccugguacaacaucuuccucguguauaaugaggaaaggaccuucuggcacaagaucucguauugcccuugccucguucucuucuauccagugcucaucauggccauggcuucuucccucggccucuacgcugcugugguccagcucucgugguccugggaagcaugguggcaagcugcccgggacauggagaaaggcuucuguggcuggcucugcagcaagcugggucuggaggacuguucucccuacagcauuguggaguugcuugaauccgacaauaucucaagcacucucuccaacaaggaccccauccaagaaguagaaaccuccacggucuaaacucccaacaacuuacucccuccucuggccccaguagccuauauaucaucuuaaaauuccagcagauuauuucuuuaaauuacccccuacucuccgcaguucuucugggaaaucagaguccauacugaucaguuuuaccaucuugaggguuccaggagggcauggagcagacaagcaauugugccaaagcaguucacccaauggacaaacucuuuuugauucccugcccuaaaaucaccauuuauuuaggacaauggaacucugcugugugucguuuugggagccuggaaguguuacuggugccuggaacugaggggaguaugugacuaaaugugucagggagaauaaagaaccucgggguaaccaaauccaccaagauaauagacagggauggagugagacauuuaggaagcuggacuaccacaguguagcagaagguaaagauuuguguguaucauuuagauuuagauuuagcugcauagaauuaaaacccuaaaauaucaguggcuuaaacaagauagaaguguauuucuuucuugugcagaagaagucuggaggcagaccauccugggacccugugaaguaauccaggucccaggcuucuucuauuucucuaccauuaguaggaugugacccuucucacccuuauccccaacaucccagugcugauuacaucuucagccaucacauccauguuucugauaaaauagaggaaagggcagagaagcacacacccuuccuguucaaggagacuucccagaagucccacucgauucuucuuauaucucauuggcaagaccucagucacaugaugucaugagcaaaagaggcuggaaauguaguuguuuggcuggguagcuauauucucagcuaaauacuggguucacgcuaauuggcaagaaaaaggaagaaugguuauuuggguuuuguuuuguuuuguuuuguuucgcuuuagagacggagucucacucuguugccgaggcuggagugcaguggcacuaucucggcucacugcaaccuucgccuccuggguucaagcaauucuugugccuuggccuccccaguagcugggauuacaggugcgugccaccauacccggcuaauuuuuguauuuuuuuuuuaguagagaugggguuucaccaugugcccaggcuggucuugaacuccugaccucaggugauccgccugccucggccucccaaaaugcugggauuguaggcaagaaugguuaucuugguaggcaagucagaaucuuugccucacaaugaucauuuaaauacauucagaacccccaaacugcuaauaugguuuuauuuauuuauuuauucauucauuuguuuauucauuuauuuauuuaggccugaaucuuacacagagaauuuauauauagauauuagcuacauauacuuugaauaugcuauacaucgauauuagcaccucacguacuuugcaauuaagcuucuguaaugucaugugauuuguuuuuggaaaggaauaguggacaggagaguacaauuuauaauaguagcauaacucuuuguccuggugguggaggugggacgagguggugauauuuaaccuagauuaaagaccaggaagggaggaauugcaucugccaaaguuuccuccaacagcgaucaguagcccuaaguacaaagaagccagauuuagccuucuguuguuuggcaaaaccucacucagagcuuuacucccucagaccuuucugaguuuaaccacagacaugaucuuugcugugcugagaaacuugugucuaccuggccuguagggaguguaaacuagauuaauacagauuaacagacucugaacuuaaaaaaaaaaaucacuccuaaggguguccuucuaauuucaaaauaucaacuccuaagaggucagcagaauuuggagauuuggguccuuauaagaauagcuggugcucuuuucuuguucaugucucaaaacaaagcuguugagagaacugcugcgaugaaucaaaccagaggaguuugucaugcuccccacagagagcccaggacauuugccugauguauggugcugagcuccaccuucagaggaacucucucuuuuuuuuuuuuuuaaauaacuauuauuagcuugacaagaaaaaaaaagugcccaacaguuuuaguguuaaucuuggugcucuauggugcauuagcagagauaugaacaauuaaaugaagacaaagaaaauaaaaauaaagucugauuaacuuuugcuca

SEQ ID NO: 191122 - RNA, 2556 nt, Homo sapiens
gaguaguucuccuggguccgcucugcgggcuucugggagauguaguuucuggucuguaggcaggacggaaggagcgggggaggccccuuacgcaaacuacaauucccggcggggagcgcggugaagcgggggugggaucugaacauggcggcggugguagcugcuacggcgcugaagggccggggggcgagaaaugcccgcguccuccgggguaaggagagggaccccggggagggcaggacugcagaagaucccuuuucuuucacguccagcccgacgauagcaggaggucagggcucuugguuccuccccacacuuuucugcaagaucuuagagucugggggugcagagaugcucuuuagaggucacccagugcauccccccgccuucggguugcucgacaccuccggggucuugcugcaagagggagcuccuaggaagccuguuggacucccgcgcuccagguguuucacacucaccgcagugcagaggaaagagccccgggcuucuggagguuugaguuccagccccggauaauuagcaguuugaccuugggcaaagcaguuuuucucucagggcuucaguuuccucuuccguacagugcaagggauggaguagacuaucuuuaaggucccuuccagugcuaacauuugcaguuucaaaaccuuuucccggauuuccuucauacgucuuaugugagucccacugcaguccuucccaugcugucgucugaggaagaacagcgaagcuuuucguccuggcaccagggugaugagcccgcagugacguggaaguggcuuccaaaggugccaccucgguggcgauuuucccauuucccuuuggauucuccuuggcacuucuuacuucagacugcagucacuccccuuccccagaucucagccgcuccucccaagcccuuacugccccccaccuccccgcuugcuuucuucucaucucuucuuacugaccuuccuuaccuccauccacagggauucucgcaggagccacagcuaacaaggcuucucauaacaggacccgggcccugcaaagccacagcuccccagagggcaaggaggaaccugaaccccuauccccggagcuggaauacauucccagaaagaggggcaagaaccccaugaaagcugugggacuggccuggugaguuuuaaccaccccuuugcccaccaacggggcguggcuuguaggggagggcaggacuuagaaacuucuccaaguuucagguggcgagcugaauccaaaguugugggaacagaauuguuggguucgauuggaaucucagagggguggggcaguggaggugggaaaguauguggaauugagaagacaguggguuuacuguggaguaagcugaguugaucugauucagacuugggucccuggccucauccucccuuuugggagcuuggagugagacccaaguuuaaguaaguaguucguugagaucaugugagcuuguacuaguuguauaguaguacucagaaggcguuaugaacauugugauugggcucugacucugaccuuaauacauauuauugaccaauauuaaagagaaaggaggaagaaaucaacauuuuuuucugcaugugaggugugccaguacuuugccauguaauguuuuaguguuugagauaaguauuacauccccauuucacagaggaaggaacugagacugagcuaggauucucaccuagucugugacuccaugcucuuucccccauaccaaagugccucccaagcagugguuacuuagcuuaagaggggaaaacugggaggguaccuuggccaagucucagagagggaaagcgucagggcugccuggaaaauccugcacaggugcuguugcaggaaugcagggcucgugcugaggaucaggcucuaggcgggaggaggaaagaggcaggcagagacccagccacacugggccuuuugugccauguuuggacuuggccaggaagugauggaguuacgggguuuuaagcagggaagugacaggaucugauuugugugggucccuccagcagccagcacagaggaugaauagacuauaagagguauugcagcauucaugcaacugaugaagcuagaaugacuccccccagcuccucuggcucaggcuuggccccuccccaaaccccgugcacaucuccccacccguagggccaucggcuucccuugugguauccuccucuucauccucaccaagcgggaaguggacaaggaccgugugaagcagaugaaggcucggcagaacaugcgguuguccaacacgggcgaguaugagagccagagguucagggcuuccucccagagugccccguccccugauguugggucuggggugcagaccugaggagcgcugcgacccuccuaggcuauugacuguuaaguccucagguuuggcccagauuccaguucgugccucugagguccaccagagggcgcaugaagcccaggcuguugccaaacccuacccugccccacaccaaggagccagccaaaggcaaauaaaguuauugaguguuuaguagaaaggaa

SEQ ID NO: 191123 - RNA, 11239 nt, Homo sapiens
cacagaccggguagaggcaggcccacagcauguccuccaagguuuacuccacaggugggaagaggacugcuggggcuggaggcggggauccucuucuuucuucccaauccacccucgggguagucuuagaggauucuguucuugggugcuggggccaggacugagguacccugccuugccucccugaccccugcccuucuccccagggucugccaucuuagccucucaucccucuguaggcuccagagcuaaggaccaccagcccucggguccggagugucugccacucccagaggccaaugcugaagccaucgacuuccucagcucccuccgugagcucagacagugucgggguugggggugcgggaggggugcaagucuggagaggagggaagaaaguccagucucucucucucucucucucucucucucucuuccuugauucuccugggacucagaaaaggccugaggccuguuuguugacauucuucaagggaaggccccccggggacauggggacauggggcaggagucuucaccuguccgugccagugaggaaggcugugggaugaggaggcagguggggacuguggggacacugguggucauggggucagaggauuggauuggggcccaggagcaggggcuuuaucuguucccacgggccccucaccccagacaaggaggagcuacagaugcuguucuucucugagacgcuggccauggucucagacaccggggagccucagggagagcugaccauugaggugcagagagggaaauaccaggaaaaacucggcaugcugacauacugccucuucgugcaugccucuagccgaggcuucuuggacaaaaugcucugcggaaauucccuccuggguagcguuccuacugccugaugcccgucacucuccccuuccuccaacccuccccuccaccaauuccuagaaucuuuuuucaggaccaagcccuuggcuuugccuuggaccaggacaaggcacggggugggagagggaugagcgaguuccucauggacucgggaugagggcacaucuuacccauccuguaguuuuucugggaccguauuacaccuaguccuccagcugcgccaccaccuucccuuccuucagccucugacccacaucuccugugacgucaaugccugugucccugcaccccaggcuaucucucagagaagcuggagcucauggaacagcacagccaagacuucaucaagguacuucccagggccccagccuugacccaauccaggggagagaagacagauuuugacuuaaaaaacagcagcaacaacaaaccaaaaaaccuauuacauacacagugaagcugaagaauagcaaucguguuaugaugcaauguaaagcucaaaagcaacgcacuucagaaaacugauuuuaaaacacgggggugggcugggcacagugguucacaccuguaaucccagcacuuugggaggcagaggugggcggaucacccugaggucaggaguucgagaccagccuggccaacauagcgaaaccucaucuguacaaaaauuagccaggcaugguggugcacgccuguagucccagcuacucagaaggcugaggcaggagaaucgcuugaacccaggaggcagagauugccgugagccgagaucgcgccacugcacuccagccugggugacagagcaagacuccgucucaagaaaaaaauuaaaaaacaaugagggugggccaggcacaauggcucaagccuauaaucccagcacuuugggaggccaaagugggaggaucccuugagcccaggaguuugagccugggcaacauggcaaaacccaccaaaaauguuuauaaauuuuguacaaaaaauacaaaaaguagcugggugugguaaugugugucuguagucccagcuacuugggaggcugagguggaagguucagcggagcccaggaggucaagacugcagugagcaaugugcgugccacuguacuccagccugggugacagaaugagacccugucucaaaaaaaaaaaaaaaagaaaaaagaagaaaaaagauguagguugggcacgguggcucacgccuguaaucccagcaauuugggaggcugaggcaggcggaucaccugaggucgggaguugaagaccagccugaccaacauggagaaacccugucucuacuaaaaacacaaaauuagccgggcgcaguggcucacaccuguaaucccaacacuuugggaugccgaggcagguggaucaugaggucaggaguucaagaccagccuggccaagauggugaaacccuaccucuacuaaaaauacaaaaagaaaauuauccaggcaugguggugggcaccuguaaucccagcuacacgggaggcugagacaggagaauugcuugaacccaggaggcgaaggucgcaguaagccaggaucacaccacugcacuccagccugggcaacagagcgagacucugucucaaaaaaaaaaaaaaaaaaaaaaauguuggggaugguuucugguuucugugggaagguuuuuagacuugaguaguuuccaguguguaaacaggucauguucacauuccacaaguuaauuaaguggcuggggcugggugugaggggcacagagcugggagacuuggaggccaggugaaacaggcccccagggaaggcuaggcucugggaaaggccagcccaccaggccuccagggaggcacugggcucucaggcuggaggagggcuggugugggcuggguucagaguuuggguaucaggagaacuuaucaguggcaaccugcugucccugcaccuggcccacccccaucuuuuaaaaccaguguucugaagugcacuguuuuugaacuuuauauugcaucauaacacgacugcuauucuucagcuucacuguguaugaaagguguuuuuugguuuuuguugcugcugcuuuuuuuuuuuuauuuuauuauuauuauuauuuuugagacagagucuugcucuuaucacccaggcuggaaugcaguggugcaaucuagcucacugcaaccuucaccuuccggguucaagcaauucuccugucucagccucccaaguagcugggaauuacagacaugcaccaccacaccugguuaauuuuuguaucuuuaauagagaugggguuuugccauguuggccaggcuggucuugaacuccugaccucaagugaucugcccgccugggccucccaaagugcugggauuacaggcaugagccacaacaccuggcccugcugcuugguuuuuuguuuguuuguuuguuuguuuuugagauggagucucaaaaacagccuguugcccaggcuggaguguaguggugcgaucucggcucacugcaaccuccgccuccggguucaagcaauucuucugccucagccucccaaguagcugagacuacaggcaugugccaccacacccagcuaauuuuuguauuuuuaguagagacgggguuucaccguguuagccaggguggucucaaucuccugaccucgugauccgcccaccucggccucccacagugcuaggauuacaggcgugagccacugugcccggcccggcugcuuuuuuuuuaagucacaaucuuuaaaccucaguuuucucauuaauggagaagggucaggugaccucugggggacccagggagucccugauccucccccgcaugcucuggcccucaguuccucauccuccccauggaacggaagaugaguuugcugaagcaggaugaucagcuggcugugaccagaaguaucaaggagggugagguaaggaugagagccagaugggaguugcacuacacacugugaacccagaauaucugagacagguccagaucaauuuagagaguuuauuuugccaagguuaaggacgcgcacaugacacagccucaggagguccugaggaaaugggcccaaagugguuggggcacagcuuguuuuuuuuuuuuuuuuuugagacagaguuucacauuuguugcagaggcuggagugcaaugacgugaucucggcucacugcaaccgccaccucccggguucaagugauucuccugccucagccucccgaguagcugggauuaugggcaugcaccaccacgcccggcuaauucuguauuuuuaguagagagggaguuucaucccuguuggccaggcuggucucaaacucccgaccucaggugauccgcccgccucagccucccaaagugcugggauuacaggcgugagccaccacgcccagccuacagcuugguuuuauacauuuuaaggagacacgaaacaucaaucaacacguguaagauguacacugguucaccagacguaaaaauacaaaaaauuagccaggcgugguggcaggcgccuguagucccagcuacucgggagggugaggcaggagaacggcgugaacccgggaaguggagcuugcacuaagcugagaucacgccacugcacuccagccugggcgacagagcaagacuccgucucaaaaaaaaaaaaagauguacauugguucauuggaaaaggcaggacaacucgaggcagggagggggcuuccaagucauagguagauaagagacaugcuuuuaaguuuccgauuagccuuucacugaauacacaauuuacaugcuauggggguuagaaaaguagucacuuaugccuuacucuggcuuagugaaacaauagagcagagaaagccaucagauaugcauuuaucucacgugagcagagggaugacuuugaguucugucuguccuuuguccacaaggaauuuccuugugggcaaauagugagggaguuauauagcuuuuuuuucucuuaguagcuaccuuguuuaggaauaaaaugggaggcagcuuugccugaggcaguucccagcuugacuucccuuuggcuuagugauuuggggucccaagauuuauuuuucuuucacaauguccucuucagaacucugagcggggaccagauuagaugaagccaggaguccagacuaacgauucauucauuaggcugggcgcgguggcucacgccuguaaucccagcucucagaagcaagaggcaggaggauagcuugagccuaggaguucgagacuugccugggcaauauagcgagaccccguucuccagaaaaaggaaaaaaaaaaaagacaaggauucauucauuaaaaaccauaugaccggcugaaggccaggcguguggugacucacgccuguaauuucagcacuuugggaggccaaggcgggcggaucacuugaggucaggaguggagaccagccuggccaauauggugaaauccccucuaauaaaaauacaaaaauuagcugggcguagugucgugagccuguaaucccagcuacucaggaggcugaggcaggaaagucgcuugaaccugggagcuggagguugcagugagcugagaucgcaccacugcacuccagucugggcaacagagcaagacccugucucaaaaaaaaaaaaaaaaaaggcucacgccuguaaucccaacacuuugggaggcagagggggccuaucaccucaggucaggaguucaagacuagccuggccaacauggugaaauccggucucuacuaaaauuacaaaauuuagccaggcaugguagccuguaaucccugcuacuugaaaggcugaggcaggagaucgcuugaaccaaggaggcggagguugcagugagcugagaccacgccauugcacuccagccugggugacaaaaagcgaaacucugucucaaaaaaaaacaaaaccguaugcccaacaccuggcuugcccacccuccuguccccugccccuuccugguuccaggacccugacccagaucaguucugaacaggaagugaagacuggagugacuucuuuccccuggagcucaaucaagggcuucaucucagaggcugccaaccuggugcugcucagggugauggccuggcggcggauggugcccagcaaugcccgcuuccugaccuuggacaccgagggcaaacucugcuauuugaccuauguaagggguccccuugggcaggggacuuggcuugggagcgaacuagaaaaggcgugaaaagcacugagauggggaacagcuguggaguagaaaagggaggcagguggggagaaaacagcacaggugggaauggggcuuucaagggcaggaaagcauguuugucugggaguguggggcagaugaauugagagugacugagaagugggaacaguucagagaagcaacccuuccgcacagaagucaguccaggaaaaauaaauauagugcagggcugauuuaaaaaauacaucauuuugggccaggugugguggcucacgccuguaaucccagcacuuugggaggccaaggcgggccgaucacaaggucaggagaucuagaccauccuggcuaacauggugaaaccccgccucuacuaaaaauacaaaaaaaaaaaaucagcggggcgugguggcaggcgccuguagucccagcuacucaggacgcugaggcaggagaauggcgugaacccgggaggcagagcuugcagugagccgagaucgcgccacugcacucccgccugggugacagagcgagacucugucucaaaaaaaaaaaacaaaaaaaaaaaaacgucauuuuggccaggcgcagugauucaugccuguaaucccagcacuuugggaggccaaggugggcagaucacuugaaguuaggaggucaagaucagccuggccaacauggugaaacccugucucuacuacaaauacaaaaauuauuagcugcgugugguggcaagugccuguaaucccagcuacucgggaggcugaggcaggagaagcaucacuugaacccaggaggcggagguugcagugagcugagaucgcacaacugcacuccagccugggcaacagagggagacucugucucaaaaaaauaaauaaauaaaaauaaaucauuuuuuaacuuuaggaaguguaacauguccaacuuuacugaaauauuccuuuauuauuucuuaaccccaaaggguguuccguuuuuguuuuguuuuuuguuuuuaacuaaaauuucauaaucagcaugccuaggacuuccugcaaucagugauuuuaaagccaugccacugaacacacaauuuccagugagacacuuugggggcugauuuguguuucuuugaccaucuuuguaaauuacauuccaggcuugucuaucaaaacacaccaagcagcaaugcauuugacaugaacaagcacaauccauuccccuccguguucuuugaaacauguguuuaacauuagcacuuuuuucuccauagcugcagcuacaacagggguuuaaguuuuaaucacaacagggacagccugccagcaacagcacaggucugagguggccacaaaucugucuggucucacaccucugagccucacuuuaccuccacccacuggcccuaguagcucauccuaccucuccgcucccacacccccccgcauaccgcuucucaucccuguaacagaauuugccaacuagaagcaccuggucagcgagaugacaugggaggggucagggcaagggcaaccuggagcuagcucccuaugaggggucgccaacucagcuuggagguuuggagaugcaauauuaaaugucuugagguuguuaugagauggagaaaaggcuaagguaagaugauggggagcccuuggcgggcauccaccuuaccucccaccccccaauuuuggcuguugccagcaaaaccugggcuuccagaccauccagguagaccaucagcaggcugaagucuucaucguggagcagacuguccacgcggaggagggcauccccauguccugccaguacuaccugcucuccgaugggugagcugcugauggugggcccagagggguggugcugagcuuguaggugcucaaggagaccggcugcuucuggggauagcaccaggaagaacuggcauugagauaggagugucccuccgcuuuauccauaucauucacucuuucuucauuuauuugcucguccucuuaacccucacagugccucccaaaccuucucacugcacaccacaggccugggguguagcuagugcagccaccacuguguaagggauaauacugaaaaacaccaaggucugaaugacugcacacuugaugaaaucacugugcuggaagaauugccuguggcaggcugccgugcagucuccagcaaagcacuggcuccaaaucauaagaaaauucagggcugggcgugguggcucacaccuguaaucccagcacuuugggaggcugaggcgggcggaucaugaggucaggaaauugagaccauccuggcugacacggugaaaccccaucucuacuaaaaauacaaaaaauuagccaaguguggucgugggcgccuguagucccagcuacucuggaggcugaggcaggaggauggcgugaacccaggaggcagagcuugcagugagccgagaucgcgccacugcacuccagccugggugacagcaagacuccgucucaaaaaaaaaaaagaaagaaaaagaaaauucagguggaagaaagaguuucuuucuguuuuuuuguuuuguuuuguuuuuuugagacagacuccagucgaguuuauuucuuaaaauuucagaauagauauucacauaaucacuacacuggggaaaagguaaucaaaacauuguuggcuuuaucucauaacuuaguauguuuucgguuuuggugcgaucauagcccacugcagccuccaacuccugggcucaagcaauccaccugcuucagccuuccuaguagcugggacuacagguaugcaccacagcuccaggccaaccuuuuuauuuugaaugccgcauagcaggagauuccauaauuuuucuuuucuuucuuucuccuuccuuccuuccucuuucucucuuucucucucucugucucuuucuugacagagucucgcucugucaccuagacuggaauguguggcauaaucuuggcuaacugcaaccuccgccucccagguucaagugauucccuugcuucagccucccaaguagccgggacuacaggugccugccaccacgccuggcuaauuuuuguauuuuuaguagaaacaggcuuucaccauguuggccaggcuggucucaaacaccugaccugaagugaucugcccaucuuggccuccuaaagugcugggauaacaggcgugagccacuacaagugugagccacugcgacaggccucuuucucuuuuugagacagucucgcucuguuacccagacuggaguacagggaugcaaucuuggcucacuacaaccuccaccucccagguucaagugauucucaugccacagccaccaaaauagcugggauuacaggcgcccaccaccacgucuggcuaguuuuuuguauuuuuaguagagacggcguuucacuauguuggccaggcuggucucaaacuccugaccucaagugauccacccaucucagccucccaaagugcuaggauuacaggcgugagccaccgugccuggccaagaggcuccaugauuuucgagugcuguaccucuaaagauccuuuuuguuuuuuuuaaacagggggccuaauacuugccaagcccugugcguuauuuggagauccagaaaugaacaccacccaggaacuuaauaaacaagagagggaggcagaaguaaagaggcccgggacaggucucucaaggggcacugucauguaggagucugcuuaggcugccauaacaaaacaccacaggcuggguggcuucaagagaaauauauuugcuggaaggcaggaaguccaagaucauggugccaucaggguugguuucuggugagggcugucuuccuagcuugcagacaagugccuucucaauguguccucacauggccuuucuuccgugcaugagugaagagaaagcucucuggcaucacccuuuucucauaagggcacuaauccuaucugauucgggccccacccuuaugacugcauguaaacguaaugaccuccccaaagccccuaccuccaaauaccaccacacuggggguuagagagacaauucaguccauagcaggcggucugggaagauucucacucucacauguuguguugcacuccaggcaccuggccaagagaauacaggugggcuccccagggugcugcaucaucaccaagaugcccaucuugagggaagagggugagugaagcccaggccuugugcaggcagggagaguuaaggggaguggggaaaccugggccuuccaggaugcagggggcuggacccagugugcuguaaacgggacaggagccuggaaucagcuggagaacaucugcccuccagccccugaccccaagcaauaagaggaggaucuuuccuacuggaagucccuuccugcaacucugcccaugugggcagaauccugggguuucaccugagccuucuguuuggguguucucgggaucucgcuguguauccaaggaagguuccgggguagggacgcccagccuuccuuguuccccaccuagaugagauugagccacgcccaguguuugagaagaagccccugguaugggaggaggauauggagcucuauucgaaguuccuggaccggaaggugaggggaggcuccaccagccugggguucccauucccccaugggccuuaaauucauuacugaucucugcaccugauugaaaugcacacccguaggggcuagaaggcuccagcgccccuuagcucuccuuggagcgagcggcugggggcuccuggggcgcgggggucccguccggcugaggcucgggcucuguccccugccaggaggagcuccggcucggccacgccagcuaucugcggcagcaccccgaagcccacgcgcucaucuccgacuuccugcucuuccugcugcugcgccagccggaggacguggucaccuucgccgccgaguucuucggccccuucgacccguggcguccgucgucaccggccuugggcuccucccaccggcccaacccuuuccgcucccuggagccggagggagacgcccgcucgggggcggccuaagcggggcccaggcccggacagggcaggaaaccaggggucgggcugggacgcgggcgggacgcgccggggcgggugcgcuuuccgggcugcgguuuugggggaauaaauggggcccucccgcuucucugca

SEQ ID NO: 191124 - RNA, 48828 nt, Homo sapiens
ggggagagagaggccgguccuggucuggccgcugcggcugcuagcccgaggucuccaagccgggcugcggcuccauccucggcuccugggcaccgucugcgaggcuccgccgaccagagugagaaagccgcgggcggcgaccgccgcaucaugucagccaaggacgagcgggccagggagauccugaggggcuucaaacuguauccguccgggagcggggcggggccgggaggacuugggaggcggccgcucacugaggagacuggccgggggcgggggccgcgccaggugggccccacagaagaagggccgcgggaggggagaggaaaggaacagcgugccgagcacccggcgggacccggcgcgagaggcgccccaaggggcguccugagggaggaaggggacguugacgggagcgccgggggguggcggguggagacgggggagccugggggacggggcugcgagaggugccgggcgucggaaacgcugucggagaagccggcuggguuccgauccccggccgggacccagaggccgggauggggcugcggcccgcggagaagggcugagggggcgcggugggcugaucucgaagccuagaagccucuuuggcuauaagccuacccggggagcggggaacagugacuuggagcgggcgaccuugugugggacaaauaccagugcuuuuaaaacucucucaggucccccaccgcaccgcaccgcaccccacccccgucugguuuccacaacuucucuuccaaacuuguggcuucuuccaggacuggaguaguugggggagguggggaaagagaaguccaagaucgaccucgucuuaacacucuuggccuucucaggcauuggucacugcuucccccucagcgccucaguuuucuuuccagcaagaugaggaccauaggcuuagguguggggugccucgcgcugggacuccuagccgaggugucuuugcucgcuccugucggugcgguuaugccuagcugugguggagcuguccagcaauggugugaugucgcuggggccacgguaggauagagugggguagagaaaucauugccucgggccuguuguggugccccuuuugcauccucuccguaaggaagcuuuguguuuucguggaguguguuagucugucaccauaugaugcagaugaaaaaaugcaaacuuggauauucaaauuuuccauucuccugccaacuuuaaucucuucaugcauccuaucuguaaucuauaguacgaacguucuuaaauugcucccucagugaaaagguagucaccacuucagggcuccucccuuggagguuuaguaaagcacuguuuucuugguauucuguugcguuuucacaauguccaugucacgcuugcaaauuuaauugcuuugcuauaaucagaaaccaaguugguaauacauuuuagaccacagugcaaaaaggaaguuuuggauguacaagugagauuuuucgaauggaaauugaucuaugcuuuuuaaaaaaacuaaaggcuguaucaccuuugcauacuaccaucugugauaaacuuucaguacuuucauguuuugguuuaguagcagccucuuuuauagcuccaugugccuuucuguguuucucuccauaauggaucaaauagguauauagggaugacugaagugcuggaaaagcuaugacauggauuuuauuuuucccucaaauaauuuauacuauuaacaucuaacaauguaauaauauugcuacuuaacaugcuuuguagacaguaaaccggaaacuggagaauugagagauuucagaagcaacguuuucaucugauuggaaauaccguauugcugaaaagaagaaaggccuuuuuaauggcuuuugaacaaagcagaaaaguuugagcuucucaccuucagucuuagcucuugaaccuguugagaaagaggauaagagacaaauacggaaaagaguuucagaaagcagaaucugugucagcccacuggaaggaaaagcgaaucaaccgauucagugauguuagugcauccagaaacaggcuuuugggaaaagcuugaccugagcugauuaaauccugaagcacaagggaagcagccacaucaaaaaguuagcaugagagcaguggcgugcucauccucugguagccuuuacugggcauuuguggaguaagagagaaaagaaaagcaggaauguuaagauaugcuacuaccuucaggaaaaaguaaaauuaauguuuuaguaagaaacugacuauuguccaccuuuuauuggguaaauagauuuucugaacuuucuuucagaguaucuguuucuguaagaauaguuuaucacugcaaaaagagcaccauuauguucucccaccagcaguguugauaguacucaguuuuccacguugacuaggucagucuuuuuuauuugccaguuuggauaacaaaugauacauuguuuuaauugguauucuucuggaucccuagauccaugaaaagguaauguagcauagugguuaagagcuauacuggacuaugucucuauacugccugcauuggaauuccagcccugcgcuccuaguugugugucccugagcaacugcuuuaaccucaccucaauuuucuuaucuguaagauggggaaaauaauaguaccuaucucauggggcuguaagaguaaaugaguugauaucuaaagcauuuagaaaagcaccugauccacagugagcauuaugcuuuagccaguguuauucuuguuauuauuagagaaguugcacaucucuucuauuuggccauuucuuuuucuucuguaaauuguuuguuaauuuuguuuuugcccauuuuacuauuguuuauuuuucuuauuuguagauguucuuuacauauuguaauaucaauccuuugccuauuauguauuuugcaaauauuuucuuucaauguauugucuccuuuuuuguugaacagaauuuuuaaauugucauuucaaauuuauuuuauuucauuuguuugagacggagucuuggucuguugcccaaguuggaaugcaguggcgcaaucuuggcucacugcaaccuccgccucccagguucaagcaauucuccugccucagccuccugaguagcugggauuacaggugcaugccaccaugcccagcuaauuuuuguauuuuuaauagagaugggguuucaccauguuggccaagcuguucucaaacaccugaccucaugaucugccugccucugccucccaaagugcugggauuacaggcaugagccaccgugccuggccucaaauuuauuaauauuugccaucuggcuuuugcauuuuguaucuuguuuaaaaagaucuuucuuaucccaagauuaacuaaauauccuaucuuuucuucucuuuucaauguuuagcucuuuaauccaccuggaacguauuuacacauuugguaugugguagacaucuaaguacuucugcuguuuggauagccaauaguuccaguacuauuuacuaaguaguuaguccaucuuuuccucacuguuuugaaaugccauccuugucauauacuaaauuuucauaagacauagguuuuuuuuuggauuauuucuguuucauugaucuauuugucucuucuuguaccuauacacauuugauugaauuauuauagcuuuauaauaugauuuaguauaguuuacaauagaauggucugugacuaacauaauauguguguuuaaggucccuacaaauaugugccccuuuuguucacauggaagcuugcccauaugcccauaguagauagaaacaugaggacuuggcugggcauggugacucacaccuguaaucccagcacuuugggaggccuaggugggaggauugcucaaggccaggaguucaagaccaaccuggccaacauagcgagacccccaacucuaaaaaaaaaaaauuuaaagauacugcauaaaagugaauacuguaugcauaaauuaggcauggucugagugaauucaguagaagcuuuguauuugccaucaguuguuucaaaaacaaaaucuuauaagauuuuauucuuguaucaccuucaccccaucucacccuaccucuuucagaguaucuguuuuugugagaagaguuuaucacuacaaaaagagcaccauuaugaucuccugccaacaguguugauaguacucaguuuuccacguugacuaggucaaucuuuuuuauuuuugccaguuuggacaacacauuguuucgauuuguauuuuccuggaucccuagauccauacaagguaauauagcauagugguuaagagcuauacuggacuguggcgcuauacuaccucucaagaaaugcaaggcucucauacacauuaagaaccuugcauuucuuucuuguuuguuaaaagcauaacauuuccuaauuguaaauuaauguuaugaaugaaauguuacuuggggaacaauaugauucuccugcaaauauuuuggauuugauuauuuuaagcagcugacauagagauugauguuuguaaaucccacguuucccauuucguuccuucaacaaaggucuguugggugacuauuauguauagggcacucuacacuugaaggauacaaaaaugaauaacuuacagucccuucuuuccagaagcuuaaccagcuuuaugucuguuuagaaggaauaucuucaaaagcaaugcauuuuuuaaaauucuauuuaauuuuccuauuacaaacgccagccaccuagagugaccuuuguaaauauuauuuaauauagccuucuaauguagcuaauguuuaauguguuuuuuauaaaaauggaauuguaaauaucacuuuguaacuuacuuuguucacuuaauaauagauuuaccauguuuaugauuuccaaagauaguuacuuucaguugcuuucacugacagauuugucacaguacucuuuuuuuuuuuuuuuuuuuuuugagacggagucuugcucuugucaccccggcuggagugcagugaugugaucucaacucacugcaaccucuaccuccggaguucaagcgauucuccugccucagccucccaaguagcugggauuacaggcaccugccaccacgcccggcuaauuuuuguauuuuuaguagagaggggguuucgccauguuggccaggcuggucucgaacuccugaccucaggccucccaaagugcugggauuacaggcgugagccacugcaccuagcauuugucacaguacucuuauacuagcuuucuaguauagucuguaucuacuguuuugccuauuugaauagcuuuuucaucaacauaaaaauauaacuuuauuaaauuaacaagaaacugacagacuuccauaagaaugaauuaugcuuuuaugauuucauuaucuuuaauccaucugaauuuucuuugguauaagauacagaguaguaauguagcuuuuuuuuaauauuggcuuauugucuccauuuauuuauuuaauucauuuauacgucagauauuauaauauccagaauauaaauggcugccuacaaaucaauaggauaagcauuuaacucaaaguggacaaaggauaugaacaagcaguuccuagaagaaaaagcagaugaccaaugaauaaaugaggacaugcucaaccuuguuaaaauaauagacuaucuuccgggugcaggggcucaugccuguaaucccagcacuuugggaggccaagguggguggauugcuugagccuagaaguuugagaccagccuaggcaacauggcaagaccccgccucuacaaaaaaaaaaaaaaaacacacacaaaaauuagccaggugugguggugcaugcuuguggucccagcuacugggaggcugaggugaggggaucaccugagccugggagguggaggucgcagugagccaagacugugccccacugcauuccaaccaggguaacagagugagacccugucaauaauaauaauaauggacuaucucuucccaauuaauugacacagauuuaaaagauugauaauauauauguauauccugaaaguggcacuguacgaaaauaaaauuaaaaauuaggccaggcacagugguucacgccuguaaucccaacacuuugggagaccaaggugggcagaucacuugaggccaagaguuugagaccagccugcccaacauagcaaaacucccucucuauuaaaaauacaaaaaauuagccaaacuugguggcacacgccuguaaucccagcugcucaagaggcagaggcaggacaauugcuugaacccaggaggcagagguugcagugagcugagaucacaccacugcacuccagccugggcuacagagugagacucugucucaaaaaaaauaaaaauaaaaauuuauuaaaaaaaaaaaagaugccaggcacaguggcucaugccuguaaugccagcacuuugggaggccaaggugggcggauuacuugaggucagggauucgaggccagccuggccaacauggugaaaccccgucucuacuaaaaauacaaaaauuagcugggcaugguguggacagcuguaaucccagcuauuauuagggugccugaggcagaagaaucacuugaaccugggaggccaagguugcaaugagccgagauugcaccacugcacuccagccugggugacagagagagacucagucucaaaaaaaaaaaaagauaauauucaguguucacaacauugagggaaaggggcacucucauuugguuuauguguguguguguagugucuguagaaaguaauugguaucuaucaaauguuuacacauuacugcaguagaguauauagcacagugguugagaguaugggcucacuuccaagguuuagacuuacugccucugcuauugugacucucaacagaacacucagacucugagccucagcaucuguaucucauauuaucagaggguuguuuugagaauuaaaugaaacugcauaaaagauguuugguucagggccuggcauauaguaauaucugcugccauucauuuuauuaauaauuacuaauaauaaugacaggccagguauagugguucaugccuguaaucccagcucuuugggaggccgagguggguggaucaccugaguuugggcauucaagaccagccuggccaacauggugaaaucccgucucuacuaaaaauacaaaauuagucaggcguaguggugugcaccuguaaucccagcuacucgggaggcugaggcaggagaauugcuugaacccaggagguggagguugcagugagccgagaucacgccagugcacuccagccuggguaacagagugagacuccaucucaauaauaauaauaauaauaaugacaauaguguuaauaugauuguaaagcuacuuauuucucugagauauaacuaaugccuucauucuaguuauauuuucuuacugaaaaacuaucguauuuccauuuugccucugaauaaaugauucaauaagcauugauauauaccucauguuuaucuugucuagaaaaugaaucucauucuaauuuauggcagguuagcaaaaagaguuugggcucagaagguuucugaaagcaucuuucacuuguuuucuuacauuucuucucccauaguuugguccuggaaucccuguaucuucuuucucauaguaccuuaauccuugacuuugcuuccaaucaaaaaacaguuggcuuuacaucuucuauuuacucacuuagaauaaagaauaagaauaguagacauauuaagaaaagucgacuguagaacuucucuugaaagucaguauucccugguacaguugccuuggccaaauguuaaaaaugaauuugagguuuauuauuucccauaauauagguuuugucugacaacccaaagucuuggaaagcaaccagacauaccacucauaaagcccaguuucauguagauugugauugguagcuuguuuccucaugcauggacucuugagaguuuguauuguuauccugaauggauuaaaugaauauaauguccuauugauuaucuuaggauucuuuuuuucuuuucugcgacagggucucauugucauccaggcuggugcuaucauagcuuacugcagccuugaccucccaggcucagaugauccucugccucacccuccugagugccugggugcacaggugugcaccacuauacccagcuaauuuucguauuuuuucuuuguagagaaacgguuucacuauguugcccaggcuggucuugaacuucugggcucaagugauuugcccaccuuggcuucccaaagugcuaggauuacagacgugagccaccacgcccggccuuacuuaggauucuuaaacaggcauuccugcuuuuguuuuuuggaaggaauuuaguguauaauuagauauuuauagucuucuacugacuuucuaaguuucuugccaggguuguguauaugguuuauaaugaaacauuacaguaacuucuggagaaaugggacagaacacgguaaaacugucauggagaauuccaguuguaucaccacuacauuugauaaaggacuagcaaugguucugaggcuuggaagcucuagguucuuacuaggguugaccucaguuuugccucccaggccucacuugucagcauucugcauccacaaauccucguguuaugagaggauuugacuuauagaccuaucccucucuauuccugagcuaaagccuagcaucauaggaaggaauuuuaaggccaucuucuccagcagccugacuauucuaauaauugcuugaaugcguaaaacucaaauugucaaaguucugagagcagcauucuuuuuugcuuuugaccugcuuauaauuuuggagcugggaagaaaagcaaauauauuucuuacaguccaauauccacaaagauuucaauggauuggacuaaagcuuacuguuuauggcaaagaaggcgauggucucaccguaggacacaugaaagcuuguuuagucuacugcaaagggaggcaggggaaaguggagcugguauaaaggugggccacuugaaacauggcauacauucaauaaugggggaacugaagggaguuuaaccuaaagaugaaaagaguuggacaagagauaugaguauucucuucuaaaguuaaaaaaaaaaaacaacuguucuaaagaggaagaauuaaauguugcuguguagcucucagaggaaguacaagauuugcgggguagaaauuacaggugacagaguuuaggccaguuucuaacaauuaguagaauuaccugaaaaaagacauuuuccagaaaguguuuuaagcagcagauagaugccugucugucaagaguguugcagagggaaauuuuguauguaucaaauguguauuacaguagaugaucuacagaaauacucaaauccuuuuccagcacuacaauucuuugauuuggugacagccuuucuuacuuaacaaguacuuuuuuuggcaaauguuuauauugagauauguucuacaccuaaaaucggcaaaaaguuuuuuugugacccaauuguuuccuuuuuguuucugacacaacucugagacacucaguauugaaguguuugguuuagugcauuguggauacaacugauucagagucaaggagagcaauuauugccucugaauuuagauaacauuuagagaaugaaacauaaauagcuguaauauaaauuagcacuguaaauauagccacaagaagaaacagcauggucuaguaauaucucauaauucuauacugcuuuucgguuuuuaaagaacuuugauauauuacugcauuaucacaacaacccuauucauuguuauccucacuuuauagacuaaggaauugaggaucgacgaggcagucacuuagacgaaggcagaaccuuaauuuaagccuuguuuugucuuuuuaaaaguccauguuuucuacaguauaccaugaugccucucuggagaauuuauucuuuuguuguuguauuauuaauuuugaguuuuaaauuuuucucagcuuggcugagcaagguggcucacgccuguaaucccagcacuuugggaggccuaagugggcagaucacuugaggucaggaguucgagaccagccuggccaacacgccaaaccccacagaagcuauuugggaggcugaggcacaagaaucgcuugaacccgggaggcagagguugcucaaaaaaaaaaaaaaauuucucagcucacugcagccuuaaccucccaggcucaagugauccucccaccucagccucucagauaacugggacuacaggugcacaccaucaugcuuggcuaauuuuuguggguuuuuuuuuuuuugaaaugaagucucacucuugucacccaggcuggagugcaauggcgcgaucucaacucacugcaaccucugccucccagguucaagcaauucuccugccucagucucccgagcagcugggauuacaggcgccugccaccacacccagcuaauuuuuguauuuuuaguagagacaggguuucaccacguuggccagacccgucucaaacuccugaccucaggugauccauucaccucagcuucccaaagugcugggauuacaggugugagccaccauacccggccaauuuuuguuauuuuuuuagagaccagauuuugccauguugcccaggcuggucuugaacucuugggcucaagugaucugacugccuuggccuccccaagugcuggaauuaacagacaugagccaccaugcccagcccuugucucaguguuuaagucacagccagauuuauuuuucacuugaaaauuauccucuucuaauguggucauaucuccuauauucuuuuuuuucccucaauucaccagauacaggggccaggguuuagcccaggauaaugaauuuuuuaacaauuagaguuaccagaggaaaaaaagacauuuuccagaaaauacuuaagcagcagguggauauauucuuguuuucauauuuuuuucaucuuaagcacaguccucuuaaacauuguccucuguagucaagagauggcuacucauaggggucugauuagcaacuucagugaugaucaaacauaggagguuguuacucaagucugauaagcacaagauuguguccauauaguuuuguccaauaaaguaacacaaaauuuaucccacaacgaaguuguuuucagaugagcaauucagauaaucucguuaauagggaaaaaaaggugaaaaagucuuggauacuagcauggauaaacaaacauguccuggcuuuguucagaauacacaaggcuaccuugugaccagcuuauuucaguuucauuuugaaaccuuuuccuuaaaugucuaugaaaaauaucaggugaaaguauauuguggguagcuuauagaaccaacucgaggguuccuguuacagaguguuauuaugcauuuagaguuuguuucaaaggccccuuaaguauuuauggauugagauaagaaucuaacagacuauuuccuuuucugugauucucuguuaaaaaauguggucccaucuguggucucagcuauucaggaggcugaggcaggaggaucacuugagcucaggaauucgaggcuacagugagcuaugauugugccucuucauuccagccugggcaacagagcaagaccccaucucuagaaacuguguguuugugugugucugugugcauguguguguauauguauaucuguguguguauguguauauauauauauacauaucucugugugugugugugagagagagagagagagagcaaauuguaggauagucauaauuaugccauguguggcacugcuaccuaggugacuacucugugugaaaaguaugguuuucaccaggucacugcuaaagauuaagaaaaagggacuaaaucugagauucagcauuuucaugaaauaggaagugagaaauguaacuguaagccuuaauugcuuuugagccaucuucugccuaaggagcaaagacaaaggaaccagaaaagcugcguucuggucauagugcugccacucacuggccauucauucagacauuuguuaacagaaucuguacguggcauaucaucugcuaaaccaaagagaaagaaaaugauaaagcaggccaggcaugguggcucacgccuguaaucccaacauuuugggaggccaaggugggcggaucacaugaggucaggaguucgagaccagccugaccaguaugaugaaaccccgucaccacuaaaaauaccaaaaugagccgggcgugguagcgugugccuguaaucccagcuacucgggaggcugagacaggagaaucgcuuaaacccaggaggcggagguugcagugaggugagaucgugccauugcacuccagccugggcaacaagagcgaaacucccgcucaaaaaaaagaaaaugauaaaccaguuuccaugaccaaauaacuuguauuauauaagggagagagaaagagaccauaacaaucagaaugcaauguguuacaugccgaguaguaucaaguacuguggaaacucagagaaagggugacuccuacuagggguguugugggagacuucaagaauuaucacuugaggucgggcgcgguggcucacgcccguaaucccagaacuuugggaggcugaggcggguggaucacuugaagucaggaguuggagaccagccuggcccaugguuucaacauggugaaacccugucucuacuaaaaauacaaaaauuagcugggcgugguggugcaugcuuguaaucccagcaacucaagaggcugaggcaggagaaucgccugaaccuggguggagguugcagugagccaagaucacgccaccgcacuccagcauguacgacagagggagacuccaucucaacaacaacaacaacaaaaggauuaucacuugaauaggaucuuaaaagaugagguguuacccaguuuaaucuuuaugacaguagggaguaacagaggaaggaaaguguuucaagagugaguuggagucaggaaugaggaaggaugaggaccaaacaaauucuuggaauucuuugaaauuuuauucauuaaugauauuuaagaaucagcugagagucccaugauaccuuauaggucauugugaucuuuuuaagaauaauagauaguggcagauacaguggcucacaccuguaaucccaacacuuugggaggcuaagguguauggaucccuugagcucaggaguuugagaccagccugggaacauggugaaacccugccucuaccaaaaauacaaaaauuagccaggcaugguagugugugccuguagucccagcuacucgggaggcugagguaggaguaucacuugagcccaggaggcagagauugcagugagccaagauugugccacuggcuacugcacuccacucugggccacagagcaagaacuugucuggaaaaaaaaaaaaaaaagaauaguuaaagaaacaaaguauaaucuuucaagauuagaaaaugaauacaugaggaaauaaagucagaaauaauagauuacucuuucaagaaaucugguggccuaagaaagcagauauuaggggagcagcuugaguggguagauagaauucauuaaauaauggaaaucacuuauuuaagcugacuuuguacaagucacuuaauaucuguaaaacaaggauaaagugguugggugcgguggcucacaccguaaucccagcacuuugggaggccaaggcgggcagaucacaaggucaggagauugagaccauccuggcuaacucggugaaacccugucugugcuaaaaacacaaaaaauuagccaggcgugguggcgggcgccuguagucccagcuacucaggaagcugaggcaagagaagggcaugaaccugggaggcagagcuugcagugagccaagaucgcaccacugcacuccagccuuggcaacggagacucugucucaaaaaaaaaaaacaaggauaaugcaugcuguuugauggagauguuaugaaauuugaacgaaauaauacaugccaacucaauuuaaaaaccauagcucuucaaaugcacuaugcuugcuauuacauuauuacaaucauuauuuaccuuugcuuuaaaguaggauaucagaaaagucagagccuuagugauuguuuuuuacuuuagcuucgauaccugugagccuuuuuucacauuucugggaauuaauuguggcucuuggagugacaacagaagaaacccccagaugacacugaaaaaccagaaucaucuuugacuuagcuuuuuuuuuuuuuuuuuuuuuuuuugagacggagucucgcucugucacccaggcuggagugcaguggcgugaucucagcucccugcaaccuccgccucccggauuccagccaucccgaguagccucagccucccgaguagcugggauuacaggcaugcacuaccaugcccaacugauuuuuguauuuuuaguagagacaggguuucaguuggccagacuggucucaaacucccccugaccucagaugauccacccuucucagccuuccaaaguacugggauaauaggcaugagccaccaugccccgccagcuuucauuuuuuuaagaguuauaauuugaaggaguugaguuucuucccaauacuauagcauuuuuuaaaaacugggugaaauucaggaaucugaauguagauuuugacaggauucaaggcaauaucccugugccuccaaauaaccugaaagaaacaguggcccuuuugggaacaugcccuugggaaaaggccuuguauuauuucuuccucagucaggaggugcugggaagcaaauaaaagugcaaagggagccucuaagaaucucuuuggauaugucucuucuagcuuguuucugaccaguuccaggcacauaacuguacaugucaguaggauaaugggcugacuagaaaaaagaaagguuugcguuauuguuugacuuugcuagggagaagacuguguuauguuucaaauacugaucuuuuucucauuacuaaauuacuugccuccacuguuucccaggccaguuugaauuuugauuguauacuuuccaagcauaguaacuuugccagcacaagaguauuauuucacggggauaucaccacugauuacaaugcugcauauuauguuucaaggauacugaaaccuggguucucagagauccauuuauauuuucucaucuuaucccccauaaaugggaaaaucacugggaaauuauuggguggagaaaugcauuuaaaugaccgugaauuagaauugguccuuaagaaggaacuaaaggcagaaugcucuguauaaccaacacuaaggcagaagcauaagagggcucugacauaagugguauuuaagaauuaaugaagaaagugggaguaagagaaggaaaugaguucagaaaggaaacaaggaggagagaguuugagaggggagagaucauaaaggcaaagugugaaaagauagagaacaggaagaaaaaagccacaaccaaaaacuaugaaaacagaguaaagacagacagcccuguaaugaaaaugcucaggauaccaccaaauagaaacucccuuuguuuacugcuagucauugcagcugcuuccaccccaaaguaaugagaagggagagguuuuucuuuaugccugugaccuugguuuugaagcuuugccucauagugcucuggucugccauaguagacauuagcauauaucauuauaugcuuagucagccauuuugccugaaaaauauacuuaccuggaaauuacucagagccacaugcccauauauaauuuaugaguacucugucaagucaugaauucaaacuuaaugcagaaugggcuuuuaaauucuaauauauuguuacuugcaauucagcugacugacuuagguguuguccuuagggagaguggagguuuuuugguucguugguggguugguuuuugcuuuuuuuuucuuucugaguuccagguuuaaguugccccccucccacuuuuuuauuuuuuauuuuuuuugagauaggaucuugcuuugccacccaggcugaagugcagugguaagauccuggcucauugcagccuugaaauccugggcucaagcaguccuccugccucagcuuucugaguagcugggacuauaggcacgcaccacuguauggcuaauuugucuuuuuuuuuuuuuuucccuuccguggagauggaaucucacuguguugcccaggcuggucuuggauuccugggcucaagcagucuuccugcuuuggccucccaaaguguugguauuacaggcaugugccacugcacccagccugaauugcccuuuuuacaguccacuggacccugaaagcaucgcuugugguugcucagccugaagagaauucuaaugaacucucccucuauugcuuagugugauucaacacauauuugagugucaguuacaugcugagcacugagaagagaaagauaaauaauauagugucaguagaauuugacuugcaaacuaauauauucaugguacucuccgauaaguacugugacacagguauaaacaaguggccaggauaggaggugaugcuguaacaaacaacacuuuggagaauggaauguauggcagagacuggacucagugucuuccuccaguaagccuugauuugccaucuugacuucuucaccugaggcauauagcaauuuguuacacaugcuggccuccugguugccuguugauuuccuguucuuuaucaaacuauccuuucuguugacagccuuucuuaucucacccuucucuguuguccuuuuaaccuauuaauagcucauuagaaaaaaauuaauauuccccauaacuauuuacaaagccuaaacuuucuguguuccucagaaauguguaugaggauggaaggaguuuuuguuguuuuuggagacagggucucacucuguugcccaggcuguagugcaguggugcaaucuugcccucagccucccaaguagcugggauuaaaggcacacaccaccacauguagcuaauuuguuguuguuguugagacacagucucacuauauugcccaagcugguaucaaacuccuggguucaagugauccuccuaccuuggccucccaaagugcugggauuacaagcuugagccacuacaucuggcaagauuuuuuauugaacacucacacaagacuagacuaagaccuugucaagagcaaaagucuuaucuuauucuuccuguuuccuagaacaaugcugcuuaaacuauggcuggcaaaagaaucgggguuuuacuucuaauccuucauagaccaauauuuuuguaaaauacagugagauuaauuauuagaaaaauaacauaaagccaggccugguggcucaagcuuguaaucccagcacuuugggaggccagagugggaggaucacuugagcccaggaauucaagaccggccugagcaacauagacucugucucaacagcaacaacaaaaauuaaaaauuauccaggcaugguggcacaugccuguagucccagcuacucaggaggcugaagcaggaagaucacuugaacccaaaaauuugggguuacagugagcuguaaucauaccacuacaccccagccugggcaacagagugagacccugucucuaaaaaaaaaaaaaagaaaaaaaaaguuuuuaaagaaaaaugacauaaaaguuuuuuuaaauuauuauugaaaucaacaaauaaauuauucugcuguauuguuauuaaaaauuuuaaacacaugucacaggcugguagcaaauggauucacagaccaggaccagucugugggccacauucugagugguacagcuguggaauccccaauauuugcaccugauacacaguaccucaauacauguuugugcaguaaauacaugaaugagacgauuggaaugauuauaguaguaggcaaggaaaaaaggagaauagaggcucucuuuggagaauuggagggaaaugauuaagugagaaacucaagaugacugcaauaaugcuacccuccauguaaaacaaacuuuuugucaucauucacucugaauacuguuccuuuggcucucuagcaagacagauaaauacuaauaaauacucucucugaauuucugcaaaauauaguuuugaucuugcugaauauguagaacuugcucuaaaugacugcacaaagaugucaaccuauuuauuuaaacuugcucucaugagcagaucuauaguagcuaggauugauuucaaauauuaacaacugcucuuagaaccagugcauuuuuccauguugcaauauggagcauaccaccaaaugcuuucucuggcugcaauuuucuuuucuuuucuuuuuuuuuuaguagagauggggucucacuauguugcccagucuggucuugaacuccugggcucagcugauccucccggcuuggccucccaaaguucugggauuacaggugugagccacugcaccuaagaucucugucugagauuuucuuguuuccucuguguccucucaaaagauuagcugaauaggguaagaaauauuuuuaugaaaaacuuugaaacaaacaagccuucuacguccauuaagauaauuuugcguugcuuacagcacuacaagucuucaguucuuaaaaccaaauuguuaggccaggcacgguggcucacaccuguaaucccagcacuuugagagggcgaggcaggaggaucacuugaggucaggaguuugagaccagccuggccaacagggugaaaccuuguccuuacuaaaaauacaaacauuagcugggcaugguggugcccaccuguaaucccagcuacucgggaggcugaggcaggagaaucacuugaacccaggaggcagagguugcagugagcugagaucgcacuacugcacuccagccuggucgacagagcaagacugugucuaaaaaaaaaaaaaaaaaaaaaaaagcguuaguccuugaauccacuucagauuuaaaaaaaaaaauaguuucauucaagggauagaaaagaggaggucuacuuuuuaauagccacacacauagcuauacucaauggagaucauuauuuugaaauauuuaagcucacaauauuuaagugcaacuuacaacagggaaguuuuguuaucauaaauggaauuuuguuuucaauguggaucaguacaaauucaauaacucaauacaucaucuuccuucucuacuaagcauauccccaagagaacauuguuaggaagggcaaaagggccauuuccaugguauauuugaggaagucugcuugccuuucucacccugucaucaguucccucagcucuucuagcccuggaggaaugucgucacaaagauacccaggacccugcaguucccuggagccuuucuguucccaaggguauguagugugaacagaccucugucugaauguuagcucuguuauuuaccagcugugaguuccugagaaagauauuugacugcugggagcaccaguauuuuauguggguaugaguauuaaauaagacugaaaaauaaaaaagagggacuguuagcacagcacgugacauauauguugaaaguagguacucaaauauuagcucuuuuacccugacucuuguuucuuugaggacuaccuuuaaacuaugaauauagcuagaugccagauaaggcuagaaauauuguucaccuuuucccuggccucaugcugucugcaguuaaguuaaacaagacuguuagaaagcuagcccugagaaaugcaaaaauaguuaagacuuuaucugucugcauugauaaugaaccacagguuaagaauuauugauucauaggccaggccugguggcucacgccuguaaucccagcacuuugggaggccaaggcaggcggaucacgaggucaggagauugagaccauccuggcuaacauggugaaaccccaucucuacuaaaaauacaaaaaaauuagccgggcgugguggcaggcaccuuguagucccagcuacucgggaggcugaggcaggagaauggcgugaaccugggaagcggagcuugcagugagccgagauugcgccacugcaguccaaccugggcgacagagugagacuacaucucaaaaaaaaaaaaagaauuauugauuuauagccauuguugggccaauacaaucaaugggauuuccguuuagccuuuggagauuuuauagaaauggucucagaagagagaccacaaccuuagucuuagacucauuucuguugucuccauucuaauguauucauggaccaaguuaucaggcaacacgcuaguacuugaauauggaagagaucauccacucaacugguauuagaucuguuaccuggacauuguuagggcuuuaucaccuuuauauagacugaugugguucaguaauuucuggagagcuuggcugagcuagaaaauagugucacuagccuugcagcguguccuuuuuauaaaucugccuuuuacccauuaagguuauauaaaacuuaaaaaucaagggcuccaaaaguauauggguuuugaccuguggaauacacuagcagcauaaucugaucuggcaucuuguauccuguagcauuuggaaaugucuuucuaaucucaugugcuagaggaacuacuugucuuguaccaugaguuuagggaucaugaguuauucaucuuauaucccucagucucucccugguacaaacuggguaugcaggauagcugggggugucauauaaaguuaaaaaucacagauguuagaaucaggcagucaaaaaccaacuugaccacuuaacuggcuuugugaccuuuuagcaaugaaaugaagcaaaaacuuaccauccucaaaccuguacagauuccucauccauguaagagcuauaauaauaaugccuauuucauaggguuauguggauuaauuuauacaugaauaauaucuaaauuauuagcauacuaucuaguacucaguacaucuuagccaucaucauuauauaguaaauagauacugaaugugaagacuguauacauuucugccaaaguuucauauaccuaagcgauguguaacacaaaucaugugacaacagaauucuuuccauaucuugguaaagucuuccccuuacuuucuucuauugauuuaaacagaaauuuacuuggaugugacccauuugauaaggaccagcugauaaaguauaccagcugauucaaauaauugcuccagcuaauuuacaugaagguuuuccuauuuuauuguuuuuagaaauuauuuuggagguauaaaagucugguagugacuuaugaauaucuuuacauuaaauguuuaccuuauuguucuaaaaaauacuaaacauuucucauuucuaugggaaagcccucaggagaaaaacacuuuuuucccuguuuugggggcuaugucucuagccugccuggaaguuuagaaauucccagaaggauauugccaagaagccgcaaagggaugccauguuugaguuucuugccauucuuacugcuuauaaagagaagcauuugggcaguaguucacuguuuguuguuaguuccuaaagcacugccacgggagacuuauacuccuggggucucuucauguccccaagagggaguugauggaagaugguuauuaaucuauaccaacuucaguuuauuagcuuuucugcuucccaaacauguuuuuggcagagaaauagauuccacagaucccuuuauagugcuucucuaucccuuuccagcacuguagccaaggguuuauuuuuuccauaacaauuuuuuagacauuugaucuuuuucucucacugccugcuccucuucucccccaugcuugcuugccuuccuuuguacacacgaauaauaagcuccaauggcuguuuuucccccugaaaaauguguuauuccaaaccuuuccaaucucuaaaaucuuauuuccuagaaauaccuuuuuccuuuuuuuccucuuuaaaauugcuuuauuuauuuauuuugagacagggucucacuuugucgcccaggcuggagugcaauggcaugaacacagcucacugcagccuugacaucugggcuaaagcaauccucccaccucgguuucccaaguagcugggacuacaggcaugugccaucacgccuggcuaauuuuuuuuuuuuaauagagaugcugucucccuauguuacccaggcuggugucgaacuccuggccucaagcagucuuccugccucagccucccaaagugcugggacuacaagcgugagccaccaugccuggccuagaaaugucuuuuaauucccagccucaacccuuuguucauccacuguggaccaccccuuccugucuggugguauagaguaugggcuuuaguggcuauaauuuuuuucuuuucacucuuuaugagaguuuucuuuccugguacccuaaagcuacucaaaguauggucccuggggcaguagcauuggcaucaucagggagcuaguuagaaaugcaaaaucucagaucccaccccaaucuacugaaccagaaucuguauuuuaacaagaucuccagaugacugguaugcauaugaaaauuuaagaaaucccuguuguaaaucaccuuuugcucaagggucagggauuaggagacacuuugucaagucaugguuccccacccuggcuucaguggaaugacuuggggaacugugaaaaauacugaugccuggguuccaccuccagagauucuaauuggucugaaaggucagguccaggaaucaggaguuuuagaaguuccccaagugauucuaauaggcagccaaggcugagaagcacuguuguacaugauucuuauaauuugcccuagcuucuuagaacacaagguauauauaaguugauguggccagaugcaguggcuuaugccuguaaucccagcacuuugggaggccaagguaagggcaucacucgagcccaggaguuugagccagccugggcaacauagugagaccuugucucuacaaaaaaaaacaaaaaaaaaauuagcugggggugccuguaauccuagcuacucaggaguccaagccaggagaaucccuugagcccaacaguuugaagcugcaguaagccaugugcaccacugcacuaucuaucuaccuaucugucugucuaucuaagaugccguuuuagacagacagacagacagguagguagguagauauauaggcaaagcuaaugacuaaaaaaaacuuuuacaauuacauuuauuggggagaaguauaugugcaucaaaaauuagaaauauauacaucaaaauauuaaacccaguaaucuguggguuauaagauuacaguuauuucuuuuuuguccuuuguuuucuuuuuuuuuuaaggggccaugcucaucuucucuguaucauuccaauuuuaguauaugugcugccgaagcaagcacuguccucuauuuuccaaacuuucuguaacagccauuccuuugguaaaggaaauauauguguaaauauaauuuuuaauaacugugaucacauuauacauguuuuguaaacugcuuuuuaauuaaaaaauacucuuccuguucacauaucaauacauuaugaacauuuucucauuaucauuaaacauuauuagauaggcuuuuauauuguuuaaagugaauccugacccaggauaacugaauuuuuaccuuaauuuuauuuacauacugauauggggauuuaagaaauugacuguuuagccgagcgcaguggcucccgccuguaaccccaguacuuugggaggcugaggugggcagaucaccugaggucaggagacuagccuggccaacauggugaaacccugucucuacuaaaaauacaacaauuagcugggcguggucgcacgcuccuauaaucccaccuacuggggaggcugaggcaggagaauugcuugaaccugggaggcggagguugcagugagccgagaucgugccauugcacuccagccugggcaacaagagcaaaacucaucuaaagaaaaaaaauaaaucguuuaauacuugaaacuuuuaguguuuggaaauuguccugguccacaggaggggacauguuuaaaaggagaugucuguugggaggcugaggcaggcaaguugcuugagcccaggaguucgaaaccagccugggcaacauggcaaaacccugucucuacuaaauauauaaaaaauuagccaggugugguggcacacaccuguagccccacauacucaggaggcugaggugggaggaucaccugagcccaggaaguugaggcugcagugagcugugaucguaccacugcacuccagccugggcaacaggagugagaaccugucucaaaaaaagaaaagauaucuggaagcgagguuagauuagcccuucucuaaggcuuuuacaacaauagucaauugaauacuaucuuuuuuuuuuuuuugagcacuuaaaccuaacacauagagcuugacuucacuuucucagaagaugcuucaccacagggaauucuuaaugauguuuggauugcaaccuguggcuggaguuauauuucuaaacuuucucuuugaaucuuugguuuagggccaggugugguggcucaugccuauaaucucaacacuuugggaggccaagguagguggaacacuugaggccaggagauagagaucagccuagaacaacagagagagacccugucucucaaaaaaaaaaaaaaaaaaagccagguuuaguaguuugcacccauaguccuagcuacccaagaagcugaggugggaagaauugcuggcacccaggaguucaaggcugcagugagcuucaguugugccauugcacuccagccuaggcgacggagugagacccugucuuuaacaaauaaauaaaccauugauuugguuggaauugugcuucaggacaaccaauaucucuuacaguuugaguuuccucugcauuaauauguacauuaugauguggaaagcuggaaaauccuuagagcaacaucuugaaaacuucaaugguauaugauggccaagcuauguuguaaucaaagucgaauaugucuucuugcccaaaccuuugggaauaaauaccacuccaacaacuucaacaaaagaaauggucugcccccaaaacuucuguucuugccccagucugcuugcauuauaggggaagagaguaauuuugcuaauggucucuuuacaaugaaaagaaaagagaaauguucuguaauuagggaacuuuuauaaagaugcacaguggauuauucugcaagagaaaagcucugucaucacauuuuuaccucuuuuaaccauuucucuaccagaaucuguacauaaaaguuucagaagugcacaguuuuuauuuucagagaaauaggcuuuauauauauaauuuuuuuuuuuugagauggaguuuugcucuugucacccaggcuggagugcaauggcacgaucucagcucacugcaaccucugccuccgaaguucaagugguucuccugccucagccuccuaaguagcugggauuacgggcaugcgccaccacacccagcuaauuuuguauuuuuaguagagacgggguuucuccauguuggucaggcuggucuggaacuccugaccucaguugauccgcccgccucagccucccaaagugcugggauuacaggcaugagccaccgugcccagccaacuuuuuuuuuagagaucuugugugguaggaaaauaaauauugggcaucaugccuggcuaacuuuuguauuuucauagagacaggguuucaccauguugaccaggcugaucuugaacuccugaccucaagugaucccgcccaccucugccucccaaagugcugggauuacaggcucggcgugaaucacuuucauaagcaaucagcuuccccagaauugggagccuaugacugaaaucagaauugucaucgguuugagcacuuuggugcuuauagaagugcuuaagacuuaguuuuucugggucuuuuuacaaguaaguuguucuuuauuucauuaugaaaaaaagcacuguaauuuuaaaaauuuauaguagagauaucugucauuucgggcugcuguaacaaagugccaaagacugggugguuuauauacaacagaaacauuucucauagcucuggagguuggaagucugagaucagcguaccagcauguucagguuuuggugagagccuucuuccagguugcagacuacuguuuucucguauccuuaugugguucaaagagaggagaaagcucucuagggucccuuuuguaggucacugaucccauucaugaagauuccacccucauggccucaucaccucccaaagcccaccuccuaauaccaucacauuggggguuaggauuucaauguaugaauuuggaggggacauaaacauuuaguucauuguaagaaauaaggguaaaauuuagucuuuggaagagaggauaagaaaggugauagcagagcaagaagaagauuauccuuuuaucguugcucuguaaccuuggccagggcacuuaaccagucuacuuuauuaccuuucucuuagucucaucacacaaugagaaacugccauucuuuggaauaaguuuugcugcauggcauuaauggcauucucauacaaaaaaaaaaaagacaaaagaaggcugggcgugguggcucacaccuguaaugccagcacuuugggaggcugaggcagguggaucauuugaggucaggaguucaagaccagccuggccaacauugugaaacccugucucuacuaaaaauaccaaaaaaaaaaaaaaaaaaauuagccaggcaugguggugggcgccuguaaccccagcuacucaggaggcugaggcaggauaaucacuugaacuugggagguggagguugcagugagcugagaucgcaccacugcacuccagccugggcaacagagggagacuccgucucaaaaaaaaaaaaaaaaagacaaaagccauuuucuucucacagcaauggaagugaagacuauugagaugauuuguuuuagagagauucucuuggggugauauggcuggcuuuacucugcaguugguacaugguaugguacaucuggggcacuuguagccagccucugauaacaauaauugcugucuuuguuacucccauuuuccucugucaugguuaccuccacagggauccucuaaguuagggagagguuuauuccucccuccuuuaucaucuuugucugaugugguccuauggucaucauaacacuuaauugggucccugaaaggccacucaacucuuuugauguugcugauguuugaagucuuaugagaagcuucagacaagagugugcaagcucaccagagugcauagaggggcauaugugcauaguauauucacugugccuggaugagaauggguguaggaaggaguguaaaacagaaagggaagccagagagaucuuugagccacaauguaaacuuucaauacuaagcuaagaaguuagcacuuuucucugaacagugaaaaccuauugaagguuuuugaagaggagguaaugauaugauccaguuuguauuuuaggacuggcacucuggucacaauguauuagauuguaaaagccagacuagagggguuuuuuacauuuuuuauuuguuauuuaauuuauuuccaugcaaaagcucaucuaugugaaagcuaguggcuuuuuauauuuuuaucuuuuauuauuuauuuauuuuuauuuguuuguuuauuuauuuuuauuuauuuauuuuauuuuuuuugagacagggucuugcucugucgcccaggcuggacugcaguggcacgaucucggcucacugcaagcuccgccucccagguucacgccauucucccgccucacccuccggaguagcugggacuacaggcgcgugccgccacgcccagcuauguuuuuuguuuuuuguuuuuugggguuuuuuuuguauuuuuuaguacagacgggguuucacuguguuagccaggauggucuugaucuccugaccucgugauccgcccacuucgaccucccaaagugccgggauuacaggcgugagccaccgcucccggccgaaacagcauuuuuaacaaggucauggaaccacccuuugagaaacaauggaccagagacuggaggagaaaaaugaguugggaggcuguuggaccaguaauauaaaagagaaggccgggugcgguggcucacuccuguaaucccagcacuuugggaggccgaggcgggcggaucacgaggucagaagauugagaccauccuggcuaacacggugaaaccccgucucuacuaaaaauacaaaaaauuagccgggcgugguggcgggcgccuguagucccagcuacucgagaugcugaggcaggagaacgggugaacugggaggcgaagcuugcagugagcugagauugcgccacugcacuccagccugggcgacagagugagacuccgucucaaaaaaaaaaaaaaaaaaaacucaaaucucucaaauauaauuucugcucuguauauaucuaucuaauauuuaauauauauauaauacaaguauaaaaguagaauuaggccuuaucucuaaaacaaaagaggaugagcaaagagaugaagauuaauauaugagcagcacaaaagauugcagcagguuuuccaggaauuacaagguuuugagugaauaaaacucaagucaaacauuaauuaauacaaauaagcuuucaguuguguuuuccuuuuugaagauuuuagagaaagaauaagauaauaauauaugcuuuuauuagagaauuugaaguuguucauaaaaagucacuuccauaaugugccuccuucaauccugaagaauuauggcauaauaauguccuacacuugcuuauaucguguuuuauaaucucuaaaccauuuuuguaggcauuucauauaauccuggaacaacuguaaggccuucauauuaucuguuguuuacaaauuaaaucucaggcagguuaaaugacugaucuaagaucacagcugcuacgugauagaacuuggacuccacagcagguguucugcucuaaaccaacuguauuuuccccucucucagcuuuuccuucugacuauaaacuaacauacccugugguuucugucuuaccccauaacucaaaugaauuccugagacauguaagcaucucaaauaaauauuucuaagcagauuucuuaguguuaaaauacuuucaucuuggugauaaaaauuuagguaucagagcacagucauuugauuaaaaaaagcuggacugauauaaaugauugaauaaaacaaauggggagaagagauaaaucuccaguguauaauuccaaguaauucauauaguuauuuaucccucaaggaaguagagcauaauucaccaccccuuaaguugugccagauuuaguaacucccuuccaaaggggacaguguagaaaggagaggaaaagaguaacuucacaauggaagaaacugacagaguacccucaaccaggugaugaagguuaacaucagcaucgaucggucauguugauagcauguauccuugauauugaugugauaaaaaugauacuaucucuguggucuuccucccaaaaaacccauaacuccagucuaauaauaagaaaaacauuaaauaccaguuuauggauauccuacaaaauaccugaccaguucuccucaaaacugucaaggucaucaaaaacaaggaaagucugagaaucucucacauccaagaggagcaauaacaucaauauugguuccuuaguugugacaaauguaagauguuaauaauagaguaaacugggugugcaauaaaugagaacucuacuauuuugcaacuuuucuauaaaucugaaacuguucuuggcugggcauagugcucacgccuguaaucucaguacuuugggaagccaaggugggaggaucacuugagaccagccuggacaacauaguaaggccccaucucuauaaaaaauguuuuuaaaaaauuagccacacgaggugguaagugccuauaguccagcuacucaggaggcugaagugggaggaucaauugagccuggaagcucaaggcugcaaugagcagugauugcaacacugcaguccagccugggcaaugaagcaagacccugucucaaaaaaaagaaaaaaacuauucuaaaauaaauguuuauuuuuaaaaaaaaaagacuagaauagaauaacaccugauaaaacaauuuauuucuuggugaauugauaugaauugaaauguuuuagauuuuccaucccuagauugguaaugaggauuugggauaauaucauuagaggauuaucucaguaucauuaagaagugucaacuugcauaugagcuauuuugaaggagaugagugaauaaguuauuugguucuaacuagaaggaacccauaaaauuaugagaauaauguccauauacaagguaacccugaauauaaugcauucugucaucuuugcagugaaaaaauauuuuuaaaaagugaugugaggccaggcaugguggcucacuccuguaauuccagcacuuuggaagaccaaggugggcagaucacuugagcucaggaguucgagaccagccuggccaacacagugaaacccagucuauacuaaaaaaaaaaaaaaaaaaaaaaaaaaauuagaugagcaugguggcacacaccuguaaucccugcuacuugggaggcugaggcaguagaaucucucgaacccgggaggagguugcagugagcugagaucgcacuccagccugggcaacaaagcgagugagugaaacagagugagugagacucugucuaaaaaaaaaaaaaaaaaaaagugauauggaugaaauagacauauauuuucacauauauaacuaagaccauaaauuuuaucaaauaauauaugaauuuaaagauauugucccccucuauaccaccugucauuuuaaaugaaacauauugcccaaauuuuuuagaugcaacuuugacauuaauaccgguacauaguagguuguauuaguuuguuuuaacacugcugauaaagacacaccugaaacgggggaaaaagguuuaauuggacuuacaguuccacauggcuggggugaccucacaaucauggcgggaggcgaaaggcucuuacaugacagcagcaagagaaaaugaggaagaagcaaaagcagaaaccccugauaaucccaucaaaucucgugagacuuaucacaagaauagcacgagaaugaccagcccccaugauucaauuaccuccccccuaaaucccucccacaacacuugggaauucugggagauacaauucaaguugagauuuugguggggacauagccaaaccauaucauucugcccuggccucuccaaaucucguguccucacacuucaaaaccagucaugccuuuccaacaaucccccaaagucuuaacucauuucaacauuaacccaaaacuccacaguccaaagucucaucugaggccuggcacgguagcucacgccuguaaucccagcacuuugagaggccaaggcagcuggaucaccugaggucaggaguucaagaccagccugcccaauauggcaaaaccccaucuuuacuaaaaaauacaaaaaacuagucgggcaugguggcaagugccuguaaucucagcuacuugagaggcugaggcagaagaaucacuugaacccgggaggcagagauugcagugagcugagaucacaccacugcacuccagccugaacagagugagacuccaucucaaaaaaaauaaaacagagugagacuccaucucaaaaaaaaaaaaaaaaaagucucaucugagacuuugccuugccuuggcaagucccauccgccuaugagccuguaaaaucaaaagcaaacuaguuauuuccuagauacgguggggguacacguauugaguaaauacagccauuccaaaugggagaaauuggccaaaacaaagggguuacagggcccaugcaaguccaaaauccagcggagcagucaaauuuuaaggcuccaaaaugagcuccuuugacuccaggucucacaaacaggucacggugaugcaagaggcggguucucauggucuugggcagcuccgccucuguggcuuugcaggguacagccucccuccugccugcuuucaccagcuggcguuaagugucugcggcuuuuccaggugcacggugcaaguugguggaucuaccauucuagggucuggaggagaguggaccucuucucgcagcuccacuaggcagugccccaguagggacucugugugggggcuccaaccccacauuucccuuacuuacugcccuagcugaggcgcuuuaugagggcccugccucuguagcaaacuuuugucugggcauccaggcauuuccauacaucuaaacuccaggcggagguucccaaaccucaauucuugacuucugugcacccgcaugcucaacaccacauggaagcugcuaaggcuuggguccuccacccucugaagccacagcccgagcuguacauuggccccuuuuagccacggcuggagcagcugggacauggcaccaaguggcugcacacagcauggggaaccugggcccagcccgugaaaccacuuuuuccuccugggccucuggguccuugaugggaggggcugcagggaaguucucugauguggccuugugacacauucuccauggucuuggggauuaacauuaggcuccuugcuacuuaugcaaauuucugcagcuggcuugaauuucuccccagaaaauugguuuuucuuuucuaucacauaggcugcaaauuuuccaaacuuuuaugcucugcuuuccuuauaaaacugaaugccuuuaacagcacccaaguuaucucuuaaaugcuuugcugcuuggaaauuucuuccaccagauacccuaaaucucucucaaguucaaaguuccagaaaacucuagggcacgggcaaaaugccaccaguaucuuugcuaaaacauaacaagagucaccuuugcuccagugccgaacaaguuccucaucuccaucugaauuuuauuguccauauugcuaucagcauuuugggcaaagccauucaacaagucucuaggaaguuccaaacuuucccacauuuuccugucuucuucugagcccuucaaacuguuccaaccucugccuguuacccaguuucaaaguugcuuccacauuuucagguaucuuuucagcaacgcccccaaucuacugguaccaauuuacuguauuaguuuguuuucaugcugcuaauaaagacauacccgaaacugggaacaacaaaaaaaaagcuuuaauuggacuuacaguuccacaugguuggagaggccucagaaucauggcgggaggugaaagccucuucuuacauggcggcggcaagagaaaaugaggaagaagcaauagugcauucagaacccauuguggacucaguguucccaagaaccucucaagggaggugccacugacaccaggaccugaggcugugaagaauaagguuaagaguacucaggcugcuuggugcaggugagaagagguauuaguguauuggagaaagaguuaagaggcuuuugugccuagggcauagugauugaggggccuuguagaccauggaaagaacucgauuuuuuuaagugcagaggaaagccagggauugacaucuaacuuacaguuuuaaaagacccuuuccuucuaugaagagaauggagaaggaggcaagaauagaagcggggaaaaccagucagaaugcuagaugggagacaauaaagaauuaauugucauugauaauaauaauagcuaacacauggcuuacuaaugccaaggacuguuguagcacauuuuaugaaccagcucauuuaaaugugcucuucaguuagcacacucuuucauucuuuaaaguaucauaggucgggugugguggcucacgccuguaaucccagcacucugggaggacgaggcaggcggaucaccugaggucaggaguucaagaccagccuggccaacauggugaaaccccgucucuacuaaaaauacaaaaauuagccaggugugguggcgcaugccuguaaucccagcuacucaggaggcuaagacaggagaaucgcuugaacccgggaggcggagguugcagugagccgagaucgcaccacugcacuccagccugggcaacaaagagcgaaacuccaucucaaaagaaaaaaaguaucaucguuuggaugauaaauuacacgaaacuaugaaccagccaauuaacauuuucagaggagcuuaacacuuggaauacuuagucuuccuccuguucucaucaauuucaaacugucuugugaaacucacuaacccagacagcuauacaguauuaaaguaggaagaaaacuguaugggaucuaucuccaaauuuucggagacucuuccuuuuuguugccuucuguccuggcucugucucuugguucugaguuguaugugggccuuucuguguuuuuucucagucuuuuuuuccccuucacuccgucccugugucucuccugugugugucccccguguuucuuuucucuuucugcuuuuugucuuccccauuccuucucacucucuguucucuuacccugauuucucuuucuuccuccuucaacuggccggugagguacgggcauguaguguggaucuguuuauuauauaaaaaaugauguugacuauuuccauuuaaaacgaaucaagucucucagaaccaguguacucauuccaaaauacucauagaugauuguuacaaacuacuuuaacaggaguguccaaucuuuuggcuucccugggccacauuggaagaagaauuaucuuggagcacauguaaaauacaccaacgggccaggcacuguggcucaugccuguaaucccagcacuuugggagaccgaggcagguggauugcuugaggucagggguuugagaccagccugggcaacauagugaaaccccgucuguacuaaaaauacaaaaaauuagccggacaugggggcgggcacauguaaucccagcuacucaggaugcugaggcaggagaaucacuugaaccugggacguggagguugcagugagccgagauugcaccacugcacuccagccuggacaacagauugggacuccgucucaaaaauaaaauaaaguaaaauaaaaauuaaaaaauaaaauacacugacgauagcugaugaacuaaaaaauaaauaaaaaaguuuuaagaaaguuuacaaauuuguguugggccacaugcagcccagaggccauggguuggacaagcuugguucaaaucauuuuauuauccuguuuucuacuuucacaucucucaaggaaauuuaccuaguaccccguucaucuaacugaucucuucugauccccaauccuucccuucccauucuaccacccaccuccuucacugccuucuauaccucaagucugcccccagcuccagcaccagacugcaccuaaaucacaccaggucacaacuauucuguaagacacaagaggauuugcguaaccuguguugagccaagugucacccauucuuccauaauauuuauggaauauuuacuuccuuuuuuaccuuuccuaacgcuuaauacuuugcaaacuauugguuuuguucugaagcuuacuuuuaagauauucuuauuuuacauacgaaagugcuuccuuauguuugccugguuccaaauuagaggguaccagagcccgaucuccucuaagcaggaggcuucccauaggaaaggaauguuccuuugugcucauccuucguauaaaucaccagggagcuuuuaaaugaacaaagaccuggcugacccagaggguagaacuuauaaauaguacuccagccccuccuuuaaagccuguccaccuaauccuccucucaagauuggaagugacuugaccuuugagucuuaaaacucaggcucuuuuucucuaaaaaaucugguuagcaguaagcuguuaaaacaaauauguuuuuagccagaugaugaccaaucaucaaagcuugucuuucauuucuagcauuuuuagccaaauguuuccucgguuuuuuuuguguguuuuuguuuuuguuuuggcuccucagaagucaacuugaaguuuccucuuuugaggaccagcuuuucucauuguuauuauuuuaagacaucuaccuuaauaacuuuuauuucuccuuacuaauagacuauuauggauuuccauuuuauaaagauguucccaaauugcugcauuucuaccaugaacuaagggcuuccuuuucaccccuaaaauuacagaacuuagaggggccuucaauggccucaaucccaacgucguuggauggagcucucuuuguauuucucuaaugcuguauugaggauaaaaucuuacaaaacuuguuaaggauuaaaaugugcaaggauuauaaaaugaugcacaugauauagauacugguagauaauuuuccagauuagggcacaugcaggaauaacuauguauauugaacuggcuaaacauauaaauauauuuuauagaauauauuuuuaugugauucccaaaaagauaagcaauuagggccgggcacgguggcucaacgccuguaaucccagcauuuugggaggccgaggcaggcagaucaccucagguugggaguucgagaccagccugaccaacauggagaaaccccaucgcuacuaaaaauacaaaauuagccgggcaugguggcgcaugccuguaaucccaaauacucaggaggcugaggcaggagaaucacuugaacccgggaggcggagguuguggugagccgagaucgugccauucacuccagucggggcaacaagagcgaaacucugucuccaaaaaaaaaaaaaaaagaaaagcaauuaaguccuuaaccugguuauuuacagagaaaagacauucauguuguggaaaucaaccauguauuuuuagcuacuucucucccuugaaauaaggggagcuuaaauuuacuauucacuaaaugccagauagaagacuaauuuaaaacaucuuucuuuuuuaucauuuaauacauagauugaagaguaaguccuggccccaggcuuugcuuuucugaccucugccagucacaguagugcuuuuucuggaaguucagucugcuccaacugcagcuuugugcagggacccuccgggacuuuucuaguuuugcuagaaugccucaucugccugugagccuggaacuguagaagucauuuuaguuuuguuuagucuuauuguuuaauuuaagaaagucugauguccauguugccguaguggguacauaggacacuaucggcugugaaagaaugaaaagcuuguucagagaaggucgaaugaggacuaugucuucagaaaaccuugggcuuagcugccugggacaguuuagaucugagcucagaggggauugauagagcaguaguaucuguuguuuuccuucugccguugggaagcuuucucuuaacauauagagacccugggaugugugagcauauuuauaguaauuauaauugugagacaugaccuaaggaaguaugugaacuugcuuuugaauuuaguuguuuaaaaaaaaaaaguggaguuugaaaauaugaaccagaggaaggcagaucacacggguggagaggaacggcacugucuggagauguauugagcauagaaggagaguuuguuaggaauugcacacccugaggggagaaugacacagccaaugugaucugaaagcgacaguacauucaugcagggaugcccacaagcagguugagugcacagaaagauagacuccucaucacauugcaggcacucugcugaauaacccuuuguuauauuuugagacuuuucuuuuuuuuuuuuuuuuuuuuugagacggaaucuugcucugucgccaggcuggagugcaguacaugaucuuggcucacugcucacugcaaccuccgccuccucuguucaagcgauucuccugccucagccuccugauuagcugggacuacaggcgcacaccaccacgcccagcuaauucuuguauuuuuaguagaaacgggguuucaccauguuggccaagauggucuugaucucuugaccucgugauccgcccgccucggccuccaaaagugcugcaauuacaggcgugagccacgacgcccagccgagacuuuucucguauagcagcaaaaccuagacagaaucucuccagaggguaaaauauaguguuauuacacacaugaugauuccagucagcuguguuguuuaggguucuucacugcaagcuauucaaacaaugggaaaggguaucugaggcuuuuggagcugccuggaaguugaaggacagggucuguagcaaagaccacacaguaggaaagggcagguuggcaugccccugcugcccccacccugaagaacuuccaacucccucgaaaguccuguagcuucaggaccccagaacuggguagcacguguccaaggcuaggccuucuugugcucaccccugauuaugccagggcugggagaaaaggaucuggccuuucuagcugcuguagugcaaagcagucacugccuuccacaagguagagacucucuucuuugggaagagagucugaucacaagauagcaaaaaaagaaaaccaaaaaaaagacacauguaaacuauaucuauauuauacauauauuuaucugcagcucagucucuucgcaaauauuaacgaucuuuugcagacagccucugugcuugcauaauguuaauuuucuuuuccuuuaaugguuugucaauuguuuuuuaaaacaaaacaaaaaaaaccuuagcacucucuucuuaaaguuagucuuuauuuuuauuaaguuguauguguucaucauuuaaagaaucauagucagccgggcaagguggcucacaccuguaaucgcagcacuuugggaggccaaggcaagcggaucaccugaggucgggaguuugagaccagccugaacaacauggagaaaccccaucuccaguuaaaaauacaaaaauuagccgggcaugguggugcaugccuguaaucccagcuacucaggaggcugaggcaggagaauugcuugaacccaggagguggagauugcagugagccaagaucaugccauugcacuccagccugggcaacaagagcgaaaccaucucaaaaaaaaaacaaaaaacacagucuaucuaguuucuaaugaagagcaccacucccugucccccuauuuucuacuccccagagaaaacuauuuucaauccuuuuuagcuuauuuauuugguauucaucuugguauuucuaaaaagcaaaauguggcuaugucguaauguuuccauuuuagcauuauuuauccacuuuccacuacggaaaaugacaguuuuguuguuucucaacauuucgugccugacuauccagauauacauacucuuguucccccauccucccagguaaauuauauuggguguuagcaugugcuuucauuguuaugaccauaucagcacuacuugcaaugaagccaugaguuauacuaugacuacuuuuuucuuccaguacuaccuuuaauuuuucuugaugucaguacuuggauuuuugucauuugcuuagauuuucugugcuucucaugaauuugaccccaaaaucucccucuaauuguauaaaucuccuuuccauauaaacacacuagguauucuaugaauuuuaucuuuuuaaaagaaaaucucuuccugagcuuugugaccugcucuagccuggacccuggacuagucacucuccagaccuguuaaagagcuauugucuugggaucuuccuucacugucacucaggggacucccuucagcuguuucuugcuugcuauaucccaugucauccccuuucuugguuuucucugucauuuugaugaagccauauuuuccuuaguuucuuaagaaagcaaauauuuuuuaguuuguuucaggaauuguuucccugaaaauuuuaaaggcccugcuaaguugucuccuacccuccaggguuccuuuugaauuugauuuauucugauuuuuuuuccuauucugauuugacccuuuguauaaugacuuguuuaaccucuggaagcuuuucgcuuuucuuuaucuuugauauucuguaaaugcacuaaugaugugacuugggcauuugcuacacccuuuuuuuuuuuuuuuuuuuuuuuuugagacaggguuucgcucuuguugaggcuggagugcaauggcgcaaucucccggguucaagugauucuccugccucagccuccugaguagcugggauuacaggcaggcaccaccacgucuggcuaauuuuguguuuucgguagagaugggguuucuccauguuggucaggcuggucucgaacucccgacuucaggugauccgcccgccucagccucccaaagugcugggauuacaggugagccaucgcuccuggccuagacacuuuccaucuacgaaauuuucuugaauuaauuuauugaugccauccuccccucuguucucucuguucuaccuuucuagaacuucuauuaguuagacacuagaacucuuggacuauucuuggacuauaaguuuuugugccuuuacucuccuuuuuuuuuuuuuuuuuuuuuuugagacagggucucccucugucgcccaggcuggagugcagucgcaugaucucggcucacugcagcauugauuuuguggacucaggcaauccucucaccucagccuccagaguagcugggaccacaggcaugcaccaccaugacuuguuaauuuuguauuuuuguagagaugggguuucaccauguuucccaggcuaaucucaaacuccugagcucaaggaauccacccaccucagccucccaaagugcuggaauuacaggugugagccaccacacucagccugcucuccuguuuucuauccuugccuuuuucguucugaaagcuuucuucaauuuugucuuuguguugaguuguuugguucugcuaucaaaauauauguguuucuagaguucuuuuuuguucucugaauauucuuuuuuaaauugguauuauugacucauuuaauguaugaaacaauacagaaacuagaaaauauaaauacuuauguuagaaggcauuuucugacagagaacaucaguuaaccagcuucauaaguuguaaccucaaaccagagaaauucaccuaaaauauacagaauuuuauuauauuaauuuuuagugucuguaaagguuaugucuuaucucucuuuuuuaaugcuccuuuuuaaaacuuaugucuuuaucuguaagccucuuuauucuucuaaguuacuuuuuucuuuuaguuuguuuuggucugucuuucauaauaaaugcuuucuuaaauuucuguugauacuuggcuaucuucucauauuuaaaaacagggcacucagaggcugaggcagacagaucacuugaggucaggaguucgagaccagccuggccaacauggugaaaccccaucucuauuaaaaauacaaaaauaagcugggcuuggugacgugcuccuauaauuccagcuacucaggaggcugaggcacaagaauugcuugaaccaaggagaugaagguuguagugagccgagauugugccacugcauuccagccugugugacagagugagacucuguuucaaaaaaaaaaaacagagggggccacuacaaagcaauuugagaguucugugcuugugggugaaguuuauggacuguggcauucacuauagagugaucuucaugaguuguuuccuugggguacaucugauauuuguuucuuuagguauuuuaucuugguuggucagauccuguugguaaauuuuaaauuuugcacuauucguuuucugucccuuucuugcagucucuaggugugugcagucuuaggauucucauagauaaaaguaacuucucuagguuucugcuucuuccuuuagaugucuuuuugacucuccucacauucuuaugugcuuccauggcaaugagcaguuugacaaacuuuuuaaaaaguaaacaagaguuggugggaguaaacaugagacaccuagaauacaaagugggagucacuuucagugccuuauuuuuccuuagucauauuugaucagaaauuggaugaaccuucgggaugcugagacagggaagauacucuggcaaggaacagaagaccugucugucccugguguggagcaugaagguacuuuccaacccuuuaucuacacagggcugugaccaaugccagacuagcaccugagcauaagagagcuaaguuaacacauaccuaauaggcgggugagccccugaagacacagcauguuaauccauguguuguugacaguuucaguuacuuucuuuuuuuuuuuuuuuuuuuuuuuuugagacacagucuugcucuaucacccaggcuggauggaaugcaguggugugaucuuggcucacugcaaccucugcuucccagguuccagcgauuuucaugccucagccucccgaguagcugggacuacaggcgugcgccaccacaucuggcuaauuuuuguauuuugaguagagaugggguuucaccauguuggccauccuggucucgaacuccggacaucaagugaucugcccgccucagccucccaaagugcugggauuacaggugugagccaccacgcccagccaguuacuuucuuaacaguucuuucucucacuucccaaaacccauuuugugcugauauuuuaccauuagaacauacccaaagauagaaacuaagaucucaacuuuuucuccaaaagaaaauuugcauuuuuaucucccugaaguaaagaagaaggaagggguuaaaaucaccagaacagaguagagagaagguacccaugcagcccccuuccugaugagaguaguuagaugaggcccuuagaugcacaaaaccugguguuccuugaagaucuaauaucuuucagauacgggugaccaauuagagaccucugcuuucagccacacaaaguguaaugcacuuaccaaggcauuauccaaaauguaagaaaguguucucuaaaucagcuguaagaaaguguucucuaaaucagcuguaagaagcucccagaaauuugaagcaucauaguccugugguuuucauuuagaaaggcuucaacauuuguuuuucucuuaccagcccguguucccaagaaaauccucaagugcaaggcagugucucgagaacuuaauuuuucuucgacagaacaaauggaaaaauuccgccuggaacaaaaaguuuacuucaaagggcaaugccuagaagguauucugcugccuacaugccugaaaucagggcuuagggcgaccaggacaaaaggcaacaauacccagugaacuaaagcagugcuuugauaacauuccuuuuacaacucaguuugugguaggauuccuacacucugcaagacugugaauccccagugaaacaaaccaaaacaaagcuagccacuacaaggggcuuugaggucucugacacugggagcguggaugguggugccugguuuaggcacugacguuguauugugauaugaucauggaggaagcugcuaugagcagggccuaguacagugcucuacauacaguaucauacagauuugacuggcaaggccacucugcauugaauucucaccaugcaguguaaagggcacauaagccccuucaagcuaauuccaagugaauuuaacuauguaucuauauauaguucacaucuagccuaccucuaagaaaaugcugcuuauauuguguccugcucgcugguccuaguccuuuagaccucaaagcaugagaagcaagccuuuggugugguucagaggacaaccugagcaggcuucccugucuuuuuuacgccccuggucugagagguugcugauagcuuccuuuggugguucucaggguaggaagaggcucacucuagagagggagacaaagagcccuuaaacuuuauacuggggcaccugcucaccccggcuuuuccuucuuccuucagaaugguucuucgaguuuggcuuugugaucccuaacuccacaaauaccuggcaguccuugauagaggcagcacccgagucccagaugaugccagcaagcgucuuaacgugagugagcaggucucaggaaauuaugaagugugucuagaaacaggcauuccaggcaggugggacuccuggugccauucagugggcagagagcucgguugagaaauagaguaaaagaguauccaaggguaucuagguuuccagguuccugaccuuuuucauaugaaaaagacaguaugauagaguagaaagaauaaaaaacuaaaaauaaaaauaaaacuuuagauuaaaccagauuuaaauuccugauucacccugacuaccugugucaucuugggcacuaauauacuuuaucucucugagccuuagucuuucaucucuaaacacagaaauuaauucugucuuacagagguguaaugaagauaaaaugugaugacauggaaggagacuggcauuuaauauauauaccgaaucuauguuaauuugcucccauuccugacuaccguacuuccgguaucucuguauuuuguuuagaucaccuuuaacagaaucuggcaaaguccuauuaauaauucuguuuucgaggauacuacuugguuacaguuuuuuggagaauggcuuaccauauuaauagcuuugguuccuguuccaagaacaauuuguuugugcuuuuuccaaaaacacugucaauaacuuccuaccucccauugucugugggaaagauguuagucucucaaauguuauaguaauaguaccuucuaaagaguuagcugggcguaauggcacacaccuguaaucccagcuacucaagaagcugagauaggagaauugcuugaacccaggagguggagguuacaaugagccaagaucaugucacugcauuccagccuggguagcagaccaagacucuauuucaaaaaaaaaagaguuagucccacagauaauuguguaauauuggaucaucucuuucaacaguuccuuuaugaaagccauauugaauuuguuaaaaauugagguuauugacuuuaagguuuuuuguuuuuguuuuggguuuuguuuauuuuauuuuuuuaaaaaacagggucuugccauguugcccaggcuggacuccaacuccugggcucaagugaucuuccuagcucagccuccuaaguaggugagacuacaggcaugugccaccaugccugucucuacuuuuuaaguuuuuuuuuuuuuuuuugagacagagucucgcccugucacccaggcuggagugcaguggcgugaucucagcucacugccagcuccgccucccagguucaagcaacucuccugucucagccucccaaguagcugggauuacaggcauacaccaccacaccgguuaauuuuuuuuuuguauuuuuaguagagacaggguuucaccauauuggucaagcuggucucgaacuccuaaccucgggugauccacccgccucaaccucccaaagugcugggauuacaggcaugagccaccgugcccagccccuuuuuaaaguuuuuaauaguuuuuuuaacagccagguguggugacacuuuccuauaauccuagcuacuugggaagcugaggcgggaggauugcuugaguccaagaguuugagacuagcuugggcaacauagauuuuguaagaggcugggcgcaguggcucacaccuguaaucccagcacuuugggaagccaagucggguggaucacgaggucaggaaaucgagaccaucuuggcuaacacagugaaaccccaucucuacuaaaaauacaaaaaaucagcugggcauggcggcacacgcuuguagucccagcuacucgggaggcugaggcaggagaucacuugaaucugggugccggagguugcagugagccgagaucacgccucugcacuccacccugggugacagggcgagacuccaccucaaaaaaaaaaaaaaauuguaauagaauuuuuuaaaguuuuaauaguuuuaaaaguagauuuuuuuuuuuuuuuuuugauauggagucucgcucuguugcccaggcuggagugcaguggcaagaucucggcucacugcaagcuccaccucccagguucccaucuuucuccugccucagccuuccgaguagcugggacuacaggcacccgccaccacgcccagcuaauuuuucguauuuuuaguagagacgggguuucaccauguuagccaggauggucucgaucuccugaccucgugauccgcccgccucggccucccaaagugcugggauuacagacgugagccaccgugccuggccuaaaaguagauuuuuuaauuacaguaguagcuauuuuuauaucuuaucagccagucagauucugaguaccuuauuuaccuguuuuuugggguuuuuuuuuuuguuuuuuuuuuugagacggagucucgcucugucgcccaggcuggagugcaguagcaugaucccagcucacugcaaccuccgccucccagguucacgccauucuccugccucagccuccugaguagcugagacuacaggcacccgccaccacgcccggcuauuuuuuuuuuuuuauauuuuuaguacagacgggguuucaccauguuagccaggauggucucgaucuccugaccucaugaucugcccgccucagccucccaaagugcugggauuacaggcaugagccaccaugcccggccuauuuaccuguuuuauaauuaauuaccagcagaaauguaucugcugguuauuaauuacccugggaaaguacagaguaguuuaggaaagcagggguuuuuuuuuuuuagauuuuauuaaacuucauuugacuucuucuucacgaggcgugauuuuuuguugcuguuuuuuuuugagacggucucgcucugucucaaaccuaucauaagaugaaaauaucauaagucaaaaaugcauuuaauauccccauaaauccacuauaaaguugaaagaucauaaguugauucauuauaaguagggaaccaacuauacuuaacuuuuuauuuuuuauuuuuuuuuauuuuuuuugagacagagucucgcucugucgcggaggcuggagugcaguggcgugaucucggcucacugcaagcuccgccucccggguucccaccauucuccugccucagccucccgaguagcugggacuauaggcgcccgccaccacgccuggcuaauuuuuuuguauuuuuaguagagacaggguuucacccuguuuagccaggauggucucaaucuccugaccuugugauccgcccaccucggacucccaaagugcugggauuacaggcaugagccaccgugcccggcuacuuaacuuuuuagaacccccaaaaacaguugcccuaaacucagcucaagugugauuugguaaggccauggucucucccauuuuacaaaugggagcaccgagauacccaccaagaaaaaugaaauucuucccucacaccucacaauacaggugcaucauuuaguguucuguaguuguaagucauagaaacaggcucuggcuaauacaagagcugaaagacuaagggggagagcugggcggcuuggaagaugcagaugggcaggaaucccuggauggcuuccucaaggagaagcuacaggaaggaucuugcucaagagaaagagucugauuggccuaaguuacauccucuguucacccuuuugccaggugagugaggggccacucacuuggcacauggacuggaggaagggugguucccaaaugaagagcaaggugcuguuacccaaaggcaggaaaauagaugugggccaggccaaagcccaccuuucgacuauugugaguacuguagggaaggauacugccccugaggucugcaggcuucuauauguaagccagccagagguguccaugaaugcaguaucagaaagucagucggaucuauaagcacccugugugcagagcacucuacuaagggcuuuagaguguaccaaggaguggagacaugcucucacuucugauuugugagcuugacagggaugaauguaaccacauaaguuaaaugucauguuagacuuguagccccauauagacaaggauuuuaauguccccaagcuaagacucugggugggugcauguccauuggcccaggaauccagauggaaaccacuuuguggaaaugaaaucuugugccuaacaugcucacucucuuuugcccucuguuucucuucuuacuuacagugggaacguuaucauagaaacaaaguuuuuugacgacgaucuucuuguaagcacauccagagugagacuuuucuauguuugaaagaagaauguguguacauuucaagaauuuggguuuuuuggagggaggaggaaacuguuuacuuuuuuccuccacacguuugauuuuugacacauacaccccuaauucccucaacagcagaaccuaccugcagccaccaggggaccagcucuguguagguaaccagauggcucuuuuucccaagccaccaucuuccagcugaccagacuaaacucccaaccccagaccagggcaggggacaggucucaaguccuucccagcauacacacagggaacaaacacauaccacaaaccgguaacuguaccugucacccuccuugucuccuccuugggcccuacaggcuacacaucuaccuuuggccccugguuuuggaaaaauuccguguuccugacccauguuuaguuuuuuccuaccauuucuauuucauacauucucauacauuuaacuuguaaaauagacugugauauuauuacauaauguaauuaaaaauaugaauuaaaauauuccuacaguc

SEQ ID NO: 191125 - RNA, 48828 nt, Homo sapiens
gacuguaggaauauuuuaauucauauuuuuaauuacauuauguaauaauaucacagucuauuuuacaaguuaaauguaugagaauguaugaaauagaaaugguaggaaaaaacuaaacaugggucaggaacacggaauuuuuccaaaaccaggggccaaagguagauguguagccuguagggcccaaggaggagacaaggagggugacagguacaguuaccgguuugugguauguguuuguucccuguguguaugcugggaaggacuugagaccuguccccugcccuggucugggguugggaguuuagucuggucagcuggaagaugguggcuugggaaaaagagccaucugguuaccuacacagagcugguccccugguggcugcagguagguucugcuguugagggaauuagggguguaugugucaaaaaucaaacguguggaggaaaaaaguaaacaguuuccuccucccuccaaaaaacccaaauucuugaaauguacacacauucuucuuucaaacauagaaaagucucacucuggaugugcuuacaagaagaucgucgucaaaaaacuuuguuucuaugauaacguucccacuguaaguaagaagagaaacagagggcaaaagagagugagcauguuaggcacaagauuucauuuccacaaagugguuuccaucuggauuccugggccaauggacaugcacccacccagagucuuagcuuggggacauuaaaauccuugucuauauggggcuacaagucuaacaugacauuuaacuuaugugguuacauucaucccugucaagcucacaaaucagaagugagagcaugucuccacuccuugguacacucuaaagcccuuaguagagugcucugcacacagggugcuuauagauccgacugacuuucugauacugcauucauggacaccucuggcuggcuuacauauagaagccugcagaccucaggggcaguauccuucccuacaguacucacaauagucgaaaggugggcuuuggccuggcccacaucuauuuuccugccuuuggguaacagcaccuugcucuucauuugggaaccacccuuccuccaguccaugugccaagugaguggccccucacucaccuggcaaaagggugaacagaggauguaacuuaggccaaucagacucuuucucuugagcaagauccuuccuguagcuucuccuugaggaagccauccagggauuccugcccaucugcaucuuccaagccgcccagcucucccccuuagucuuucagcucuuguauuagccagagccuguuucuaugacuuacaacuacagaacacuaaaugaugcaccuguauugugaggugugagggaagaauuucauuuuucuugguggguaucucggugcucccauuuguaaaaugggagagaccauggccuuaccaaaucacacuugagcugaguuuagggcaacuguuuuuggggguucuaaaaaguuaaguagccgggcacgguggcucaugccuguaaucccagcacuuugggaguccgaggugggcggaucacaaggucaggagauugagaccauccuggcuaaacagggugaaacccugucucuacuaaaaauacaaaaaaauuagccaggcgugguggcgggcgccuauagucccagcuacucgggaggcugaggcaggagaauggugggaacccgggaggcggagcuugcagugagccgagaucacgccacugcacuccagccuccgcgacagagcgagacucugucucaaaaaaaauaaaaaaaaauaaaaaauaaaaaguuaaguauaguugguucccuacuuauaaugaaucaacuuaugaucuuucaacuuuauaguggauuuauggggauauuaaaugcauuuuugacuuaugauauuuucaucuuaugauagguuugagacagagcgagaccgucucaaaaaaaaacagcaacaaaaaaucacgccucgugaagaagaagucaaaugaaguuuaauaaaaucuaaaaaaaaaaaaccccugcuuuccuaaacuacucuguacuuucccaggguaauuaauaaccagcagauacauuucugcugguaauuaauuauaaaacagguaaauaggccgggcaugguggcucaugccuguaaucccagcacuuugggaggcugaggcgggcagaucaugaggucaggagaucgagaccauccuggcuaacauggugaaaccccgucuguacuaaaaauauaaaaaaaaaaaaauagccgggcgugguggcgggugccuguagucucagcuacucaggaggcugaggcaggagaauggcgugaaccugggaggcggagguugcagugagcugggaucaugcuacugcacuccagccugggcgacagagcgagacuccgucucaaaaaaaaaaacaaaaaaaaaaaccccaaaaaacagguaaauaagguacucagaaucugacuggcugauaagauauaaaaauagcuacuacuguaauuaaaaaaucuacuuuuaggccaggcacgguggcucacgucuguaaucccagcacuuugggaggccgaggcgggcggaucacgaggucaggagaucgagaccauccuggcuaacauggugaaaccccgucucuacuaaaaauacgaaaaauuagcugggcgugguggcgggugccuguagucccagcuacucggaaggcugaggcaggagaaagaugggaaccugggagguggagcuugcagugagccgagaucuugccacugcacuccagccugggcaacagagcgagacuccauaucaaaaaaaaaaaaaaaaaaucuacuuuuaaaacuauuaaaacuuuaaaaaauucuauuacaauuuuuuuuuuuuuuugagguggagucucgcccugucacccaggguggagugcagaggcgugaucucggcucacugcaaccuccggcacccagauucaagugaucuccugccucagccucccgaguagcugggacuacaagcgugugccgccaugcccagcugauuuuuuguauuuuuaguagagaugggguuucacuguguuagccaagauggucucgauuuccugaccucgugauccacccgacuuggcuucccaaagugcugggauuacaggugugagccacugcgcccagccucuuacaaaaucuauguugcccaagcuagucucaaacucuuggacucaagcaauccucccgccucagcuucccaaguagcuaggauuauaggaaagugucaccacaccuggcuguuaaaaaaacuauuaaaaacuuuaaaaaggggcugggcacgguggcucaugccuguaaucccagcacuuugggagguugaggcggguggaucacccgagguuaggaguucgagaccagcuugaccaauauggugaaacccugucucuacuaaaaauacaaaaaaaaaauuaaccgguguggugguguaugccuguaaucccagcuacuugggaggcugagacaggagaguugcuugaaccugggaggcggagcuggcagugagcugagaucacgccacugcacuccagccugggugacagggcgagacucugucucaaaaaaaaaaaaaaaaacuuaaaaaguagagacaggcaugguggcacaugccuguagucucaccuacuuaggaggcugagcuaggaagaucacuugagcccaggaguuggaguccagccugggcaacauggcaagacccuguuuuuuaaaaaaauaaaauaaacaaaacccaaaacaaaaacaaaaaaccuuaaagucaauaaccucaauuuuuaacaaauucaauauggcuuucauaaaggaacuguugaaagagaugauccaauauuacacaauuaucugugggacuaacucuuuuuuuuuugaaauagagucuuggucugcuacccaggcuggaaugcagugacaugaucuuggcucauuguaaccuccaccuccuggguucaagcaauucuccuaucucagcuucuugaguagcugggauuacaggugugugccauuacgcccagcuaacucuuuagaagguacuauuacuauaacauuugagagacuaacaucuuucccacagacaaugggagguaggaaguuauugacaguguuuuuggaaaaagcacaaacaaauuguucuuggaacaggaaccaaagcuauuaauaugguaagccauucuccaaaaaacuguaaccaaguaguauccucgaaaacagaauuauuaauaggacuuugccagauucuguuaaaggugaucuaaacaaaauacagagauaccggaaguacgguagucaggaaugggagcaaauuaacauagauucgguauauauauuaaaugccagucuccuuccaugucaucacauuuuaucuucauuacaccucuguaagacagaauuaauuucuguguuuagagaugaaagacuaaggcucagagagauaaaguauauuagugcccaagaugacacagguagucagggugaaucaggaauuuaaaucugguuuaaucuaaaguuuuauuuuuauuuuuaguuuuuuauucuuucuacucuaucauacugucuuuuucauaugaaaaaggucaggaaccuggaaaccuagauacccuuggauacucuuuuacucuauuucucaaccgagcucucugcccacugaauggcaccaggagucccaccugccuggaaugccuguuucuagacacacuucauaauuuccugagaccugcucacucacguuaagacgcuugcuggcaucaucugggacucgggugcugccucuaucaaggacugccagguauuuguggaguuagggaucacaaagccaaacucgaagaaccauucugaaggaagaaggaaaagccggggugagcaggugccccaguauaaaguuuaagggcucuuugucucccucucuagagugagccucuuccuacccugagaaccaccaaaggaagcuaucagcaaccucucagaccaggggcguaaaaaagacagggaagccugcucagguuguccucugaaccacaccaaaggcuugcuucucaugcuuugaggucuaaaggacuaggaccagcgagcaggacacaauauaagcagcauuuucuuagagguaggcuagaugugaacuauauauagauacauaguuaaauucacuuggaauuagcuugaaggggcuuaugugcccuuuacacugcauggugagaauucaaugcagaguggccuugccagucaaaucuguaugauacuguauguagagcacuguacuaggcccugcucauagcagcuuccuccaugaucauaucacaauacaacgucagugccuaaaccaggcaccaccauccacgcucccagugucagagaccucaaagccccuuguaguggcuagcuuuguuuugguuuguuucacuggggauucacagucuugcagaguguaggaauccuaccacaaacugaguuguaaaaggaauguuaucaaagcacugcuuuaguucacuggguauuguugccuuuuguccuggucgcccuaagcccugauuucaggcauguaggcagcagaauaccuucuaggcauugcccuuugaaguaaacuuuuuguuccaggcggaauuuuuccauuuguucugucgaagaaaaauuaaguucucgagacacugccuugcacuugaggauuuucuugggaacacgggcugguaagagaaaaacaaauguugaagccuuucuaaaugaaaaccacaggacuaugaugcuucaaauuucugggagcuucuuacagcugauuuagagaacacuuucuuacagcugauuuagagaacacuuucuuacauuuuggauaaugccuugguaagugcauuacacuuuguguggcugaaagcagaggucucuaauuggucacccguaucugaaagauauuagaucuucaaggaacaccagguuuugugcaucuaagggccucaucuaacuacucucaucaggaagggggcugcauggguaccuucucucuacucuguucuggugauuuuaaccccuuccuucuucuuuacuucagggagauaaaaaugcaaauuuucuuuuggagaaaaaguugagaucuuaguuucuaucuuuggguauguucuaaugguaaaauaucagcacaaaauggguuuugggaagugagagaaagaacuguuaagaaaguaacuggcugggcgugguggcucacaccuguaaucccagcacuuugggaggcugaggcgggcagaucacuugauguccggaguucgagaccaggauggccaacauggugaaaccccaucucuacucaaaauacaaaaauuagccagaugugguggcgcacgccuguagucccagcuacucgggaggcugaggcaugaaaaucgcuggaaccugggaagcagagguugcagugagccaagaucacaccacugcauuccauccagccugggugauagagcaagacugugucucaaaaaaaaaaaaaaaaaaaaaaaaagaaaguaacugaaacugucaacaacacauggauuaacaugcugugucuucaggggcucacccgccuauuagguauguguuaacuuagcucucuuaugcucaggugcuagucuggcauuggucacagcccuguguagauaaaggguuggaaaguaccuucaugcuccacaccagggacagacaggucuucuguuccuugccagaguaucuucccugucucagcaucccgaagguucauccaauuucugaucaaauaugacuaaggaaaaauaaggcacugaaagugacucccacuuuguauucuaggugucucauguuuacucccaccaacucuuguuuacuuuuuaaaaaguuugucaaacugcucauugccauggaagcacauaagaaugugaggagagucaaaaagacaucuaaaggaagaagcagaaaccuagagaaguuacuuuuaucuaugagaauccuaagacugcacacaccuagagacugcaagaaagggacagaaaacgaauagugcaaaauuuaaaauuuaccaacaggaucugaccaaccaagauaaaauaccuaaagaaacaaauaucagauguaccccaaggaaacaacucaugaagaucacucuauagugaaugccacaguccauaaacuucacccacaagcacagaacucucaaauugcuuuguaguggcccccucuguuuuuuuuuuuugaaacagagucucacucugucacacaggcuggaaugcaguggcacaaucucggcucacuacaaccuucaucuccuugguucaagcaauucuugugccucagccuccugaguagcuggaauuauaggagcacgucaccaagcccagcuuauuuuuguauuuuuaauagagaugggguuucaccauguuggccaggcuggucucgaacuccugaccucaagugaucugucugccucagccucugagugcccuguuuuuaaauaugagaagauagccaaguaucaacagaaauuuaagaaagcauuuauuaugaaagacagaccaaaacaaacuaaaagaaaaaaguaacuuagaagaauaaagaggcuuacagauaaagacauaaguuuuaaaaaggagcauuaaaaaagagagauaagacauaaccuuuacagacacuaaaaauuaauauaauaaaauucuguauauuuuaggugaauuucucugguuugagguuacaacuuaugaagcugguuaacugauguucucugucagaaaaugccuucuaacauaaguauuuauauuuucuaguuucuguauuguuucauacauuaaaugagucaauaauaccaauuuaaaaaagaauauucagagaacaaaaaagaacucuagaaacacauauauuuugauagcagaaccaaacaacucaacacaaagacaaaauugaagaaagcuuucagaacgaaaaaggcaaggauagaaaacaggagagcaggcugagugugguggcucacaccuguaauuccagcacuuugggaggcugagguggguggauuccuugagcucaggaguuugagauuagccugggaaacauggugaaaccccaucucuacaaaaauacaaaauuaacaagucaugguggugcaugccuguggucccagcuacucuggaggcugaggugagaggauugccugaguccacaaaaucaaugcugcagugagccgagaucaugcgacugcacuccagccugggcgacagagggagacccugucucaaaaaaaaaaaaaaaaaaaaaaaggagaguaaaggcacaaaaacuuauaguccaagaauaguccaagaguucuagugucuaacuaauagaaguucuagaaagguagaacagagagaacagaggggaggauggcaucaauaaauuaauucaagaaaauuucguagauggaaagugucuaggccaggagcgauggcucaccuguaaucccagcacuuugggaggcugaggcgggcggaucaccugaagucgggaguucgagaccagccugaccaacauggagaaaccccaucucuaccgaaaacacaaaauuagccagacgugguggugccugccuguaaucccagcuacucaggaggcugaggcaggagaaucacuugaacccgggagauugcgccauugcacuccagccucaacaagagcgaaacccugucucaaaaaaaaaaaaaaaaaaaaaaaaaggguguagcaaaugcccaagucacaucauuagugcauuuacagaauaucaaagauaaagaaaagcgaaaagcuuccagagguuaaacaagucauuauacaaagggucaaaucagaauaggaaaaaaaaucagaauaaaucaaauucaaaaggaacccuggaggguaggagacaacuuagcagggccuuuaaaauuuucagggaaacaauuccugaaacaaacuaaaaaauauuugcuuucuuaagaaacuaaggaaaauauggcuucaucaaaaugacagagaaaaccaagaaaggggaugacaugggauauagcaagcaagaaacagcugaagggaguccccugagugacagugaaggaagaucccaagacaauagcucuuuaacaggucuggagagugacuaguccaggguccaggcuagagcaggucacaaagcucaggaagagauuuucuuuuaaaaagauaaaauucauagaauaccuaguguguuuauauggaaaggagauuuauacaauuagagggagauuuuggggucaaauucaugagaagcacagaaaaucuaagcaaaugacaaaaauccaaguacugacaucaagaaaaauuaaagguaguacuggaagaaaaaaguagucauaguauaacucauggcuucauugcaaguagugcugauauggucauaacaaugaaagcacaugcuaacacccaauauaauuuaccugggaggaugggggaacaagaguauguauaucuggauagucaggcacgaaauguugagaaacaacaaaacugucauuuuccguaguggaaaguggauaaauaaugcuaaaauggaaacauuacgacauagccacauuuugcuuuuuagaaauaccaagaugaauaccaaauaaauaagcuaaaaaggauugaaaauaguuuucucuggggaguagaaaauagggggacagggaguggugcucuucauuagaaacuagauagacuguguuuuuuguuuuuuuuuugagaugguuucgcucuuguugcccaggcuggagugcaauggcaugaucuuggcucacugcaaucuccaccuccuggguucaagcaauucuccugccucagccuccugaguagcugggauuacaggcaugcaccaccaugcccggcuaauuuuuguauuuuuaacuggagaugggguuucuccauguuguucaggcuggucucaaacucccgaccucaggugauccgcuugccuuggccucccaaagugcugcgauuacaggugugagccaccuugcccggcugacuaugauucuuuaaaugaugaacacauacaacuuaauaaaaauaaagacuaacuuuaagaagagagugcuaagguuuuuuuuguuuuguuuuaaaaaacaauugacaaaccauuaaaggaaaagaaaauuaacauuaugcaagcacagaggcugucugcaaaagaucguuaauauuugcgaagagacugagcugcagauaaauauauguauaauauagauauaguuuacaugugucuuuuuuuugguuuucuuuuuuugcuaucuugugaucagacucucuucccaaagaagagagucucuaccuuguggaaggcagugacugcuuugcacuacagcagcuagaaaggccagauccuuuucucccagcccuggcauaaucaggggugagcacaagaaggccuagccuuggacacgugcuacccaguucugggguccugaagcuacaggacuuucgagggaguuggaaguucuucagggugggggcagcaggggcaugccaaccugcccuuuccuacuguguggucuuugcuacagacccuguccuucaacuuccaggcagcuccaaaagccucagauacccuuucccauuguuugaauagcuugcagugaagaacccuaaacaacacagcugacuggaaucaucauguguguaauaacacuauauuuuacccucuggagagauucugucuagguuuugcugcuauacgagaaaagucucggcugggcgucguggcucacgccuguaauugcagcacuuuuggaggccgaggcgggcggaucacgaggucaagagaucaagaccaucuuggccaacauggugaaaccccguuucuacuaaaaauacaagaauuagcugggcgugguggugugcgccuguagucccagcuaaucaggaggcugaggcaggagaaucgcuugaacagaggaggcggagguugcagugagcagugagccaagaucauguacugcacuccagccuggcgacagagcaagauuccgucucaaaaaaaaaaaaaaaaaaaaagaaaagucucaaaauauaacaaaggguuauucagcagagugccugcaaugugaugaggagucuaucuuucugugcacucaaccugcuugugggcaucccugcaugaauguacugucgcuuucagaucacauuggcugugucauucuccccucagggugugcaauuccuaacaaacucuccuucuaugcucaauacaucuccagacagugccguuccucuccacccgugugaucugccuuccucugguucauauuuucaaacuccacuuuuuuuuuuuaaacaacuaaauucaaaagcaaguucacauacuuccuuaggucaugucucacaauuauaauuacuauaaauaugcucacacaucccagggucucuauauguuaagagaaagcuucccaacggcagaaggaaaacaacagauacuacugcucuaucaauccccucugagcucagaucuaaacugucccaggcagcuaagcccaagguuuucugaagacauaguccucauucgaccuucucugaacaagcuuuucauucuuucacagccgauaguguccuauguacccacuacggcaacauggacaucagacuuucuuaaauuaaacaauaagacuaaacaaaacuaaaaugacuucuacaguuccaggcucacaggcagaugaggcauucuagcaaaacuagaaaagucccggagggucccugcacaaagcugcaguuggagcagacugaacuuccagaaaaagcacuacugugacuggcagaggucagaaaagcaaagccuggggccaggacuuacucuucaaucuauguauuaaaugauaaaaaagaaagauguuuuaaauuagucuucuaucuggcauuuagugaauaguaaauuuaagcuccccuuauuucaagggagagaaguagcuaaaaauacaugguugauuuccacaacaugaaugucuuuucucuguaaauaaccagguuaaggacuuaauugcuuuucuuuuuuuuuuuuuuuuggagacagaguuucgcucuuguugccccgacuggagugaauggcacgaucucggcucaccacaaccuccgccucccggguucaagugauucuccugccucagccuccugaguauuugggauuacaggcaugcgccaccaugcccggcuaauuuuguauuuuuaguagcgaugggguuucuccauguuggucaggcuggucucgaacucccaaccugaggugaucugccugccucggccucccaaaaugcugggauuacaggcguugagccaccgugcccggcccuaauugcuuaucuuuuugggaaucacauaaaaauauauucuauaaaauauauuuauauguuuagccaguucaauauacauaguuauuccugcaugugcccuaaucuggaaaauuaucuaccaguaucuauaucaugugcaucauuuuauaauccuugcacauuuuaauccuuaacaaguuuuguaagauuuuauccucaauacagcauuagagaaauacaaagagagcuccauccaacgacguugggauugaggccauugaaggccccucuaaguucuguaauuuuaggggugaaaaggaagcccuuaguucaugguagaaaugcagcaauuugggaacaucuuuauaaaauggaaauccauaauagucuauuaguaaggagaaauaaaaguuauuaagguagaugucuuaaaauaauaacaaugagaaaagcugguccucaaaagaggaaacuucaaguugacuucugaggagccaaaacaaaaacaaaaacacacaaaaaaaaccgaggaaacauuuggcuaaaaaugcuagaaaugaaagacaagcuuugaugauuggucaucaucuggcuaaaaacauauuuguuuuaacagcuuacugcuaaccagauuuuuuagagaaaaagagccugaguuuuaagacucaaaggucaagucacuuccaaucuugagaggaggauuagguggacaggcuuuaaaggaggggcuggaguacuauuuauaaguucuacccucugggucagccaggucuuuguucauuuaaaagcucccuggugauuuauacgaaggaugagcacaaaggaacauuccuuuccuaugggaagccuccugcuuagaggagaucgggcucugguacccucuaauuuggaaccaggcaaacauaaggaagcacuuucguauguaaaauaagaauaucuuaaaaguaagcuucagaacaaaaccaauaguuugcaaaguauuaagcguuaggaaagguaaaaaaggaaguaaauauuccauaaauauuauggaagaaugggugacacuuggcucaacacagguuacgcaaauccucuugugucuuacagaauaguugugaccuggugugauuuaggugcagucuggugcuggagcugggggcagacuugagguauagaaggcagugaaggaggugggugguagaaugggaagggaaggauuggggaucagaagagaucaguuagaugaacgggguacuagguaaauuuccuugagagaugugaaaguagaaaacaggauaauaaaaugauuugaaccaagcuuguccaacccauggccucugggcugcauguggcccaacacaaauuuguaaacuuucuuaaaacuuuuuuauuuauuuuuuaguucaucagcuaucgucaguguauuuuauuuuuuaauuuuuauuuuacuuuauuuuauuuuugagacggagucccaaucuguuguccaggcuggagugcaguggugcaaucucggcucacugcaaccuccacgucccagguucaagugauucuccugccucagcauccugaguagcugggauuacaugugcccgcccccauguccggcuaauuuuuuguauuuuuaguacagacgggguuucacuauguugcccaggcuggucucaaaccccugaccucaagcaauccaccugccucggucucccaaagugcugggauuacaggcaugagccacagugccuggcccguugguguauuuuacaugugcuccaagauaauucuucuuccaauguggcccagggaagccaaaagauuggacacuccuguuaaaguaguuuguaacaaucaucuaugaguauuuuggaaugaguacacugguucugagagacuugauucguuuuaaauggaaauagucaacaucauuuuuuauauaauaaacagauccacacuacaugcccguaccucaccggccaguugaaggaggaagaaagagaaaucaggguaagagaacagagagugagaaggaauggggaagacaaaaagcagaaagagaaaagaaacacgggggacacacacaggagagacacagggacggagugaaggggaaaaaaagacugagaaaaaacacagaaaggcccacauacaacucagaaccaagagacagagccaggacagaaggcaacaaaaaggaagagucuccgaaaauuuggagauagaucccauacaguuuucuuccuacuuuaauacuguauagcugucuggguuagugaguuucacaagacaguuugaaauugaugagaacaggaggaagacuaaguauuccaaguguuaagcuccucugaaaauguuaauuggcugguucauaguuucguguaauuuaucauccaaacgaugauacuuuuuuucuuuugagauggaguuucgcucuuuguugcccaggcuggagugcaguggugcgaucucggcucacugcaaccuccgccucccggguucaagcgauucuccugucuuagccuccugaguagcugggauuacaggcaugcgccaccacaccuggcuaauuuuuguauuuuuaguagagacgggguuucaccauguuggccaggcuggucuugaacuccugaccucaggugauccgccugccucguccucccagagugcugggauuacaggcgugagccaccacacccgaccuaugauacuuuaaagaaugaaagagugugcuaacugaagagcacauuuaaaugagcugguucauaaaaugugcuacaacaguccuuggcauuaguaagccauguguuagcuauuauuauuaucaaugacaauuaauucuuuauugucucccaucuagcauucugacugguuuuccccgcuucuauucuugccuccuucuccauucucuucauagaaggaaagggucuuuuaaaacuguaaguuagaugucaaucccuggcuuuccucugcacuuaaaaaaaucgaguucuuuccauggucuacaaggccccucaaucacuaugcccuaggcacaaaagccucuuaacucuuucuccaauacacuaauaccucuucucaccugcaccaagcagccugaguacucuuaaccuuauucuucacagccucagguccuggugucaguggcaccucccuugagagguucuugggaacacugaguccacaauggguucugaaugcacuauugcuucuuccucauuuucucuugccgccgccauguaagaagaggcuuucaccucccgccaugauucugaggccucuccaaccauguggaacuguaaguccaauuaaagcuuuuuuuuuguuguucccaguuucggguaugucuuuauuagcagcaugaaaacaaacuaauacaguaaauugguaccaguagauugggggcguugcugaaaagauaccugaaaauguggaagcaacuuugaaacuggguaacaggcagagguuggaacaguuugaagggcucagaagaagacaggaaaaugugggaaaguuuggaacuuccuagagacuuguugaauggcuuugcccaaaaugcugauagcaauauggacaauaaaauucagauggagaugaggaacuuguucggcacuggagcaaaggugacucuuguuauguuuuagcaaagauacugguggcauuuugcccgugcccuagaguuuucuggaacuuugaacuugagagagauuuaggguaucugguggaagaaauuuccaagcagcaaagcauuuaagagauaacuugggugcuguuaaaggcauucaguuuuauaaggaaagcagagcauaaaaguuuggaaaauuugcagccuaugugauagaaaagaaaaaccaauuuucuggggagaaauucaagccagcugcagaaauuugcauaaguagcaaggagccuaauguuaauccccaagaccauggagaaugugucacaaggccacaucagagaacuucccugcagccccucccaucaaggacccagaggcccaggaggaaaaagugguuucacgggcugggcccagguuccccaugcugugugcagccacuuggugccaugucccagcugcuccagccguggcuaaaaggggccaauguacagcucgggcuguggcuucagaggguggaggacccaagccuuagcagcuuccaugugguguugagcaugcgggugcacagaagucaagaauugagguuugggaaccuccgccuggaguuuagauguauggaaaugccuggaugcccagacaaaaguuugcuacagaggcagggcccucauaaagcgccucagcuagggcaguaaguaagggaaaugugggguuggagcccccacacagagucccuacuggggcacugccuaguggagcugcgagaagagguccacucuccuccagacccuagaaugguagauccaccaacuugcaccgugcaccuggaaaagccgcagacacuuaacgccagcuggugaaagcaggcaggagggaggcuguacccugcaaagccacagaggcggagcugcccaagaccaugagaacccgccucuugcaucaccgugaccuguuugugagaccuggagucaaaggagcucauuuuggagccuuaaaauuugacugcuccgcuggauuuuggacuugcaugggcccuguaaccccuuuguuuuggccaauuucucccauuuggaauggcuguauuuacucaauacguguacccccaccguaucuaggaaauaacuaguuugcuuuugauuuuacaggcucauaggcggaugggacuugccaaggcaaggcaaagucucagaugagacuuuuuuuuuuuuuuuuuugagauggagucucacucuguuuuauuuuuuuugagauggagucucacucuguucaggcuggagugcaguggugugaucucagcucacugcaaucucugccucccggguucaagugauucuucugccucagccucucaaguagcugagauuacaggcacuugccaccaugcccgacuaguuuuuuguauuuuuuaguaaagaugggguuuugccauauugggcaggcuggucuugaacuccugaccucaggugauccagcugccuuggccucucaaagugcugggauuacaggcgugagcuaccgugccaggccucagaugagacuuuggacuguggaguuuuggguuaauguugaaaugaguuaagacuuugggggauuguuggaaaggcaugacugguuuugaagugugaggacacgagauuuggagaggccagggcagaaugauaugguuuggcuauguccccaccaaaaucucaacuugaauuguaucucccagaauucccaaguguugugggagggauuuaggggggagguaauugaaucaugggggcuggucauucucgugcuauucuugugauaagucucacgagauuugaugggauuaucagggguuucugcuuuugcuucuuccucauuuucucuugcugcugucauguaagagccuuucgccucccgccaugauugugaggucaccccagccauguggaacuguaaguccaauuaaaccuuuuucccccguuucaggugugucuuuaucagcaguguuaaaacaaacuaauacaaccuacuauguaccgguauuaaugucaaaguugcaucuaaaaaauuugggcaauauguuucauuuaaaaugacaggugguauagagggggacaauaucuuuaaauucauauauuauuugauaaaauuuauggucuuaguuauauaugugaaaauauaugucuauuucauccauaucacuuuuuuuuuuuuuuuuuuuuagacagagucucacucacucuguuucacucacucgcuuuguugcccaggcuggagugcgaucucagcucacugcaaccuccucccggguucgagagauucuacugccucagccucccaaguagcagggauuacaggugugugccaccaugcucaucuaauuuuuuuuuuuuuuuuuuuuuuuuuuuaguauagacuggguuucacuguguuggccaggcuggucucgaacuccugagcucaagugaucugcccaccuuggucuuccaaagugcuggaauuacaggagugagccaccaugccuggccucacaucacuuuuuaaaaauauuuuuucacugcaaagaugacagaaugcauuauauucaggguuaccuuguauauggacauuauucucauaauuuuauggguuccuucuaguuagaaccaaauaacuuauucacucaucuccuucaaaauagcucauaugcaaguugacacuucuuaaugauacugagauaauccucuaaugauauuaucccaaauccucauuaccaaucuagggauggaaaaucuaaaacauuucaauucauaucaauucaccaagaaauaaauuguuuuaucagguguuauucuauucuagucuuuuuuuuuuaaaaauaaacauuuauuuuagaauaguuuuuuucuuuuuuuugagacagggucuugcuucauugcccaggcuggacugcaguguugcaaucacugcucauugcagccuugagcuuccaggcucaauugauccucccacuucagccuccugaguagcuggacuauaggcacuuaccaccucguguggcuaauuuuuuaaaaacauuuuuuauagagauggggccuuacuauguuguccaggcuggucucaagugauccucccaccuuggcuucccaaaguacugagauuacaggcgugagcacuaugcccagccaagaacaguuucagauuuauagaaaaguugcaaaauaguagaguucucauuuauugcacacccaguuuacucuauuauuaacaucuuacauuugucacaacuaaggaaccaauauugauguuauugcuccucuuggaugugagagauucucagacuuuccuuguuuuugaugaccuugacaguuuugaggagaacuggucagguauuuuguaggauauccauaaacugguauuuaauguuuuucuuauuauuagacuggaguuauggguuuuuugggaggaagaccacagagauaguaucauuuuuaucacaucaauaucaaggauacaugcuaucaacaugaccgaucgaugcugauguuaaccuucaucaccugguugaggguacucugucaguuucuuccauugugaaguuacucuuuuccucuccuuucuacacuguccccuuuggaagggaguuacuaaaucuggcacaacuuaagggguggugaauuaugcucuacuuccuugagggauaaauaacuauaugaauuacuuggaauuauacacuggagauuuaucucuucuccccauuuguuuuauucaaucauuuauaucaguccagcuuuuuuuaaucaaaugacugugcucugauaccuaaauuuuuaucaccaagaugaaaguauuuuaacacuaagaaaucugcuuagaaauauuuauuugagaugcuuacaugucucaggaauucauuugaguuaugggguaagacagaaaccacaggguauguuaguuuauagucagaaggaaaagcugagagaggggaaaauacaguugguuuagagcagaacaccugcuguggaguccaaguucuaucacguagcagcugugaucuuagaucagucauuuaaccugccugagauuuaauuuguaaacaacagauaauaugaaggccuuacaguuguuccaggauuauaugaaaugccuacaaaaaugguuuagagauuauaaaacacgauauaagcaaguguaggacauuauuaugccauaauucuucaggauugaaggaggcacauuauggaagugacuuuuuaugaacaacuucaaauucucuaauaaaagcauauauuauuaucuuauucuuucucuaaaaucuucaaaaaggaaaacacaacugaaagcuuauuuguauuaauuaauguuugacuugaguuuuauucacucaaaaccuuguaauuccuggaaaaccugcugcaaucuuuugugcugcucauauauuaaucuucaucucuuugcucauccucuuuuguuuuagagauaaggccuaauucuacuuuuauacuuguauuauauauauauuaaauauuagauagauauauacagagcagaaauuauauuugagagauuugaguuuuuuuuuuuuuuuuuuuugagacggagucucacucugucgcccaggcuggagugcaguggcgcaaucucagcucacugcaagcuucgccucccaguucacccguucuccugccucagcaucucgaguagcugggacuacaggcgcccgccaccacgcccggcuaauuuuuuguauuuuuaguagagacgggguuucaccguguuagccaggauggucucaaucuucugaccucgugauccgcccgccucggccucccaaagugcugggauuacaggagugagccaccgcacccggccuucucuuuuauauuacugguccaacagccucccaacucauuuuucuccuccagucucugguccauuguuucucaaagggugguuccaugaccuuguuaaaaaugcuguuucggccgggagcgguggcucacgccuguaaucccggcacuuugggaggucgaagugggcggaucacgaggucaggagaucaagaccauccuggcuaacacagugaaaccccgucuguacuaaaaaauacaaaaaaaaccccaaaaaacaaaaaacaaaaaacauagcugggcguggcggcacgcgccuguagucccagcuacuccggagggugaggcgggagaauggcgugaaccugggaggcggagcuugcagugagccgagaucgugccacugcaguccagccugggcgacagagcaagacccugucucaaaaaaaauaaaauaaauaaauaaaaauaaauaaacaaacaaauaaaaauaaauaaauaauaaaagauaaaaauauaaaaagccacuagcuuucacauagaugagcuuuugcauggaaauaaauuaaauaacaaauaaaaaauguaaaaaaccccucuagucuggcuuuuacaaucuaauacauugugaccagagugccaguccuaaaauacaaacuggaucauaucauuaccuccucuucaaaaaccuucaauagguuuucacuguucagagaaaagugcuaacuucuuagcuuaguauugaaaguuuacauuguggcucaaagaucucucuggcuucccuuucuguuuuacacuccuuccuacacccauucucauccaggcacagugaauauacuaugcacauaugccccucuaugcacucuggugagcuugcacacucuugucugaagcuucucauaagacuucaaacaucagcaacaucaaaagaguugaguggccuuucagggacccaauuaaguguuaugaugaccauaggaccacaucagacaaagaugauaaaggagggaggaauaaaccucucccuaacuuagaggaucccuguggagguaaccaugacagaggaaaaugggaguaacaaagacagcaauuauuguuaucagaggcuggcuacaagugccccagauguaccauaccauguaccaacugcagaguaaagccagccauaucaccccaagagaaucucucuaaaacaaaucaucucaauagucuucacuuccauugcugugagaagaaaauggcuuuugucuuuuuuuuuuuuuuuuugagacggagucucccucuguugcccaggcuggagugcaguggugcgaucucagcucacugcaaccuccaccucccaaguucaagugauuauccugccucagccuccugaguagcugggguuacaggcgcccaccaccaugccuggcuaauuuuuuuuuuuuuuuuuuugguauuuuuaguagagacaggguuucacaauguuggccaggcuggucuugaacuccugaccucaaaugauccaccugccucagccucccaaagugcuggcauuacaggugugagccaccacgcccagccuucuuuugucuuuuuuuuuuuuguaugagaaugccauuaaugccaugcagcaaaacuuauuccaaagaauggcaguuucucauugugugaugagacuaagagaaagguaauaaaguagacugguuaagugcccuggccaagguuacagagcaacgauaaaaggauaaucuucuucuugcucugcuaucaccuuucuuauccucucuuccaaagacuaaauuuuacccuuauuucuuacaaugaacuaaauguuuauguccccuccaaauucauacauugaaauccuaacccccaaugugaugguauuaggaggugggcuuugggaggugaugaggccaugaggguggaaucuucaugaaugggaucagugaccuacaaaagggacccuagagagcuuucuccucucuuugaaccacauaaggauacgagaaaacaguagucugcaaccuggaagaaggcucucaccaaaaccugaacaugcugguacgcugaucucagacuuccaaccuccagagcuaugagaaauguuucuguuguauauaaaccacccagucuuuggcacuuuguuacagcagcccgaaaugacagauaucucuacuauaaauuuuuaaaauuacagugcuuuuuuucauaaugaaauaaagaacaacuuacuuguaaaaagacccagaaaaacuaagucuuaagcacuucuauaagcaccaaagugcucaaaccgaugacaauucugauuucagucauaggcucccaauucuggggaagcugauugcuuaugaaagugauucacgccgagccuguaaucccagcacuuugggaggcagaggugggcgggaucacuugaggucaggaguucaagaucagccuggucaacauggugaaacccugucucuaugaaaauacaaaaguuagccaggcaugaugcccaauauuuauuuuccuaccacacaagaucucuaaaaaaaaaguuggcugggcacgguggcucaugccuguaaucccagcacuuugggaggcugaggcgggcggaucaacugaggucaggaguuccagaccagccugaccaacauggagaaaccccgucucuacuaaaaauacaaaauuagcugggugugguggcgcaugcccguaaucccagcuacuuaggaggcugaggcaggagaaccacuugaacuucggaggcagagguugcagugagcugagaucgugccauugcacuccagccugggugacaagagcaaaacuccaucucaaaaaaaaaaaauuauauauauaaagccuauuucucugaaaauaaaaacugugcacuucugaaacuuuuauguacagauucugguagagaaaugguuaaaagagguaaaaaugugaugacagagcuuuucucuugcagaauaauccacugugcaucuuuauaaaaguucccuaauuacagaacauuucucuuuucuuuucauuguaaagagaccauuagcaaaauuacucucuuccccuauaaugcaagcagacuggggcaagaacagaaguuuugggggcagaccauuucuuuuguugaaguuguuggagugguauuuauucccaaagguuugggcaagaagacauauucgacuuugauuacaacauagcuuggccaucauauaccauugaaguuuucaagauguugcucuaaggauuuuccagcuuuccacaucauaauguacauauuaaugcagaggaaacucaaacuguaagagauauugguuguccugaagcacaauuccaaccaaaucaaugguuuauuuauuuguuaaagacagggucucacuccgucgccuaggcuggagugcaauggcacaacugaagcucacugcagccuugaacuccugggugccagcaauucuucccaccucagcuucuuggguagcuaggacuaugggugcaaacuacuaaaccuggcuuuuuuuuuuuuuuuuuuugagagacagggucucucucuguuguucuaggcugaucucuaucuccuggccucaaguguuccaccuaccuuggccucccaaaguguugagauuauaggcaugagccaccacaccuggcccuaaaccaaagauucaaagagaaaguuuagaaauauaacuccagccacagguugcaauccaaacaucauuaagaauucccuguggugaagcaucuucugagaaagugaagucaagcucuauguguuagguuuaagugcucaaaaaaaaaaaaaagauaguauucaauugacuauuguuguaaaagccuuagagaagggcuaaucuaaccucgcuuccagauaucuuuucuuuuuuugagacagguucucacuccuguugcccaggcuggagugcagugguacgaucacagcucacugcagccucaacuuccugggcucaggugauccucccaccucagccuccugaguauguggggcuacaggugugugccaccacaccuggcuaauuuuuuauauauuuaguagagacaggguuuugccauguugcccaggcugguuucgaacuccugggcucaagcaacuugccugccucagccucccaacagacaucuccuuuuaaacauguccccuccuguggaccaggacaauuuccaaacacuaaaaguuucaaguauuaaacgauuuauuuuuuuucuuuagaugaguuuugcucuuguugcccaggcuggagugcaauggcacgaucucggcucacugcaaccuccgccucccagguucaagcaauucuccugccucagccuccccaguaggugggauuauaggagcgugcgaccacgcccagcuaauuguuguauuuuuaguagagacaggguuucaccauguuggccaggcuagucuccugaccucaggugaucugcccaccucagccucccaaaguacugggguuacaggcgggagccacugcgcucggcuaaacagucaauuucuuaaauccccauaucaguauguaaauaaaauuaagguaaaaauucaguuauccugggucaggauucacuuuaaacaauauaaaagccuaucuaauaauguuuaaugauaaugagaaaauguucauaauguauugauaugugaacaggaagaguauuuuuuaauuaaaaagcaguuuacaaaacauguauaaugugaucacaguuauuaaaaauuauauuuacacauauauuuccuuuaccaaaggaauggcuguuacagaaaguuuggaaaauagaggacagugcuugcuucggcagcacauauacuaaaauuggaaugauacagagaagaugagcauggccccuuaaaaaaaaaagaaaacaaaggacaaaaaagaaauaacuguaaucuuauaacccacagauuacuggguuuaauauuuugauguauauauuucuaauuuuugaugcacauauacuucuccccaauaaauguaauuguaaaaguuuuuuuuagucauuagcuuugccuauauaucuaccuaccuaccugucugucugucugucuaaaacggcaucuuagauagacagacagauagguagauagauagugcaguggugcacauggcuuacugcagcuucaaacuguugggcucaagggauucuccuggcuuggacuccugaguagcuaggauuacaggcacccccagcuaauuuuuuuuuuguuuuuuuuuguagagacaaggucucacuauguugcccaggcuggcucaaacuccugggcucgagugaugcccuuaccuuggccucccaaagugcugggauuacaggcauaagccacugcaucuggccacaucaacuuauauauaccuuguguucuaagaagcuagggcaaauuauaagaaucauguacaacagugcuucucagccuuggcugccuauuagaaucacuuggggaacuucuaaaacuccugauuccuggaccugaccuuucagaccaauuagaaucucuggagguggaacccaggcaucaguauuuuucacaguuccccaagucauuccacugaagccaggguggggaaccaugacuugacaaagugucuccuaaucccugacccuugagcaaaaggugauuuacaacagggauuucuuaaauuuucauaugcauaccagucaucuggagaucuuguuaaaauacagauucugguucaguagauuggggugggaucugagauuuugcauuucuaacuagcucccugaugaugccaaugcuacugccccagggaccauacuuugaguagcuuuaggguaccaggaaagaaaacucucauaaagagugaaaagaaaaaaauuauagccacuaaagcccauacucuauaccaccagacaggaaggggugguccacaguggaugaacaaaggguugaggcugggaauuaaaagacauuucuaggccaggcaugguggcucacgcuuguagucccagcacuuugggaggcugaggcaggaagacugcuugaggccaggaguucgacaccagccuggguaacauagggagacagcaucucuauuaaaaaaaaaaaauuagccaggcgugauggcacaugccuguagucccagcuacuugggaaaccgaggugggaggauugcuuuagcccagaugucaaggcugcagugagcuguguucaugccauugcacuccagccugggcgacaaagugagacccugucucaaaauaaauaaauaaagcaauuuuaaagaggaaaaaaaggaaaaagguauuucuaggaaauaagauuuuagagauuggaaagguuuggaauaacacauuuuucagggggaaaaacagccauuggagcuuauuauucguguguacaaaggaaggcaagcaagcaugggggagaagaggagcaggcagugagagaaaaagaucaaaugucuaaaaaauuguuauggaaaaaauaaacccuuggcuacagugcuggaaagggauagagaagcacuauaaagggaucuguggaaucuauuucucugccaaaaacauguuugggaagcagaaaagcuaauaaacugaaguugguauagauuaauaaccaucuuccaucaacucccucuuggggacaugaagagaccccaggaguauaagucucccguggcagugcuuuaggaacuaacaacaaacagugaacuacugcccaaaugcuucucuuuauaagcaguaagaauggcaagaaacucaaacauggcaucccuuugcggcuucuuggcaauauccuucugggaauuucuaaacuuccaggcaggcuagagacauagcccccaaaacagggaaaaaaguguuuuucuccugagggcuuucccauagaaaugagaaauguuuaguauuuuuuagaacaauaagguaaacauuuaauguaaagauauucauaagucacuaccagacuuuuauaccuccaaaauaauuucuaaaaacaauaaaauaggaaaaccuucauguaaauuagcuggagcaauuauuugaaucagcugguauacuuuaucagcugguccuuaucaaaugggucacauccaaguaaauuucuguuuaaaucaauagaagaaaguaaggggaagacuuuaccaagauauggaaagaauucuguugucacaugauuuguguuacacaucgcuuagguauaugaaacuuuggcagaaauguauacagucuucacauucaguaucuauuuacuauauaaugaugauggcuaagauguacugaguacuagauaguaugcuaauaauuuagauauuauucauguauaaauuaauccacauaacccuaugaaauaggcauuauuauuauagcucuuacauggaugaggaaucuguacagguuugaggaugguaaguuuuugcuucauuucauugcuaaaaggucacaaagccaguuaaguggucaaguugguuuuugacugccugauucuaacaucugugauuuuuaacuuuauaugacacccccagcuauccugcauacccaguuuguaccagggagagacugagggauauaagaugaauaacucaugaucccuaaacucaugguacaagacaaguaguuccucuagcacaugagauuagaaagacauuuccaaaugcuacaggauacaagaugccagaucagauuaugcugcuaguguauuccacaggucaaaacccauauacuuuuggagcccuugauuuuuaaguuuuauauaaccuuaauggguaaaaggcagauuuauaaaaaggacacgcugcaaggcuagugacacuauuuucuagcucagccaagcucuccagaaauuacugaaccacaucagucuauauaaaggugauaaagcccuaacaauguccagguaacagaucuaauaccaguugaguggaugaucucuuccauauucaaguacuagcguguugccugauaacuugguccaugaauacauuagaauggagacaacagaaaugagucuaagacuaagguuguggucucucuucugagaccauuucuauaaaaucuccaaaggcuaaacggaaaucccauugauuguauuggcccaacaauggcuauaaaucaauaauucuuuuuuuuuuuuugagauguagucucacucugucgcccagguuggacugcaguggcgcaaucucggcucacugcaagcuccgcuucccagguucacgccauucuccugccucagccucccgaguagcugggacuacaaggugccugccaccacgcccggcuaauuuuuuuguauuuuuaguagagaugggguuucaccauguuagccaggauggucucaaucuccugaccucgugauccgccugccuuggccucccaaagugcugggauuacaggcgugagccaccaggccuggccuaugaaucaauaauucuuaaccugugguucauuaucaaugcagacagauaaagucuuaacuauuuuugcauuucucagggcuagcuuucuaacagucuuguuuaacuuaacugcagacagcaugaggccagggaaaaggugaacaauauuucuagccuuaucuggcaucuagcuauauucauaguuuaaagguaguccucaaagaaacaagagucaggguaaaagagcuaauauuugaguaccuacuuucaacauauaugucacgugcugugcuaacagucccucuuuuuuauuuuucagucuuauuuaauacucauacccacauaaaauacuggugcucccagcagucaaauaucuuucucaggaacucacagcugguaaauaacagagcuaacauucagacagaggucuguucacacuacauacccuugggaacagaaaggcuccagggaacugcaggguccuggguaucuuugugacgacauuccuccagggcuagaagagcugagggaacugaugacagggugagaaaggcaagcagacuuccucaaauauaccauggaaauggcccuuuugcccuuccuaacaauguucucuuggggauaugcuuaguagagaaggaagaugauguauugaguuauugaauuuguacugauccacauugaaaacaaaauuccauuuaugauaacaaaacuucccuguuguaaguugcacuuaaauauugugagcuuaaauauuucaaaauaaugaucuccauugaguauagcuauguguguggcuauuaaaaaguagaccuccucuuuucuaucccuugaaugaaacuauuuuuuuuuuuaaaucugaaguggauucaaggacuaacgcuuuuuuuuuuuuuuuuuuuuuuuuagacacagucuugcucugucgaccaggcuggagugcaguagugcgaucucagcucacugcaaccucugccuccuggguucaagugauucuccugccucagccucccgaguagcugggauuacaggugggcaccaccaugcccagcuaauguuuguauuuuuaguaaggacaagguuucacccuguuggccaggcuggucucaaacuccugaccucaagugauccuccugccucgcccucucaaagugcugggauuacaggugugagccaccgugccuggccuaacaauuugguuuuaagaacugaagacuuguagugcuguaagcaacgcaaaauuaucuuaauggacguagaaggcuuguuuguuucaaaguuuuucauaaaaauauuucuuacccuauucagcuaaucuuuugagaggacacagaggaaacaagaaaaucucagacagagaucuuaggugcaguggcucacaccuguaaucccagaacuuugggaggccaagccgggaggaucagcugagcccaggaguucaagaccagacugggcaacauagugagaccccaucucuacuaaaaaaaaaagaaaagaaaagaaaauugcagccagagaaagcauuuggugguaugcuccauauugcaacauggaaaaaugcacugguucuaagagcaguuguuaauauuugaaaucaauccuagcuacuauagaucugcucaugagagcaaguuuaaauaaauagguugacaucuuugugcagucauuuagagcaaguucuacauauucagcaagaucaaaacuauauuuugcagaaauucagagagaguauuuauuaguauuuaucugucuugcuagagagccaaaggaacaguauucagagugaaugaugacaaaaaguuuguuuuacauggaggguagcauuauugcagucaucuugaguuucucacuuaaucauuucccuccaauucuccaaagagagccucuauucuccuuuuuuccuugccuacuacuauaaucauuccaaucgucucauucauguauuuacugcacaaacauguauugagguacuguguaucaggugcaaauauuggggauuccacagcuguaccacucagaauguggcccacagacugguccuggucugugaauccauuugcuaccagccugugacauguguuuaaaauuuuuaauaacaauacagcagaauaauuuauuuguugauuucaauaauaauuuaaaaaaacuuuuaugucauuuuucuuuaaaaacuuuuuuuuucuuuuuuuuuuuuuuagagacagggucucacucuguugcccaggcugggguguagugguaugauuacagcucacuguaaccccaaauuuuuggguucaagugaucuuccugcuucagccuccugaguagcugggacuacaggcaugugccaccaugccuggauaauuuuuaauuuuuguuguugcuguugagacagagucuauguugcucaggccggucuugaauuccugggcucaagugauccucccacucuggccucccaaagugcugggauuacaagcuugagccaccaggccuggcuuuauguuauuuuucuaauaauuaaucucacuguauuuuacaaaaauauuggucuaugaaggauuagaaguaaaaccccgauucuuuugccagccauaguuuaagcagcauuguucuaggaaacaggaagaauaagauaagacuuuugcucuugacaaggucuuagucuagucuugugugaguguucaauaaaaaaucuugccagauguaguggcucaagcuuguaaucccagcacuuugggaggccaagguaggaggaucacuugaacccaggaguuugauaccagcuugggcaauauagugagacugugucucaacaacaacaacaaauuagcuacaugugguggugugugccuuuaaucccagcuacuugggaggcugagggcaagauugcaccacugcacuacagccugggcaacagagugagacccugucuccaaaaacaacaaaaacuccuuccauccucauacacauuucugaggaacacagaaaguuuaggcuuuguaaauaguuauggggaauauuaauuuuuuucuaaugagcuauuaauagguuaaaaggacaacagagaagggugagauaagaaaggcugucaacagaaaggauaguuugauaaagaacaggaaaucaacaggcaaccaggaggccagcauguguaacaaauugcuauaugccucaggugaagaagucaagauggcaaaucaaggcuuacuggaggaagacacugaguccagucucugccauacauuccauucuccaaaguguuguuuguuacagcaucaccuccuauccuggccacuuguuuauaccugugucacaguacuuaucggagaguaccaugaauauauuaguuugcaagucaaauucuacugacacuauauuauuuaucuuucucuucucagugcucagcauguaacugacacucaaauauguguugaaucacacuaagcaauagagggagaguucauuagaauucucuucaggcugagcaaccacaagcgaugcuuucaggguccaguggacuguaaaaagggcaauucaggcugggugcaguggcacaugccuguaauaccaacacuuugggaggccaaagcaggaagacugcuugagcccaggaauccaagaccagccugggcaacacagugagauuccaucuccacggaagggaaaaaaaaaaaaaaagacaaauuagccauacaguggugcgugccuauagucccagcuacucagaaagcugaggcaggaggacugcuugagcccaggauuucaaggcugcaaugagccaggaucuuaccacugcacuucagccuggguggcaaagcaagauccuaucucaaaaaaaauaaaaaauaaaaaagugggaggggggcaacuuaaaccuggaacucagaaagaaaaaaaaagcaaaaaccaacccaccaacgaaccaaaaaaccuccacucucccuaaggacaacaccuaagucagucagcugaauugcaaguaacaauauauuagaauuuaaaagcccauucugcauuaaguuugaauucaugacuugacagaguacucauaaauuauauaugggcauguggcucugaguaauuuccagguaaguauauuuuucaggcaaaauggcugacuaagcauauaaugauauaugcuaaugucuacuauggcagaccagagcacuaugaggcaaagcuucaaaaccaaggucacaggcauaaagaaaaaccucucccuucucauuacuuugggguggaagcagcugcaaugacuagcaguaaacaaagggaguuucuauuuggugguauccugagcauuuucauuacagggcugucugucuuuacucuguuuucauaguuuuugguuguggcuuuuuucuuccuguucucuaucuuuucacacuuugccuuuaugaucucuccccucucaaacucucuccuccuuguuuccuuucugaacucauuuccuucucuuacucccacuuucuucauuaauucuuaaauaccacuuaugucagagcccucuuaugcuucugccuuaguguugguuauacagagcauucugccuuuaguuccuucuuaaggaccaauucuaauucacggucauuuaaaugcauuucuccacccaauaauuucccagugauuuucccauuuaugggggauaagaugagaaaauauaaauggaucucugagaacccagguuucaguauccuugaaacauaauaugcagcauuguaaucaguggugauauccccgugaaauaauacucuugugcuggcaaaguuacuaugcuuggaaaguauacaaucaaaauucaaacuggccugggaaacaguggaggcaaguaauuuaguaaugagaaaaagaucaguauuugaaacauaacacagucuucucccuagcaaagucaaacaauaacgcaaaccuuucuuuuuucuagucagcccauuauccuacugacauguacaguuaugugccuggaacuggucagaaacaagcuagaagagacauauccaaagagauucuuagaggcucccuuugcacuuuuauuugcuucccagcaccuccugacugaggaagaaauaauacaaggccuuuucccaagggcauguucccaaaagggccacuguuucuuucagguuauuuggaggcacagggauauugccuugaauccugucaaaaucuacauucagauuccugaauuucacccaguuuuuaaaaaaugcuauaguauugggaagaaacucaacuccuucaaauuauaacucuuaaaaaaaugaaagcuggcggggcaugguggcucaugccuauuaucccaguacuuuggaaggcugagaaggguggaucaucugaggucagggggaguuugagaccagucuggccaacugaaacccugucucuacuaaaaauacaaaaaucaguugggcaugguagugcaugccuguaaucccagcuacucgggaggcugaggcuacucgggauggcuggaauccgggaggcggagguugcagggagcugagaucacgccacugcacuccagccugggugacagagcgagacuccgucucaaaaaaaaaaaaaaaaaaaaaaaaagcuaagucaaagaugauucugguuuuucagugucaucuggggguuucuucuguugucacuccaagagccacaauuaauucccagaaaugugaaaaaaggcucacagguaucgaagcuaaaguaaaaaacaaucacuaaggcucugacuuuucugauauccuacuuuaaagcaaagguaaauaaugauuguaauaauguaauagcaagcauagugcauuugaagagcuaugguuuuuaaauugaguuggcauguauuauuucguucaaauuucauaacaucuccaucaaacagcaugcauuauccuuguuuuuuuuuuuugagacagagucuccguugccaaggcuggagugcaguggugcgaucuuggcucacugcaagcucugccucccagguucaugcccuucucuugccucagcuuccugaguagcugggacuacaggcgcccgccaccacgccuggcuaauuuuuuguguuuuuagcacagacaggguuucaccgaguuagccaggauggucucaaucuccugaccuugugaucugcccgccuuggccucccaaagugcugggauuacggugugagccaccgcacccaaccacuuuauccuuguuuuacagauauuaagugacuuguacaaagucagcuuaaauaagugauuuccauuauuuaaugaauucuaucuacccacucaagcugcuccccuaauaucugcuuucuuaggccaccagauuucuugaaagaguaaucuauuauuucugacuuuauuuccucauguauucauuuucuaaucuugaaagauuauacuuuguuucuuuaacuauucuuuuuuuuuuuuuuuuccagacaaguucuugcucuguggcccagaguggagugcaguagccaguggcacaaucuuggcucacugcaaucucugccuccugggcucaagugauacuccuaccucagccucccgaguagcugggacuacaggcacacacuaccaugccuggcuaauuuuuguauuuuugguagaggcaggguuucaccauguucccaggcuggucucaaacuccugagcucaagggauccauacaccuuagccucccaaaguguugggauuacaggugugagccacuguaucugccacuaucuauuauucuuaaaaagaucacaaugaccuauaagguaucaugggacucucagcugauucuuaaauaucauuaaugaauaaaauuucaaagaauuccaagaauuuguuugguccucauccuuccucauuccugacuccaacucacucuugaaacacuuuccuuccucuguuacucccuacugucauaaagauuaaacuggguaacaccucaucuuuuaagauccuauucaagugauaauccuuuuguuguuguuguuguugagauggagucucccucugucguacaugcuggagugcgguggcgugaucuuggcucacugcaaccuccacccagguucaggcgauucuccugccucagccucuugaguugcugggauuacaagcaugcaccaccacgcccagcuaauuuuuguauuuuuaguagagacaggguuucaccauguugaaaccaugggccaggcuggucuccaacuccugacuucaagugauccacccgccucagccucccaaaguucugggauuacgggcgugagccaccgcgcccgaccucaagugauaauucuugaagucucccacaacaccccuaguaggagucacccuuucucugaguuuccacaguacuugauacuacucggcauguaacacauugcauucugauuguuauggucucuuucucucucccuuauauaauacaaguuauuuggucauggaaacugguuuaucauuuucuuuuuuuugagcgggaguuucgcucuuguugcccaggcuggagugcaauggcacgaucucaccucacugcaaccuccgccuccuggguuuaagcgauucuccugucucagccucccgaguagcugggauuacaggcacacgcuaccacgcccggcucauuuugguauuuuuaguggugacgggguuucaucauacuggucaggcuggucucgaacuccugaccucaugugauccgcccaccuuggccucccaaaauguugggauuacaggcgugagccaccaugccuggccugcuuuaucauuuucuuucucuuugguuuagcagaugauaugccacguacagauucuguuaacaaaugucugaaugaauggccagugaguggcagcacuaugaccagaacgcagcuuuucugguuccuuugucuuugcuccuuaggcagaagauggcucaaaagcaauuaaggcuuacaguuacauuucucacuuccuauuucaugaaaaugcugaaucucagauuuagucccuuuuucuuaaucuuuagcagugaccuggugaaaaccauacuuuucacacagaguagucaccuagguagcagugccacacauggcauaauuaugacuauccuacaauuugcucucucucucucucucucacacacacacacagagauauguauauauauauauacacauacacacacagauauacauauacacacacaugcacacagacacacacaaacacacaguuucuagagauggggucuugcucuguugcccaggcuggaaugaagaggcacaaucauagcucacuguagccucgaauuccugagcucaagugauccuccugccucagccuccugaauagcugagaccacagaugggaccacauuuuuuaacagagaaucacagaaaaggaaauagucuguuagauucuuaucucaauccauaaauacuuaaggggccuuugaaacaaacucuaaaugcauaauaacacucuguaacaggaacccucgaguugguucuauaagcuacccacaauauacuuucaccugauauuuuucauagacauuuaaggaaaagguuucaaaaugaaacugaaauaagcuggucacaagguagccuuguguauucugaacaaagccaggacauguuuguuuauccaugcuaguauccaagacuuuuucaccuuuuuuucccuauuaacgagauuaucugaauugcucaucugaaaacaacuucguugugggauaaauuuuguguuacuuuauuggacaaaacuauauggacacaaucuugugcuuaucagacuugaguaacaaccuccuauguuugaucaucacugaaguugcuaaucagaccccuaugaguagccaucucuugacuacagaggacaauguuuaagaggacugugcuuaagaugaaaaaaauaugaaaacaagaauauauccaccugcugcuuaaguauuuucuggaaaaugucuuuuuuuccucugguaacucuaauuguuaaaaaauucauuauccugggcuaaacccuggccccuguaucuggugaauugagggaaaaaaaagaauauaggagauaugaccacauuagaagaggauaauuuucaagugaaaaauaaaucuggcugugacuuaaacacugagacaagggcugggcaugguggcucaugucuguuaauuccagcacuuggggaggccaaggcagucagaucacuugagcccaagaguucaagaccagccugggcaacauggcaaaaucuggucucuaaaaaaauaacaaaaauuggccggguaugguggcucacaccuguaaucccagcacuuugggaagcugaggugaauggaucaccugaggucaggaguuugagacgggucuggccaacguggugaaacccugucucuacuaaaaauacaaaaauuagcugggugugguggcaggcgccuguaaucccagcugcucgggagacugaggcaggagaauugcuugaaccugggaggcagagguugcagugaguugagaucgcgccauugcacuccagccugggugacaagagugagacuucauuucaaaaaaaaaaaaacccacaaaaauuagccaagcaugauggugugcaccuguagucccaguuaucugagaggcugaggugggaggaucacuugagccugggagguuaaggcugcagugagcugagaaauuuuuuuuuuuuuuugagcaaccucugccucccggguucaagcgauucuugugccucagccucccaaauagcuucugugggguuuggcguguuggccaggcuggucucgaacuccugaccucaagugaucugcccacuuaggccucccaaagugcugggauuacaggcgugagccaccuugcucagccaagcugagaaaaauuuaaaacucaaaauuaauaauacaacaacaaaagaauaaauucuccagagaggcaucaugguauacuguagaaaacauggacuuuuaaaaagacaaaacaaggcuuaaauuaagguucugccuucgucuaagugacugccucgucgauccucaauuccuuagucuauaaagugaggauaacaaugaauaggguuguugugauaaugcaguaauauaucaaaguucuuuaaaaaccgaaaagcaguauagaauuaugagauauuacuagaccaugcuguuucuucuuguggcuauauuuacagugcuaauuuauauuacagcuauuuauguuucauucucuaaauguuaucuaaauucagaggcaauaauugcucuccuugacucugaaucaguuguauccacaaugcacuaaaccaaacacuucaauacugagugucucagaguugugucagaaacaaaaaggaaacaauugggucacaaaaaaacuuuuugccgauuuuagguguagaacauaucucaauauaaacauuugccaaaaaaaguacuuguuaaguaagaaaggcugucaccaaaucaaagaauuguagugcuggaaaaggauuugaguauuucuguagaucaucuacuguaauacacauuugauacauacaaaauuucccucugcaacacucuugacagacaggcaucuaucugcugcuuaaaacacuuucuggaaaaugucuuuuuucagguaauucuacuaauuguuagaaacuggccuaaacucugucaccuguaauuucuaccccgcaaaucuuguacuuccucugagagcuacacagcaacauuuaauucuuccucuuuagaacaguuguuuuuuuuuuuuaacuuuagaagagaauacucauaucucuuguccaacucuuuucaucuuuagguuaaacucccuucaguucccccauuauugaauguaugccauguuucaaguggcccaccuuuauaccagcuccacuuuccccugccucccuuugcaguagacuaaacaagcuuucauguguccuacggugagaccaucgccuucuuugccauaaacaguaagcuuuaguccaauccauugaaaucuuuguggauauuggacuguaagaaauauauuugcuuuucuucccagcuccaaaauuauaagcaggucaaaagcaaaaaagaaugcugcucucagaacuuugacaauuugaguuuuacgcauucaagcaauuauuagaauagucaggcugcuggagaagauggccuuaaaauuccuuccuaugaugcuaggcuuuagcucaggaauagagagggauaggucuauaagucaaauccucucauaacacgaggauuuguggaugcagaaugcugacaagugaggccugggaggcaaaacugaggucaacccuaguaagaaccuagagcuuccaagccucagaaccauugcuaguccuuuaucaaauguaguggugauacaacuggaauucuccaugacaguuuuaccguguucugucccauuucuccagaaguuacuguaauguuucauuauaaaccauauacacaacccuggcaagaaacuuagaaagucaguagaagacuauaaauaucuaauuauacacuaaauuccuuccaaaaaacaaaagcaggaaugccuguuuaagaauccuaaguaaggccgggcgugguggcucacgucuguaauccuagcacuuugggaagccaaggugggcaaaucacuugagcccagaaguucaagaccagccugggcaacauagugaaaccguuucucuacaaagaaaaaauacgaaaauuagcuggguauaguggugcacaccugugcacccaggcacucaggagggugaggcagaggaucaucugagccugggaggucaaggcugcaguaagcuaugauagcaccagccuggaugacaaugagacccugucgcagaaaagaaaaaaagaauccuaagauaaucaauaggacauuauauucauuuaauccauucaggauaacaauacaaacucucaagaguccaugcaugaggaaacaagcuaccaaucacaaucuacaugaaacugggcuuuaugagugguaugucugguugcuuuccaagacuuuggguugucagacaaaaccuauauuaugggaaauaauaaaccucaaauucauuuuuaacauuuggccaaggcaacuguaccagggaauacugacuuucaagagaaguucuacagucgacuuuucuuaauaugucuacuauucuuauucuuuauucuaagugaguaaauagaagauguaaagccaacuguuuuuugauuggaagcaaagucaaggauuaagguacuaugagaaagaagauacagggauuccaggaccaaacuaugggagaagaaauguaagaaaacaagugaaagaugcuuucagaaaccuucugagcccaaacucuuuuugcuaaccugccauaaauuagaaugagauucauuuucuagacaagauaaacaugagguauauaucaaugcuuauugaaucauuuauucagaggcaaaauggaaauacgauaguuuuucaguaagaaaauauaacuagaaugaaggcauuaguuauaucucagagaaauaaguagcuuuacaaucauauuaacacuauugucauuauuauuauuauuauuauugagauggagucucacucuguuacccaggcuggagugcacuggcgugaucucggcucacugcaaccuccaccuccuggguucaagcaauucuccugccucagccucccgaguagcugggauuacaggugcacaccacuacgccugacuaauuuuguauuuuuaguagagacgggauuucaccauguuggccaggcuggucuugaaugcccaaacucaggugauccacccaccucggccucccaaagagcugggauuacaggcaugaaccacuauaccuggccugucauuauuauuaguaauuauuaauaaaaugaauggcagcagauauuacuauaugccaggcccugaaccaaacaucuuuuaugcaguuucauuuaauucucaaaacaacccucugauaauaugagauacagaugcugaggcucagagucugaguguucuguugagagucacaauagcagaggcaguaagucuaaaccuuggaagugagcccauacucucaaccacugugcuauauacucuacugcaguaauguguaaacauuugauagauaccaauuacuuucuacagacacuacacacacacacauaaaccaaaugagagugccccuuucccucaauguugugaacacugaauauuaucuuuuuuuuuuuuugagacugagucucucucugucacccaggcuggagugcaguggugcaaucucggcucauugcaaccuuggccucccagguucaagugauucuucugccucaggcacccuaauaauagcugggauuacagcuguccacaccaugcccagcuaauuuuuguauuuuuaguagagacgggguuucaccauguuggccaggcuggccucgaaucccugaccucaaguaauccgcccaccuuggccucccaaagugcuggcauuacaggcaugagccacugugccuggcaucuuuuuuuuuuuuaauaaauuuuuauuuuuauuuuuuuugagacagagucucacucuguagcccaggcuggagugcaguggugugaucucagcucacugcaaccucugccuccuggguucaagcaauuguccugccucugccucuugagcagcugggauuacaggcgugugccaccaaguuuggcuaauuuuuuguauuuuuaauagagagggaguuuugcuauguugggcaggcuggucucaaacucuuggccucaagugaucugcccaccuuggucucccaaaguguugggauuacaggcgugaaccacugugccuggccuaauuuuuaauuuuauuuucguacagugccacuuucaggauauacauauauauuaucaaucuuuuaaaucugugucaauuaauugggaagagauaguccauuauuauuauuauugacagggucucacucuguuacccugguuggaaugcaguggggcacagucuuggcucacugcgaccuccaccucccaggcucaggugauccccucaccucagccucccaguagcugggaccacaagcaugcaccaccacaccuggcuaauuuuuguguguguuuuuuuuuuuuuuuuguagaggcggggucuugccauguugccuaggcuggucucaaacuucuaggcucaagcaauccacccaccuuggccucccaaagugcugggauuacaggcaugagccccugcacccggaagauagucuauuauuuuaacaagguugagcauguccucauuuauucauuggucaucugcuuuuucuucuaggaacugcuuguucauauccuuuguccacuuugaguuaaaugcuuauccuauugauuuguaggcagccauuuauauucuggauauuauaauaucugacguauaaaugaauuaaauaaauaaauggagacaauaagccaauauuaaaaaaaagcuacauuacuacucuguaucuuauaccaaagaaaauucagauggauuaaagauaaugaaaucauaaaagcauaauucauucuuauggaagucugucaguuucuuguuaauuuaauaaaguuauauuuuuauguugaugaaaaagcuauucaaauaggcaaaacaguagauacagacuauacuagaaagcuaguauaagaguacugugacaaaugcuaggugcaguggcucacgccuguaaucccagcacuuugggaggccugaggucaggaguucgagaccagccuggccaacauggcgaaacccccucucuacuaaaaauacaaaaauuagccgggcgugguggcaggugccuguaaucccagcuacuugggaggcugaggcaggagaaucgcuugaacuccggagguagagguugcagugaguugagaucacaucacugcacuccagccggggugacaagagcaagacuccgucucaaaaaaaaaaaaaaaaaaaaaagaguacugugacaaaucugucagugaaagcaacugaaaguaacuaucuuuggaaaucauaaacaugguaaaucuauuauuaagugaacaaaguaaguuacaaagugauauuuacaauuccauuuuuauaaaaaacacauuaaacauuagcuacauuagaaggcuauauuaaauaauauuuacaaaggucacucuagguggcuggcguuuguaauaggaaaauuaaauagaauuuuaaaaaaugcauugcuuuugaagauauuccuucuaaacagacauaaagcugguuaagcuucuggaaagaagggacuguaaguuauucauuuuuguauccuucaaguguagagugcccuauacauaauagucacccaacagaccuuuguugaaggaacgaaaugggaaacgugggauuuacaaacaucaaucucuaugucagcugcuuaaaauaaucaaauccaaaauauuugcaggagaaucauauuguuccccaaguaacauuucauucauaacauuaauuuacaauuaggaaauguuaugcuuuuaacaaacaagaaagaaaugcaagguucuuaauguguaugagagccuugcauuucuugagagguaguauagcgccacaguccaguauagcucuuaaccacuaugcuauauuaccuuguauggaucuagggauccaggaaaauacaaaucgaaacaauguguuguccaaacuggcaaaaauaaaaaagauugaccuagucaacguggaaaacugaguacuaucaacacuguuggcaggagaucauaauggugcucuuuuuguagugauaaacucuucucacaaaaacagauacucugaaagagguagggugagauggggugaaggugauacaagaauaaaaucuuauaagauuuuguuuuugaaacaacugauggcaaauacaaagcuucuacugaauucacucagaccaugccuaauuuaugcauacaguauucacuuuuaugcaguaucuuuaaauuuuuuuuuuuuagaguugggggucucgcuauguuggccagguuggucuugaacuccuggccuugagcaauccucccaccuaggccucccaaagugcugggauuacaggugugagucaccaugcccagccaaguccucauguuucuaucuacuaugggcauaugggcaagcuuccaugugaacaaaaggggcacauauuuguagggaccuuaaacacacauauuauguuagucacagaccauucuauuguaaacuauacuaaaucauauuauaaagcuauaauaauucaaucaaauguguauagguacaagaagagacaaauagaucaaugaaacagaaauaauccaaaaaaaaaccuaugucuuaugaaaauuuaguauaugacaaggauggcauuucaaaacagugaggaaaagauggacuaacuacuuaguaaauaguacuggaacuauuggcuauccaaacagcagaaguacuuagaugucuaccacauaccaaauguguaaauacguuccagguggauuaaagagcuaaacauugaaaagagaagaaaagauaggauauuuaguuaaucuugggauaagaaagaucuuuuuaaacaagauacaaaaugcaaaagccagauggcaaauauuaauaaauuugaggccaggcacgguggcucaugccuguaaucccagcacuuugggaggcagaggcaggcagaucaugaggucagguguuugagaacagcuuggccaacauggugaaaccccaucucuauuaaaaauacaaaaauuagcugggcaugguggcaugcaccuguaaucccagcuacucaggaggcugaggcaggagaauugcuugaaccugggaggcggagguugcagugagccaagauugcgccacugcauuccaacuugggcaacagaccaagacuccgucucaaacaaaugaaauaaaauaaauuugaaaugacaauuuaaaaauucuguucaacaaaaaaggagacaauacauugaaagaaaauauuugcaaaauacauaauaggcaaaggauugauauuacaauauguaaagaacaucuacaaauaagaaaaauaaacaauaguaaaaugggcaaaaacaaaauuaacaaacaauuuacagaagaaaaagaaauggccaaauagaagagaugugcaacuucucuaauaauaacaagaauaacacuggcuaaagcauaaugcucacuguggaucaggugcuuuucuaaaugcuuuagauaucaacucauuuacucuuacagccccaugagauagguacuauuauuuuccccaucuuacagauaagaaaauugaggugagguuaaagcaguugcucagggacacacaacuaggagcgcagggcuggaauuccaaugcaggcaguauagagacauaguccaguauagcucuuaaccacuaugcuacauuaccuuuucauggaucuagggauccagaagaauaccaauuaaaacaauguaucauuuguuauccaaacuggcaaauaaaaaagacugaccuagucaacguggaaaacugaguacuaucaacacugcuggugggagaacauaauggugcucuuuuugcagugauaaacuauucuuacagaaacagauacucugaaagaaaguucagaaaaucuauuuacccaauaaaagguggacaauagucaguuucuuacuaaaacauuaauuuuacuuuuuccugaagguaguagcauaucuuaacauuccugcuuuucuuuucucucuuacuccacaaaugcccaguaaaggcuaccagaggaugagcacgccacugcucucaugcuaacuuuuugauguggcugcuucccuugugcuucaggauuuaaucagcucaggucaagcuuuucccaaaagccuguuucuggaugcacuaacaucacugaaucgguugauucgcuuuuccuuccagugggcugacacagauucugcuuucugaaacucuuuuccguauuugucucuuauccucuuucucaacagguucaagagcuaagacugaaggugagaagcucaaacuuuucugcuuuguucaaaagccauuaaaaaggccuuucuucuuuucagcaauacgguauuuccaaucagaugaaaacguugcuucugaaaucucucaauucuccaguuuccgguuuacugucuacaaagcauguuaaguagcaauauuauuacauuguuagauguuaauaguauaaauuauuugagggaaaaauaaaauccaugucauagcuuuuccagcacuucagucaucccuauauaccuauuugauccauuauggagagaaacacagaaaggcacauggagcuauaaaagaggcugcuacuaaaccaaaacaugaaaguacugaaaguuuaucacagaugguaguaugcaaaggugauacagccuuuaguuuuuuuaaaaagcauagaucaauuuccauucgaaaaaucucacuuguacauccaaaacuuccuuuuugcacuguggucuaaaauguauuaccaacuugguuucugauuauagcaaagcaauuaaauuugcaagcgugacauggacauugugaaaacgcaacagaauaccaagaaaacagugcuuuacuaaaccuccaagggaggagcccugaaguggugacuaccuuuucacugagggagcaauuuaagaacguucguacuauagauuacagauaggaugcaugaagagauuaaaguuggcaggagaauggaaaauuugaauauccaaguuugcauuuuuucaucugcaucauauggugacagacuaacacacuccacgaaaacacaaagcuuccuuacggagaggaugcaaaaggggcaccacaacaggcccgaggcaaugauuucucuaccccacucuauccuaccguggccccagcgacaucacaccauugcuggacagcuccaccacagcuaggcauaaccgcaccgacaggagcgagcaaagacaccucggcuaggagucccagcgcgaggcaccccacaccuaagccuaugguccucaucuugcuggaaagaaaacugaggcgcugagggggaagcagugaccaaugccugagaaggccaagaguguuaagacgaggucgaucuuggacuucucuuuccccaccucccccaacuacuccaguccuggaagaagccacaaguuuggaagagaaguuguggaaaccagacggggguggggugcggugcggugcggugggggaccugagagaguuuuaaaagcacugguauuugucccacacaaggucgcccgcuccaagucacuguuccccgcuccccggguaggcuuauagccaaagaggcuucuaggcuucgagaucagcccaccgcgcccccucagcccuucuccgcgggccgcagccccaucccggccucugggucccggccggggaucggaacccagccggcuucuccgacagcguuuccgacgcccggcaccucucgcagccccgucccccaggcucccccgucuccacccgccaccccccggcgcucccgucaacguccccuuccucccucaggacgccccuuggggcgccucucgcgccgggucccgccgggugcucggcacgcuguuccuuuccucuccccucccgcggcccuucuucuguggggcccaccuggcgcggcccccgcccccggccagucuccucagugagcggccgccucccaaguccucccggccccgccccgcucccggacggauacaguuugaagccccucaggaucucccuggcccgcucguccuuggcugacaugaugcggcggucgccgcccgcggcuuucucacucuggucggcggagccucgcagacggugcccaggagccgaggauggagccgcagcccggcuuggagaccucgggcuagcagccgcagcggccagaccaggaccggccucucucucccc

SEQ ID NO: 191126 - RNA, 637712 nt, Homo sapiens
ggcgcucggagcgggcuccgcggcuugcaaggcgccugcgacucggucccaggucggcgggcggcgcacggcgggcucgcgcgggggccccggcgcgccgggcggcgcaguacgcagcgcgcggacccacgccacggccaggagcccagagcagcgcggccacacugcccaggggucggcccucggccccggcgcucggagcgcggcggcugccugggcuuuaauggcugcuccgcggagcagcgccuagggcuggaaggcggcugcggcucaggaagucacccgagcaagccuccuucggggccggccgcacccgccgcggcgcgcuccaugggggcgcgcuccccccgggcggcccgcugacccgggacgccggggcccgcucgcucgccggccgcgcgucccggccaugaacugagcccgcgggccagccccgcgccugcuccgcccgcgccuuucuucucgcgccuccuccgcccgccgccggcgggcccggcuccccgggggcugcggcgccccgggcucggcggcccgcgggccccggggcgcggggcggcggcggcggggggcgcgcggcuccgggcgcggcgccugcaccaugaacuaccagcagcagcuggccaacucggcugccauccgggccgagauccagcgcuucgagucgguccaccccaacaucuacuccaucuacgagcugcuggagcgcguggaggagccggugcugcagaaccagauccgggagcacgucaucgccaucgaaggugagggccgggccgccuuggggccucgggaaggcacggacgcccgcggcgcggcgggggugugcgcugugugcgugcggguguccacacacgccggccggggcacgcggcugcuccgccgagggagcacugcggcgcugcuugucuugcaaggccgggcgagcgucgccugcgccccgccgcgccgcgagcuccgccaggaagauagaucgucagcguuaauuugaucguggacaauagagucucuccugcgggaaaguggcucggugccuccgcguccugggcugccggagcgucccggcccagcagacgccugggggcagccggcggggucggcgccacccgaccccugacagguuaccaggccaggccugggcgucuugcuggacguugaagacguguucugagaagugcugccgcugggggcgaggcccgggccggcguguuugggcggugcagggcugcccuccuuaguguguuugcuuaauucaggggugcaguugaacuuaguggaugccgagagccagcccuagccgcgggagcaucguguccaggugccccugugcaaacgcuggaaccgguagugugcuuuguaccaaccaaaaguccgggguuggauuagaggaagaacccuaccaggagggcagggcguccuccagcggaagggucucgcuuucauaugucugcaguuggaggccacugaaguggagggugcugugguuuuaagaggggcaggaugcuugggcagaauccccacccgcuucccucugcaugucaggcagggccauggccuuccaggagagcuacagcagcagucugccuuccggggcugugcccucuggauuucugguggcucucauuucucuguuuccaggcugcugauuuauuuucuugcuucaucccuuugguccggccaagacucaccuggggcaccagguggcaugugcguggacaguguggagucauaucuuagccacaguugaucagcacuuucucccuucucagcgcuguuggccagugaugguaaaaagccugcagaguggcuuguccauaauacagacuggccgguaagaccucuauugaggaacauugagaauggcccaaagccggcaggaaugugccugaaagccuggugcuggcguugcccagccuccucccucugugagggagaggguaucagcccacagagaggcuuugccuuggcacuauguagucugaacuacuaaccccgaagugcuuugguuugaaacuuggccaguuagguggagaaaguggauguuguguugcugagcccuuggcauuuggcagcccuguagacuugaaccaugucccagccaggcuggaugacuggcagacuauacccuugggggacuuguuaauuccaggggaggauccggguggagcuccagccuuaugggguccuagcccuuuguguguaucugucucccaugaggucaccuggcugccuuguuggugacuuaagaugcucuguggauuccucaagagaugggcucugucugccucugcaugacucgugaugaguggcggugggaccuggacccaucugcugaugaucaggugguguugcagcaagguuccuccagagcuccagcucugcgucuguuacgggagcugugaaggcugcacggugcucauuucagaugguucuuccuggcucucuggcugcauccacagaagucugaugaaacacugugaaagccggcgucagguauugaaggcaccuggcugagagccucuuuugcugcaugaagaccucuggcugagugggguucacaacaccucguuuuuauuucccauucuugaagcugagcucuggggcucaagcacuuccagcaaagcaguuugacuuucuagcaagaggaugugguugcauuuuccuuucucccuuaaaagaaaaaaaaaaugcgucguuccuagaugaugguuuuuuuugacagcacgaugccuaccuuugcgauuugagauuuuaggccccuucuuggccgggauccuugucauuuuuaauaaggcuuagaaucauugggugaauccuguuugggacuggggugaugcuguuauuuuucucuuagaaauagggaugucuacauuauguggagcuguaguuaauuuagugaggcuuaagaaccacucagacaugcugcuguucuuugcauguucuucuguuaucaauaaugauaccacuuuucauuucuguagaacuuuaacagaaauauuuuugcauguauagucucauuguguggcuucaccaacccugugaggguggguggguagcuuccucauccucauuuuauggaggagcggguggagguucagggagggauaaugaccuccuuaacauuugacugaggugguuugaagucugaucugaaccaagggaucauuugaauggaguuucugucuccacacugcauguggauggcaggaacccagugcuggcaacuaagccugcgcuggaacaucacaguaacugcagagggcucccugcaggggcagagagcugccccugccugugcgugcaccuuggagguuuuaaagucuaacuguuuccaaucaggacagcaggugcacaucauaacaaauggcucaaaaagucacuugucccaccaaauagaaagcuggccacauuuuagaagauuuccagcuagggauuuuuuccccuuccucuguaugugcauacacagaauuggggucugacuucccaagcuucuggacuaccgugaugugggcacuucuuuuuuuguuuugagacggagucucgcucugucgcccaggcuggagugcagcggcgcaaucucggcucacugcaggcuccgccccggguucacgccauucuccugccucagccucccgaguagcugggacuacaggcgcccaccaccucgccuggcuaauuuuuucuguuuuuuuaguagagacgggguuucauuguguuagccgguauggucuccgucuccuaaccucgugauccacccaccuuggccucccaaagugcugggauuacaggugugagccaccgugcccggccgggcacuucuuaacguuaugaagagcuuuugaagauaggguuucucuuguuggcacaaaauucccacauuuggcugcacccuacucaaaacuucacuguuuucuggcaucuucaggaauuuuugcuguuggagugaggugcagccuuguccaggggaaggauguuuuggcuaaugcuuauuucagagcgcguggaggugggucuggguuguaaaaucucuuaacgauggacuaaacauauuuuaguugaaaggcccaccaaggcucccaaauaaaaacacauccguaauccuguuuguaggcaugggauacaggugauuuugcccucagucuuguuuuaaaacacuagcuugucagaagagaacaguuuuuuucccccaauuuuuguuuuguacauugagagguuuauuccccccucccuucacccccaaaucacuagaguuuaaggaagcauugcugauuguuccagauuuaucugaucagguuucugggauguccuauggggcauggcaugcugugaaauguagccacacagcugugucgucucuggagccuccgcagccaccaugcccagaaaugagccugagagccaucucgccuccagucugaacagcguguguuaguuuccccucugguucuccuuagaaaaguccaucggggguugauggcauugagguagaugaauuaacugccuuucuuguucaauaaagcuuguucuucuuucaaggauaaagccucucuuagcagucacacaucguaauucagcuugccagcagcaggaccgugaugugagugauagcccagccagcucauucagccaggcggcccgauucccagguucccacgcaucgccgggaagguuggccuuccucugagguugagcccucauccagcccacaagccuccauccccaccagguggccgaugagaggaaacccaggcucuccacuggccuggcacuuggcaggagaacccugcccugcacuucuuaagggcauuuccacagggagauuccaggaccccuuaguaguaucucagccccaguguuugggggaccugggaagaugggucaggguuccccacuuugucccaugauacagcugcucuguugagcaugugugucccacagagugcggagugucugaggugcaucaucucaguucguccugcagcgaucuuguacacagacgcacugcugaggccagaaagcuuaggacacuugugcgagagcggugagcugggcccguccgaccucaccucuggcccucugucgccgugugagauugcggagccccuguuauucauacuucccauaggccgugugugcaaagcaucccaagcuuguuuccgccacccaaggcaagaggguuugagaaggccccaaagaaccuaaaguauucuguucucuguaaagcagcugacuguggcaaaacuuccagaagcauuuguuuucauguggaaauguauuuaguccgguugaugcaggugugcauguuuagggaaacaaacauuuucuuccugcuguggauaagugucauguuucuuugucaccauuggccauguucauaauccuucaaguugaaugaaagguggcagguuugcaguccccuccuuaaaaauaacacucaguuggcuuuuaguugcuuccaggugagcucucguaccuugccggcacccgggaccuccacaaugcgggcguuccuugugaguccagcuuacucaugcuucucaguuguggugcaggugcucuuugagaugccgccuucucugccuguugcucacccugcgaggcucggucucuguuggugucacucaugaccagccuugccucgccagaauuaaggcccuccuggucucugcccaccguguuuggcucaucuacuuaaucagcugggaggucuggaagcugguugagggcagaaaucagggcuuguuuauugcuguauccucagugguuugauagaucacgucuggcccuugaaggaugcccagggguuuguuggcuggcugacuugccagaggguccuuuccaaagcuccuucuugguaggauaaacaauguuuauacgcugcagaagugaggacaauuugaaacguccccagagcacagaaguuaggguuagacaccuuuuggauuuggugggcuggcuuggugggaacucagugucaugugguguuugggauggaagugaaauuuucuuuacuguagguaggggaagcaaaagauuugcuugcuaaaucuuggcagcuuuuucagaucagcugucuacaacagguugguguuuauguuggguguaagugaauuucagacauagaaucaauauuaagaggacaaaugggugacagccugugucacugccaugauauaguaucuuuggcgucacaccgagagcaaacgugagugugugucaggucacauugagggcugauggaaacagauugccggccccucccauaccucccgaguuucuaguucuguggguuuggagcaggacgcacgaaugugccucucuaagaaguguccugaggaugcggaugcccugguccagggaccgcacuucuggaagcauagcuguaaaggaaaggcagcuccaguugacuugguaucaucucugggccguuguuucuucuuccuugcugugcuuguagccagcugagaagguuuccuaucagccugcccugcagguuucaggugaagacaccuaaggccagcugcucagggaguugcuuguggucacgcaggcuaagugugguggacgagggacuuaaaccagaucugaaugguuucaagcugguguucaugugaucuucaugaugcuguuugaaaagcagcugaaugcugggugaggggccugucgugccagaccccuuuaaauuucauuagggauggcaccggguucaagagacuggagaggagaccuagagccagcaaacaaaagacagaggguuuauuaggggaauuuauuuacagaguggucccauggcggccugggcaggagaagcgcugcugcuugcuuucagaaagcgugcaguuuauauagcauuuucgcuuaacacccucccccaaacaaccaccacccagcaaccuuaacaccaaucaaagagccucaauacccuguauggccugcuuuccaugggacaggcuggggguuuagauguuccucauagauaaggaaugaaucucuggguuggccacucccggauuccuuagcucagaaccccgaacauacauucaggugcaccugccauguggggccauucucaguuauugcugucaggggcaucugucagugggcugcguuucugcgacacgguggcaugucggauggacauugccaagagaaucugguuaggagguagaggcagcugauguccauuuccuucuagacucauucugugguuuugcggauuuuccuucuugucuuucggagauuguugcuuuuuaauguagucuuauguauauuuagauuggguucuucaguauucacuuauuauaugauaauuuggcagaugacacauuuuguuaccaauauuuccaagcugaaagcgcguuucuguaaaagacaggagcuagauguuacuaguagcuuaaaagagcuguuggaggagccugaaggaagugacucauaagggagagaagcagugggggcagcugcaggaaccuucaaaacaaaaccugcagcccuguugcuaccaccucuuguuuuuugccuaaaccaggcguuuuauuuuguuaagacgaaaaucccuuauuuugcauccguuuuucccccuguauacccugcagguguuuauaguuugugagucucacucuggcuuguuuuaaccacugauuucguuucgucuuauguuucucuacacucuagcaaaccugugucccccuccccgcccccaucccaauccuccagccuucacguccuuagcuuaagugauugagucuggcaaagcggaugaggcuuagcuauuuuuaaaauccaggguuugagguucugaucuggugcuuagcuacauaauuccuucccuuuguuaaguaccuuucuccgagaaacaaaaugcacucuacagauguuaaucucuaaucuuugcagcaucuguuauuuuuauucagggguacaagugcuuugugugugcugcggugagcccuggccuucuggaagcucugugcuucugaggggcugagggggauuugggggucccuuuucauagugugggcugucuuucccaagaugcagugaugacccaucagaggcaggguugguauuguccgugggguccagucccucuaucuuccagggcuuuucuggucacaagagaccauggccagaaguggguaucgugcuugugucuggggccuggggagggaaggaaaacaaauaccacccccugcagaagagaucguuaauggauucuuugaguaaccagccagauagcuuguuugugugcgagguugggacauuuuccguaaagagcagacuaaauauaggcucgaggguggggaccagggcccgagagggggcugccacugcuugcuccaguauuguuucuuccauugguaaccagaacuugccaccagucccaaacagguggccacccugagcucucugggaacagauugguguuuuuguuuaaccaggggcucauuugcaaauuucacacuucucccgcuguuugauggggauugucuuuuuuugggcugcaguguuggaguauuuguacaguguuucuacacaagcaacugucuaaucuuuaaaacugcucaugccgucugguugucauuagcaucaugguuagaagcuuuuuauuugccuuuuuuuuuuuuuuuuuuuuuaagggugggaaaacacuuuucaugguucugggagaagaauuucaaauaauguccauguucacaaaugauuuauguuuggucuuggagaaaugucagcauucaacaggcucuaguaaauacaaccauguugauuuccagcuuaggacgaagcuacuguuacccuguucucacucagauaauagucugaaaggcagaaccguaccuuuagaaaguacauuuagcuucaauucaauaaguuuuaguuuuagccaauagugacuuguaguauggaggauacuugaaagaaagaaguuaaacauuuuuuaaaaaauuuaugaacaccugcaacaaauagccacaagaccuacccuuuuuucaggaaagaguuuucacuucuuaaaugucaccuugggggcaugcccacugugugaugguacccuucagcaggauugguauugucggaagugcuggcuagcuuauguaaugaaaaagaaauugauuuggaaagagcugauugcccugaauuuccauccuguuugugcguugagcugcccuuuucagugggggagaauccagcauauuuuccagggagggcguuuccggaagccugucugcacccccuuuguuguuguuuucgaaggucuggggugcugcugugagccgggaucgcguaucugcuccuguucugacgagacugcuccugcuggaaguucagccuggugaaccugauuugggaggggauggugugauuggcggggaacagcauuguguuaauuuuagcuucaacaaucaagccugggucucugaguguccauguaguacuugaaguuuggguuuggaauuggugggauugagaccacuucaaacucuuuuauuucuuggaacuuguuaguauuuauuuauuuauuuuuugagacagggucucacucuguugcuuaggcugaagugcaguggcacuauuggggcucauuuguagccucaaccucccagacucaaguaauccucccaccucagcccccgccaaguagcugggacuccagaugugcaccaugccuggcuaauucauuggauuuucaguagagacgggguuucaccauguugccugggcuggucuugacauucuggacucaagcaauccaccugccucagccucccagagugcugggauuacaggcaugagccacugugccuggccuaguuuuuaauuuuugagacagucucugucaaucaggcugaaguacaguggcacgaucguggcucacugaagccuugcuuuccugaagcgauccuccugccuuggccucccaaauagcugggaccacaggcacgcaccaccaugcccgacuaauuuuuuaauuuuuuuuguagagauggggucucgcuauguugccuuggccucccuaagucuuagguuuacaggcuugagccaccacgcccagccucgaacucucuuuuuuuuuugacacauaacagagaaaggugcccaagucauaaaggagaaaguuuucacaaacugaucacaugugggaccagcauccaguucaguggccagcacagacucaucugucgugagggucguuagaaauuguagcccccauuuauuggucucuucugccugugauaugugcuugagugguugccuguuucgggggcugucaguguuugaguggcugccuguuucgggggcugucaguguuugaguggcugccuguuucgggggcugucaguguuugaguggcugccuguuucgggggcugucagugugugagugguugccuguuucgggggcugucaguguuugaguggcugccuguuucgggggcugucaguguuugaguggcugccuguuuuggggcugucaugaauagcaccacugugcagauucucacuugccuuuuggugcccauauggccucauuucugucgggugugugcugggcugugucuuucucucuguggguuggacguagcugcucgugaagccgcuccugcagcccagcagccccuaucugggaaaccuuucagugcuuucaagguucauuuuaugacacucaggauggccguuugucuccuuuugcugauuuucauucuuucaguuguuuguucauaaacaaauguuugcauggcuaaugcauuuccagcacuuagagauuagguuuuuaaacuuuuggauugucugcaggcuauuaauuccuuguuaguugaauaaugacggcugugugcauggagcugugugagcgaaaucccucaccaggaagagggcgcaguuccucugggacuggaacaggggccccuuuggcucuccuuggcuccuggcagaagucaguugucaacugggggacucuuucuggcugagccccaagcagccucaauccaucccugugcuggguuuuagauaacccacuggaucuguguuggucuuugaaagggaauucacucuguauguuuggccuaaacuguguuauggccuucauaguuacguauuagcauuauucaguuuuuguuguuuguagcaauuaugcugaagacacaaaagaagaaaaaaagcuaaguguugccaacucaaggaguaauuuucuuuguuccagcgcuguguccugggagcugcccaucccccuccacaaaggccagugcuaaacaaggccagagccaggaaggacacgcggggccauggauugagugagggcagugugugcguguguggauuucucugguggcuuugcaauggcaaauauuuauuuugagggaugguggugggaggaccaaguuuauacucacuuuguuuaguaggggaaguggcuaaugugagaaucaauagacaagauuuuaucaagccucugcacugggcagagcgcaguuuuugaagcugggagaacaggcagaugugugggacacucagggcccuucagaucucccccaggagccacugauacagguagagaucgcagccacacaaggcugugugggaggggccugggagauggggcggaguccagggagagauccuggaagccagguagcagucaggagggcuuuccaggcuaguggguacuaggauuggagcauccagaacagagucacuucagccugggaagagcgggguaggcggccgaaugauaagugauccuugacagcccccgagagcaggcugggagaccuuuuguuggacggucuacuacugauuauggauccugcuuggagaggggagugcuuuuuuuaaaauucuuuucuuuuuuuuuuuuuuuuuuuaagacggaaucuugcucugucgcccaggcuggagugcaguggugugaucucagcucacugcagccuuugccucccagguucaagugauucgccugccucagccuccugaguagcggggacuacaggcaugcaccaccacacccaacuaauuuuuauguuuuuaguagagauaggguuucaccacguuggccaggccggucucaaacuccugaccucaggugaucuacccgccuuggccucccaaagugcugggauuacaggcaugagccacugugcccggcccuguuuuauuuauuuauuuauuuagcucggguuucaauauuuuaaaaaauuugaagccaggugcgguggcuaaugcuuguaaucucagcgcuucgggaggccgaagugggaggauugcuugaggccaggaguuugagaccagccuaggcacaguggcaagugccuuuaguccuagcuacuugaguggcugaggcaggaggaucacuugagccaaggaguugcaggcugcagugagcuaugauugcaucacugcgcuccacccugggugccagagugagaucuugucucaaaaaaaaaaaaaauugaacugugaugacuaugauauugucuuuugggggguuuucuggacauaaaauucagaauuuuacauagaaacuugaauuuauuuguccaagaguuucuuguuuugaaaauaggaugccacugggaacauucuugguuaggagccaccggaagccgggucuguaugggcagggccagugagaugcaaagccacacacgaaagcuaagcacacacucuuguuuuccucacucacauccauguucauccucuuuccugugcugacgguuugcaaagcugggagagaaugagggcggggccucgggaagugaauggcagagcagguggcauagacaccucagccgucugcccacaggguaugggcaagguuuguuuuggugacuuuuucuuccagucuuguguacauuaucgucucucacaggacuugagcuuggagggagcuggaguggccgcuugcugagucuuucucccuggagcucgugggcagcugguuaccucgcgcuggggcgacccugacuuaggaccuccugccguuucucugggugacugcucuguagucgugagucgucucuuuaaugcugagcaucaguaccugcacagcccugaauggagcagcugcccagaaucugucuugucaucgauagauggacaguugccgaguguccugcgugccgacugacuaaggaguuuuugucucugucacccuguccccugugguuuuaugaagacguuaguuaugaauccguguuuaggaugagaagauguaaacagugaggaggauaagugagaagcuagcaagagucuggauggugauggcgggggagcgcugguggaggagucgggggcgucccgcuggacuggggcacagcucugcagcagcagccggugcgguuuugccuuguaagugacaccguugccugcaggcaucucugacagcugcuccugcuccagauuccagaaauuucuauggaacauuuccugaaccauccuccugguuucuucccuuccccucacugaauaaaauccguaauagcaccugccgcuugaguguuugucucugcaggacgccguguucagggcugggugcccuuugugucauuuuguuauccuggucacugccagacagaggugguaggacccucauuugucaggucaggagccugcagccuggagaguuuaaagccuugccugaauccacccacuucugaagguggcagagucaggauucgaacucgggacccguggacaccagccaccuaugggccuuuauuuuuauauuuuuaaaaacuuuuaguuucagggguacacaugcagguguguuauauagguaaguugggugucaugguggucugguguacagauuauuacaacgcauaguaaguacaguaccugauagguaguuuuucaguccuuucccucccacccuccacccucaagcaggccuugguggccguuguuccauucuuugugucaauguugagcucaagugagaccaugagauauuugguuuucuguuccuccgcugguucgcuuaugauauuggccuccagcuccauccauuuugcugcacagggcgugaucucauucuuuuuauuauggcugcauaguacuccacaguguacauguaccacauuuucuuuauucagcccaucgaugggcauuuugguugauuccaugucuuugcuauugugaauagugccacagugaacacacaacuaacugcgugugucuuuauauagacacaauagaacaauuauauuccuucagguguguaccaaguaaugccaccuacaguuuugauguuuuaguaaaguagaaaaggaaacuucagaaaucagcccauaagucugcagaaguacuuggggaauucucuccgcaguucgcagcucuccugcagaucucgguuugugauuugaaacucacauucacgcucgguuuuuuacucaucaagguuauaaagaaaauaacagcuguugguucacuuuuauucccucgcugagaguugguggcggcugggaugcugacugacgguuuugauuacaugaggaggaggcacggaggcaagcugacugccugcgauuacaggucccgaaguccgggaggagggaggauuuccaaacggcaugccuuugaaaauucaccugcguuuaggaaaucugcagcaccuuuaauccuggcuagcugaaaauacagcuuacauuuaagccacacaaauucugugacauuuuaauaauggagauguuagugggcaguuaacuuuuuauacauguaaauagaaguuacuuucccccugugcuguaauuagcaaaagagggagaaagggaugcucugugcaucaaagcgauuugcccaggguuacacagaggaagguggcagagccggaaguggcagaauccagugcacgggcgggaugccgagugugucgccaaacuccaccacuuuagucgggggcguggugguggcugcgcuaucugcuucccacucacuggcauccuagccguguggggugugugcucaccugcagccacccucaccugcuugaaccagauuuaccuagaggguggugugaacucaugugaugugaacgauuacuuauaguuaccgugaaaauuaaugguggguuuuauaguuggaaugcuuuuucuacacuuacuugauuuuugucuaucuguuuagagaaguguuuuuucuguuguuguuguuuuuuaaacuugagauggagucuggcucugucacccaggcuggagugcaguggugcgaucucugcucacuguaaccucugccucccagguuccuggguucaagcaauucuccuuccucagccucuugaguaacugggauuacagacauccacaaccacgcccggcuaauuuuuguauuuuuaguagagacgguuucaccauguuggccaggcuggucucgaacuccugaccucaagugauccacccuccucagccucccaaaauguugggauuacaggugugagccaccacgcccggccagaggugugguuuacauaaaguaaacuccaacucuugaaaguuuaccauuugaugaguuuugaccccuguagcuacaacugagguauggaaggcaaccauuccccgaccccaacacuuccucaugcccguuugcaaccugcaucaccucuguccgucugcuugcacccaucugcugucugucacuguggauuaguuugcauuuuccagaauaaaauagaaauaagaucaugcauuaaaaaggggguccccagccucugggccauggaccaguacugggccuauuaggaaccaggccacacagcaggaggugagugacgggccagcaagugaagcuucaucuguauuuacagccacucccuuugccuuguguuacccccugagcuccacuuccugucagaucagcggcggcauuagauucucauaagcgcacaaacccugcugugaacagcacauaugagggaucuagauuuggcgcuccuuaugagacucugaugccugaugaucugucacugucuccugucccccccagcugggacccucuaguugcaggaaaacaagcucagggcucccacugauucuacguuauggugaguuguagaauuuuuuucauuauauauuacaaugcaguaaugauagaaauaaggugcacaauaaauguaaugcauuugaaucaucaugaaaccaucccccugccucccuucagugggaaaauugucuuccacgaaaccggucccugaugccaagaagguuagggaccacugcaguaaaggaccccuucuuugacuggcuucauucagucagcaugaugauuuuuagggucauucaaguuguuacauauauccauagcuuuuucuuuuucauugcugaguaauguuccauuguauggauuuacuacaguguuuuuauccuguggauggauauugauggaguuguuuccaguucuuggcuuuuacaaauagaggugcugugaacauucacgugcaagucuucauaugggcacgugcuuucauuucucuuggguagauaccuaggaguggaguggcugggagaugugcuggguauauaauuaacuuuuauguaaacugccugcuguuuuccaaauugguugauuuuacucucccgccggcagugugagaguguccacuuugggcuuaaguucagcaggcuucuggcagugaugggauagcagcuguccuuaagaaagagcauuugcccucugugucucuugggcugugaagugucuuguacugaugaggggggugggaggcuauaggagugaggcugaggagggaaaggagaagccucagaaagaggugcagacugaagaccaccuuagaaggucgcaaaauccaagggagcagagccagugugccucuccuugugaccucuggccucaguuucccugucuguaaauccggauguuuggccaagaucaguuuucaacaaggugcugggugggggggcggggggcggcgguguauggcgugcaagcauuguagcccccaagaggacauuuggccaugucuggggcaauuuucgguuuguuacaacuuuggggugucaugguuguuacuggcacguggcagguggaggugagggaugcugcccaagaucccgcaaugccuggggcagcccugagucuucgucaucccgagacugagagccccaggucagaugagcucugugacccccucagccucugauccacacucaccaaggauuacucuggugcacgauucuguuucggugggagcugguguaauuaucuagaggugugucuaccugugugcccagaggggcccgcccucucggugagcaaggacaccugguucccuggggucugagccaggcccucagggaggggggcagccaggagccgcagggggcucagccagcuccuggcccucaaguguucuaggaaaccggcuucucuguggggaugugacucucccucacuccucccauugccugaguaggcaaauuccaccuagcucuuuaugacuaacugccuggcagccugagcucagggcaguuccuaacgaacuucuuugauuauuaaccuaugcugggcccagggaaauuacucacuuguuuucuggccaagagaaaaucuccuggaaacuucuauauauaaaucuuuuugacaauuccgcauucaagagaguuccccuggcaguucuucuauuuguaggguggggagaaaaacccauguaauuuccccaaacuguggauuuuguuccuauagaacaugcuugugagauucagugugcguauuugugugagugugugugaaugugugugugaauguaugaguguggaugugugugaauguguguguguaugugaaugugugugaaugugagugugaaugaguauguggaugugugugaaugugugaauguguaugugugggugugaauguguguguaaaggugauugugagugugugaaugcgugugugaaugcgugugugacugugugaaugugugaggugugaaugugugugaauggaugugugugugaaugcguaugugugaaugugaaugcgugugugaaugugugugugugugaauguguguguguguggugauggucauuguccacauugguggucuugucacucacuucuugaucuguugcugcaucagcagaaugcugggcagauggcugcaucuuguuugggaguuugggaguuuucuuugaguaucuguuuuuuaacuuucaggggagaauaccaagguugggaaacacugguuuugcugacauaagaauaagaaaauuggccaggugcauuggcucacaccugugaucccaacacuuugggagaccgaagugggaggauugcuugaagcuaggaguucaagaccagccuggguaacauagggagacccccaucucuacgaaaaaacaaaacacccagguguguuggugcugccuauggucccagcugcucaggaggcugaggugagaggauugcuugagccuaggagguugaggcugcagugagccaugauugcaccacuacccuccaaccugggcaacagagugagacccuaucauuaaaaaucagucaaucaaucaaucagucaauccaugcgcguccucccccauuccugccuugauuucccuguuaggauuugccauggggugggcagcugggcaaaggcaucugagcuggagguaggugauaagcucccugggccucccacccugccugccucugcucaguggcuccugggucccuccugaccauguaaccuuugcgccagccagagaaucugcccuuugccuuccucuccaggaaguuguugagauacaugagugaaaauauuauucuuuuaagugcuuuggauguuauaaaaaauacacugugccauuaaugcucgugcagggcucccggccggccuaggcccucugcacuugagauuccucuggcagcaucuguuuagaacugggcacuccugguucuggucaaguuuauccugaccaguucauuucauggcaguucuggucauuuuugagaaaaucuaguuugcacuuucauugggccccuuuguguuuucuaguucagauguggcuucucuagcuuuuucuugcugcuaaauggucuuaaagguuugagaucagugucucagacuuuagccugcgucaggaucaccucaggucacguuuuaacugaggguggguuaaaaugcagaucacugugccgggcgcggguggcucaugccuguaaucccaacacuuugggaggcugaggcgggcagauugcuugaagucaggaguuagagaccagcauggccaacauggugaaaccccgucucuacuaaaaauacaaaaauuagccaguagugguggcaggcgccuauaaucccagcuauuugggagguugaggcaggagaaucccuugaacccaggaggcagaggucgcagcgaacugagaucgcgccacuguacuccagccugggcggcagagcaagacuccgucucagaaaaaaaaaaaaaaaaaaaaaaaaagaaaugcagaucacugggcuccacccccagaaguucugauucaguggguggcgggugaggccugggaacuucaugacgagcccccuggcaaggcugcugcugccauuuuggugccacacuuuggguacuauggcuuugggcacucccaauccaggugccauggcauggggagcagugggugaaccaaauccuggagccuggacuguuccauugggugcauuucuggcuggcagauagaggaccacccagcugugcuugauggggucuagaagcauugaaacugguuugccguuaugauguccaugagguuggaguccuuucuuaguuaaaaaaucugaagacccaacaacacacagcacccccacgcugaacccucccgagaaugauugagcucuuccaaauaaagggcgauuuuguagcuuuucaaguuuuaacaguuugauaacucccaggcuccuguugagaugcuuugugaugagguugugcguuccccuguaucuuuccuguggguguuuauguguacagaacacauguaucuguauuuacgugacugagcacaggcgauuuccccgagucucaccuuggugugugccagugcaugcgcgugcgcgcgcgcacacacacacacacacacacauaccuccucucagagaauguugauguggcaauucauguuugacagcuggguuaacccauaaauagaucccaaaauauaaauuuacccagaccucaaccugcuuaagccuuuaaauagcucacuagggcuuuuagaaugaaguugaaauuccuuggccucacccuuaagccuuuuuagaaggagucauggaggaaguaaagaaauggaaauggaguugccucgcugggcucccaggcccuuugccguggcccugccugcucuccagccuggucucaccccaccuguggcaccuucgcuguggaggauaccgucagccaggcucacaguuccuggcaggccacuuccucugucuggggcccugccuggggguuuggaucaccugaguccugccccuuggcaagccucuuuuaacccaccugaugccuucacaacccagcucaggaguccugcuuccccaaggccauuccgauggcuccugcuggcgauuccagggccugccaccugguggccugugcacuuugcugugacgugggcugcacgucucuccccagcaugggcucaaggugcucaggaaccaaaccccggugucucauccaggacuggacacguggugagagcuccauggagcuuaacugcaugagggaggcgggauggacucuggcuuguagggcacagucuguguagcaacaaggaacauaccugguguuuagaucagauguucaaugacucaugucccagagaaggggccugcagccguauuggucaguuggggagcuuguauacucaggccauugagguugccauggccaccauuuugggaaucuuuucuuugggaguugccaucagaauuuagggcauuaaaaaaguccuuaaauuuagguaauguuugccuuaagcagauggucuuugccuuuuagaacugucagaacuuguuuacccuucaagcugggcacugugguaaguugacucuuuggguccuugguuggaaacaugagaaucccauucuggcugacucaagcagacauggauuuuauucgaaggauguggggguggcuuugagcauagaggcguugggauggacugaaccaugggcccaggggacaggcacaggcugccuguguauuuagggcacugcuuggguugccuggagagugguuuauuggcccagauucugccacuucuuggccaggggaggccuuucauggacagccucaucagaguggcagcagagagaagagcagggcagguccucaaaggaacacugaaaagguucucugaaagacaggggcguagauacugagcuggcaauaacagcgcugauccacuggaauggggaagggccucgagcuguucugucaacacggaguuguuugucaggcgucauggguaucauuuugugcaucugcccuuguucaguguuuccuuguaauuuugcggaaaaaagucugcuuaguguugaaccagacauucugcagccuuuaaaagagaauggaaauggagagauuguaauguguucauuggugacuuuugacacggaugcuaaccuguaagaugugcagauauaucaugugcaaacuguuaagaugcugucaacauuuugaaugacuucuugcaaauaguaaggaaauuaaacacgcacagagcugggcaaaugcuagaggaugguguugccuuuugcaucuuggugggaaagagauauuuaagggggugaggggagcucagcaacagcgacuuaagggccugcuaggagcggggagaaguugguugcuggggugugcggccucuguagcccaguccuccgaguaucgugacagguggcugggugccucagugcucagguaugggcuccuguuccugccgcaugggcuccucugcugcugcugcugcugcugcugcugcugcugcugcuggcccgccaguucccauggacucucccucaccugugcuuccuucugcuccccgacuucaugguuggaacgugcugucuucccaucccucugggcacguggcuccucuuuuacaugcaugccuggcgaauaguauauccccaguaaaugcuugcagaaugaaugucuuuccugaauguucugcucugcuccccagcccccagaaauaaaacagaaaugcuguacuccuucccugucucaggcccaggagcauuauuauuauuuuuuuuaaaucucuuguggcacuuuucuacuuucuccuccacaguacagcugcuuguugagaggcaguauaugucaugucuaagaagaguccucaagugaagucuggugcagcuucuuucuagcugugugcuuucaggaaagccuuuugaauuuggagccucuguuuccucuagcuuuacuccaaaggaaacaaguguaagugcuuggcaccugcagccugagcguaguucaugccgcccguauuccuggccagccuccguucucugggacccggcaggaauguguuugucgccucuggcccugugcacccuggcuucccaucauaccuggagacccugggacaaaugccuguggaguggaugagugagugcaugcggguccacucagcuccccggcaggcuucagaaucuucccuguauucuggaaguaaguggcgucgcugcccaguuuaggagagugccaugugggacucuguuccaucagcuggguuggugcagugggacugaacuuucuucuuugguugcccucugcaaacagccaugcagauguuauugaugggcaguugcagguagaagcauuuuuggcccuacaggguagaucugccagcauggcaggcugaucagccacgggugccacguggcucuggaggggcuuggcgccuacguuagucagcucgggcugccacgacaaaauaccacagacugggaggcccaaacguauuuucucacaguucuggagguugagaguccaugaucaaggcacuggcagguuuggcuucuucccauucugugccucaccuggucuuuuccguguguguggucuucaguguuuuuccguucucaggaggacaccagucuuguuggaugagggucccacccuuaagcugccauauuaccaugauugccuccuuaaagaccuuaucuccagcgacagucaccuuggggugugagccucugcagaggaauuugggggauacugcgcaguccguacagcaucccucccucccuggugguuucugaggauuugucacugauguaguagcaucacgaguguuucgucacuuaacccagagcagggcuuugacgacauagcugugcccaacguagaucuuuaugguaauuuuauuuuaauugaggucgcagggacuaauuuuuacuggaaagaaguagcagccaugaggcaggagauccucuuuacuuuguaaaaaaauguaaaagaacuuguuuagaucaaagucauguuuuuaaaauauaaacuagauuaugaaaaaaauuaaaacuugauuuaaaaagaagccugggccagaugcaguggcucacaccuguaaucccagcacucugggaggccgaggcagacagaucacuugaggucaggaguucgagaccagccuggccaacauggugaaaccccguuucuacuaaaaauacaaaaauuagucagacaugguggcgugugccuguaaccccagcuacacgggaggcugaggcaggagaaucucuugaacccgggaaguguuggagugagccaagauugugccucugcacuccagccugggugacagagugagacuccguuucaaaaaaaaaaaaaaagaaaaaaaaaagguagaacucauaguugccauugaggucugagucccggcuugccucaguugggguucuugcccccauuugcaggugagagguggaagcucaggcaggcccagccuccgaaggugcagcgcagggacccuaaccugagagcuggaaaugcuuucuuagagaaagugcauaagggcugugcccaucucuccuuugcccgaagacgacuguucugcugcauugguuucacuguguuguuucuguaacucugguguuuaauccacgugaagacaguggagcuguuuacacuguuugauugauuggaugcuuaucaggaaucucaaaacccagcuuugggcaaccagaugccuuugacuucucuuucuccuccacugacagugaucucugaaugcuuuuauaaagguuuuucauaaagaauauaaaaagugacagaaauaaaauuggcaaucaaccaaauuccuuaccucucaaauugccucuucugagacuuuuugugaugaugcgugugccccacccugcaauugguuucauagaaauuccuuggauuuccucuguuucugacaaagagccagggcggaagcugcaggucacugggugccagcuguuucccaccgucagccuugggaggggcacggagcuuugcaaaugucucuucagcugguguuuucugccauaggacaaagagaaaggagagugacaugguguuuugaauauuuuaguaagaaaacagucuccaccugcacacaaacaaaaaaaauuaaugcuuggauauaacuuuuuuaauccucaaaguaauaauaacuuucuaucucauaagccagagggaugguggcauagcuaacagcagcugcauguccucagguuaaacuucacaucuugacuggcaggcuugccucgcgggugcacuucgugaaugcccgcugcuccugcagcggaagagucuccuguccuugggccucaguggcaggggcagcaacaggaggcugcggccaguuggcuucacacuguuugggaacagcagaagggucagagcagaccucaacauuaucugaaacgaguacuauucacaacagcaauuugcagguuaugugacaagaaucauaucauuugguguguguguauguguuuauuuaugagacagggucucacucuguugcccaggguggaguacagugccacaaucguagcucaccauaaccucaaacuccugggcucaagcaauccucccaccucagccucccagguagcuaggacuacaggcgcacaccaccacaccuggcuaauucuuuauuauuuuuguagagacaggcagggucuugcuguguugcccaggcuggucuugaaugccucaagugauccucccacuauggccucccgaguugcugggguuacagucaugagccaccgcacauggcccuaguuuauauuuauuaauugguuuaauccucccaggaauuugaagauauaauuccugauauauaggugucagaauuugagacuaagaguauugagugauaauucauuucucaccucucuggaagaagguguaauaagcauagaaaauacagaauuuucuauauacugauauaacacauauuuucuuguguguauguguauauguguugugugugcauagugaacaaaggcagaagaaacauuuaggcuugaauuuuuugagcuaaguauuauuuucuagagcuuaccaaaaaauccaaacacacauauauguauguagaauaagcguaaugaucuccuguguacccucaaccagcuucaguaauuaguucauccuguauauacccugccaccuaccaauauuauuauuaucauuauuuauuuuuuugagacggagucuugcucuuguggcccaggcucgagugcaauggcaugaucucaguucacugcaaccuccaccuccuggguucaagcgauucuccugccucagccuccugaguagcugggauuacaggugcccaccaccacaccuggcuaauuuuuuuguauuuuuaauagggaugggguuucaccauguccaggcugguuucgaacuacugaccucaggugauucgccugccucggccucccaaugugcugggauuauaggcaugagccaccaggcccggccucaauauuauuuugaagugaauuccagacacccugccauuucauccguaaauacuucaguaucuaucucuaaaagaugaaaacuuaaagcacacaugaccacauuaccacacuuuagaaaaugaacaguuccuuaauauggucaaauauccagucugugcccacauuuccaguugucucaugauuaccauaacuuuucccuucaguuugccuguuggaaucaggaucaaauacugugugcacguugcaguugguggagacuucuucugaaacuccuccaaugaguagguuccaugaccgucuuucucuccuucccggggccuguguuuguuucgaaugccuccccuuggagucagucagcgugcuccuuugucuccuguauuuuccuauaaauuaguggguguuuggaggcuuguuuagguuuuuagcuuuuguuugguuugguuggacuccuuucugggcgggucugugugguucaucaggaggaucccaccuucuauuuguccuuuugcccacguuagcagucgggaccaguuagcucgucagagguugcaaaaugaugauuuuauaauucucucauuauuuuuuuugcuguuauuuguuuaagaugagauaauucuaugaagaguaccuuucgggucauguaggaaaggcaagauaacccucuuuauuuacuaaucguaaaaauaacaaguuuugguuuaguagacuccguuuaaaauugacuaauuaguuuuagaucauugugaacucucuggauuaaauguacauggugcauugcggugaaagcuguuauggaugcuccagugaucccaucuucugcguguggaagcauuucaggaagccuucuguguucucuugacaugacauugaccacuuccuggauuucugaugucacaggaaagauaaagauggacagaugccccaggcucaugugguacauuggucaucucucuagcagucacgguucucagggacacgaacauaauuccucauuugcuuugggcuuccccauacaauucucagaagacagcuccagcagagcuuccaacagugugaccaccagaaugaguucaacgugcugcaaauugcuuuuccucuuuaggguguaucucacuuucggugauaaacuccaguuauuguguuuuaaaucacauggaauuggucuucucugugacucuucuauccugguggagguguacuuagauacauuucuuuauuuucaauuuuuagggaaauaguuauauaacuaguuaacauauuuguguggaaccaaugucacaucaucaaaauaaauucuaagaguccuggcuuugauucuuaaagauaaauucaaagacucucucuuugucacuuuuucaccuugucgucuucucuucaccuauaacuauuuuuuaauaaguauuguuuauacuugucucuuuuaaauauaagcaaauacaugcgaauggguacuuauauaaccuccugcuuggauacagguagcuucccaugcacuguuuuucguuugccuuuuuaacuuaggaacauguucuggaaaccacuccauagugugggcuccagaacaggccucauugugaaacuguucccaauuuauuaacaggucucuuauuaauagacguugggaucgauccaguuucuuguuuuuguuuguuauauauauguguguguguguguguguguguguguguguguguguguugcuauugaaaaauagugcuguauagucuacgucuaucuuuuucuuauuucuugucaauguauuuuugggauagaugccuagaaaggaggauugcuaagucaaaaggguaaugugcauguaguuucgcuaaagguugccaaauucccauccauaauaagugugccaccagcaauauacgugagugccucuuucccaacagggugcugucaaacuauuggauguuugccagagaggcacagcuugguuuuugaauacaucggauguaaucaggaugugcagucuuuuugguuccuagaggcugacugggcucugagaagcauagaacauuuccucaagaggcuuagagucuguuuaggggugaugaggcuuccuggcaguuccuuaaacgucaguaaacauuguucgugugcccgaccugggccaggcucuguuagaagcuggagcuguggacagggaguccagauggacuggugagaaugucacgucgguugaggauuugaauaggccacugguuuugguaaaaaggugguaaggagugggcacauuggacuuagaccuccugggcuucugucuguaccagcucugagguaccucuccuccguaagacgcucagccucucuguaucuguggggucuugauaauaccaaucucaugguucauaggaggcgugaugguggugaugguggaagugaggaaggagaggacgcaagagaaugggagacacccuggagaagccaagcuggggagggaaggaagacggcucaugaggaaggccagguuuuugguugggagagacuugagcuugaugaguguuuggacaauacuggcccugaugagggagcgauugcagggacggggugaugccgaugaagaggcuggccacaaggcagaggggaggcugaaaguugugugaagauggcugagugggaaagacaagcaagaugggaguaagggaggaugucuuggccuuugugccugagccuguuuucucugcaaggcuggaaagcugaccuuuauggugauaucuguuugguacuguuagagcgauuuguccugcauuucugggcaaccugugggcagaagaggagaaggauagauccuucugauaucuccuggguuuggcaguuggcaugguggaugucaugugggugacaugccaccaggaugucuuagcuggggcuacuguagcaaaacaccuaagacugaguggcuucaacaauagucguuuaugucucgcaguucuggcgguugggaguccaagaugagggagccagugagggcaggcuccggugagggcucucuuccuggcuuacacacggcugccuucucgcuguggccucucaugguggagagagagagagaaaggcuggucucuuccucuuccuguaaggacacugaucccaucaugcuccucacggccaugaccucaucuaaaccugaucaccucccagaggccccacuuccucaugacaucacagugggguuuagggcuucagcauacagauucagggggacacaugcauucagcccauaacagggugagggugcaguucuucagcuggagccccaggaggcucuuggggagaaaauguuuccuucccuguggggaucuaggcuuugcucaccugugcugcauggugauuguugugaauuuugaaagggacugcuucccaucggugccugagucaaggccuaggacuugauggauggugccuggcagggucagcugcuuggugcagguuccugugcccaugucaugguacgugcuguccgcuaagcucccucccagcccuuagugguccucacugugaaaagcugauuuugaguaaggcuuuaucccacccagggaugaaauggcagguguuaccagucagggaguggggugggaaugggugucugcaggggaggcugcacagacauggcggggggugguggccaguggucagguggccuugggucgaaaggccgacugaccaccgugugaccuggccagggugugggauugcaucugcuucccugcccuuccagugggagugacccugcuuggacguagcagggggacgguggucuuggauugaauggcucacucaccacccugugaccugaccaggguaugggauugcagcgugccuccucaucccuccaguagggaugacccugcacggaugaggccgggggcgguggccuuggguugaauggcccacucaccacccugugaccuggccagggugugggauugugcccggcuuccccauccuuccaguggggaugacgacaggcauuugcugaguuccaugggacuguggaaagggcugugucacuguagacgcuccaucggaaaugcugauguguauucuuaccacgggcguccgugggccaccauugucuccuggcaucuggcuguccuuggaacccagcaacacccagggacuugggcugugaucagaaguccugcccagagcgaguagggucacgccagagugaggcuggggacagcaugguccacuguggcccagauguaacuuuuaguccugccuucuuauccgguuuggcaggaacaggacagggugguuagcaggccacaguguggugggagugaaaguguacuguccugugugauauuuuugcacagccugacagugggggcaaguuuagagccuuugagcugagaaucuggagagagcaguggaugcgaugggcaguugcuuguccuugcugugagaagacaggccacggggcugcacccagcccccauggguaaguauaacccccaccccacuacugcccgcccaccaugccuuccccacauggaugaguugcucccuccuauaaaguaggaaaacaugcuuaccgcuggagaggaugccuaacaacagcuccugcugcccagcgaggaagggacccuguguccaagagaaaaccugauggcagguaacacaucaccccucucuuuuagggaccucgucccuuucuuuuagggaacucauuggcuugucuuggacccaaacauaauuaguggggguaggggugaggagagaaacucuucagugaacagaugucuucuugggccgauuguuggauauugcucaccagcuaguuauuaaauucuagaaaaacuaauucuuugugcagauucuagguaaaaugucucuguugcaaaauaggauuuuucaauuaagaaaagcuuuaaaauauaucauguguuccuccuuagucugcagaaucugaaugucaccuuaaaaugucaggguuaaauuucuuacgguuaguacaugaggcaggcgugaaauuuacaacagaaaauugagauugauuacuuucauuuacuuucucuuuuuuggggcaguaacuguuuaauguuaaauuuguauuguaugucggugccucuuuugaaacuggagauauugauaugaucuuaagcaaaugucuccaauacgagaaaaagaggacugauuuauaaaguggaggacugacacauaauguggaggacugauacauaauguggaggacugauacauaauguggaggacugauacauaauguggaggacuaauacauaauguggaggacugauacauaauguggaggacugauuuauaaaguagaggacugacacauaauguggaggacugauuuauaaaguagaggacugauacauaauguggaggacugauacauaacguggaggacugauacauaacguggaggacugauacauaauguggaggacugauacauaauguggaggacugauuuauaaaguagaggacugauuuauaaaguagaggacugauuuauaaaguagaggacugacacauaauguggaggacugauuuauaaaguagaggacugauuuauaaaguagaggacugacacauaauguggaggacugauuuauaaaguagaggacugaugcauaauguggaggacugauacauaauguggaggacugauacauaauguggaggacugauacauaauguggaggacugauuuauaaaguagaggacugauuuauaaaguagaggacugacacauaauguggaggacugauuuauaaaguagaggacugaugcauaauguggaggacugauacauaauguggaggacugauacauaauguggaggacugauuuauaaaguagaggacugauuuauaaaguagaggacugacacauaauguggaggacugauuuauaaaguagaggacugaugcauaauguggaggacugauacauaauguggaggacugauacauaauguggaggacugauacauaauguggaggacugauuuauaaaguagaggacugauuuauaaaguagaggacugacacauaauguggaggacugauuuauaaaguagaggacugauuuauaaaguagaggacugacacauaauguggaggacugauuuauaaaguagaggacugauuuauaauguggaggacugagaggcaguuggaucuggauggcuauuuuucaaagucaaggccacucagccagaugaauccagaggcauaucuagguucucuugauugacaggaaccugcagaccagcugugcucuugguccuguggccuuccaugggagaggguaugggaagggcuuuggugcaccacagaugucuuggccugucucuuccgaugacuucccuuugcuuauaacucacaccuguuuacuuggagacugugaauuagauuuuuaguuuugcagcaggaaaaucauuugaaauuauagacuaucccucuugaaaucucauuacauaaaaagauuuaacaagccucuugugaauaaguuagggugacaaggaaugaauuauuuggagaaguaaaaaaaccuuaaaaauuaaaaaaaguuuuuacaaguaauaagaacuuuacaaaauuauuguguguauuaauaucaaagggagauacugaugaggaccugaacaacaugggugauggguaaaaggucauugccacccugaguuuggaaauuugaggugcucguugcuacuuuggguucagaauaguuaugauuuaugauaaaccuaaaaauuaaaaguaccacaguuuucucucaaaucguauguggguggguuguguccagaaacaaauaggaaagcuuccacagauggaaugaaauaguggaacagauauggugguuuuguuuuggaaaggauuugucuccaaaguuuugggguggaggcauucuagucuuguuuuucuucugagauggaaacacuggcaaacuuggagucuucugcaaaacuguaucaagcaaaagugaaacaguaguugcugugugacaaguuaguauuuuguccaugacauguagcaaucaguagaaauagauaaaggaugggauauuggaaaauccccuggagaugagaaacggugggugacaucugaugagaggaggaggauucagggagcagaaugaagacauuggccaggcaagcaucucaguguggagguggggcugcuuagacauuuaaauugaccuaaaucaagcaguuauuaauaagugggcaaaacaccggaaaaauugcacuccauuccugugccugucagggcuguucuauuauuuggaaacagacuuuacuuacuuaccuuauugauugagacagggucucacucuguugcuuaggcuagagugcaguggcacgaucauggcucucuguagccucgaccuccuagguucaggugauccccccaccauagccuccugaauagcugggacuacaggugugcaccaucaugccuggccaauuuuuauuuuauuuuauuuuuugcguuuuuuuguagagacgaggucucgcucuguugucaggcugguuuugaacucuuuugcccaaaccaucugccuaucuuagcgucccgaagugcuggaauuaccguagugagcugccgcuccuggccuacuuuaaacaucuauaauuuguguucguuguaggauuauucacgguagaaacaggguggaaaaaaaugcccacagccuagcauuucaaggugcaguguuuuaguucuugugucugucauuacagaugugcuuuaccugcucccauucacaccuuagaacagagaggcuccuguguauaaagguauccguaaagccucaugcccugcauuucacaucuagcaauaucauaaguagagcaucuucaccaaauucugucuguaucaucuugaguacacagaugugucauaacuagccacacuucuuuggacauguaagucgcuucucaguuuucacuauucucagcaaugcagugaggauauuuucaugauaaccucauuaggcucuuugugauguuguccuggaucugucaaaaauuggucugucagaaauuuguuuuuaacaauaauagcuauauuguugcauuaacuccagaaaguuuuaccaauuuacccucuaaggagaauagaccuccuuccccaucccccccacauucaggacuuugcaucugagggggaaccuggccacgugguuggcauuccugagccaugccaggcugcuggagcgcacaaauucuuucaccccagcaagcccggcuccauccaccaucugugcacucaggcccccucccccucccccgcccccuccccucccacuggcgguuucauuuuuauuucuuaggcuuuauaaggauauugauuauggacuuuuggcugauuucagaucuagaauuacagagugagauggaaaaaugacagaaaugcagggaaaagucgaagcacagugugugggaguugcauauggcgagaugcucgagagauugucauuuuccuuaagucagugaaagauugucuucucaauaaaugauguuugcuccgcuuguuucauauaguagcuguaggagaccauaccucuccagccuucucuugugugcauuuguaugugggguuaauuuuuuguuuguuuugagaagacggaguuucgcucugucgcccaggcuggagugcaguggcgugaucuuggcucacugaaaccuccgccucccggguugcaagcaauucuccugccucagccucccuaguagcugggauuacagucaugugccaccaugcccggcuaaucuuguauuuuuaguacagaugggauuuuacuguguuggucagcuggucucaaacuccugaccucaggugaucagcucaccucggcuucccaaagugcugggauuacaugcaugagccacugcgcccagccagugggguuaauuuuugugaucauugucuggcuguugauuauuacuugauucuccugcugugugucuucucucuuucugagagccacaaaacaccacguccccuugccugagucucuagcuagcucuguggccccuaggccacaccucugcugccugguaacuuuccuugcugcguugugacagagccccuguggccaggcaaguguugccuuggcgcugguccuuucugugaauaugguggaaaguugaucucaguccuuccagggaacuagucuuacaguauaugcuggaggcuacuuugugcugaugguuguaauagccacaauuuaguggacagccacuguugccaaguaucuuauguacauuggugaccucuuauaauaauuuacaaaauccaugcugucauugccauuguaaggauuaaaguggcaaauagugaauccagguuugguguccaggggugccugaucuuagagccuguguguggggauugaacuggcaggaggugcagaucucucaagcagguggggugucugugggacaggggacagcugugcagucagcaucagacuccaguuaauacagaaugcuugacagcucacgcuccccacaucacaaaauccaggaccuggaagggagcagugagcacccacauugagguuauuucaugacuguauucaccugacccccacugaugaccucccaugugaggugcacacauuugucuacaugugaauccucagcucuggacuguugggaauuuuggaaguaguggcugggcagccgaggaaagaagugaagcugggugggcagaaaucgaggccccaggcccaucagccugagugguugggaggagagcuuggagcugggguuguacgagaauugggcugggcaaaggcaguguccaccuuguugggugaugaggaugggauucaacaacuaccuguccucuggagauugaaagguuaaaauaaggcuuguuggagccuuugccaucugaagcuucuguaugguuuuggggucaaaguagguuuggggaggcaaaaaugagcccccagacacuaagaagagaaggcacaggacaggccaccauccauccccugcugucccaaaacugacaagucucguaccucugacaguaaaacuccccguaggacuacaagacgugggucuuggagcugcaguuggccucaaaugcagguucacgaacugaccagagccagcugcugcagaggcugagcucauucgcagucuugguguaucugaacucaugauugaaagauuuugauguacagucgacuugccauaugccuaaugugauaucccguuagacugugcuuccgcuuuagauagguaguaguuacaagggcuuucacgggagcccuugugccuuagucccuguguccguuucccauugcagcuguacaagguuaccccagaugcaguggcuucaaacaacacacauuuauucuguuauaguucuggaggucagauccuaauaucaagguguuggcagggccgcguuccuucugcaggcucuagggaagaauuuguuuccuugcuuuuuccagcuucuagaggcugcccacacuccuuggcucauggccccuuccucugucuucaaaaccagcuguguagcaucuuccgaucucuucuuccauuccacuccauccugacguccccuucuccggcuccucugcuuucuuuuuucauuugauaaggacccuugugauuacguuggacccaucuggauaaucuugaaugauuucccugucuuaaaauccuugacuuaaucacagcgacagugccucuuuaucauguaaagucacaguugcagguucuggggauuaggacuugggcaucuuuggggaggguggugucugcccaccucaguguccuuccucuguguuucuccugagggcugacucuucccucacugugggagacccugcacaccugcugucauuggggcugagccagucaacaccgguugaggguagggggacacuggccaacccaaaggcucuuggcggucuccacagacuuccacuucaguuuagaaaguacagugagaaaaccaguagcugaauaaagauuuaggguauuuggcacagaucugcuaaugcacguguccgcaaaucuagacucagcacaaggagucuuaguuugggaucacaacugauucuccugguccagugauaccucugggcucuuguucauuggcuggagcucuccuuuuugcugggaggcagugcuucaucuugcaguucaugagaugacuggcacuuuugcagccggccucacacugcugguuaugugcauggaagaggucucaucucacuccuuccuauggcuuuucuagcugggcagacucugguuccuguauucucccccucaacuguaguguugaauguucacugcccauccuuucugcccugcucuguggcugccuguccucaucucugcaucggucuucucuuuucauguccuguagcucaugagugacccgcucccaugucaccugccauuuuggccuugaaauuugguaaugauucauacauguguccucgcuugugccauauccagugggacaagggaauugggacaccuuugguucucugguagcuuugccuuuuuuuuuuuuuuuuugagacagagucuugcuguggcacccaggcuggagugcaguggcgcgaucucggcucaaugcaaccuccgccucccggguucaagcaauucucccgucucagccucccagaguagcugggauuacaggugccugccaccacgcccagcuaauuuuuuuguauuuuuaguagagacggggguuucacuguguuggucaggcuggucucgaacuccugaccuucguugauccaugugccuuggccucccaaaaugcugggauuacagacgugaaccccugcacccggccuagcuuugcuuuuaaauugcaagcugggacuccagcccugugaaguggcuguccgcauuagaucggacaccuggcagacacuuguuuaaguuuuagaauuuuaaaaaggaaaauacaggagaaaaaguagaguugaucacaaaaaguagauuuugcaggaaauaguuuaacuuuuaaaaaaguuaucaauguguuauaugcaaauauggaaaacuauaaagaagaagaaaacaguugccuauaauucuucuagcuggagguaccugcuguuacucuuggggaugcuuuuuguuuuucuaccuuuguagcuuuuuaguuuuuuucuaagacaaagucucucucuugcccaggcugcagugcaacggugugaucucagcucacugcaaccucugccugcccagcucaagugauccucucaccuccaccucccaaauaccugggacugcaggcccacgccaucacaccuagcuaauuuuuguauuuuuguagagaugggguuucacccagaauggugucagacuuggguuuaagcgauccuccugccucgggcucccagaaugcuaggauuacaggugugagccacugcaccugcccuaccuuuguguuuuacgaggguuguauauguaucacauaugcagugguuuguccagcuuuucuccuacagugacauuuuucuuuguccucgccuuuucauaaacugucuuuuuaaauguuugcuugauauuuaaucauggauguauugagauggacucaucucaaacuauauuaaaaacacucuggaugcuuuaaauaaaaaauggcaaaaguuaauguuguaagagaagugaaaagaaaaccaagagcuccuaccugccucagcuuacccuuuguuuggugcgugggugcagugggcagugagccgugccauucccuccuggcagccggugcauggcuggccaugguccuuagcagugacugugaacagccgugggcuacuuuguuacccacccagugcugcuuuuguauguuggcaaauggggcuuucgcuuuccuugguuugauucugucauugaugcuucagacuagucaugcuuuuguuugaagggaaaaaaaaaucaaucaaucaauaucaguaacuugcuauagauuuuuauaaaggaaaaaaccccaccacauguaugguggggagugaguugauguggaaucagucaugaccgcguugaguuaggagcaucgcggauguggaguuacagcucugcuguggauguuuuuguuuuaagaaaacaucuuuuaaaaaucuaauaaugguucauuaaaaaccagaaauggucaagcucacuagaaaccgucaucagccacauucugaugaaagagguuuugacuuucuuuuuuaaaaaauuaaugaagauacauccaaauauuuguggcaggcaggaaaucaagcggauuuuaaugggaaauuauguaagaaagcuuaaugacuaauuuuucuggaucagacaaguggagaacggucuuagggaaauguguacauccauuacucauuaguuugcuguauuauaauuacuguuguauaggaagaagcaugucagauaauuaggaacuggguggcauuuuaugcuaaggaucaaaacaaagauuuugcuuggaauguugagcaaaauuauacucuggcugagauuaaacacauggcaagcauccuacuccaguauuuaaaaucaucaggcaggcuuuauucuauuuuuuugggucuuuguucuuucauguuuuccucuaaugaaaaggaaugcuuagaaaauagcacugggaggccagcaagaaaucaguguugggauuuucucaugugugaggagcuguuacugcuccugucgccugguuucaccccucgguucugcucccaggagcuggaccccuccccgcuggccccucugugcugcaagcauccauuuugggcuuggggauaauggucaagagaguugguugguuugggcugugggcuggacaagcgcuugcugcuuaaaccauguugauuguggcuuaacugcugaaccaaaccaauacuucauccaaagaacuucuccagggagggagugggcuucaggggagccacaugggaagcccccuaaccaacauuucuguagcacuugauuggagccuccaaacaccgucgcugucgaugcuacagcaguccugugggccgcagaaggaguacucacuguguguucuccaugcccuucugucucugagaagcagcguggcguguucggauugugcccuccugccgaccccgguggcucaggcaaagggcuugccagauggucgguguucuuugccaaaugggaccgauagcgugcgcaugguggggaugaggggaggacuagggaaguaaauacagugccugcugccacgucaccuucacacaguccauguuuaauaagaggucgcugcugugaugauagggggucggccagacauguccacuguuuaaaaagcagcauccaucugaggacucauuggauuaaauguacaccuaaaaaaaauacaguggcaccugcaugcagugcccgaggaugggugugcuguuuuacuagaucugguguuuuuuggaggugcacauuugguaguucauuguuggguugguauuugucuccauaaccuguuucagccucaaggucauuuaccuuugaucagugcuucaagcuuagcgguuuguuuauauacauguucauguauaaauuauauuacucagucugaucauaauauaugcccagugcaaaucauuucauuaaagccucagggauacacggugccaccguuuccucauucagggacacggggauagugguagugugucuucagcacgacauggggaaauucaaaggcagccauccguggaagagccaacggcagcccgugcaggcgucagcgccuggggaauaguagcagucuacaucuuuagcugucaggguaucucguuguagccucauccugcccucuuuagggguccuuggaugaguuaucaguuguaguauugacauuuucuguaaauagugucacucaagcgagugacagugggaagcagacaccagcccuuagggagcagcccaggaugcuuuuuuccuccaaaugccucucaccuauucccagauacucgcuggaguuggagcacacaugucugcagauguaaaacgaccugcucccccaggugaauggauucucgccagggccaauacuuauccgcaggggugugugccaggcagcccaggucagccucccuccaccgggccacccgcaccagguugccucccaucguuugcaggagcggaagacccgauggagcagguuucacagugcccucgcugcugccucccguuucaucugcacgucucuuucaaugcgggcgugcgaacuuccagguagagccgaguucaagaaaaugaaguacugcaugcgacgagcaaguuuauugaagagggugugaggucgcggcgccugacccucauuaugucaguuacuacuaaaugaaauuagaacuucacugcccuuuuucuuuuucccaucgaggugcaggaggaauugaucuuaggguaguauuuuggauuuaaaaaaaaaaaaaacaugaaaugaaauccguguccucuuuauccuccccucucucuguucugcgcggcagguagcaaggaacgguggcggggccaaagguuuccucaaagacccugggggccgggcggggcugugccaggcacccgcgucgcgcuccagcuccagcccuuuaaugcucuuugccauucaagccacucacuuucauuuucuauagaaaagccuuucugccgccuuucacaaaacuuguauuuucaugccuaauaagugagcgugugacaugcagugggcucagucucugcauagcccggcaggcagcggcucugcuuuccagaaccuucugggaguggcagacacacauuaggaguccacgcgcagguagccuggccuuugaagcucuccaggcucuggccacaguggcuuuccugcccuccuuggcugguggacguaaggccccucgccccaucugcuuccugcucucccagagccggccucaccuucgagacucaugcuacuaaguugucuuucaguuccccugguggugccuccucuagaccccugaggagauggagggggcugccuucuuugcggcuuucucacgauuuccucacaguacacacagcaggaccccgggguuuguguguggcauccuacacacacacacacacacacacacacacacacacacagcaggaccccgggguuuguguguggcauccuacacacacacacagcaggacccugggguuuguguguggcauccuacacacacacacacacacacacagcaggaccccgggguuuguguguggcauccuacacacacacacagcaggacccugggguuuguguguggcauccuacacacacacacacacacacacagcaggaccccgggguuuguguguggcauccuacacacacacacacacacacacacacacacagcaggacccugggguuuguuuguggcauccuacacacacacacacacacacacacacagagcaggacucugggguuuguguguggcauccuacacacauacacauacagcaggacccccggguuuguguguggcauccugcacacacacacauacacagcaggaccccuggguuugugugucgcauccuucacacacacacacacacacacacacacacacacacacacacacacacacaccccuugcuuauguccuccacccgucccugaaaacaugaggucugcgaagacgucuuugagucuguuuggcauccccaagugcagcggugaaccagagagagagggagcauucacuugauucuucacgcgucaguguuuuuaaucucuguggcuggaggacagugugugucaccuuuucuuaguuuccagggacugcggcuuccuuccaccucucccuucccucuguaguuggacaggccauggcuccccaguucucugcugugggcaggugcaggagccugaccaacuccuccgugaguccaucuaucugugcgugcauuuauucauuccucccuagugaggcaggucccugaugagcagcuccucugcgccugcccagguccagcguugggcaugcaguggugaacaaaacagacucaaacgcaucuucacagagcucauguuuugguggacaaguggaggauauaaacaauaagcacaauuuaguaaaacauacgguaccacagcuagcaaagguggcaaggaaaacaaugagagcggggguggugugaaugugugugggugcaggggcaccucgggagccuggccgggaagguggcauccgcugcaggcccagguggggagauggugggugcugcuuccaggcccaaggaagagaaaggcagaggcccugaggaagcacagagcuugagggagagggcuggcgucagcucagggaagcagggaggccaggcggggaggccaggugguguggggccucauggaggcuggggagucaugaggaugugggaggaugggggagcucugguugcucaggcaguggggagaggacagcaccaugguaacaugcacuuguguucaugucuuggcugccccauugcugggcacguguaaaauaggagaaaucuuaaagcuugcagcucuccaugugaaaaugaucuguuuguuucuucuuauuacuaucaauauuaauauugauccuguagugcuuucacacuuaaauuguugaguucccagucuugucuaauaauuaucucagcaauugcgauaccauuggcugagguucauggagguuuucaggcuaaugucacugaaugaucggaaggacucacugcuggcagucacuuguguguuuuguguuuuuuuuuccucugucucucgcccuccauuuuucugcacggcauuaagucagccacauuuuagauugugugcuucugucaucagaauaucuggcaugcuuuccccugaauagcaggcuugacaucuuuuucugauauuuuguaccaaccguacuaagaggcuucuuguuagcuguuaauucauauuuucugaggcugcuaauaugcgugguagagccauuacuguugcauguucaagauaaaagccaaaucucagcuuauacccuguucucccaggauaaauucagagaaccacuaugaagucuaauccauacugugauguugcugaaaagaaaauaggguuauaggcuuauuuggagccuuucacuguuuaugguuguacaaguuggguguuacugacuuauaauguaaaaucugaauuuccagggcagggacaagauucguuuuuggcuaaggcauauugugucuguggggcugcugaaggaaaaagagcaucuuauuuuuaugugauuagcauuauucaaucacaaaaugcauuggauucuacucagacugucggagaauaugcuugcuccucuccuaggcucuggaggaagaaccucagccacuaugugugugugugugugugugugugugugugugugcaugcuuguacgccugugcacagagggugggaagagggcuugcaccuaaguccuaggguccuguucucugcacaguucucugcauagguuuccgcacgccuugcugucuccuccuuguugcaggcauggagcaaauuaucaccuggugguaacuccagucuccgccacggagacugcuuacccucuuccucuuugguucaggcugaaccauccucacucaucuuguagagccucccguucccaucuccgcaucagaguuuccuacuuuccuugaacuuuccuuuuugaggagauuugagaaguguguuguccaagauaggauuuaguauccuggagccaggcuuggaauucuagugugggaaagcuuacuuacuauuacuuuauuauggcauuuuaaaaguuuuuaaaaguaaguggaaaaaggauuuuugaaccuguuauuacuuucuuauagcauuuuaaagccauuuuuuuuuccuagugggaggcagaaggaaaaacucggucauguuucacucacuccuuucuuaaagggagaguuuuauauuguaccuucuuguucacagccagguggcagcuacauugcuaauugcaagcuuucagggugagaaagagaacccgugccuaccugccuuuuccugauuugaaauggugaucugcguuggucucaagaccuugugcagccucgcagagauugcucugcacacaugugauugcaucuaaucaggacuuuuucugaaacugcugccaggaaaaugugugcuaggaagguuaccuucugcagcuggacuuuuaugaugcacuggauuaucauggccuuagauauaccaucagggcauggaguggcaacagugcuuugcugucuugacgcaucucagguagaggaucucuuagggagcuuucugauugaaucccacgcccauuuugagggaagggaaugggccaugggucucaucccugccuagcgcugccuugugaggggugcuggccugucaccuccaguucuugcuccuuuuuaggaagccaugcugccuccuuccuuguugugcgauuauuuuuuggguugugucuauuuugguauuuuuuucucuuucaccuccucucccauauuuccccucuagggugggaggaaggagacccaggugugagguggugcagguggcugcaguguccucagagauacugagcugugggguagagguagcuggaaucuagaucaacucaccucucuuuuaucagccauuuguucugagaagagaggcuucgaggagagacgcuucgguaagggguugcuguggguccuggggucacggguguuaguucugggugccacugggggacacgagagacagaaaggauaggaaugaaaaugaagagcaacuaagggaugugaagauuucucuugcacuuguuuucgggauaggaaaacaagcccuuuuagucuggggcaaggaagugucuagugccuccaccuggucauccaccgcgguccuccuggucuccguucaggcccacaggacucuggaccgccccaucccucccagggaacugucccauguccugcucaggaaggugguggggaagggguaggcaggauggacagauggacaguggcagguggggacaccuccaucucauuuuguuccucucaauccguuuguuuuuuucucucccucccucucuccucuuuuuuuuuuuuuuuuuuuugagacagagucuuacucuguugcccaggcuggagugcaguggugcagucucagcucacugcaaccucugccuccugaguucaggcaauucucgugccucagcuucccaaguagcugggauuacaggcacacgccaccaacgccuggcuaauuuuuguauuuuuagucaagacgggguuuugccauuguugaccaggcuggucucaaacuccugaucucaggugauccaacugccucggccucccaaaauguugggauuacaggcgugagccaucguacccaaccucaauccauuucuuuauccuaauugagagaauuugaaaagaaauuaauagaaucaaaaaagagaaaagggccugguuaucagagaugcaaaauaaaugaugauuuuaaagaugcuagaaagcugugcucccucccugggugcuuucucuuuggaggggaaugcuggagaaaaucucuacaaaaucuuccccuugcagugcugggagagaguaauggugagcaaauccuuguagaauuaaaaugggaugaagagacccuuaugaagggagaaagcaggugaagaugguggggauaggggcgggacgugcacccccuucacuuuccaugccgggcaguauaaaaagugagaagaaacacuucagggcugguguguaaacuucauguuggauaaauacgugacuucugguauuuugggggcauggaaucaaaaaguugcagauuuggagggauguuugcagccacuuuuuacccaacauggcucucuauguggucauucaguugcuuaaacaaagucuggguagacuuacaauuuuuuuuuaauacaaguaauauuugcuuauaguuuuaaaaaagggaguauaaccaucaaaaguaacucuagcgaaugauuuuggaauauuccagaaauuuucuauccuuauauaagcucuaaaacaguuaaacgcaguagcucuauuuaauaaucaccauugggcacguggacuuucaucaguacacauagauuugccucacacaaacaagaaugaacuugaauguacagauuaagggauaauaaaaaugccagccuggcugccaucuggcugaggagacguuuuacaagaaccuuugaagcaucuugugggccucuucuccauuuacuuugcuuccacucccaacccccuuccuaaaucuucuguccauuauuuccuuuuuccauucuuauucuuuuuuuuuuuuuuuuuuuuuuuuuuuuugagacgaagucucacucucucgcccaggcuggagugcaguggcgcgaucucggcucacugcaagcuccaccucccggguucacaccauucuccugccucagccuccugaguagcugggacuacaggcgcccgccaccgugcccggcuaauuuuuuguauuauuuuaguagagacaggguuucacuguguuagccaggauggucucgaucuccugaccucgugaucugcccgccuccgccucccaaagugcugagauuacaggcgugagccaccgugcccggccuccauucuuaauuuuaucacuuaacauauuuguaucuauaucugaaucucuaucucauuauguauauaaugucccuaaaguauauauugcucaauuuuaccuguuucuauaaacuuuauauagauguaauuuaccuguaugugguucugugacuugcuuuguuggcuaaacaugauuucugguaaugagucaugauaaugcacgucgcuauaguucauccauuuucacugcuguauaauauucuacuuaaugaauugcaugguaugaccuccauugguucuucuaacggcugcauuauuuauuuuuuucugcccacacuggauauuaucuugacauauuaaauggguaaggaccuaaguugugaaugaucagguuguuccaggauggaaguuguuauccuuugugcaaacaggguuauugcucucaaggcuagaacuguuugugugcuuuguauuuucacuuucauuuuuugcagcuggacuucagagcaagaccuaggaagcaaagugcaguucagacagugggucccgggggggggccaguugucagagagcccggaguuagguguuugaagccuagugagcagagacccauccugagcauaagggccagggccagggacuuggccuuggccuucagggagcccgcccuuguguggauaagcgggauugaauccucagaugaaaaggaagcaaucaauggagcuguuugcuccugcagcuucagacagcgccaucucuaccggaucaaaagagcucaucaacucccagccuccaucaccgaaaaagaaagucucaucucugucugauaauaccuauucauuguuaaaaaggaaaaaucccaaauccguacauccuccugacccaugugauacugauacauaccuuugauguguccauucagauuaaaaauucuuaacaaaaugauacauauuuuacauguacaaucauuucaaaauauagacuguucugagaauuguuugcaaauaugaucauaaaaaguugauuuucuuggagacuuuaaaaaacuaguuuguuguauuugcuuugucaaucucuauguaaguaauauauguguauuuuugugccaagccauuugagaugcccugcaggccccauggugcuucagccuccagcacugcucccuguguuucucagaccgaggccccuccuguaaaaggcucugaaucucgcuuucaccugugugaauugcaccacccaaggggagggguccaguugcauugggcuuuuguccuucguuuuccugaccuggggacggucuccuggaagccugacuuccuguuugcugaggguggacuuuucuuugggaccuguuugucgaguugagccgggagccacagucauucccucccuggguauugugcgacccugcucccgccuccucccccucccccccccccgcccccugccccucguuggguguuggguguuggguguuggguguuggguguugaguagcccagggcuucucuuuccuggcugggaugcaggcaguagucauaucaucacagucaucaacagccaaagugacucagugucgcccacagguucugagugggggcuugacugagccaggcagcaucagugagaaaugccuagucggaagguacccguuguucaggaugaaguuaguggcuucccugccauucgguuuccacuccaggagagaguugaaucagagccuggaauucuggcugaugggcuguguccccguguacggggagaacugcugguuucagucuuaaccaggggacgaaggacauggcagagcauccagagaagaagcuggggcucggccuggucuaccuggcugggaagaaccgugcuggauugagcucugcagcaagggcuguggcuggccggggguguuuccccggccucuccccagccuggagcuguggcgcaggugccugauuacagugcuugggagagcagugagggcaggugggggguugaccucacucuccaaggaucuguguuuccuggagcccuucuucccugcaggccuaggaggcugggcugaaaccaccucgggccugugcaucuguaggaacagcacgagagcuccuuggagugguagugucagggcgguagccaucugagcucacacuggcccuaggggcuguacuuugggguauccaggggcaacacgugcccucuaaaagcauagaccugucagggaaucacgggaugguuccaggguaauaucuggucaagggcuugcggcagauaggaagaguucucucucugccgccugugcccaggccacugcuguggccuagaucggguuggcucuggccgugccccauuccucaugugcuggcuauugagucacccccugcccccacuuuaaacaagcauguuugaaugcagagcgauucguggugacaguuucauaaggcuaacguugaauaugcucaaaugcuuaaaaggcauuucauuugugaauggcagcaugucuuuaugaggggugacagauugcucagauaugacuuucccugguuuucaggaggggucucuuccuguccagugguccagggcuggucaggcgguguggcaggaacggagccagcagacucccucuugguaaaauugugcaagaaacgcaccaccuagguuugugccuccugccguugcuuacgagguucugagucccgcagggacuggcuuucuuccucuguaggaguuuccuaccauguaaguuuuagaaggaaaggauacucuuuggggccucagcgguccccuuaggcugagcaucugaaccuucccgugguccguguggcuggaaggaggcuuccaucgcuggaaauccauuucucaaggcgaggagccagccgggccgaccacggagccccuuccucuauuaugcacgaagucauccaggugucaucccaucagugguccaccaaggugggacagugcagcuugggccgggcagagguggggaggccugcuggguaccccugcuggauuguagauggcccccaaaaccaaugcugccucucacaggaagcccuucgccugaggcucucccacacugcaacugucaaacucgaauuuccaguugauguaaaaucugucuuccuacuggaauguugacuugaggggaccuuucaucucagauuucagacuugcuuuguuucuguugggucacguugcugucuucucaauacucgaguauucuuggugugguggggaaguuuuugaguuaaauuugaauaguuuuaaaauuuagguuugaguuuagcaguauucuaacgggguaaggcgucacuugacauacugauaaaucuuuuacauucuauauaguggaauuagacaauuuucugaaccuuccgucccaaccuuccaucccuuacccugguucuugcuacuuuguuguuuagaucauggucuguuagcggaaauaugacuccaugugguccaugauaugggcaccuuacaaguuauucuaaauaauggcacuuagguucaaagggcuuguuaauaauagugccauugaggaaaaucauuugggccaucacccccuucucauguugaaaauagcguuaaguguucaagagugugaucggugaaacacagcuuaauucagcucuacaggugugaguauuuagcccuggaaaggaaggaaugauuauugcaggguuagaagguucaggagaacagugccucccuccuagucacaguucugcagggcuggcgugugagcccuuacuuagagguuuacuuauaggaaguuugagacugagccagaaccuuucugggucucuugcaccugcgggggaaguaguagcagcugggguuuucugcuuuagcacauuguuaguuuuacuccgacuccguugcuguuucccagagucauuugcucuuucugaagacacuggcccgugggcgucacugcccuuaguggaguuccuuccuggaggcucucccugcagauucugccucuggaaaucaacacguauugccccugugcucccccggauuacuuggcuggaguccucuuucccuccugucaccugcaguggcauucuucuuccagccugugggauguugcuuuaugcuggacagagcuggauucugucuuggcucugcuggugcugaaaguuccccaggcccaggaccaccauccacacaccuccgauaucuggugaagcaccaggcaucguaggcauugcugaguauuugggugacugacuucugagcaugaaggcagggaggguccccucugucuggaugguaccccacccuucgccccuaggcaccuuggccagacccuccucauucuucaagauucagcagcccuugccuucugugaggagugaguuagguuucaucugugcccagcugugcugugugcuuugcaaaugaacuggaacagucugucugugaaggggaugucagaaauucaaggaugggggacagcugucaucaaagcaggccacaccaaucugggcuguucugcuagaauucaguugauuucuuauuuugugugacuguuguucauccgagcccaagguagagcugcaggaaccccaugucugaguguccagcaggcccgcaggcccucgggugccaccugauggggccauccugccuuuucagguccuugauuauaucccacaaagagaaauagauggcuuaaaagucuuuuucagaggcagaagggacaagaaaaguggaaguguagucuggaaguagccagguuuuaaguuaaccagguuacacucuuggugguuccuggcguccuaucaagagaaggaauuauggccccagagcugugccugggacccgcaugucugucacagaucucugcugggaagccaggcuguggcccuuccaaggugaauggugguuuccauccaggguucagguuucuuagcagcuaguggugacggucagggugugaguguggggacguggcuggcguggugacgggugugugggggcaucauugggagugauggcgauggcuugucuucucaccggccgguuuggaguccagaaccacaugaaugaccucagggugggucagaacaaggagcugucagucugagaccucucagugugcucuuucuuggcuagcaaguuacuuuaccuugguagucauuaguuucuucuuugacuaaaugaaaagguuuuuaucuagaugcugcugugcaucuugaagcauguuaaaagaagguuaaggaaaaccaguuuguggaagcugacugagcaggcggcucacuggccguauucagcucuccacccguagggaccugcuguggcagccauaaaacugugcagaggugaaccacuucagcagaaagaugcuuccccacagagaucugggagccuuugacuguugaacagggaaaaauuccccaugcuuuuaggaucgugguguaagaccccacuguggagagaugcuuucuaugcugcaacacagaccagggaggugacgggcaguggcuuugggacaccaucaacuccaaggagauggccuagcugcuugaggcccacguccagaguuacacacuuuauucuucugauucuugaaggcuuuaagaaaucucuuuagcaagucucuacuucuuuuuaaauuuuacucuuuccuccuaucaccugaauaaaacuccaggcaguaauaugcugcuuacauugacuuuuuuuuuuuuuuuuuucugagauggagucucgcucugucacccagacuggagugcaguggugcgaucucggcucacugcaaccucugccucccggguucaagcgauucuccugccuuagccuccagaguagcugggauuacagacaugcaccaccacgccuggcuaauuuuuguauuuuuaguaaagaugggguuucaccauauuggccagauuggucucaaacuccugaccucuggugaucugccugccucggccucccaaaauacugggauuacaggcacauaccaccacgcucaacuaauuuuuguauuuuaguagagacgggguuuugccauguuggccaggcuggucucgaacuccugaccucaaauggucugcccuccucagccucccacagugcugggauuacaggcgugagccaccaugcccggccaugaguccuuucuacugugggguuggucuuauuuccccuugcucccgugagaagcugaauuugcaaaugccagggugaacuugguaauggaggcaacaggcagaugcuuggugucugugcguugaacagaaaagagcccggugaaauuccacgccuguuuguguuuagcacacgguuccugaauuauuucaugagaaugcagguauagcggugacagcuacaauauuuguuagccaagcugcggacagaggguuggccucaggcugcuguuucugccccagggucgugagaaauagcuguguccauuuuaaagcaagaaaacaaauggcacgauugcucugcuguuccuguccuagggcagagagcuaagucaagcacucaguggacugcgucucgucucccuuggacugguagugacagggcugcccugcacgccacacugcucuccuguuccuguagugucgcucauguaaaaugcacugcaggcuggugcugcugaaucggcucacuuucucccauuuccuucuccuccacuuucagauuucuuucagcacucuccaacuuaccuucagaaaugcaacaaugggccaggcgcaguggcucacaccuguaaucccagcacucugggagguggguggaucaccugaggucaggaguucgaggccagccuggccaacauggugaaaccccgucucuacuaaaaauacagaauuagccaggcgugguggcaugcaccuguaauccuagcuccucgggaggcugaggcaggagaaucacuugaacccaggagguggagguugcagugagccaagauugcgccauugcacuccagccugggcaaaaagugcgaaacuccgucuucaaaaaaaaaaaaaaaaugccacgauguaugaagaccugcagccccuuaucuggaauucaaaaaccccaaagcacugauuuuugcagcccacucauuuggcagcagaaccugaguuaucugcucaugugagagugcaccuuucauuacaaaaguacccaugcguuugacuaggggugcucugggacguggguuagccaacucaggccacugccccguuuuugaacauaaaggguuauuggaacacagccauagccuuucgcuuauauugccuuuggcuguguuuguaccugguccuuacagaaaaagcaucuguaccccugcucuggagcggaccugcccugcuuugcuugcaaggugguccgagccuggguggaaagcacugcagggcagcuugugcagaaacugggaccugcucuccuuguagagacacaaccccaggguacuuggagcucaugcuaaugacuaaaucauucaagccuucuucuuccuggauuuuauaccuccuaguucuuugaggacaguuugccacguucagcaggauuuuccagaccuuuuauuucuaaggaauacaaacuagaagggccugguuucuguaggugacaaagcuggggggaacguggaggacagggaugacuggagagagcuggcgagugcagccugcugggaugccagcucucaccugggaaggucagcgugcaggguugcagacugcuuaagccuccuccugucagaggaccccagagagcucccccagcuacuuggagagaugcuguugagguugggaggcaaugcaggguguucaucagccagcaugagacccucgcuuccagccugugccuuuagcccagccuugcuguucuagaugguguuggcagccuuuuucacguacagaguugcauugcuccuccgucuuccgcgugccugugggcagcuuuuguuccuuuggauuacuuuuguuucuuuaaaacuccuuggcaccaucuaauuuuuuaaaaaugagccuaauacuguucacguuuuagcaccuggcaaauguauugauacuuuacgagcauucacaugcauuuaagagugcucuuagcaguucgcguucuauauagaacuguuuacaccucucaggauucuuacucuaacaaacagguauagacaacauccuaguugcaucucaccgcggccuaacauccccgggagcauggggauuaguggagugagugggaggacucgcccugcgcagguggagggugaugagaggcuggggacguuuucggaugaccacaggugugaagcugucuucaguggugggggaaccaccugggccuugggccuuggcucugguagucucacauaacucuuuggugucugcagcuguauaauaugauggauguccuuguauuguacauuuuuaggaaggacggguaggguugcugcuucagagaucaaguggcauguccacaucuggaguagacccugaguggggcagaaccaucauccugcgugcagccugcacacucccagcacccguggcagucuuagcagguggauuaucaccgagcacacaggcagcccgaggcaccuccucgucacaguguucuccgcagcccugacuggcgaggagggcacguccccacguucaugcccuguacuaggguccccucuggcacucuuucucuggggcucuguguucccuuugccuuuugagcucuucauaaaaucacugccagugacuucucauagcuguucgucauugggagucacugagcaugcacacgggcugucagguccuggucccagcucugccuuccucuccucaaaugccauucacagcagugucagugccugcccagagugugcuagaaugccaguucuugggccccaccccacaccugcgacuccagacucagaguugaugagggucugcaggcgucggucugggagccacagacagguguguuugccgcagaggugccgagggcccagcaggacuguagcacaggaucagcaccauccacaccugaggcguggggaucuccgggcaugaugcggaauguagugacgaucgcaaauccuuccuguggccaaagagugagcucuuugaugcugaugagauaguguuuauuuauuuuuaucuuauuuuuuuugagauagagucucacucuguugcccaggcuggagugcaguggcacugucucggcucacuacaaccuccaccuccuggguccaagcaauucuccugccucagccuccugaguagcugggacuacaggcgugcaccaccacacccagcuaauuuuuguauuuuaguagaaaugggguuucaccauguugggcaggcuggucucgaacuccuggccucaagugauccacccaccucggccucugaaagugcugggauuacaggcgugagccaccgcgcucggccauagauaguguuucuuaagagugaguuugcuucugaggaagagaaguggggggucgggggcaucccaccucccuggccaccuccaguggugugaguugguugcuugaugucaucugagguggggccacccgggaaaggucuucaugucucacuuguaugccuucuuggaucaggauuuccaggccucugcaucucuugaguugauucugaaagggugaggagagaggggcuagacagauuuuuuuuuuugagacaaggucucacucugucacucagguuggagugcaguggcuugaucauagcucacugcagccucaaccuccccaggcucaggucguccucccagcucagccucccaaguagcugggacuacaggugcgcagcaccacaccuggcugauuuuuuuuguagagacgggucguccagugauacucagauuggucucuaacuccugggcucaagggauacaccuaccucagccucccaaagugcugggauuauaggcaucaacuaccauugccagccugagcugcaugcauucuaaggacacuuugugagacuaauuaaaacguuuuucuuuccaaggcacguggcaggugggugcuguuucuuuccugcaggauguuugcugagcauuugugaguggagcaucuuuagggaaagcaggacaaacccuaaaagacuuucucugaauguuaccuuugcucuucaccuugacugguagauccugaaggcguagaaagaggguccucuggagaacacaaacugagcguugcugggccucaggagcuucuagugaugcuggaggcggccacugcugucuuucagcugugaggagccaggagggcgaucccagcuuucuccugguuaauuuuaccgucuuuuaaaaaggaaguucacaagauuucuugaaagaacucuaguuggaguuguagagcuaauguuuuuuucucuggucccugccaccugcuggaaggagccugcagggaacuguuuguugugugcuuggcuguucagugccccauaacuggccgcgguacugccacccgcuggaaggggccugcagggaaguguuuguugugugcuugguguucauugccccguaacucuggccgcgguagucuggacagggcuucugagaaccaccugcaguucugcuuauugcugguguugagaaauacaguuucugcaggaaagagagagacauuggugccaagaaauccuaucggggacauuuaauaacuggaaguagcuuaggaagccagguuuggagugcugccuuggugucguuauaaugcaagugggauuucauuauguguuuaaggcuuggcauuguuggaggucaggaagaccaacuaagucaaguagagccauuggcugcuugagugcagugcagagcacugggaaauggacuuccugggaagugugggauuuuuucugcuacuccuucauucacaccuggauucaguugcccucaugagcucacccgcaauguguguagggggaugcugcucccauuggccaggcacuggggaugcggcguaugggcaggugcacacacaccuggcagagguuuggagcuggguugugggugagggaugcagagaggcuuaacccagagaauggaggaaaaggagaccaggagaguucagagaggugaagagugaggagagagcaguggccaaaguggagagaguugaguuucagaaagccagcugcagaaugcagugccugacagagugugaugggccccaucucucucugcugagccggguucugacucugcagagcauuggaggccuuguugugggcucaaggagugcagagaggcagcgccugccuuggucguaacuucucacacacauacauccacacaugugcaucugauugugugugugacacagugaaggguauggggacagccacaucuggguuucaguuuucagucagcucccuagcugggugguuccucugagccucugcuuuauuucaucugcaaguagcauuaauacuauaacugaauauacagucagcuacucaccacucgaaagccagacuugagagacaaggguuggugggagaaacagcagguauauuugaaaaccaagaagauggugaacuaacauucucaaguacugucuuaagucaguacagauuuuaggcuuuuuauauuaagggcugggggaagaggaggggguugagaucaagagaugaccaacgacuggacaucugggaggcagugggggucagaggaaguuggguuuuuuuuugucuuggucaggucacgauguuccugugaauuuuuaauaaaacauaguuguuuacauacuucuccuuuaaucccacagcuaguuuuaaaaacuacaugauuguguugcuaggauuaguuaagaacugauuugaggucacuagcacauggugaguaguuaguaaacaauugcuucugcuagaaucaucauugucaauauuaagaaggcgaguccacgcaucucucuggccuguuggcucacauuuggggguguggcauuugugcgugaaguggagccuggucccuggugacccagguacaguuuacgucuggagccagcauuuggaaaguugccuccagggcccuggauuuggagggagccaacugccagagucucaagcaggugaggguggggugcaggagaggagcguucagggcaccucugagcacaugugacauucguaaguggcacuccucaugcugagcaacugacgucguauuuccacccgacaauggcuugauucacuugauaagugaaaggaacuuccacguaaggaucccgaagcacgguugccuccgccucccaccccaccccguggugcggcgugugccaagaccagcccucugaggucagcccuccuggaccccuuacuggguggacaaagguuuucugugugacucaccucuggccagaaauuuagggaagcuuauuuguaacuaauaccacccagucacugcaggagaccugccgaagggcucuggggaaagugaucuucaaaaauagaaagguugagugaagguaggacuuuugggagaagcagaaggagccuauaagacagcacauuaauuuggcagguaauuaggaacucugaucuugagcaucucauuuuaauuagcgugguccagccugccuuacggugcucacgcugaagcagagaguggccugcuuagcugcuccgcaccauuuauuuggguuucuuauuugggaaguuugcaugugacugggccaagugacauuuguuuugaggucccucccagggcccaggggugagcucuugacaaccccagaguagagauggggcaccugugcccgggcauugauuuccugggaaggaaagaaaacgccaggccaugcugcuguguuacagcccuuuaaucagaagccccugcugcaugugggccugcuguucccagugccuuucaggaaaccaccagaagggcuccagcuuuagggaggaugguccauuuacacgccugugguuggagguuccaagugccuugaaaaaugccuugaugccacuuggagcuguuucuuucuucucuuuccuuucccuuuuaaaaucacggaaccauuucuuucuuucuuucuuuuuuuagacagaguuucgcucuuguugcccaggcuggagugcaguggcgcagucuuggcucacugccucccagguucaagcaguucuccugccucagccucccguguagcugggauuacaggcgccugccaccaugccugacuaauuuuuguguuuuuaguggagacaagguuucaccauguuggccagguuggucucaaacuccugaccuuaggugauucgccugccuuggccucccaaauugccaggauuacaggugugagccacggugccuggccagaauuguuucuugaguuuuucaaacaaugcuuucucuccagccaguucaauuguagaggguccuggagaggagguggagcaguugccuucucagcaucgugggguggggcugggaugaggagagcgcggccgccagggucagccuggaugcuccuaggcagaggcacagggguugcugauucuucuuuccagauggauguuucuaaagucuuucuuaaaggagccagaggcuugcccgcccugcagugccauccuucuugccgcucccacccacuucugugaugcacagaaccugccgcccugcccugucucuuuguguucguuggucuccauuucuagugucugaguaaaggcaguccccaguccagucugcaaagccuggccacuugcacaggaagaugcucauagauggcugguuccugccagugacacacguggaccucaagcagguggauggguggagcucagggaauaggcauguggggcacacucuccaggcacauccagggcuggacuggggccggcaugggggucacuggcugcaagcgaaggcagcuuaugucauguucccucugccaccgccagcuguccugcagcaggaagagguagucauguuuggaggccgggcugugcaugagcuaugcaggccuuggggucuuuucaucagauuccuuuuggcagaauauaaggaaguuggcccaaaccacauuuuugaacuucugcuuuggccuugucagucuccuucugugauucagaccguagugaagcccugguuggcugaagugcucaggagaggagacuuugggggucaucacucauuucugaguuacagaaguuaaauagugacuugguucggggucaugccaugugugugaggccugaguuugcagguuugugcagggcauugauugguugguugguugauuggcugaggaauauuuggggcaccugcucugggccauguacacaaugaggcaaagcaauacuuagaccucaaaaacaaagcgauguagaccuaucugcuguguccuuguguuucugccuguggggcacgugggacaugugagggagaaacagcauccugcaggagagcaaugccuccagcuuggcuucuggaagccuccagaaggauggacgggggcacugagaccugaagaaggguugugcaugugggagggagccagccugguggaccguggccugcacaccugcagcagcuccucagagcugcccccucaugccuuggccaaucacagagcacccuuucuguccaggccacugaucagcccccagguccagguccaagaacaagccugugacccccuggguccccuuuguccuuggccuauaccugccuucugcauucuggggcuacccuuugcuccaguggcuacagaagagagaggagggacacugaccccaaggcccaggccagucucguccaggcugcccacaccuaggucuucaggaugggacaaggcagucuugggggacuuuggggugacacaaaccagagaagggcuucagcagagggccaugagugccuaaccguuuaccuguuuucugcucugaccaggcaccuugggggagggaaggcaucaggagccuucugcugaguucaguggaagguggucuuccuuuccaauacucugguucccucucuccccuaugugcaaguaaauaacaugcuacuauauguaaauuaacacaaaugaauguaagauaguuauaugugucuacugccuuagaaaguacaguaagaugaauauuaaacuuuucagacuguaagaucgugaaucugaaagucguugcuuauuguauauuugagaaguggcacuuauuuacccuggagugaauguguuacuggaagugucuuggcuaaauuccugaccuaagcuuguguggucuuuugcucuucauuggcaauguagaagucaaguuugaacugagggcugucuuauuuuaaauccagguuugaucauuuucugaggauauagcguuuagugcacaccucuuuugugcaacucagggcuuucuggagguuggggggcggaucccgaaggcagacuuggccuucccagcuggcgcgggacuggggacuuaggggacuggguccuggggugagcucuggagcccgugggucugguugucuugcugaccuggucugccuccugcuugcuuccauagcagagccugugggacgugaaccaccauucaugauccugggaggugaagcccugggaacugccacuuggaaugagaggggaaggcuggaacugagcugggcuggccauggggaugcucagagcccggcucuuucaugggaucacaguuuguucaccuuggaagcuguugcucaccgcguguugauuuuauuuaagacuggaaaggcuuguccauguaucgccguugggaagggaaaucacuccgaagacggugaugcuggguacaggcucuggagucaucuugauuugguaaaaggcaugaagucugaguucauuccgaagauucuggcuuuugagaacuuauauaaagagaacuuauaaaaaauggaaaaugagaaacgaugaugucagugaacauuuauuggccuuuuuuucugugccaauaacucucagugcuuaaccugaagaagcccacuuaauccuuccagcauccuguccuagaacuuucccugcugucuggauaaggaaacugaggcacagagggucgaggaacuugcugugguacacccagacagccugaccccagagugggcacuucaggucccgcuccauggccgugugcaccuucaugguacgugcugggguugugccuuaugaaaacaacggacuuggcuacauuucgacaaggggaaguuagacacuuuagauucacaguuaacuguugaugcuuaaaugacauuugaggaaccuauuggugcuuucuugagcccugcgccaugugagugagguuuugugguccuggacaggugagcuccccuccagaggcugccuguuuguaaaauaauagguuuagaugaacaaaguggucuuuagaggcagauacaccuggggcagaguccaucugugagugggaagaguaccaggcacgggcuguggagaagcgggauggcgaguaggaggcuggcggccuucccuguguggaaggggccuuucugugugccuggccccgcaggguaugcaguacacacgcacauuuauggggauuacucgguuccgcaugggcuguguguagaggugggugggaugcucaguggagauggaccaggcucuccuccuugaguacugucaccucuuccuuuucuauucugucaccuccuucucaucaccucuguugucugucccugacaggcuucugugcuuuggagaccucugugugucuuucuugguuuugguuucccugucucccagcaucucugggagauauguguaugauugauuccaagaauaaagugugaccaggaaaaccauguuuugaaaucugaccucucaagcccuugaaaauacucagagcuuuuccagaauguucucaugucuccauccacuuccuuucccuuucugcuuuaaccccgcuacccuccagucguagccuucaggagaaauaaaaagaccccagagaggccagccuacuuucccccacacugaguuccaggaagcugagucugguuuucccauaggaacaauguuaugggauggggacugcauuccucacaaaggacucugccucgaaaugugcgauuagaaagaugcacccgcuuucagccgcagcaacuuacaauaaugccguuaugcccucagccauaaacacauugugcaaauugauuucuugaggagccccaagguacuguggguagaaggagagcacauacacaugugagugcugugaaaucauuaccauagccucagacaugucuguucuuaauaaggaaaaaaaaaguucauuacacgucauugaagauuuuuuuuuuuagauagggucucgcuguguguccuaggccggaguacgguggugugaucucugcucacugcagccuucgccucccaggcucaagaaauucucccaccucagccuccuagguagcugagacuacaggcaugcgccacuacacccgacuaauauuuuguauucguguguguguagguggggucuugccauguugcccaggcuggucuugaacuccugggcuuaagugauccucgcaccucagcuucccaaagugcugggauuauaggccugagcugccaccacaguuggcuugaagauuuuuuagaaacuugccagcuuagucuuuauaaaaauacgaugaaggggugauuugggugucccaagacuguuuggaagguuguucugacaagcaagugcugauguuuuguacuugaucggcuucucuguggcaagccagaggcgucugugaugagcgccugcagacgcuggugggugcuugccgugugccagugauugauugacguuagugucgguaucucucauugcgaacauucuucucuaagguugaaaaucaguuuuucauuauguaaauaauguguacucaguguagaaaaaauuagcacaggaaauagaaagcuaaaggauaucccucaugaucccucauccagauccccagacgugaccacuguuaugugguuauauguuacguuauagccucccagaaauuuucuauaccccugaaauuuaacauuuugguggguaugaugugguaucucaacugugguuuugauuugcauuucccuggugacuaaugguguugaccuuuuuuuuuuuaaauaugcuuaucuuaaagcauauuuauauauuuguauaucuuaggagaaauaccuauucaaaucuuuugacuguuuuuaaauugagucuuuuuauuguugagugguuggaguuauuuauggauucuggauacuagacacuuauuagauauaugauuugcaaauauauucuuuuuuucugugguuuguccauuaauguucuugauauucuuugagguacuaaagcuuuuaauuuuaaugaaaucuaauuuaccuguuuuuucuuugauuauuuggacuuuggugucauauuuaagaaaucgcugccuaauccaaggucaugaggauauacuccuuguguuuucuucuaagaguuuucugaugguuucuuuuacguuuaggucuuugauuuugaguuacuuuuuguauaugguguaagaugggguaauugucaauuuuuuaaaaggaaaaugaaauucuauuaauauuguuguacaaguugguuuuccccuccacggcauguuuggcugucuucauaucagcaugcuuagaucauuugauugauuuucucuucuuucuuucucucuuucugcuuccuuucccuucccgucuccaucccucccuccucaccuccccaugccucccuccaucccuuccccuacugugguagacagaaaaauggccccgagaugccuguccccuaauccccagaacuugcgaugauguuaccucacauggcaaaagggacuuuacggaugugauuaagaacuuugagauggaugaucuugugggcucaagguaauuaugagaguacuuaaaaguagaagagggaagugaaagaggagagucggggacuguggaaggagggcgagagaguugcagcacuguuggcuuugaugauggagggaggcuaccagccaaagaauguggauggcaucuaaaauuucggaaaagaugaggaaacuuggagccuccugaagggcauacagcccugcugacaccuaagccuggugagacccacauuggacuugugacccucagaacugucagacagugaaaucacgucguucuaaaccagucagcugaguggucacggcggcaguagaugagugcaccuccccuuuccaaccuucuaaaccucagguguugccuucuccacuaggccaagcgaugcuccaggaaaccucaggucacagccagaugcuccacccuccaucaguuucucauguguccuugaaaagucauaaaaaauguugaccagaaugucagcacagacaguagaggugggaguguuucuuuggagugggugccgcugccugguuguuugggccaugcacagaaggcuuguggcaggagccuaggguguccauuuagccuucucuguuguguuggcuuccauagggucacugccuccucgccugugcucucuaugugaacacagaguuucugcuucacugugggaugaggaggcuucagugaauuguccacagaccuagucgcuguuuccaauguuauuuccuuagggaagaguaucuccaauuuuaaacugcccacaaacaaaugacguuuaggaaaccuuguaggucaggagcugcuggggucugcggguaagaacaggagggcuuccuaagcucuuccacugauuuagggggcgagguugggagggguuuccugacaugguagaauuuuucuuuauuccuacucguugguucagguguguaauuauuaacaguuacacccuuuaucuccugcuuccucuggcugcugacuuggagggaugcugggagaaggggagggcugaagaguuggggaugggugugccuggcuuccuucuaagguuuagggcugacccuggacagucccagccccaggcaaguguucuugaggcuuauugcugucugccuagcuggggaggauguugagaggauuacuuagcuaauucaguauuuggaaaaaguaucuguaaacuuaaauagaggcccauuacauaccuuuuguggauuagaacuguaauugacuuaguguuuaaggcagaaacuaaggccuuugauuuaaaaacuguugacagaucggagccuaagccgcuucuguuugcagaggagagccaugacuuccagucaaguugaaacauagcuuucuuuauacccuucccaguuggacuucugucauauuuuacaaaauucaaggcuuuucauuuaacuuagauuuauggcuuuuccauggacuaucuugagguuuuucuccaaagcaaaccagcucauaccuugacauugucaaaauagcaaaaacacacaucuuaacaaaugauggcaaaauauuugagcugagagauugggguauguguaguguuacaccuuugcauguaaaagauuaugucaagcaaucuucuaaaggaaaucaguuuuuaguuaacuuuuaaggcuauucaccaugauuuaaagugauuccuugauuccucuguuacauuaagugugauugaaacuguaccuuuauuuucucaugccuugauaagcaguguagucaaaucauaacauauuaugacugcaaucaagugauuauagcacgugauuauacuuuuugucucuguggcgugaggaguggaaaggugucuuuuuuugcaccacuuggcacuaacgguggggagagaugguuccccgaagcccccucccucuuguguguuuuggggcagagcgcccuguuccugaauagcacggauugcacguguuucugagcauggugugugagacugcuuucccuuccugcagucaacucgccaaggugccuccccagccccagcaguccggcuucucuccuuuccgcugccccaugcuuucugguggccuggcagacucaggacuaucucugaguccuucacaaaacccuccuccacaugccuucuuuugugaaaacccucaguccucuuuaagagcagggccccuggagccagacagcucugguucaguccuggcuccgguccucugcagcugggugacccugggcaagucaccauggcucuguguuuuucaucuuuaaaauggggaugcuggcuggugucgcggcucaugccuguaaucucagaauuuugggagacugaggugggaggauugauugagcccaggagguuaagaccagccuggacaacauggggagauccccaucucuuuuaaaaaauacaaaaaaauuagcccggccgguggugugcgccuguagucccagcuacuccggaggcugaggcaggagaauccuuugagcccaggaagucaagguugcagugagccgcugcacaccagccuggggcaacagaacaagacccuaucucaaaaaauaauuaaaauaaaauaaaauaaguacagucgcuuugcccuggggcugcuguggggagucugcaaacaggaccugccuugugcugaaugcagcaucucuguuguacuugggaggugugcagccccagcaucucaugccucgcacccuccgagcugccuggccuuggcugugccccccugcccuggcccacucggcguccccagcacuucauuucuuuccguccugccccccuuugcugugucugguccuuuuaucacugcucuugugucugccucugugcccuccuguccuggccacggcuugagaucacacugccgugccucuugcccaggugacccccugagaagcuaccugagcucugcuaaucagccccacuuuccucugcccaggcagaaacuaagaugccucggcuccuucuguggaggaaaguaauguguuaauuggauccaggguccucagcacacacugggcuauuuuuacagucagacaggaaguugucguuuuauaacuuuauccuguguaaauuauagcccgggcgggggguggggggacuuggauuguuaagaaagugaucauccuguucuuggauagggugauuuuggcugucuggguaaguucuaggaauuugcuguauucucuugauucuaaugaacuuugcuauggcuugggaaggggccucugcauggagagagagaaggaagcuagcguuucuugagggucugguauaugcuaggcacugugcuggcugcugaauuggacuguuugauuuaauccuugucacaaccccuuugaaguggucuuguuacccucuuuuacaaauggggacauuguggcuccagcagguuaagaagcuugcuccagguuacauggcuaucagugggaagcugggugggggguguggacaggucugugauucccagacccauccucagaugccuccuggagccucuuugugggagagugcaugugucauggcgaguauguggcucugcgauuggaggaaaugucaccggaccagucaauaggucuuccucuuuacaauuagcuuuugucaauguacguuuuuucuuuaguccacacaaccuuuuaaaauuuauuuaugaucguagcccuggccuuuauccaucgaauccuaaagugaucuggcugcucaugaccaggggugacagccaggaugcuuuucuuggaccaagaaaccuggcuuaaaugacagccuugagccuugcuuuggagcagucagacucucuggggauacuguuacuauuagugagcauuauuugcugcagaaauugauuccuucugccguacaguaggccagggaggccuccaggugccuucggugggggaaggauuuuaguugcucaggccaaauaaccgagacuagcucccugcaaauuccauggagccaucuauacuucugaguauaucuucaagugcuacuccuaaauuuaagguucuuccacuuuucauccaguucacauguaguugagggccugccugccuugagccugacacagggccaguugugagccuggaccagcacccacagccaggugugagccuggaccaccacccagggccaggugugagccuggaccaccacccagggccaggugugagccuggaccaccacccagggucaggugugagccuggaccaccacccagggccaggugugagccuggaccagcacccagggccaggugugagccuggaccagcacccacggccaggugugagccuggaccagcacccacggccaggugugagccuggaccagcacccacggccaggugugagccuggaccaccacccagggccaggugugagccuggaccagcacccagagccaagguaugagccugaaccaccacucacggccagcugugggucuagaccaccacccauggccaggugugagccaggaucauccucccagggccagguguaagccagggucauccucacagggucaugugugagccuggaccaccacccagggccaggugugagccuggaccaccacccacggucagcugugaauuugaaccaccacccauggccaggugugagccuggaccagcacucacagccaggugugagccuggaccaccacccacggccaggugugagccaggagcauccucccagggccaggugugagccaggagcauccucccagggccaggugugagccaggagcaucuucgcagggccagguaugagccaggagcagccuggcauuggccccaugccacaugacacucuuugucccuugucagcauuuuaaaccaaggugaagaggucccacuuagcuuugugguaucuguuuuauaggaaugaaggggguacuuuaacaaguucaucuuaggguucucaucugcauuguugccugugcaguuacaccacucaugccuacccagcauaauuaacagugugaccuacgaaagguggggcggggcucacaggaacuaaccagggauuccugugugugaauguuauuaugaaggugcuuuaccucauuaguuauuugugaugaaaauacucuuaaaagaccugcuauaaagugucaauaccaaaagcuucucaugucauugacauuaaaagacuuuuuguauuuuuuuugagacagggucggcucugucacccgggguggaguguaguggcaugauuucugcucacugcaaccucugccucccaggcucaaaccacucucccaccucagccgccugaguaguuggaacuacaggugcacgccaccacgccaggcucauuuuuuauuuugauagagacaggguuuuaccauguugcccaggcuggugggcaauuuguccaccucaaucucccaagauauuaagaaacuguuaaagaauguuuugccacuaaacuauuguuuuacaacauuucauuaugaaaaauuucauacagaaaaguggaaauaauuuuauagugaguacuuguacacugauugccaagauucuguaaacaauauuucccucugcuugugucaucuuucauuuguccauuccucgauuuauuauuauuauuauuauuugagguggaguuucacucugucgcccaggcuagagugcaguggcgcaaccucggcucacugcaaccucugccucccggauucaagugauucugcucccucagccucccaaguagcugggauuacaggcaugcgccaccacgccuggcuaauuuuguauuuuuaguacagacggaguuucuccauguuugucaggcuggucucgaacugccuuggccuccuaaaguguugggauuacagauauaagccaucacgcccggccuuguauuauuuuucaaugcauugcaaagucaacggcagacugaaggacugccgcaugcauagcugcuauuauuaacucgagaucaauauugauuuacuguuuuguuuuuuuauuuccagauaagcauucauaaacagugaaaagcacaaaucaucagugcgccguacguuuuggccagcacuuuauuuuauggaacagaggacuagaugaccagugcugugagugggcaggucugucuccugccucucuuauuuauguuguaugccugacaccuuccucaugccgcaggaccagccgggaccggggagaggcuguucgaggaacacaggaugcauauucaggcaggaaguuguugggguuaacaugaguggacccuagauuucccugccugaagggggccccguguuaguuuccuguggcugccguaacagccacaaacuagguggcuuaaaacaacagaacaucauucuuuuacaguucuggaggccugaagcccaggaucaaggugugcccagagcugugcucccuccagaggauagagcaggauuccuccuagccuuuuccggccucugguggccccuggcaauccuuggugucccauccagcugcaucacuccagucucugcuucuguuaucacgugcccucuucccggcaugugucuucugggugggugugaauuuugggaggacacuauucaccccaguacaagcuugagccugguugcggggacuguguggaccucucccacaggucugucccccuaaagggagcacacuggcagugugcccacccccaggccagcgggcagcccuuggcagagggugugccuagagcuuggaugugcgggucggaugucuuugccucucuucuuuccuguccugguuucagcuggaaggauguucagauaugagaaugggaaaaggcggagcgguguuuguucaugagagaggacugcucugcccucagcuggcccauggccuucccuuccagagccccaaagggcccugcccucagcugggagaugggcccugggcgucauuuagcuugagcaccugccuggucauccucugcaagccccagucacugucccugggagagguucuacagcucccuacccacaccugcagccuugcuucuccccgugucuguucuugcgcuguccaucuguaugggagcugucuuuucaugggucucaggucugugccaguaugcagcuggggagcugugaacccagguguguuuucaaccugcuucccagccggucgcauacugugggacugguggacuauuuagaggucuagggagugguggggagaaggggcugcaggggaagagcaucugauggugguggccaggaggaacguggcacuggggggugggcagggugggaauuguccacuguggggggcggcugaggaagccaaggggucugggccuguaggggaagugggagaggagagaggaaaggacaaagaugaagguggaaagggggaaggugacaguggccucucaauaugcggaggggcuugaaaacaggagggcugugcacuagaggaugcacuggcgcagaacugagacauuucuggaagguggcuuuggagccagcauccuugcugguauguaagaaaugccagguauaugcccucugggagguugugugggcugggugacacugccaguucccuucagucucuggggcucugacucaguggggauucccacacugaccucgugaugucucuagugcccucagggacccuggacagcauccugagcugcagccuccaugaaaggaggccccugaagguggcagguugucagaucgaggcccacauggaggucauuccuuacugggcuuggugaugccccgccagcuaacuugagggcaaaggcgugcuugcagguugaugagcagcucugugggauccgagcugcugcuguucgugggcugccugcugugggccaggcacuuugcggagcauggacgcccguucucuuacucuguugaugcaacaaccuguugaaccagaguuuuucuccguuuuauggagaaagaaacugaagcuccuugaugaagugaagccauguccuaaagccgcuagcacuuagcauguggcgggcaccuggcaugcaugcgugggauggacauggacucguggcagaaccgagacccagacggcaggaaggagaagcuguguauguguuggaggaggauguggaucgcugcuggcucagugccgguuguaaaaggaagcaauugcaguuauuucuugcugcugcuguaacagauuacaacauacuuaguggugaaaaacagcacacgucauucucuuugaggucagaaguccuuaaaugcauccacaaagcuguguucuuucuagagggugcagggagaauccauuuccuucccuuuucuagcauccagaagccaccugcaguccuuggcuugugggcccauccuucauccugaaaggcagcagcggauggagcaucuucugaccucucaccucugcucuaucaucauguuguccccuagcuuuacugcuuuuucuuagaaggaugccugugauuacauugaacccaccuggauaguucaagacacccucaccucaaugccauuaauuuaaucacaccagcaaaguuccuuuugccauauaaggauauggcagcguauucauagguucuggguguugggacauggacauuuugggggacccaugauucaguuucccucacguugucagagaccauccuggccaacauggcggaaacccgucucuauuaaaaguauaaaaauuagcugggugugguggcgggcgccuguagucccagcuacuugggaggcugaggcaggagaaucgcuugaacccaggaggcggagguuguagugacccaagaucacgccauugcacuccagccugggcgacagagcgagacaccaucucaaaaaaaaggaucuuggaggaaguacaugaccccgagugggugccucuccuggccagguguccccuuguguauguuauccuugaaucuuccuagcagccuuccaaaguaggcuucgggauucaguuuuacagauagggaaacuuaggcacagagagacuuuugguggcucuauaggcaguaaagggcaaaauggaaagcaaaccuggccucuuguaccucugagccccgaauucugcccucugcccaugugagcauggucugugagcaaaccuuccuguggauagguuuggaggauucgaaggacaucccuggaggggcugugcccagguaggguguguucacugugccccugugugaggguuuguagucuuacaccuuugccaaacccuuucuggguuuugccccucacaggagaugcaggucuuucuauggaaccuguagguucugagaccgagccuuggguaguuuuuauuucuuaggcucucuggaguucucccaaauccccauugccaaucaguagcugaaaguggaugcuauuguuuuuccgauugcuggucucuuuacuuguuuagugaaaacagcaaaaauuuagaauguuuauagaauugaacacgaaaaccagaguuguauaucuaaggaaaacauggugugacuggcccgggauccaaauuauuugcagcgccugucgucuuuguuaacucuucucaguucucuuuuucuuuccuucucucuguuucuuucaguuuugguuuuucuuuuugaagacggaaucaaagggaaauuauuuucauuuucuucacagggaguucccaggcuucccccuagccuuugcuuuacuugcugugcccaguuccaugagaaggaguuguuacauuucuucuuccuaaagcagugaucggugcuucugcccugguggagaaggcuugagcaguccccggcuagcggcuguugccaccuacaagccccugccuccauuaggaagccauuuauuuauggggccuagguaggggcaggagguuccuuucaagaaaacaacagauugcuuaaugcuggucucccucuugcuggccaaaaggaauguuaaagccagaucauuaucuuguuauaaugugugagagaguccugcuuaaaaagaggacaaagacuuaucacacaaauaugcuugggucccuuuuaaugugggaagcacauuccauguaaaggcagccucccguuccugucuuucuuugcagagacuuucagaagaagcaggugcccucaucgagcauuccuuugaucacuugcuagguguguuugguggugguuucagugcugcucuuuggccucggcauuagagacuaguuuuuuaaaauuaaguuucucugggugucccaagauucuuuuaaauccaaagaccauuuagguuccagcuuccuugagccucgguuucuuccucuaugaaguggagauaauggcaaacaucugaaaacauuuuaucaggauuuggugugacacuacguguaggugauuaggccggugccuggcaaguacugcugcucgaggaaucucagguaucugcauucaacuguucucacacggcuauaaaggaauaccugagacuggguaauuuauaaagaaaagagguuuaacuggcucacaguucugcaggcuguacaggaagcguggcaccauuugcucagcuucaggguggccucagggaacuuacaaucauggcggaaggcaaaggggaagcccacguuucacaugguuggaguaggaguaagagagggguugcagggggcugugccacacacuuguaaacaaccaaaucucgugagaacuccuuaucacaggaacagcaccaaggggacggugcucagccauucaugaaggauccaccccaugauccagucaccucccaccaggccccaccuccaacacuggggguuaccguucgacaugagguuugggauggggacaaggauucacaccauaucagugucuuaugcauaguaaaacauuuuaugaaugauugucucuaugugcuguagcuguauauccuccaguaugguagccacaggccacuuguggcuaaauuuaagugaaaugaaagauucaguuccuugggcacacuagccacguuuuccaggccugacagccaugugcugcugauggcugccuuauuggaccacacagauagugaaagguuucugucacggcugagagguucuguuggccagugcuuguucagcuaagguuaaaauauuaaccaccuacacuuccuuuguaucuaaacccauuuccuugguucuuuuccaauacuuauuuccuggguagcccuuuguguuacagggaaauugugaauuuucauauuaaaggcaacucaccugggauauggcuugcugaaagggaagaggcagacgcuguaguauauagucagugcucaaugaagggaaaggggcuucacuuccccaacagaguggcccuccaaaagggucucacuuuguagcccaggcuggucucaaacuccuaggcucaaaugguccuccaaucuuggccucccaaagugcugggacuacaggcguuugccaccacauccagcugcugcuccaucuuuaaaguugucuugcccacacuuuguguguguguguguguguguguguguauacauauauauguauacacacacacacacacacacacacacacuuuuuuuuuuuuuuuuugaagcagcucgucuuuauugaaacuucuuaaaacauccaaccugauuuucaaagcucacagcucugcuccuggcuuugggggcuuagccucuaauuugggucugaacuuuauugagcuuugcuuggcaaaugcaaugaagaaaguguuaccagguggcauuacugagagcccuugaggguggggggagauugcgugccgugcccugugugugugucagcugacucuugacccccgcuugcagcucagcauggcugugugacuuaggacuuucuagaugcacauaauuucaggagugguauuugagugcauuuggcaccaggcaugggguggcugagccccaucaguggcaccucacuguugcugugcacuggugggguaguucuucaggcagugggggugauauccaucagcagguuccaccacugggcaccaccacccuucccccgcaggugcuccucuguccucuagauguccugccuccugcguccuuugcaccauaccccacagguccugccaccccugcucaucaucucucuugcuguuuucaucucugaagucccuccuauaggggcuuccugcccacuucucugcaccugggcuucugccccagcuaaaaucucaccucuccagaaaauaguggccaacuuccccaucaccuuggcuagaagucaccccuccauuuggaaugccacagcagcugcccuuagagucuuccugcucuggcaggccguugugugcaucacacugacuucagccccacaaaggaggaccuacugugugcucagcgugugcccagcucugagugaggcuacacaugugaacaggaccagcucggcugcgggagcuccugguguugggggcaggcaagcagacauucugccugagacuccuuuuagaacgugaaugagaagcagcacgagaguugcugucagacuccccgauugcuccaucuuuuuucuucuucuucuucuucuucuucuucuucuucuucuucuucuucuucuucuucuucuucuucuucuucuucuucuucuucuucuuucuucuuucuucuuucuucuuucuucuuucuucuucuucuuccuuuuuuuuuuuuuuaaagauagaaucucacucuguuacccaggcugcauugcaguggcacagacagcucccugcacccuggaucuccugggcucaagugcuccuagaguagcugggccacaggcauguaccaccaugccugguuacuuuuuuacuucuuuguagagacaggguuuuacuuuguugccuaggcuggucucaaauucuugggcugaagugauccuuagccccucaaagugcugggauuacaggugugugucccugcacccggcugcugcuccaucuuuaaaauugucuuacccacacguacuuacauuuuuuguuuuuuaaagcagcuuguuucauugagacuuaccaaaacauucaacuuaauuuucauaggaaaaaguccucuuauuuaaauucuuauuuagucaguguguauaauguuuaaucaaaugaugucauuauaguuacuauuauuaaaacucccauuucaucgauuugugugauauuuaagugaugugauaauaguuagaaggaagcguauggaagaaaguguggcaacaacacugcugacacuggaggacagaauucuggucucugcaaacggcaugagugcgccccaugagugcgccccaucaccagcaggugggcuuggcaggugugccccggcucaucuggagagucaggucagggguggcuggucaggauagcuguuaccacauggaaugugcauuccuaaauccaaaugcuugccucaccccagugcugagccuggccagcugagaggcuggagaccccguguauucauggcuggggcuggcuccuggcagagccucccagcggguuggcauucuguucagcuuuccccugcugucgcacaaccuuuuuauugaccccucccuuccuguguuggccaggagcccacuggcuucaccagacccugacuguuagcuggucagggaggcagggccugggugccuuggggccuguccuaucugagguccacagccugcagggacaucaccuaaaaguugucaucagcuucauuagcagcacucaggcccagcugggcauucagcugugacugcauucuggcaccugaagcaucugggccuggacggacucuuucagguuguuuggauaaucauccuaaaaacgccucugagauccacccccacuccugccaucaggcauuaaaaucuuccgaacagaaaagcugaaaauguucccuuaccuuaagggaaaggccucaauggauugauuuaauuguaugugugaagcauuuuuucuucuuugcuaaaugcauaaacuguauaacgaaauguaauuagugaaggugcauuaucugauaaaguaaaucucagccacugggaagagcccuuuuuggcaguguaguuucucuuuuaauagcugugaucagauuauaccuuuaaaucucuuuaaacacuucccaccacugaagucuuugguuuccuugauuugauaguuuuuaccaggcuguucaaaaagucaagcaguguucuuuuagguccuuuuugguucugugcgacaguuaaugaauagucaugugcauuugaccccuaaaaggaaggucuuuugcuuuuuaaagagacuguauuaagaggaauaauggaccaaguacaccaggagggaaugaacgagaaaaauaaaagaaagaaaaucacacaagaccaaauaacuaauuuugaauauuuucugagaccuuugguuuagaaucuaaacuuuguugaggcugggcgcaguggagcacgcguguaauucuagcacuuagggaggccgaggcaaauggaucacuugagcucaggaguucgacaccagccuaggcaacauggcaaagcccugacucuuccaaacauacaaaaaucagcgaggcauggaggcagacaccuauggucccagguacaugggaggcugaggugggaugaucgcuggagcuugggaaguugagggugcagugagccacgaucguaccacugcacuccagccugggugacagagugagauccugucucgaaaaaacaaaaacaacaaaccaaaaaaaaaggugacauugagaauaaagagauggugguuggauuuguggcuauuuuuccagcugcucaauaguuguacaaaauguagcuugauaugaugaguguuuccaaaauuccuaaauuacaugucauguuuguugauuauuuguauauguuuuaauguguauuaaaaagacaccaaaggugugaguucauaaauauuaauacuuaggauaaacuuaagauuugaaagaauuuaaaguugaagagaguugaaguaggugauaguuuagguggucuuugaauguggcagaagccacaaagguggugcaugaaguuugggaaaagcugagccgaggaaacuggaaggcuuucuccuuuaaggaccagugugauucuaggcuguugaaugauaucuucagauacccguuuguccuguugcucugccuccuccgugagcugugcucacggguggccagguguuugacacuaguauccagagacaaacucagacaugcgcccugggcucuacuccuggaaccugggagaaagggcugccguagggaaaggugugaacgcacagguuugcaugccuaaaauuauaacacuuuuuuauugcaaagguucuuuucagcuuuuuucuuuucaaguaaauggagaugugucuuucuucuguuucugguguccuuuuucuuuccguaaaauaaccaccucuuuacugagauuggggagggaagucugucuccauugaauugucugcugucgacaucagauaagacauucccuucuguucuguuuucaaaagaagaugaugugaaaaaaaaguggcauuuuuaugagacguguuguccccucacauaacuucuuggauaccuuucccuuguccuagggaccuaagccucucugggugucacuguccgugcacagccugugauaagccgcuguguggcagagaccaacugugggugauuugucgcuccccagagcccgguugcaacaggaggagccaccaggcugggagggcaccaggcaggaggcuggguccauaccuggcgcaacccugggccucagguuccccaguggcaaagguaggauaggggcuuuggucgccucugugcuaugagucuuuguccaguuugucagucaccauauucguuuuacucuccagucuuuucuauaaaaguguuugggggccagaaguuguuaaccugguucacuagaagcuaaugcauugauuauuuuuguguguguuguacucagcacgugcuucucagugcgcuguguccucauuugcuguuuccccugaaguuugacgaguaugguauauucuggucaccaggcagguggugcuuggggaauaucuccucuccgugugcuggaagcauugccugauuuuaaugaggugacucacugcagcugguuuuaagaacuuuguugcagguauugguugacugcaguguucccaaguggucgugcugugcccuaaaggcugcuagaaccucaggggccguugagggcagguucgagucccgcaggcaagaagguggaacucuagagaggagggggaugccuuggccugggcccccucugagggaggacugucgccccugcugcugggagcaucauuagcugcagcuccucauggagagaugcccagcguaaggguacauccugucagacccucuucccgugacuguucuuccagggugugaagggcagaaagguggggccaucuggacccaucaugggacaauucuaauggccucuccauugcucccuguuggguuggcgagauggccucagguuugccuggcaguucagccucucucuggccaguucugcuucuuccccuccuuccacagguauccaucuucccuccauaccccaaaugccaaacucuaccucugcaucuucaccaagaaaagcauuucuguuguccugaaauaucaggccuuccugaacccccuuguaccucuguccaguggaaguagaaugccagccacauacgucauuuaaaguuuucuacuagcuacauuagaaaaaauaaaagaaacagaugaaauuaauuuuaauaaacuguuuaauccaacauauccaaaauauuauccuuucauugcaauuaucuggaauuuguggacgagguuugcuauaauccuguuugguacugaugcuuuggguggugcuguguaauguucauucaucgcacauuucaauucggccacauuuuagugcucaguagcaccuguggcuggagcuacuguauugggcaccacggccuuaggguuuugauuaaaaccccauucucuugaccuucugcccaaagccuuugccagaugagacacugccucucgcugaaugccugcuuggagcagaguccuguguuuguuuggaaaugaucggaagcuccugugucccuggucgcuugcuggagucggugggagcugagagucccuugcugcccggagcauggcuguguggcugccugacuacaugguucuucccccgguuauuuuuguuugggcaguuaacucugagcauucggaacauucgccgaguggaacgugugugucgucauccccucgaaggcuuggcugauugagccaguaaacaaaaagugcauucaacacaggcuugucugcuggccucccccgggagagagaguagguuugcuauuccugaaauguaaucccuccuucagcgcugcacaaaaggcccaugucugcucgcugggaccugauaguucgccuuuguacggaugaaaaaaaccaaacacugagccuggucugagcggggcuguuuguugaggcuccugaugcagacaagggagcagugucugcacagggggucuggaucgcacccgacaccauccaggugccugcgugugcuggucccgccaucaggacuuccccucgugaggagcuggguaccacuguuauccugccugcuggucugaggguccgagcgugauugggagcagagacaagaguuccagggcgagccucaguucugggaccaccauugaccaguagagcuauaaaggacuuggccaccaagguuggagcugagccccccaugucaugaaacugccacugucagagccagccugagcuccacggugcccgucuccuaccugcacugugcccccacaccuuuguugacaaggaccugaccucuccucaaacuacaaccuaagaaccacaaugccuguuccccuuaccugcccccagguguccugggagaagucagugacaugauuaagaccuuuaaaaaugaugguaagcaugugccagugugaauguacuuagugccacugagcugcacacuuaaaaguggguagaaugaugcauuuuguguguauuuugccacaguuuaaaaaauuacagacuggacgcaguggcuuaugccaccccagcacuuugggaggcugaggcaggcggaucacuugaggucaggaguuugagaccagccugggcaacauggugaaaccucgucucuacuaaaaauacaaaaaaauuagcuggaugugguggugugcaccuguaaucccagcuacuugggaggcugaggcaggagaauugcuugaacccaggaggcggagguugcaguaagccgacauugugccacugcacuccagccugggcaauacagcgagacucagucucaaaaaaaaaaaaaaaauuuuuuuuuuacaauaagcuauuuaaauaaacauuuguguauagcccaauaguuuuucacuguugagggucaaaauuuuaccuuugucuaccuaucugccugucccucuagcugucagucacacagacggauauagauauguaauuugaauuacuucuguuucuuucucuuugcuagucuaagucuuagaagaauuaaggguuuucuuauuacuggcuaaaguuaaaagguacccaguugaaucaucuuggaaagaaaaccaggaaaccaaauuaucaccaugaagcagccuuccccagcuugugucacaguggagcgcucauuuuuguggcugguuuacugucguaaaacuuucguauaagggcgcacugugucagccccugcccacugagggcuucagaaaugaaaggcaguucuauuuaugcccagcuggcuucugcagagccgggcucaguuuaccaggcgacacuuuugcuuuaauccuuccuggugugacguaaccuuucacuguccuucccaugcccugaggucuccagccuuuuuguuaaaacaaaacaaaccuuauuugggcaugaucaauacagcuguggguugcaaucccagggggcgacuuggcucuuuuguuguugucguuaaaaaauauugaggcaaaauuuacauaacauaaaguuaagcauuuaaaagugaacacuuggccaggcgugguggcucacaccuguaaucccagcacuuugggaggccuaggcgggcagaucacgaggucaggagaucgagaccauccuggcuaacacagugaaaccccgucucuacuaaaaauacaaagaaauuagccgggcgugguggugggcaccuguagucccagcuacucgggaggcugacacaggagaauggcgugaacccaggaggaggagcuugcagugaguggagauggcaccacugcacuccagccugggcaacagagcgagacuccaucucaaaaaaaaaaaaaaagugaacacuuacuuagcguaugcaccacaugguguaaccacccacccgucuaguuccaaaacaauuucaucacccccgcccaggggaaaccccauguucuucagcagucauugcccauuucccccucucccuagcaccugacgaccgccagucuucuguuucuguggguuugcccauucuggacauuucauauaaacagaaccauacaacauguggccuucugugacuggguucuuucccuuaauauaauguuuuugagauucaucgagggugguagcaugcauuggugccucauuucuuucuacagcugaaugauauuucauuguauggagggaccacauuuuguuuauucauucaucuguugaugggcguuuguguccaucuuuuggcuacagggaaccaugcagcuaugaacgugcguguacagggauuugcuugaguugccauuuucaccucuuuggaguauauccuuaggagcugagugguugcuuggaaagguaauuguauuugacuuugagaagaaccgccauacuguucuccccaucauuaguggugagaaugaagacgugccggccgcuuacauuuugucggguugauuucuucauuuucuugcaucuccuucacaguggcagugcuggcuuuucccucggugcuuguuggaggcagugggggagggaggguuggggagggugcgcuuucuacuccaccauucuagugucuucuagagguagagucgaguguaucugagagugcuucucucuuagaauaaaugacauuaacauaugaaaaaacagcuacuugugccugacuaugggcauuuucauguacaggaguucuugaagcugaguuuauugagaaugguuuuguuaccugcugauagcuaucuuuuuguguuuaguucuuuuugacuucuuuggccucuaauguuuugacaguggcacuuagaugacagucagcaauugcaacagugaaugaaaucacacagcuugaguucaagguggaaagagaaaaaaaucuagagaggauguuaucugaccuggcaugagaggugaucauccugucucugagcaguggguucuugcucucgaccuuaggguguaauguggcccugcuccuuguauggugaauaacuugugacugcuguguuuaccacauggcuugacaguuuacaaagcacuuuuguguauauuauugcacacucugauccuuacaguaaucccgugagguguggaguggaggcuuuuuaagaaacagagacugcuuugggaggcauaggucgguggaucaccugaggucaggaguucgagacuagccuggccaacauggugaaaccccaucucaagcaaaaaaaaaaaaaaaaaaaaaaaaaugccgggcauggugguaggugccuguaaucccagcuacuugggaggcugaggcaggagaaucacuugaaccugggaggcagagguuacagugagcugagaucaugccauugcucucuagccugggugacaagagcgaaacuccgucucaaaaaaaaaaaaagauggagggugaaagagauggagacuuggagguugcacacuguucaguggaggugcaggacuuccagcuuggucuuuguccccagcuuuuuaagaauucaaucaugaagaagauuguuuauauuguucuuuuuuuuuuuuuuuuaauggauugagugugaaacugguggaaauauauuccaggaggccauuuaaaaagaaaauaggcuggguacaguggcucaugccuguaaucccacacuuugggaggccaaagcaggcagauugccugaacucaggaguucaagaccagccugggcaacguggugaaauuccgucucugcuaaaauacaaaaaauuagccggguguaguggugcaugccuguaaucccagcuacucaagaggcugaggcagagaauugcuugaacccggaaaguggagguugcagugagccgagaucgugcuacugcacuccagccugggcaacagagcgagauuccaucuucaaaaaaaaagaaagaaagaaaauaacaagguuaccauggagauccugcagucacggggacauucucaaacaucacaaugauuggugucaaaaauugaaaccuggaagaagaaaacuggacuaugauuguugaauuagcacccggggagguuuuauuauucuguguucaccccaggaaauucuuaaggccugaguguugauguccuucagcaacccaacauauuaacgcagucuuuaggagacaugaaauguuccuuccauccagggaagacgugauugcagcaggcaggaguugauagugaugcuauggggcugucugcucuauacgaggagcagagaccccuggauccuagugguggccccuggucaccagaugugagcccuggagcgcaugauugugguuuugacccauucuugccccagcuugagccugaccuuuggcagguccaggagugugcugagucuuucuaccccgcugcguggugcugccugccgaggugguguggcucuuugugcuggcauuuagggugucacuaaagcccaagaccaggauugcuuguccuuugcagugugcuggacaggagccacacaguguagaagcgacuugcccuaaaugccucauugagaagcauggguguccccuuagacaucaugggagcucauugcauugaugaagcccucuugagucagaucgugggguugguuggucaugcguguaauuauguguugagguuuggugccuugagauuaaagggaugccacauuuugagcuucucagauauaaaagaaggauucuuugggggaggaccuauaaauauuucuuaaaaguguuuuacaacaaaagcacggaguguacuucagaaggaaggauuuagcugcuggagugauggccgaaggagccugggagaagucagagagagggggcucgugguccuucuugggcucucauugcuguuagcaggaguuggcacuugagucccacguccuagccucccggcaucacagccuuaugcugcauuuccuaaagugcuuucuagcacugaccgacuccaggaggcagcacuggcaaggauuuuggugagccuuugauggaguguguuccggaaucgggaggaagcuuguaaggcugcuuuccacucauuuuauguuguugggauuuggcucggaaccugccaaggaccccuguguguuaaaguugaaauaguucccuaguaaacuggccacuuucagaccagcugcauuuucuagaauaaacuucauuuguccuugacucauaaagggaaaagccagaagccaggggcucuggggcaccuccaagugggccagggucagguguggguccucugccuggguuuuaauguaaacucaggguuuuaauguaagaaccuguuuuguuugcuuuuguuuuuagaccaagucucacucuguuacccaggccagagugcagcagccauaaacaugucuuacugcggccuugaaccuuggucuuaaaugauccucuuacucagccucucauguaacucugggguaacuccaagugggccagggucaggugcggguccccugccugcguuggucucacugccauauaaccccagccauggugaucuuaccagagaaacucauuugaaccuaugcggcugcuucaggccggugguuguuggccugauaggaagagagcauacucagccucauacucagccucucguguaacugggaccacaagcaugcaccaccauaccuggcuaauuuuuuuuuuuuuuuuuuuuugguaaagauagggucucagagguuuggugugguggcucaugccuguaaucccagcacuuugggaggcugaggcagguggaucaguugaggccaggaguucgagaccagucuggcuaacauggugaaaccccaucucuacuaaaaauacaaaaacuagcugggugugguggugugcgccuguagucccagcuacucgggaggcugaggcagaauugccugaacucaggaggcagagguugcagugagccaagauuguaccacugcacuccagccugggugauaaaaugagaucaugucuuaaaaaaaaaaaaaaaaagauggggucucacuuugcugcccaggcuggucuuugaacuccuggacuuaaaugauccuccugccucggccccccagagugcugggauuaugggcaugagccaccacaccuggccagggccuguuuuuaauuguugaauugcccacauugcauuaucaggauugaaaacauaguaguggcacagccuccuggagagugcagauguagcucaugguacgcuugggguuucugcagagcaugacaucaggcugucuuccagccuugccucacuaagaacuugaagcaugacccucaauaaaccacuuuuuuuuuuuuuuuugcauggaaaucugugaagaaagaaggccuugggaaagccuguguccuggccugucauugaacguaauaauuacauuaacaagugaaugauuuaaguucugcacucuuuguucuuauaggaacaagguuaagggacgacuguguuguggguugaaaugugucccccaaaauaguauguucaaguccuaaccuugguagcuguguguguggccauacuuggagauggucuuuggcugauguaauuaguuaagaugaggucauacuagauuggaguggguccugauccagugaucgguguucaucugagaagagggagguugugacagcaacacgcaggaagggccaugucacgauggaggcaaaggucggagcaagcugugcuaggaagaggcaaggagggauccccucccccagccuucauaaggagcacggcccugcagacaccuugauuuuugaacuucuggcuuccagaacugcgagggaauacauuucugcuguuugagccaccugguuugugguacuugauuacagcagugcuaaccuccccacaguuacccacaaccucugaguaccuguuugccgcucacuccucccucucccauugccacguggucucugcuuuuauucguuuucucagcggaaacuuggaggccauuggcuauuguguaucguguaucguggcuaagucauuaccuuuuuuuuuuuuuuuuuuuuuuuaaagaaaacccaaaaccaaaaaacuccuuuuaggcgucaccccccuacccacuuagguacagugcugcugcugcugcccccggcuucuugaaaccuucuuucugacucucugagagagacucuuguggauaucuuguagcucuggccuuuuucuuuagcucuggucuuucccucucuuggcuguggauucauuucuuaucgcuguuguaacaaauuaccacacacuaaguggcuuaaaacagcauagauuuauuacaguucggaagcucagaagcuccaaaugggucuuacgggccuaaaaucaaaggcugugcuccuuuuggaggcugugggguagacucgauuuccuugcuuuuuccagccucaauggcugcugcauuccuggccuuagcucuguaucccucuggccucugccgugguagcugcguggccugcucugacccugaccuccuggaaggacccugugauuacauuggacccaccuguguaauccagaauccuugcaaaacccccaucucaaaaucuuucaccucuucacaugcacacaguggcuuugccccguggagccacaugcucucagguuccaggaaugagucugugggcaucucugggggccacuguucagccugaauguguucugaggcuuaguauuuugucucuuugaguucuacauucauuuugauccuuacaucaucaucugcaggggauaggugauucucaaucuagguuugggaagaggaacuuaaggcuccacagaaauuugaguccauuuuuacuuaaauguacuuuuuaccuuuagaaaaacuuguagguaaaaaccaacaggugcauucaaaccaaucacacgccaacuuuuaccacccaccaccgucuuaccuucugcugcuguguuggcucauuauuuugcgcggacccgaaaugaaggcugucucguccuuucuguuuaauuggagcgccuggagagcacaggugaguuguuaaaaacccggugaauccugcauggauuugcaaaccaaacuacauggagaaaucaguuaaauucucagguuucaggguugcagcugccacugagaaguguauuuaggcagguucuggcaacagacuugguguugggcuugagugggaaggggauuuaggagcuucaugagcgagucaaaugcaaguuggggaaguggcugaaaaaaaugccuccuggaaaaagcaguaaauguaaggauuuaggucggccauugucuccguguaagucaacacuaccuugugugugugcgcauacacacaaagagggugagcccucagcccgccauacgggcauguuauccagaagagaggagagagaagcccgcugcacucuccacugaccagaccacccacuuugcccucugcacgcucacuccacgaaggaugcaggugggcacacugcuacaacccccuggguguguguggaguugggaaagagacggauguugagccugaagaggcugugaccuccccaaauacucggacuccccuguggaaggcaagguggaggcagcuguuaugugguguguuggauucacagcagucaaggcugccacgagcaaguauuuugagugcuccuuauguccaugcagaggcugacuccagaggaugcugugcacaggccugugugaccugaaggcccuugcaggcugaggucucuuggugauaauccacacacuguccugggccuugguuuugcagcauuuccaacuuggguugucagagugagacugugcaggacugccccguacaguacggcuucuaugugugaacaacacagaccacuaagagaugugacaaagcuguuccaucagaggaaacauagucugggggacaaauccucccauuccugauaggacaggagggagcgguuggcuggggaagaccugagugagggagcuuucuugaggacggguuuugucggaguguaguucauauaccaugcacagccugucagcauacagcuugaaugaacucacguguguaaccagaucaagaggcagaauauuacuaggguggcaguuuugagucccaugaaaacaaacacauuuacucugucuagcuccaucucuaguuaauucuagugcaguuuaaaugcucacaaaauccuuauuugaauggaugagucagugguuugaauugaauaguuuuugagccauuuguauggagaagguauuacccaaacagaaacaugguggugauaauagacucacguugauuucacuuguuaacugagcaaacaccucuugucuccucauucugugcagagcauucuggguggaaaagucggaccaaguuucugaggggaggacggaggaguccugucuuuuaagcagauggagcugcaaacagccagagagugacagagauugagaggcagcagcugucuuuucaguugcgcauccuccuuguaguaaccauaggugggaggcugggauuccgagcucagggcagcgggaugcucaccaugugcugggugcuguuugaaggaccggaaaugcaucauuuuguuuaagucucccaacaggccgggugcgguggcucaugccuguaauuccagaacuuugggaggcugaggugggcggaucacuugaggucaggaguuugcaacuagccuggccaacauggugaaaccccaucucuacugaaaauacuuaaaaaauuagccgggcauuguggcaggcaccuguaaucccagcuacucuggaggcugaggcaggagaauugcuugaacacuggagguggagguugcagugagcugagauagccccauuucacuccagucugggcaacaagagcaaaacuccgccuuaaaaaaaaaaaaagucacaacaaccuguuucacuuaaguacgggcuuaagaggccagugugagggucaggagcuaacacucagccccacaggggucuccagguccugcugcuccuuccacgccugcccggucccugcagcuucccaugaacggaagggaagucaucuggcagccuuagaaaugcucauuuguggccgggugugguggcucacgccuguaaucccagcacuuugggaggccgacaugcguggaucaccugaggucaggaguuugagaccagccuuaccaagauagugaaaccccgucucuacuaaaaauacaaaaaucagucgggcaugguggcacaugccuguagucccagcuacucgggagacugaggcgggagaauugcuugaacccgagagguggagguugcagugaaccgagauuguaccacugcacucagccugggugacagagugagacuccgucucaaaaaaaaaaaaaaaugcacauuugcaucagugauuucauucugccaguguuaaaugaaaauuguuacagggaaguuaguucucaggauccauuggggauaaaauaccagaacaaagggaaggcuaggguuucuucuccuccacuucucuacacucaaccacccuucccauuucuuuaaugccaacgcaccgucaccuuccucacccuugaugcugagacauucaagaccccuuagaacccaggacucccgguggcugcuacacccuggucauaucuggccucucacacuuaaccccuccaaauaguaaaaucuggauaaaaaaaaauuggguuuucaaagagcuguuaacagucuucuguagcugaguuuuuaagaaauuauaccauauucauuuugacuccuaauuccuuuuuggaaaaauuucugaauuuuguuaaauucacggaguaacacaaaugguuaucuuucuguuccuuuaaaaucuaucuuugauuuggagauuacuaggguaaauuauagaucaagaauaucauacaugucauuauucacugaaauuugcagucagcucuguagacaccauucugccuccuuuacccagcacguuggggauugugauuacugacgagaccuuuaaagaaucuuccggcugggaaaggucccgaguggccugcuuuccuggcuuauuugagaauuuugccuggccccuagguuucucagcagucuguauuucccacuguucguugugcucgugcugaguuguuuuccuaucgaaauacaacuguguuuuauugaccuugaauagcucugccagauuucacaggugcuccuugcucugggaggcccugaaaugcccuuucuggucccucuuggguucagcgcucagggccucuggaagguuucaggagccccgaugcugguagaaaaggagauuuugagaacuaccaguuaauagcuuauuguuuuguuuuuuuuuuuuuuuuuuuuuuuuuuuugagacggaguuucguucuuguugucuaggcuggagugcaauggcgcggucuuggcucacugcaaucccugccucccagguucaagugauucuccugccucagccucccaaguaccugggauuacaggcgccugccaccaugcccggcuaacauuuuguauguuuaguagagauggagugucaccauuuuggccaggcuggucucgaacuccugaccucaggugauccgcccaccuuggcaucccaaaguguugggauuacaggcaugagccaccgcgccagugcuggucccaguuaauggcuuauuucugaauuucccauccaaccgaacuuuucaaguguaacuccugguucuucaugggcaggaggaccauguccgcucuagguggcuuguccucuuugggaaggcucucuuugcauuuuaaaauuauucuggaugacagaaugaaacccugucucaaaaaaauauagauagauagauagauagagauauagaauggagauaauuggaggaagcaguggucauuuuaguguuuguguagccaggagagcacggccaggacucacucugaguugggguagccagaauucagagcaucuagagagagagagagagaggcucaccucuuaggaaaggguuugggaaugaguaggaaguuauuuuccuuuuuuuuuuugagaugguaucucguucugucgcccaggcuggagugcaguggugcaaucucagcucauggcagccucugccucccggguucaagcgauucuccugccucagccucccugguagcugggauuacaggugagugccaccacaucuggcuaauuuuuguguuuuuaguagaaaggggguuucaccauguugagcaggcuggucucgaacuccugacuucaagugaucugcccgccucggccucccaaagugcugggauuccaggcgugagccaccgcgcccggcccuuucuuuucucucacuguuacugucucccugaguuuuuacucgguguuaacguuuaaaagcuccagcuucaaaaaguaguuuuuagucuuucuuaaaauacagauguaagcacccaucagcucucugcccaaagauaaauauucuuaaccuuuaggugccuauccuuuuaugccagaugccaaguugaccagggagugucugcacagauucccggugucugcaccuccuagggauauggaaggaggccugagcuccgcgaggcuggauguugaagcuguugaucaacaggugugggcaggaagggacgggaggcuggaaaccgugaccaugcccagagacagggcuucugggggucaccagcaaugccuuucacugcccucuccaccacaaccugcuuuucgaauuuaaagauaacagaaccugccaggauaggccacucauuuuuguuuuuguuucuguuuuuuuuguuuuguuuuguuuuaaugugugugugugugugugugcgugugcgugugugugugugugugugugcauuuuuuuuuuuuuuuuuuuuuuugaggcggagucuugcucugucgcccaggcuggagugcaguggugugaucucggcucacugcaagcucuaccucccggguucaugccauucuccugccucagccucccaaguagcugggacuacaggcaccugccacuacgcccggcuaauuuuuuuguauuuuuaguagagacgggguuucaccauguuagccaggauggucucgaucuccugaccucgugauccgccugucucggccucccaaagugcugggauuacaggcgugagccaccgcccggccuauauuuuuaauuuuuugagacagucucgcucuguugcccaggcuggagugcaguggggcgaucucgguucacugcaaccucugccuuccggguucaagcaauuuucgugccucagccucccgaguagcugggauuacaggcacccaccagcaugcccagcuaauuuuugcauuuuuaguagagaugggguuuugccauguuggccaggcuggucuugaacuccuggacucaggugaugcauccgccucagccucccaaacuguugggacugcaggcgugagccacugcgcccagcccuguuuuuuaaguuauguaaacagcaacgggaaugaauugacugaacgagggggaguggagugggaagcaaugugcugcccgggucuuggugugaaacgcaguggcccugggcagaaugcacaacaaaggcgcacggauuuggguuuagaggcuuaaucccuccuucucuuggugugauguugacuccacagaggcaaaugugccccaggcugcagucaacuguuugaccucgaguuugggauaagcauacggccucuucagccugaugucacugaugugguuuggaugauuuucuccuccaaaucucacuucgaaaugugauccccaguguuggaagcgaggccuagugcaggugcuugggucaugggggugaauccuucaugaaugucuagcaccauccccuuggcgaugagugaauucuugcucugauaguucaugagaggucuguuuuguuuuguuuuuaauuuuccuuuacacaacaguauacaguauuaggugccaagagaccugguuguuuaaaagagccugcccccacccccaccccccaccacuucucucuugcuccucucuugccaugugacaugccugcucccccuucgucuucccacaugauuggaaguucugggaggcccuuagcaagagcagaugcugcuaccagcuuccuguauagccuucaggaccaugagccaaaauaaaccucuuuucuuuauaaauuacccagccucaggcauuccuuuauagcaacgcaagaacagacucacacagucauacauugaaguggcgcugguucccaggggcccaggcuugccuggacagcgcccuguggccaggaagaccuggggagggaggguggcuggaggccaggagcugugcuagguaucccugcucugcagccaaggaggcuccuccuccacugcccuggccaccuggaugcugcauuuaauucugggcaccacgcgccagaaggaggaguagaugagccauguucuggggggcagugagcaggauggugaaggaggaguagaugagccauguucuggggggcagugagcaggauggugaaggaggaguagaugagccauguucuggggggcagugagcaggauggugaaggagcuuagaaccacgagaggaccccgcuuuuccaggguuuuggagggcagggcuccaggagaggcucauuuagggcugacuccgggcuugcggcuuguggcaugagcucuuggagguucucccuaaggagucagccaaucaggccuuccuuucuugugguuuugagcagauuccaagcuggcuucacgggagggguguugaacaggaguagcuauaucagagucaaggcagggaggggagaccucaguacugcuggaugucgcacauggagauaugggcgcaucuuaguuauggugucagucccaaagccuguaucuggccgagguugcuuggggacgugauggcuaaagcugugcccuugcagggugagagugcgggguggcugcucgucuggagaagagagcaccccuugggaaauggaagauggagguggggaucagcugcugcacaguuuccaggaacacuggugucucagggagacaccuggcaucucaaaauaaggagaggcugucugacagcuucaguuaaggaugaucgguggcugggacgguggccgggagggcugcugagcuucugaaaugagcguuaggugacccugaccugcugaaggccccuguucaccugaccaggugagagauggcucggaagugagggagaggggagagggaugcagguugugggccuguaauccuuauugauaucagccacccucaaccugagauguaaauuggaaucaccuguggcucucaagcuggcauucagacgggcagcuuuuccugagcccucaaggagauucugucuugcagcacguggguaacaaguggauuggguaaauaggcucuucccuggagggaugguguuaacgcagagacccgagacugagcuuaggaaacaaaaguggaacagaacaaccuccugauuucaaaagcaaaggcuuaaaauuuauuucagaaugaguuacagugauauuaguauguuuuuuuggguggggaggacagaaucuaauuuuaguuguuuuagauuaugguacuuuuuccugcuugauuuacauguuaaauguuucugaugaacuguuaaaaucuucgagguuuuugcuucauuuaaacaaaugaugccugccaacucuacaacuuaaauauguuuuccguguauauagauauauacuuaaauauaucuacuguguguuuuggcuuugagguuuucaaaaauguguauucaaaucguguagcgcuacagcuaauucaguaauaaggacuaggcuuaguggcuccuuucuguaaucccagcacuuugggaggccaaggugggaggacuguaugaggccaggaguucaagaccagcccgggcaacauagugagacccacaucucuaaaaacaaaaaauacaaaaauuagcugggcaugauggugagcaucuguagucccagcugcuugggaggcugagguaggaggaucacuugagccccggaguucaaggcuacagugagccaugauugugucacugaacuccagccugggggacagagcaagcaagacccugucucaaaaggaaaaagaagagaaggaaaaaaaaucaaucaaauucuaaggugaauuugagaguauacauaaguuuaaugaagauuuuuauuuaguaauaaucauaggugcacauguaguaaggauaguuuucaagcgguguuaaggaaguggagauugagauguuaaauagcaucugauaggcguuugcuuuucaaauagacuuaguacuucagcuucuuacucuagagacagaauacaguucuuacauggcuuuuaagaugcugcccccuucuggugacuaggaagauuauaauaucuguagcaaauaggcauucugggguuuuuuuuuuuucauauuuaaauauuaguuuuauuacugaaccugaaaaacaaaaugaggaucagagguagcgucuccuccucuguacucuccuuucuuccuugagaggaggaauaacuuucugucucuugcuguucuuuguaaaugaguuuccuuuuggcuuucuuucuucuguccuuccuuccucugauggguagagcaucucugugggccagguacuguguucagcauuucaugagauuuaucaauuuuaaagaagaauugacaauaugaugcggaguuuuccagauugcuguuuguuuugagagggagucuugcucuguuacccaggcuggugugcagugaugugaucucggcucgcugcaaccuccaucuuccggguucaagcaauucugccuuggcgucccaaguagcagggauuacagaugcaugccaccacacccagcuaaauuuuuuguauuuuuaguagggauggggucucaccauguugaccaggcuggucuuggacuccuggccucaagugauccaccugccucggccucccagagugcugggauuacaggcgugagccacugcgcccggcccagauugcuguuuuuuuuuuuuuuuuuuuuuuuaugauguaaaaguaucaacauauuuuuuaaagaaaguuucaucugcugcuaucuagaggagguagcuggaaccagagcaccaggcuggcacuggcaaggaggagagggcaccucccggcauguggacggaaugacccaggugaggcggguguggcgccagaggggccuguugcagaccugaagaacuccaguguguuuugcagaaagggaguuucagagaauaaggggcagccuugacucagacggcuugggagaggaguaagugcagcccagccuccaggggaaggggaggaaaacugaagguuuguaagggaucuggccagcauggucuugaugccuggaaacagcuccugggcuucucaccaguauugggagcugacucuuagaaaggcagccuuccuggggagcacacccucgaggggccggaaaccgugaaacugaccagaagcacauagguccagugggcacugaaauacauucucaggaaggaaguguagcugaaguccagaacucagcuuacucucacuccugggccugcugcugccuuaaugugccugcuccuguguuuuuguucugauaaacacguauagcacuuucaauuaugcuguuacuuacagcuaaguaaagcaguacuagguggauuugucagugccacuuccuacaaagugaaggcuggauuuuugggggacucauuuccagcagccaccagcagguggagggagugagaugcguaaacaaacugucccucaugcuugguguuugggcagaugcauugcuaaagcgugcucacuaauaaauccccugcugauauggcacaaauauuuauagccgaugauugaugugaaauuaacaaaaacuagcaguugacagcgauaugagguggcaaaggcuauuugggaaaguuuccguugucuuugaaaauuaagaaaaauuauacguuuacuugccuugcuaagaacuguuuaagaauaaaucaacauaaacuagggcagcuucuuaaacuaugauggagaagcacaaggucaaaguguuucgucucagaaugaagcaguaauguauuacuuugcguacuguguacaggggccggcagauguuucugauguuaugaagcuaugcuccuggaagugguugugaaaaucgcagcccugugaauugugugcccuaagagccagcugugcuccuaacagugaugccgucuuuccauggaaaucacccauaagcacagccuucagucuaacuucaugucaagucuaaguggcacagcuauccaugaacacuguaaacauucccagcuccaucuaaggugauuaaacggagucagaacccggccauggauguguauucacuguuauuuaacagaugcucaaacuagacaggugggacuguccagaugccuguggggcacuacagaguuuugaggaaauagagucucagacuggagccccaaggaccuugaggacaggagucuaccuggggaggggcaucccagagacuuacuccagcugcuuaacuccggugugccuggagucaccuugggaccuuguuaccugcagauuuggauucagcaaggcaagguggaccugagagucuguguuucuggugagccacagguagcaccccggcugcuggucccuggucuggggaaaggcaggcagaguuggagagacccuucccggguuccugguugcaggugcugugucaucguauggcuguauuugaggggauuguguaagaagauguuguuaaauuuauuuuuagaauaauagacuuuuagauagaagagaaaccucggaggucaaucagcuuucacucuuccucucuugugccccaguccuagugaugagaaaagcaaugauguuucccaaggccggggcugucgacugaauugugucccugcaaccccgugugaugguauuaggaggugggucugugggagguaucaggucaugggaguggaccccuugugguggcacgaaugccccucaggagcgcuugcucuguacccuaugaggacaucaugaggagauauggcuucugcaggaagaggccucaccaggaaccaaauugaccaguaccuugaacuuggacuuccagcugccagaacugugagagguaaacguguguuguugaagugccucugccgguggucuuugugauagcagccccagccgacucaucacagccagauuaagggagaucaaaagaguuaagguuccagacuccagcuccugaguucuucuauguggaaagaugccccuucaaccaccaaggccagggaugcccugugguucagcguugucacccuuguugcccgccuccagggcagagcugggggcacuggaggugcucaggacguguggagcagaauugggagugaauguugugugcucagggccaccuccacucugcaagcacagcucccagagaugaggacggggcuugcuuuguccucugccacacacagcccuucaugcaaggccuuggccccuccagggccacacaccuuggccacccagcaagcaccccuugcuuggccagucuuuccgucacuuccuuuccuuuuucccugucuccugagcuucagacuaguugacccuaaggggugucuccagcuguaaauaacuguccagacugcuuguaaaggaaaacauugcaaccaccuuacugcacaauugauacuauuauuauuuuaggguuacccaaaaaugugcagcacgcccucgaaugacauggauuuguucuaacguuggugaugaaaaaaauggauucccgcuggggcccugucuguguggagcgugcacgcgcucccguguuuccuguguguggagcgugcacgcgcucccguguuuccuuuguguggagcgugcacgcgcucccguguuuccuuuguguggagcgugcacgcgcucccguguuuccuuuguguggagcgugcacgcgcucccguguuuccuuuguguggagcgugcacgcgcucccguguuuccuuuguguggagcgugcacgcgcucccguguuuccuguguggagcgugcacgcgcucccguuuccuuuguguggagcgugcacgcgcucccguguuuccuguguggagcgugcacgcgcucccguguuuccuuuguguggagcgugcacgcgcucccguguuuccuuuggguggagcgugcacgcgcucccguguuuccuuuguguggagcgugcacgcccucccauguuuccuuugggucuuccgguuuccgucgacgucccaaagcugugcacauuaggugacuggcgugucuacagcaucccagucugagugaguuugggcaugugugaguggccccgcgauggaacagcgcccugguuccugccugcccccacugagcugcugggacaggcucccaccacccugaacuggaauaauuggguaaauaauuaucuuacuuauuuuuacauguauguaagcucacguuuauugcaguguuuaauauuagaagggcuuuggucuuuauuuagaaguuuggugauguuuuugugaccagaaauaagccauaggagcuuaacucuuguuuauaucaaauuacccuaugggaaacuugguugcauuguaugucguuucguuuaaaguugcuguuuccaggaaccuauuggugaugugaagugaggacuuacuggaugacgugaaacuaauuuuaacuuucuuuuacucaucauccugggauuauucaaguauaaacucagaauugccaaauuaaaugcaaagauaugaaaaggagccgcuuaugcuaaauguacagaugaugcguuuuugcuguaacggagucgucccuccgggugcugacugugccacucagcaugguggcccagggcuguguguuuggugcacagugggacgucuuagucccacuaccucagccagacuccuggcaaagucuuuauuuuuuaagauaauuuauuuuuagauuuuauucaaaaugaaaacccauuuaaaaagcacaugagaaaugaguucuuuauucacucaucuaaauauuuagggcuguggaugggcucagcugcuuuaaauauuuggcugggcagaugagugggagccugucuuccucuuguugacauuugcgucuguggugguguacacagaugagcucacugcuguccucggagcagguaggaauguauuuauuuacucgcaugccuucagaugcuugcaguaaguccauuugagaugcugcuucuauuuuuccuuguggagaacuuacuugacgccaacaaagaaauuucuagcugcuuguagaagacaccccaggguacgcagccagucccuuccacgaaugcugcgagaacccacacagcuguucauuucgguggccgagggccugugggcugcaguacguuuacacuguguguuggggggguggcagugugcuuucuuccugccccaauuuugcccaggaggagucuggugauggagaagguguggcgggcagcaaggaggcuggggaaguggaugcugcagggugagcucugggcgacccaggaggaaguauuugcaugaauuagccacacgcagagggcaguuaugugugaugugggaaaugacugcaaagcuaucuuacucuuuauuccauagccacaaaaauaaguuuauaaaaagcccccaccaagucaggauuuguccagaauggucacucugcuuuggagaacugcggauccccugccauggcccauguggcuccggaaguuccugggaguggcucguagagccuguuuucauccuucagaggaauccugcaguccacuugcccagcgucacuuccuccagugcccuuucugggucccacgugauucuaccugaucgcuggcucucuagggcuuuuccccuccagguucagagagagcgccugccccagggcugggaagaugagcagggauccugggaugugauggcacggucagucgccccugguggaggcaaugcugguacccacgacguggagcccugaaggaugaggaaaauaauuucugagaaacugacucagggaagugccuguguucagggcggagguuccacugugauuugaaaacaggcgauucuuccagacaacuuuaaagaugaguaggugcaaacugcagccacaguaaacuucagggugucaacuucaggggaauauaaacagccuccagggagccccucucuccaucccagccuuucuuccucucucguaacuguuauuuacucaguaauuacagguucaagucccuuguccaaaauccaaaaagccgacacuggaaauauucuguagcucaucuggcagcagggccagagcugaugaucuaauucggaugauuuauggccucuguuuaccccacagacgaucagugugccugcuuccagggggcugcuccuaagggaggugcuggcacuaccuuuucagccugcauggacugugcuggaaacacucaguagcaacucaggcucagggagcccucaccugaagcccuccucuuacccacccucugcccuauagacccccauacuccuguagauacccccucauuacagacccccaccauccccgcuggauuaggguucucuagagggauggaaccaauaggccagauauguaauaaaggggaguuuauuaaggaguauuaacucacaggaucacaaggucccacaauaggcuggcugcaagcugaggagcaaggaagccagucccaggccgaaagcugaagaacuuggagccugauguucgagggcaggaagcauccagcacaggacaaagauacaggcugggaggcuaagccagucuugccuguucauguuuuucugccugcuuuauauuugcuggcagcugauuaaaugaugcccacccagauugagggugggucugccuuccccagcccguugacucaaauguuaaucuccuuuggcagcgcccucacagacacacccaggaucaauacuuugcaucuuucaauccagucagguugacacucaguauuaaccagcauacccaccauuguuucaccugcagccucccccaucucagcuggugcucacuuuauuuuuacugcuuguuguucuggccccagaucucagaguccugguaacgccucuccucuucucacugccuucaguauccagccaagcugggaaacgccacugccacaguaccugcaggguccagccagcuccccaccuccacuggaugccacuguguuagcuugggcugccacgacagagaccacagaguggguggcuuaacagaaguguauuugcucaguuuguagaaguugaaaguccaaggucaagguggcguuucugguggggccccucuuucuggcuugcagauaguuccuccuuacuguguccucucugugcuuggggguggggagagaggcgagaagggaaggagaaagagauggagacagguuugcugucucuuccucuuguuauaagaacaccaguuguauuagucuguugucgugcugcuaauaagcacauaccugagacuggguaauuuauaaaggaaagaaguuuaacggacucacaguucuacauggcuggggaggccucacagucauggcggaaggugaaugaggagcaaaguuacaucuaacaugggggcaggcaagagagcuugcucaggcgaacucccguuuauaaaaccaucagaucuugugagacuuauuuucuaccacagaacagaauaggggaacccacccccaagauucaguaaccucccacugggucccugggagccacaauucaagaugagauuuggguggggacacagccaaaccauaucaccaguccguggagccaggugugguggcucacacuuguaaucucagugcugaggcgggaggaucacuggaggccaggaguuuaagaccagccugggcaaccucuuuuaaaguuaauuacuucccagcaggcccuguuuuucugguacagucacacuggagguucaacacaauccagccaccacaucacccaggucacugcaguaaccucuuagcgggccuccgugccccaucccaaaagguccauucucaaaggagacuccagggugaccccuaaaacccaaguccaaucacauuacuccugggccucacaccugcagcagcucuccaaaauucucaggauaaacaccgauguccuuacuaugaccuccagggccgcagagcaggcacuggcaaacugcugccaccugcuucuguauggcuuucuagcucagcacaguuucugugguuuuaaguaguugggggaaaaaaucaaaagcauaacuuguggugcaugacaaugauaugaaauucauauuucagcgagcacaaauaaagccguguugggucauagccaugccuguuugcucaaauguuaucuguggcugcuuucaugugacaucagcagaauucacugguugugacagagaucuacauaauucccucgauuuugucucuuggcccacaaaaccuaaacuaucuacucccuggcccguggcaguggaacuuuguuaaccccugcuuggccuucuuuccucacuaccucuuugcccgccaggcucacccucacucccuccgcuccagccacacucagucccugcuguuccucuagcacgccagccccagggccuuugcauuagccgugcccucugccugagugcccuuccgcuuccugcauuuugcccuuccuucaagccuuugcucaguguggccaucccauucagccuaauggugcauguuuccuccaccuccacaguuccucuuauccuguuuccauuuuccuuagcaguuauccgcaucagacacauuucuuuuucuuuuuuuugagaaggaaucucgcugugucacccaggcuggagugcaguggugcgaucuuggcucacugcaaccuccgccuccuggguucaaaugauucuugugccucagccucccgaacagcugggauuacaagcacuugccaccacgccuggcuaauuuuuguauuuuuaguagagaagggguuuuaccauauuggucaggcaggucuugaacuccugaccucaggugauccuccugcaucggccucccaaagugcugggauugcaggcgugagccaccgugccuggcccaucggacacacuucuuacugauaugguuuggcuguguccccacccaaaucucaucuugaauuauagcucccauaauucccacguguugugggagggacccagugggggauaauugaaucaugagggugguuucccccauacuguucugaugguagugaauaagccuccugagagcuggugguuucauaaggggaaaccccuuuugcucggcucucgucucucucuugccugccgccauguaagaugugccuuucaccuucugccaugauugugaggccuccccagccacuuggaacugugaguccauuaaaccucuuuuuguuuauaaauuacccagccuaggguaugccuuuaucagcagcaugaaaaacgaacuaaggcaccuacuguauuuguuuucuugucugugcaccacugcggaacugugagcucccagagugcacagauaugugccagacaccaagaucagaaugggugcuucgcagugcucaauacauuauuuauugaaugacuuaauguagaaugacuaguuacacaguucaggugcuaggaggcaguauaaaagucagagagcaaaugcuuuaagaaacuguaguauacaccaggaaaugcaauucuuuaguuagauaccuucuccuuucaguaaaauuauguucagugcuguaaauaggcaacuuucagugauuuguuuuucaaacaaguggcuuuuuaucuuuuccucuugacagugagugucucuccaugugugaaguauuuucuccucucauaucugugaaguccugcuuguaaguguuucgguuaugcaacauuucauggggaauuugagcacuggaauucuuggucgcuaguuaggugggucuuaccgcauuugucagaaaggaaugcguccaucagguugguugacggguugguugacggucugcaaguugcagucuuggcacaggcacccaucaaaaugacacacggugacucugguuucuuccagcauccccgagaugaagaugaaaaacuguugcauagcagguggaucuugcuagaagcucuccagccaugugauuaguuuauuugcucauuuuuuuuuuccuuuuaauauaaauauaucagaauucaggcugguuucagaaccuggcaucaggaauggaauuuaaaaaaaaaauugguucagauguaucauuccuccaauuggcauauauaaaaagaauaguguggcucuugccugguaauacuggcacuuugggaagccaaggugggaagauugcuuuacuccagggauuugagaccaggcugggcagcauagugagaccccgccuauacaacagauuuuuuuuaauuagcugaacaugguggugugcaccuguagugccagcuacucgggaagcugaggcaggaagauccuuugagcccgggagguugaggcuguagaaaaccacgauugugccagugcacuucagccugggcaacagagcgagacccuguaucaaaauaaaaaaaaaaaaagugcuuguuacuguccucuuuaugccaguuccuuuagguugcacauucguguuucuuuuuuauuuuuauuaucuuuuuuuuuuuuuuuuuuuuuuuuuuuugagauggagucucgcucuguugcccaggcuggagugcaguggcacgaucuuggcucacugcaagcuccaccucccagguucacgccauucuccugccucagccuccugaguagcugggacuacaggcgcccgcuaccacgccuggcuaauuuuuuguauuuuuaguagagaugggguuucaccauguuagccaggauggucucgaucuccugaccucgugaucugcccgccucuuccucccaaagugcugggauuacaggcgugagccaucgcgcccagccuauuaccauuuuuuuuugagacggagucucucucugucccccgggcuggagggcaguggcgcgauccuggcucacugcaacuucugucucccagguuuaagcgauucucgugccucagccucccaaguagcuggccacaggcgugcaucaccaugccuggcuaauuuuuguauuuuuaguagagauggguuucaccauguuggccaggcuggucucaaacuccugaccucaagcgauccgccugccucugccuccgaaagugcugggacuacaggcaugagccacugugcccagccucauguuucuuuugacagauaacauuuaauaguaauaaauaagugguaauaaguaauaaauaauaauugagugcuuuucacauuccaggugcugagcuguuuugcauuucacgccccucaucuucauuuauauuguuguucuuaauuauccccauuuuaccgaugaggaaagggagauuguaaccaccccgaggcugcacagcuaauacccagagagcagaauuucgccacaugcgaagauucuagcuaauccuaaaaucuguuuuucaccagacgacgccggcccuuccggcuugucgugcagcacggcauuaucugguacccaccauuuguaucccggcaucauuuaucuucucccuaccuuguugccaaggcacgugugggucccuaacggcuggaaacaccaauuauucaagacacccuaagggagaccagaaggaaagcgauauuuaagaaaugcaggcacagaaaaauuuaagcauuuuagacucauucuccaucagaaacagggaggucuuugaagaggcugcuuuuguaaaaauugccagcuguacccggucagcacauuuuuguugucuaacauuuguucucaaccagcaauuagucaaugacucuagaauuucagcgcagauccgaugaguauagaggacgcgguguacgcccuguguugccauggcaacgcaggcaugcacauccuccucccuuggcugcagugugguggugaacagcacuccgguugcuuaagugcugucugcagacacaaagauguguuugccuggugaaauuacagagcuuuucuuucuacuuuuuaagaauuuucuacacuuucuccaauaaguauguguuuuauaaggaaaacaacaaaacaagcaaacauguuuauaggucugcagagaagaagaguucuuguaaacaguguugaauauucaugguucccaagaucggccauuuccccggccuuucaccggugagaaguaaggcaucugcucuggccaguggcuugcguuccauuggucacccuuggcauugcuucacauauguuugcggcugcccuuuuuuaaccccuuggugaaugugauguaggaggcagaagaaaggccuucuguucuccacaacagcagaccgcugagagccgaucauguaucuguuuuuaaggaaagcaaaaccuguuugccagagaugaacauccuucacccuggagccagcaucugguagauuuggggguuuggggauggcaggaaugaguuacucgauucagagaccaagaacuacuucugugaaagcaucaucuggguuuauguuuggaaugucuaguaucacauccauaaugaaccuuuuuuuaaaaaagugggcaucagaaugaaucuugcaugucaccaaaucgaaagccaauccugagucauagaagcauugacuggugccagaacuucaaagaaagaaggaacacugcuuaccuuaaauuuuaauuguuuacaguuguuugcaaaccuuuuggcuugguggcucacgccuuuaaucccagcacuuugggaggcugagacgggcagaucaccugagggucaggggaucgagaccaguguggccaacauggugaaaccccgucucuacuaaaauacaaaaaauuagccuggcaugguggcgcacgccugcagucccagcuacugaggaggcugaggcagggggaucgcuugaggcggaggcugcagugagcugagaucacgccacugcacuccagccugaugacagagcaaagcaagacugccucuugaaaaaaaaaaaaaaaaaaaaaaagcacugcuuaccuuaaauuauaauuguuuacgaaccuguuucacacauauuaucucaucuggcccaugagacuggcaggugagaaaaauggguauuaaauuauuguuuacaucccacugacaaaaauaaacagggucagcuggguaagggacguuucccggauucguuaaggggcagaagugggaccacggugaguucguuuguuuccaaauccagagcccccccuucccugcccagacccagggcugccccuagaccaugcaggggaaugcuaggugggaaauaggacauuuuguugaagcccgaugcaugauuuagcccaccaguacuuggguucuaauauuccauugugugcuaaaaacaauguacuuggaucaaacuuuaccuuauauucaugcaaucucacaguuauguggaaaucuagcuauuauacagaauuauuagucuaccuuuagggcuccccacagcaacaagcaaacucacagagcccagggcaggaggagcuguucugacuucaggcggccuugccaggagcccguuggccuggguggagcccguuggccuggguguccacugucagaggauggagauugaucugggguuaccuuuuucagccuuugcuuuguuugucaccugaaggggcuggauccugagcccuguaaggcccccuucggcuggugcacacaagaggacagcuuugagccuccaccaaggucucuggauuccacuuuaagugcgggcuugggugugggaagcugcaggccagccucgagggcagccuccuggagguggaagggcagcggggcgcgagacugcugcgcuggugggaugcuuggauucccaggccccaagucacuaucggggaacguucuuugagguuuaauaguauuuuaggauuuuuuaaaggauagauaauaucuagauguuguguucuaccaaaacaaauauuguucuuuuggaaauauguuagaccaaaaaaaugcaucuagaucuucgaguuuugacuuggaagugccucaagugagcgagugccugcugucucagacaugagguggaugcugaagagauuaccccugacuucauagucugccugucucagagcgugggcggguuggcaucgucugcacguugaccgggucguuuuuagcuuugcccacuuuucauuuuuggcuucacagagugaugccucuggagcauccccuugcggagccucagcaucucuucucugcuuggcccacgucuagcaguucuucuucaucuugcagggaaaguguguuggcaaacaugcuggauacugucagaaucagagcaggcuggauccauggccguauucuguaaaauuccauugugucuuuuuuucccccaaguaaucuggcucugggaggaaacucgcugauuggagacuagcugagagggcuuggcugggauucugugggauggggccuucaggagguggagccgccccaggccauggagaccuggagaugcucagggaaggggguggucaggcccugggucccauguuggcagccucccuggcccagcguugggcugggacccucugccucucccagugagaccaacccugcccucuggacggauggaaggacacuggggagccgaugaugcccagagugucugggggacgcauccagggucccaggcccagaaaacaguggagccaagagaggaacgaggucucuggauuccggacgcccugcugcuacuuggccuccaaccaaaaaauuguucuucuccuuccuuuuuuaguaggggagagaggagcaauuuuccauggaauauaucugauggcaggucuugaggucagucugucagaggccugggagaucaggggacaagggugaaauucgaauagauuguacgaagguuugagagcuggcaugacccacuuuugaccguaaaaccuuucagcuuguucuugacuucccccccaucccuaauacccccaacuaugcaaaugauaguacuaggaauaauaguaguagaaguaguaauaauaauuacagaagagcaaauuuaagaagcuaaggagggaggaaggaggcagugguaaguucugcauagaaaugauuuuugcacagagcuuugucauugggaaggaugcuuaucacagggggcugaugaauuuguuuccuucuugccuuauuuuuggcaguuuucuuucuugaugguggggaggguuugugaccagguccuagugaggcagcuuucugagcacuuuuucuugaucacugaugaugaccguaaacaagcugugggaacauaaggaaaagcagauguggccacuggugcuuggaagagaacacaaugaaauugagucccuagcaggagaagucccuguuaaaauggccagaggacauggggacauggggcagggagagcuucagaaugagcgggaagccuccacaacagguggagaaaauagcaagggcugcugggcacgaucauucgagauuccaagagguaagaacugggggcugggcuguggaagaagugcgagagggaguggggaaggcaggcugggcgugcugugguuauaggcagccuacaugucuugaguuuucaguagagaaggccugcuccucacuuugaccccggaccugcaugcgcgcugaggauggcagaggggcuccugccugucucagugcucuggggucccgugcugagggagcauccuuaugguaaacgucccugguucuguaccggaggaacaggagcucuggaggucuucuguuugcuguuguaugcuguggcucagaaguuauguggccacuuucacucccaacucacaggccagaaaguguagugggaggcugugggcauauuuggcgcuuggcaggauugaaggcgcaacucuuggcuucguguuucagagguugguaaauggagucuugcucgccaggugcaugaggugaagucacugggcugggugcagggagugaguggccaaccaccugagaauaccugguguuuccuuccucagggacgguuuggcacugggcaacagcuccauuuagcuaggguaggauaaugguaaaguugccagcagcaaugcuuuuccugcauuugccccaacucugugcagggccagcacuuuuagcuccuagucacagauauggugacaggcuugucuccaccauuggaguaagcuccagcccagcuccuggcuucugaucuguguugacugcuacccgauagagccacagucauccugugugccugcuugagucugcaccgaacauggcucuagcuucuucguuggccagacaggaucugcuguauccuuaugauaccucgucaucuuggaguccaccgugcacuuguccgcuugggcugccauaacaaaauaccagacgcugggugccuuaaaccacagaaaugcauuuucucacaguucuagaggcuggaaguccaagaucagggugcuggcaugguuggacucuggagagacucuuguccugacuucuagaugucugccuucuugcuauccucacguggugcagagcaugccagcucucugcugucucuuuuucuaagggugcuaauuccaucaugagggccccauccuuaugaccuuguccaacccuaauuaccuuccaaagaucccaccucagauaccaucgcauuggggguugagcuuuaaauacaaauuucaggagagcucaauacagcccauagcacagcgcuuccgcacacauccacauugcagacccgccauccucaaacgcacugugcucccgugagcucccugcccuggaguggaaacccugggcuggggaggaggugcgcuaagacugggccacaggugugcucugguucagaaaacucuugcagguccuacuuccugccuugacaccacccccugcccacagccuucucauucuuguccuguagcccaguuucguuucaccuguccucugccuguaauccuuuucagccccucugaagagcggcccaguaggaugguugacugacguuagcuuggcuuucuuccuaaggcaccgucuuccucauugaaacugugcccaugaccuccggaagccugccagccgccugccugcaaccccauagccgagucagcucccuggaugggcuaguguguugaccuuccacugccccgaggggaggacucugcccuacuggauccuccaccucucacuucauuuugccaguugaaauguuccccugccuaguguagggacugccacuucaugcugucuugccagagcaccuucccaggcagcugcaaagguggucuugguuugacucccuuguggcccacacaacacuuucguuggagaugaagagucucccuuucagacugcaagccccuugaggucaggaugcugcaacgaauauaauagaaaaugauguuaauauucaaggucauggccauccucaaugcagccuucauauuuucauaaugaauaguuauugugaaggagcugauuuuuggaggagugguuugucugcaguugcacacaucugugauaacauggggugggugguucugauuccuguuuugagguggugauuuaugaugccuguguacuucccuguggugcccaggccugcagauuacagacgcuguguaauuagagaaucccucuccacauguguucucugaacagggagcccagggaggcuuggaucuuuagauugauaagcaggauaguaaaccaguugugaggaacauuguauagagaaaaaacaaccuugaguuucuguugaaaucuagauuugguauaacugucuucauuucuuuaaagagcauucaucaaugauauuaaugauuuucauuuccuaccuuuguaguuuucauauaaauuagauuuacauaggagacaaagaaauccuucccucccuguuccaguuguggaacauauggucaccguucugugacugggagcauugcuguuuggcaugcuugugggcacgguuuaaggguugagaccacauccuagguggcggucacaaacccggcccagcggccucccugcuaggcaguccuccaucaauacugauguuaauaauuauguaaaaucauuccuguccgcagccuagagucucacuggagaacaaucagacaugcuuuauuuucuacuuguaaucguaaucugagugcaauuucaggacuuuguuuuccagauggcuuauuguuucacacguuuucuuuucucagugaagcccagguaaccugcugcuuggguguacgcugggcggguucgcagugcuggaagagagaguggacagauuuuacaccagcaccuuucaucucaggggugcuugugaauugauugcaccccuccuguggcguggaggcggugccugguuaaaguggggcucagaugccccuugguugcauuuaaugugugugcauaaucagagggcaaggacagcaguaaauaauuuaugucagcuggagcccuuggcccugguaaugagaucucaggggcagcgccuagagugcugggcccuuccagaugaucuaugaauuggucuuugccuuuguacuuauucaaacugacaaauacuuacuuaauagcugauuguauucaggugcuaagggaaaagaacgugacugugugggggucucccugacuccuuagaaccugcaaaugcaugaaacucauguuaagaacaguugugguucacguguaccaaacuugggaaauccugaccagcgcauccaggguugcuugggcacagugguccuuuugcaugggguggccggccaggugugcugagugccaccugggcuugcaugccggacgcauaccuggcaccugcuuccagguuggccugccagccgauguugugaucuuguggagggaaugaccccacgucucuggauucuggcuucugcuuccagugagacuccgcccagguuauguuuguggccuuuuaucucuccaaugugaggcaucucugaugaugccuaaggauguccuucuaauuuggaguuaaccucucuuucccaggugagguuagcaaauacguauagauuguaacaagagaauuuugcauuucaguuuuguuuuuuuuuuuuuuuugagauggagcucacgcugucgcccaggcuggauagagugcagugguacgaucucggcucaguguaaccucugccuccugaguagcugggauuacaggcaggcaccaccaugcccagcuaauuuuuguauuuuuaguagagacuggauuucgccauuuuggccaggcuggucuugaacuccuggccucaagucaucugccugccucggcuuccaaaagugcugggauuacaggccugugccacugcacccggccacauuuaauauuauuuaccugagauuuuugaggcaagcagcccuggggauguaagcaccuuuuaauuuggcagcuuauuugauaagcaaauggguucuaucuuaaaauccaaaguuguuuacacuuaaugcauauuuugagagcuguuacccaaaccuuuuuccuuccuucaaugagaagacuuauaucuuuuugagcagaaacuguggauucagaaaccaacagaacucuucauucuccuuaaggagauagaggccagggaaaguguuuuuagguaaauaauaacgccuucuugccucucucccuuuaucuccccauucucccugaaaaaacuacaagaaaugguaaggaagagaauaaaagaggaaaauaaaucacagauaacuagaaccacuuuauugcuauuauuccaggugaucuacugauaaauuaaaagaaagaugaauauaagcugguaauuacuuuaaaauauuccuuugugaaugugccuaauuggcgcgggccucccuguagaaugaggcuccuccugcaguucgaggagaggcuguaauuaacagugaauuagcauauaguggcgccguguggcccgcaggguggccuuguccaucugcuguguaggggacuuaggugacaccuggcuagugguagucugcaagaacccuuuguuaaugggaauauugugcaugagucagaauucagaaucuuugguaugguuuuuuuuuuuucccccuuuuguguguuuuggccaaauacucaaaagcacuaaguuuucuugcgugguaucuguucauauauugauucaccaaauauugauuguacaucugcgaaugugcuagauacccuacuggugcuggugagcagaaacaggcaaggucuuuggccucaggggguccuuggagucuagaagggauggugacauuggccagagucaccccauaaucauacaguuagcaguguggccagcgucacuuaaagcggggagguggcuggugcuggagcguguauaacaaaagugggauccggaaagggcugcuggcgagugggaguuuucuagggagccgcugcucuugcuucaggucucagauggcauaggagugugugucaucccagaggagcagcagcaaacggccugugaugggcuggauguauuuggggagggaagaaggcaguuguagcucaagggagagaaaaggcaaggagaaacauggcgaggggugggggcuuugcucuuuagcccgugagcaguggaaagucauugaaugcugucugguguaaaaucuguuagcaguuucacuuccaucuggagcacccaggccugcaggaguguggguuggcucucuacccccguugcagauuggcuugugguuuggggugugccaggcucaggggcagggcccuuuuuccacacgcuuagggaagauacgagacuggcuaacucaguauucaccgugaauucuuuugugggaaauagaacacagcguuggguaccaagagggugcugucuuuuccuguuuucuuggccuccuagggaaucaguuugauucuguggcuauuaaauuaaugguuuagcugagauguuuucucuacucagggcccaaugccguaugugauauuuuacaacaaauuugguucacuggggccgacuugaaaauagucaaaguccaaguaaacuucugccuguguguggugcgcucaaauaaaggaggcuguucaaggugagugguuuuccuggcggugugguuuuuuaaaauuucuaauaaaaugcaaaugauuacagccccuuccaugaagagugcaaguacgccugacuccuccgcgcagggaaugagcagccucugcuccuucauuugauugcuaugacaacccacagagguggguguugucacuuccacugccagccagcuugcacgguccagggacguccccacccucgguuggguuguccagggucacaugguugggagucagaaccagacuucaaagggcaugugacuacagcauccauccucccugcucugccucgcacugccuucuaaugggucccacugaggagcuugccaguauuguuacaauuggagugaucucauaugaccaaaaguuggaaugaucccauucuuuacucacagccugagcuauuuuuuuucaaagcauuaucucucuacuguuuguaggcagagaauuuauuaaaucuugccuaaauuuauccguaagcauggaucaaaugcacauuuggcaugauucucaucucugagccauugcaaccuauuuuuuaaugccaagagaaaguauuuuaaggaaguggggucagcuuuccucugcuccccugacuucacaggauagcuaugcauuuugccucuuggggagcuggguuauugugaaacuaggucaaauuauuguuuuuucucuuuaugcucauagccauuccaaagacagaauccuuuccucaaaaaaugaauuuuugaguguuccuauauucuuggggaugaacuucaagggcagaaaauaaaugaaaggggauuacuuugacagcaucugaacaacagaacaccuucugaacagcacaaacacuuguagcaaaauuaaaagaccaacaaaaauauguauuacauauagagcauugucuucuauauguaaagaguucuuauaaaacaauaagaaaaauauuuccuaacuaaaggaaauggacacaaaauucauaaaagaagaaacaaaggagcaauuaagauauaaauauauuuggcuuuguugauuaaagaguaacaauuaaaaugacaggugacuucugggccggaugcaguggcucaagccuguaauccuagcacuuugggagguagaggcaggcauaucacaaggugaagagaucaagaccauccuggccaacauggugaaacccuaucucuacuaaaaauacagaaauuagcuggguguggugacgugcaccuguagucccagcuacuggggaggcugaggcaggagaaucacuugaacccaggaggcggagguugcagugagccaagagugcgccacucuacuccagccuggugacagagugagacuccaucucaaaaaaaaaaaaaaggugaccucuuucuuuucaucugguuaaguucaguguuaaaaacaaaggcccaguguuggugaaggugauggaaaauaguuccccuuuuacauuuuagugggaaaaauguaaauugagauagccaucuggagagaaauuugucaaacaguaauaaaaacccuaacaauguauuugaccucugaccuggcaauuucauuucugccuaucuucuuuuaacccuagauugauuaaacucguuaaauaaaacacauuuguggguauagaaaacuucauagguuucuggcuuccugccccaccugugguuucauucugcccaguuguguucaacuugaaaacgcuuggugccuagcacagaguagacccuuaauaaauguuucuguccugaacagauuuaaaaacaaauagugaaaacaaaauucugaacguaugauuuuaaaaaucauuuuguagccuaacacuuaggaaacguacuuuuuuguugcuucgcugaagugaggagggguguaucuuguaauuuuuaaaugccauuauuaacuucccuagggaugcuuguaaaaugaacaaacgugcaucuuuaaauuuuuuuuauuuuuuuuuuuuaagcuuggaaagaguugaaaagucaaagucacaucagcucucuagggauugggcugggcucacauuuuaugaauuugcuguaaagaagggaaacauuugcuuucacuuuuggcaugcugaaguggcuuuaccagggaauugugacuuuaauuuuaagaauuaaucguaauguagggggaaaaauguucuuaaaacacaaaacaaacaugugugaauagaugaggaacagcaguuaaaauaauaacuuucaaaaacuagguuaaaauguccagagaauuagauuuuguuaauguucaaagcacagcuaaguuacuuuuucuacaaacaauucuugaaaacguuuuugauuuuuaagaggaaauuagaauagugguugaaaucaugaggccccaaaucagcagugugcuugcuguuaauuuuguuguuguaaagaacauuuguuuuuggccaggugcgguggcucacaccuguaauccgagcacuuugggaggccaagguggguggaucaccugaggucaggaguuccagacuagccuggccaacauggugaaacucugucucuacuaaaaauacaaaaauuagccaaguauguuggugggcaccuguaaucccagcuacucaggaggccgaggcaggagaaucgcuugaaccugggaggcggagguugcagugagccgagaucccgccacugcacuccagccuuggcgacagacugagauuccaucucaaacaaacaaaagaacauuuguuuuugaguuauaaucucuguuucugcggccuggcuaauaguuuggauagaaacaugucuugcauacaugaguauuuguuuuuuguuuuuaaaaacacuccaaauucagauuucuuuuauuaaguaaguggaugcagugcauaguuuugggauaugcaugcaugcacuuuugaauuuaaauacauacuaagauggcaguugggggaccugagucucccuuguggugcuguggguuuguaggggccggcgaguuaacugaacugaguugaguagcucacaucucguggagcaucaaccaagaggaugcaacuuguguaacugugagaagcucagacuuggaagaucugcgucuguaugugaucgcacacauuuuggagggugggaugugcucggucuugggcgcgugcaguuuuugcucccuuuuacuguuacugcguugaugauguguaacccaugauauccaugaguuacugugauuucuuuguuuauuuugacucagagcuccaaauacaugggaugcuagcaauuucuguguuaucauuacuaaaccacaagagcuggaaaauuccaguagguuuuuguaggugauuuuucgggagcaguugguuuuccuuggccuucauccuacucuacagagugaaugugacuagguucuguugucauggggcaccuggucuaucuugcaaguugaagccccuaucuguccaguuuaauugaccuccugcaggucuggucuuucuuaguuuuuuucuaaccuucacuuucugguagacccauuucacauuagugcaaaaauuuucagucucaauucaggcauaaagcuucaaguuaaggauuuauagaugaaaaggcuuuaguuauuuuaucuuuuuauuaagguccauuuuuaagcuuauauuuaaauaauguaccauaaaagcuuaaaauuacaagacuuaaaauuuuaauaguggcuguuaauaauuauuauuacugagcucuuguuaugugguauguauaaucuuauuuaacccucaaaacaaaagcagaaaucaaaaccuggguggguagaugugguagacguaauaacggcccccaaagaugucccaaguccuaaucccugaaaccugugaaugugugaccuucuguuggcaaaagaaauuaaguuaaggaccuugcguugggagauuauucugggcuaucuggguggaucugucauaaucacaggggucucuauaaaaggaggcaguaagaaugaucuuuugggucagagucacagaaggagaugugaauaugaaagcagaggcuggagugauggagccaugagccaaggaaugggggagagcgcuaggagccggaaaaggcaaggaaauggacucuaccccagaaccuccaggaucacagcccuaagucaccuugauuuuagcccaugucgauuuuagaccuuggauguaagguaagaaauguguguugugucaagcaagccaccaaguuugugguuuguuacagugguaauagggaacucacgcaguaaggacagggcgauccccacuuuaccaugaaggaaaccaacacucagagaaguugaaugauuugcccgaguucacaucaugaagugggggagcugggauucaaaccuggggcugaagugggggagcugggauucaauccuggggcugaagugggggagcugggauucaauccuggggcugaaguaggggagcugggauucaauccuggggcugaagugggggagcugggauucaaaccuggggcugaaguaggggagcugggauucaauccuggggcugaagugggggagcugggauucaaaccuggggcugaagugggggagcuggucaauccuggggcugcuggagccuaggaucuagagugcagucucuggccuggaggagagaagaggcucccugcagaugcagcucuuuuccccauguccaccccuuuaauuucaugagcauccugggcuggcugcacuagaaggggacaagauugccaagaggcggccagcugcuggagaucagcaacaccagcuucggcgcccgaauugcugcacauugucccagcagcucaagugucuaccuccucugauagcacaggugucugggcaauucugcauugcaacaagggcccuguucuacuuuuuucugcaagguuuguccagagugcgcagccagacuauaugcugggcuugguuuuccugagccuuggccacugcuggcgccccgaucccgggccaguuguucuugguggcauggcugucccaaggagacacauguuacugucucuguagcugccugugccuccagguguggugcugccuuccugggccucugcagcaccugcccucggcccccagggaccuucuuugucacagcugaagcccucgcaugcuggagacuugucauucuucuccugccgggcauggaugcugacaauagaacuacuuuccagaaaucagcaaaugcugggcugugccuucaaaguauauccaggaugcaguggcuuccugagccaccucagccauuagcacccuggucccgggcagcagcguugcuuggcggauuacugcucaccucuucaagccgaugcugcuacucuccuggacaguccacuugcccagcagccaggggcaucccugagaagccgggucagagugugaugcccucugccaaaaccuccuccuggcccucgccuucugccacucuccccuugcucauggcucugcugauccuucaaccaaaugcaugcuccugacccuuacaugucugcacugcuuccucuuuuuggaaaaccuuccugggggcccuugcagcuuggcccucgcauccuucagccucaccuccagugucauugaggacccuccguggcaccuggccuuccucccagccacagccccuccuccucaccuccucaccugcuuccuauuuccccauaaaccccagcucccugacaugucuggugucucucucuccccacuggauggaauauaagggcuuguguuugccguuuccccagcaccuagacaggaccuagccaaugcuaggcccuuugucgauguucguuaggcaugcaggugaacaagugaaugagugauccugaguuugcucugguuuccuucuaguugugggaaguaauuccugaauugcagcccuacagcuuuuauuggugacaaguucuugacuccccaucaccucugauggagggggcuggggucuguugugaguucaggagccagggggcugcaucugcguguuggcucugcugcugaaguggcuggauggccuuggagaucuaguuaauuuuuuuccuuuuuuuggagacccagucucgcucuugucucccaggcuggaguacaauggcacaaucuuggcucacugcaaacuccaccuccuagguucaagcaauucuccugccuuggccuccggaggagcugagacuacaggcgcccgccaccacacccggcuauuuuuuguauuuuuaguacagauagggauucaccguguuggccaggguggucuugaacuccugaccucuggugauccgcccaccucggccucccaaagugcuaggauuacaggugugagccaccacgcccagccgaucuauuuaauuucauugugccuugguuucuucauauguuucaauaaaauggguauguuaacagucucuaccucccagagugguugggguuacgugaaguaagcuuagacacggccgaaugagccagagccucugcugcugccauuggcguuggcaccauucuuaccuccuauaccuacgaggcugucaugugaaugugucaagggcccugucacgucucugagccggcuucucugggcacuggcugggcugaccccaauggccccugcccaucaugcauuuaggggcuccucugacuccagaugucagugacccuucuggucucuccaacacaaggguuggucauucccugugcccauuguucaugcauuggaacuuggagugccugcucucugcccuggguuuauguccuaaggauuugaagauagaagaggcacagcagucacuugggagcuauucccagucuaacaggagagggcacauggcaguaacccccugggagcggcugcugauguucuggcucucugcaguuggguaggaguggaggaggggugcgaucggaagggagugccgcgcagacccccccacccccucagaacagcggccacuguguggauguuucugacggccucuuacagacucuguccuuuuuguuguagcugauggagcagaauuuuaaaugcauuccucuaacuaguggucagcuugcuacuguccaaccuaagcucauauucaacacuuuagaaugccuuaaucuuuucuuguuguguuuugaauagguuacaugcagacauccaaaauaaacuuuuuuuuuucuguacaaaauuagauuuagcuaaaguagcuuagguuuuauaaaagcugauguucuucaugcucuucccaauuuugggaaaggagccuucgucuuugcuuccuaggaauggucauagucacaccagcccuccugcuggcuuuguagaaugcucacaguggaauagacugucagcagguccugagaugugacucuggacagccaguggucuguagcauucucauccuucagagcucccugagcuucuucacggccacgcugcucuccugcauguccgcccaucucacuggggugaugaauggaucuagaccuggugccuggacucaaucugcagagacaggugucugggaucugaagacagcaguuggggaggacaguguuggcugcugcugugcuuccuuuaacugaaccccgguggcccaguugcuccucuugguggacucacuaagucaacuuugacgcuucagccaacgucgguuuugagaaugcgaccuaugaaauugggagcccuggcuggaucagaagcacaugguucaguggacacugucagaggugcuguggaucacuuggaccacgguagcuaauguuuguagcgcgcucacguaugccagacucuucuuagcgcuaagccauuuucccaggccggguuaugcagugagacuucagggcaggcacacaugucgcuuccugcacccacacuggacagucauuguagaaaguaagaugugauguuaauagucucuucuuggagucagcacugcuucacgguccuauuggcaugagaaccacguccccagcuauucccaccugcacacuggagggaagcaggaggggaacaaagucaacagcaaugacugucgcugaaucuuaaguuuauucuggauugagaaaaguggaagagguuagaagcuaacuuggacauucuuuuugggggaauagaugucucucaugcagcucauuuuccaguggauugccugauguucuccaggcugcuacagcuaugauauuuuaaaaucaaugggccuuuccuuucauuucgaacuuucaauacagcugcagaaacaaugcaucugaacggauggacuguuuuggagauuuaugcguguucugcaggcugaccucugcuuguugaucguauuacagcauguugggcaugucaaaugaaucugggcguuagccuacaaaucaagauuugcuuugccucguuguguaaauaucggcaaaccauguuuuggggauggaaaauuaguuaauuuggagaugguggguuauuagacuucacuuggucugcacgugguggcuuugggauuugcugcuucaagguuucaggaugacacaagccaucggguugaguguguuuguuucagccccucuugcugagcacuucucucuuccuguuccugugcugcugggccuucacagcauggugcucccaagcuaguugcugaagcugugggccauugagccagccuggagaugcaugguagguuagggugcuguguugcaggucugugaugcaguugccauauauuuuuugacuuuuggaucuucacuccuccccucauuuuggacauuuucucagaaugaaugauacaucucugcuuucagccucccuaagccauuaauuuacaugucagauuuuuuugaguauuguaguuuuuuucaauauuuauggaaugcuuaguauuuguaaugcaacaaaaggucagaauuaauaagguguagugcccaagaggaauauuuuguuuccauuuucaagaugauuccaauuugagcugucuccuggagaaguuggauccauuuguguuucugagugugcuuguaagcagucuuaggggaucugucacugcuuacuacuaacagaagaacaccaaaauaaggccaaccugcucccaggcugaauccaggagagccaguggccaaauaucagcucugcagccaccguugcaagugagacuuugugaaaggaaacuucucaccauuaaauguacauuuuaucuuaaccguugaauguacaggaugguucaaauacuaaaaacuggagaaaagaccaugauggaugucauuucucccugaugggacauuuuaccauauuugcuuucucuguauguugugcguguugguguuuauggaagaaacaccuacagauacaguggaaguccccuugcccccuucucuguucuguugaagauggucugucuuucccaucuggaucucuuuccuccgcuacuucuguguccuuagacaguagauggugcucugugugcaugaggggaagcaccuacaguggucgccugcugaagauguccuucagugguuggaauggaaaaacaauuguucugcuacauguugcucugguucuuucauuuuaccugcucuagaauauuccauuuagaacuuaaaauauuucauuacuuaaauauugcuuuuucuguucugugugcuguaaaguguaugugcgugugugcuggcauuguaauguuugugcuuguggggaggauggaggagauucugauuuugccaggggucucagcuacagccccucagaucauugcaggugauaggguuuggaaguuuguccccuucaaaucucuuguggaaaugugauucccaguguuggaaguggggcauggugggaggugauuggaucaugggggcagaucccucaugaaugguucagcaccauccccuuggugaugagcgaguucuugcucaguuaguucaugcaaauucaauuuaaaggaguaugccccuuccccacuccccgaccccucuacucaugcucuugccaugugauguccugcuccuccuucaccuucugccaugauuggaagcuuccugaggccucaccaaaacagaugcugaugccaugcuuucuauacacucugcagaaccgugugccaauuaaacuucuuuuauuaauuacccagccucagauauuccuuuagaguaaugcaagaauggacuaacacagcaggugugaucauuggaugaggaaggcucucggaaucauuccaggugccugcucuagacucuugguguugcucuucuuuccuucaugaccuugaacucucugacuccagcaguccccucugcacaugccugaacugcuucagggcacccuacaggucacucaggccuccaacucuggggugaugccuuuagcagcauugaguauaaggugaccuggaggaggugugaagaccugcgcauguggacaguuugaaagccuagcugaggcagcuggaagaaauucaugggaguccugcaucgcugaggucaggggagguucuguaaaucugggagaaaggugccuuuccuuuggagggaugguggguuucaaugguuugaaagagaaaaccaugcuuugcaugugucuuuuuaccaacccaaugagauugcugauuuugcaaguacaagucaccagauuuuaguuguuuauaaacuucagcuuaaaaggugggguuaauagggaacaacauaaaugagggcagguguguguuucagggaucuuugugcaacuuuucuaaauacagaguugguugugacauauucagcugggggaaaauagucgucugaaauauauuaugguuuguuuguagcuucagcuaguacuuuucauuguaaucauggcucagguuucuaagagaaaauuaaaauaauuuaggauguugccccacacuauugggagguguagauguugcuacugcaucuggaaagcauugugacaacaugugaccaaguauuaaaaauguucucacauuuauucuugaaauuccacacagagaaagguguuucggggaaguagaauauuagcagagcuauuuguaaaaauaaugcacaggcauuugcugcuguauccuaugagcgaaaaauugggaagugugauaucugugucugccuccauacuguacagaaaucacugaauauaggccagugcgguggcucaugccuguaaucccagcacuuugggaggccgaggcagguggaucacuugaggucagcagucuagaccagccuggccaacaugacgaaaccccaucucuacuaaaaauacaaaaaaaaaaaaaaauuagccgguuaugguggugcauaccuguaaucccagcuacgcaggaggcugaggcaggagaauaguuugaacccgagaggcagagguugcagugagccaagaucacgccacuguacuccagccugggcgacagagugagacugucucaagccaaaaacgaacugaauauggcugacacucucucccucauaagcuugcuuguuccauuaauggggagacccauguaaggucugggugcagugcauggcacaugggaagugugugugacaguuaaugguggcguuuuuuaaaaguacauaugucuauagcagucuggaaaggcauacgccagaauguuuguggcagugacaguggauuuuauaagugauuuuuuucccuuuacauuuuuucuuaaauaugcauuucucuuuuccucaaugaacacgcuaauuaugugaacaguuauuuaagaagaaguaaccugaguaauacuaaaaauguauuuucugaggggcgaaaguauaguugaaguaaaaaguuuuagugcacuuuccagaaugggcuggauggugacuauuuuagguuuugaggaugguaccgucucuggcaacuccucaacucuuguagggagagguacagacacaaauuggcauggcguguuucaauaaaacuuuauuuacaaaaacacauggugggcuggauuuggccuguggcccauggccugaucucuguucuaauaugucccauuaaggacuuuuguuuuugaaauccacugauagugggucauuccagcgcauagauauguuggguuuauuuucacuguucacauaacguaaguuugaaacccaacugucuuaaguugaaaaguaagacauagcguggauauuguuuuguucuuuaauuuuacacugcagaauccuuuuaagaaaacaauucagucuaucuuauaaaggggaguggcauuguccccugcuuuuccugugcuggccccaggcuguuuugagguuuuuuuuuuuuuuuuuuuuuuuugauagggucucuguugcccaggcuggagugcaguggcgcgaucuugguucacuucaaccuccaccucccggguuuaagcaauucugcaaccucuaccucccgaguuuaagcaauucuccugccucggccuccugaguagcugggaucacaggugugcaccaccacacccagcuaauuuuuguauucuuaguagagacaggauuucgucauguuggcccugcuggucucgaacuccugaucucaagugauccguccaccuuggccucccaaggugcugggauuacaggcgugagccacggcgcccggcuauuuugaguucuuuauguugggcaugcugaucccccagccucagcgucugaucgucuugguaccaaguccacugcccguggggcuuauuuuguggugugaggugaagcagcagcaucuguugauuuuggggucugugucccccagauugcccaggauaguaauaguaaaaugccucguccccggcucagcccuuagucucccauugcaauacuccuguuugagauuauucacaguuggggcucaugucuauugcugagaaagagaaaugguuuuucuuggugauuuuucucagugcuuugaauguuauuuuugaguucuggccaaacagagaugggacaaggucagaacuagaaaaauauguccuauaaucuucucaaugggagggaggaagagguucccuuaggagcaugaacuuaggaaaggaaauggugcguuugguggaaaagaaggggggcauaggcugaauugggacagugcccuugacugacacagggagagggucugagccccccaugcacuuacugggcaggcuuccccccgaagcaagguggaccugcuuccagugggaggagaagggggagcacuagagcccuccgugagaccauugacugcacugggguaguucaguggugagcggauggggagaaggcagggccagcccccagcacacgucaggcacugucugggcaccugugcauugcugccuacaguccuuucagagacucggcaacucagcgagagucccucacuugccugugagcugcuccacuugguggaggagcugcuggggcagaggauacugagccugaccacugcccugugcuuguuccuguccccauggaggagcacuggacuuguccaggggcaccuagcagggauccagggacccaggcagggccggaaaggggauguucuuugcauggauuucugggaauguacuuggcagaagggaagccugggagugagcuccaggcagaagaacaagcagguggaagugcccgguucuggaagagcccaggguaucuuugggggaagauggagacaagauuugguggguccuugaaugcucuggaaagaagggggagccauugcccaccucuuuuuuuuuuccauagguuauuggggaacaggugguguuugguuacaugaauaaguucuuuagugaugacuuguagagauucuggugcacccaucacccaagcaguguacacugcacccuauuuguagucuuuuauccccugcuuccccucccauccuuccccccaaguccccgaaguccauguaucauucuuuuuuuguuuguuuguuuguuuuuugacuccguuacccaggcuggagugcagugcugugaucuuggcucacugcaaccucugccucucggguucaagcaauucuccugccuuagccucccgaguagcugggauuacaggcgccugccaccacauccggcuaauuuuuguauuuuuaguagagacgggguuucaccauauuggccaggcuggucucaaacuccugaccucaugauccagccgccuuggccucccaaagugcugggauuauaggugugagccauuguaucauucuuaugccuuuguguccucauaccuuagcucccaccuauccgugagaacaacaauguuugguuuuccauuccugaguuacucagaauaaucgucuccaaucucauccaggucacugcaaaugccguuaauucauuccuucuuaaggcugaguaguagucauuguguguguguguguguguguguguguguguguguguguguguguguguguauguguauacaccacaguuucuuuauccacuuguugauugaugccacugcccaucucuugagaugcaacaggaucagacuuguuggggagcaaggaggaaaguggguggugggaggcucuggcccuagucagacaccguagaccaagaaaaggagaacaggacagagacaugaaaaucagcaggugaguaucgaguguccagcacaggggccagguguccagcauggggacuucaugagguauuuuaagaguaagaagucauugaggggccgggcgcaguggcucauaccuguaaucccagcacuuuggaaggccagggcagggggauugcuugagcccaagaguuuaagaccagcccuggcaacauaguaagacccuaucucuacaauaaauguaaaaaaaaaaaaaaauagcuggacgugguggcguguacuuguagucccagccccucuggaggaucccuugagccaggaggucaagacugcagugagccaugaucauacuacugcacuccagccugggugacugagggagacccugucucaaaaaaaaaaaaaaaaaaaagaaagaacagaaaucaccauugauaauguggcaugaauagacuucaugacagacauuacuccagagauuuuuaugaugcuuuauuaauuaaaguaucaucuucaaagcagauguuaaccacuucaucacuguauacaaaaugucugauuacauuuaauuuuuuuuuccagcaggauggaaaugcauuaagaugaaacuuuaaaaauauaggacuguagaaagauuuugugccaaauuaaacauauacugaaacaaauaaguuguuuuuugaaaacccagggagcuaucacacgauuguuaauauuuuaguggaauuccuccuaaacgucuuucuguacuuuuuuuuuugagacaaagucuugcucuguugcccaggcuggagugcaauggcacuaucucagcucacugcaaccucugcuucccggguucauccaauucugccucaaccucccgaguaguugggauuacaggugugcaccaccaagcccagcuaauuuuuguauuuuuaauagagacaggguuucaccauguugaucaggcuggucucgaacuccugaccucaggugauccaccugccucggccucccaaagugcugggauuacaggcgugagccaccaugcccggccccuguacauuguuuuuuuaaagauguuugagauaggguuuguagccuuauuaacacauuagcauuuuuccgugucguguuguaauauugcacauccauguuacugguaagcuguauuugagaaagaauuaggggguuaguuuggggagcagcagcugaugugugccucaguucucaaguuaauugguccugcuccuucucugcccuggugugccccucggcucgccacuggcuuaggugcagguacauuuguccuucaucggaacaggaccacccucccuuggcugccaccauggcaacgcucagccccgcugccuccguuugucauuucuccuccuaaugauuugaacugaggucugugugcuggcccagcccguugcgggucugcauaauguaugaacacgagugacagccagccgcagcccgaucaaaacaaagagccgcugcacgagaggggcagauugcggaagcauauugugaacacauucucugguaacugugaaucgugucguaaaacgcgucuuuggccugucaaaaauauuuugacagggcccacagucuagcuccuucauaugcaaaugcacugguaaugccuggauaccaggguuacacacucagggaaaauccacaggacgagggcugauguuagcaggguucauuacuucugcaaauaaacacguugaagagccuccuuccaguggguaaauggcaaacucgauaacuggaaugcugucagaucccaggguaacaaaagggugguguccccuaaaggcuuggaaggauugaguuaggagaguucaacugaaaagucaagcauggcgcaaggaaggacgauggauuagccaaccaugaccggccaggcugugcgagcuagccaaggagaggccacgaggcgggagagccaaggaggacagccuccgggugggccaucacugcugguagagaggguuucugggucccaggaccggacugcgugguccugguuauaccugcuggucaaaggucagucugccaaggccccuccuugugaagauggacacugagggcacccuuccuagaggaccuauuuccucuuggugcucuucugcuuuuugcuucuucccugggcuugcuuuccgugugauucugggcaaguugguuaaccucucugugcuuaggugaccuucgauggcacgggggauagcaguaucugcuucacauggucagaaaauucugugaggugacacacggagccuuggagcugccuguggcagguggcggugcuaauuaaguuccggcuguugugacggucuccucggcuggguggcccuuccugcugucagguguggccacucucgugagaugcaacuggagguguuuuguggcagcuucuggaaggccugccuuugacccuuccuuucugcuuuuuccaucuguuaccugcaugcauauaugauggcuggccaccaucugagacugggacagcaagggucauguuggcauuggaaggggucuggguuuauggggucaccagccucaagggacagcccaccuggagauuuuguuaagggguaagagaaauauucuucugucuuguauaagccacuguuauuugggguuuucagacauauguggccaagugauucuaauuagcauacaaggugagaauguguuaucugcaagauccagagcuuagccgcccuggcaguucagugacuuaaggggaguuaaugaacugguuuucugacuucaucucccaccaccagagcaguguucgcaugaacugcccagccagcuguccccaggagcuaaagaagucaguuucugagcuucagagccuuuggcuauccucggggugccucagaguagugagggcagcucugggggacugggaccucucagccuccccucugccuguguguuccuccauggagccccuguuucgccacguccauuacgcuugcaguagucagcaacugccuggugagcuuuacaugccugaugggcuuuggugagcuggcaagucugaaacacaccuggggucaucugugaccaucugcugauggccaaguuugauaggguuuauuuuuccuuucuuugcugaaaucgggcuggggucuuggcagcaauugggaaacuuugauugcuucaguugcuucaguuuuucuagcuccaccuggccucccucuggggaccacgguucugucaccucuccugcuauuuagguggccguguuucccaugcuaaacagugcccgcugauuuaaucaagagacuugauagccggccauugcacguucaucagcccgguuuuccucuuguggcaccugguggugugcuggugugugguuuauaaaacaugcucugccgcuuugauuucccugcuuagauuuacauaauuguuuuagaagaagguucaggugcuuugcuggcagaaaaaggaagacgaccucuugcaaagugggguuagcccuagccuugcaggaaggggucucggcuuccuuccaaaccagaagcccguggugcagccucugaacccccgacucuuggugggcuuuugaguucugcuuuugcuugaacuucuagcggcagaaagggggugaucccuuucuucuccaucauaagggucauggcccacaucccuguaacaaaagacagguuaacgagagaaaagcauuauacauuuacuugauccugguuuuacggcaugcgggagccuacggaaugaagacccgaagauucaggggaggucgucugugugccuugguuccaugacuugggggcagccaaguagaaguggaauuggacaaauagggcaugagcgggccgggcgugguggcucaugccuguaauccuagcacuuugggaggccaagguggguggaucaccugaggucaggaguucaagaccagucuggucaacauggugaaaccccaucucuacuaaaaauacaaaaauuagccaggcaugguggcgggcuccuguaauuccagcuacucgggggcuaaagcaggagaaucccucgaacccaggaggaggagguugcagugagucaagaucgcaccauugcacuccagccugggugacaagagcaagacucugucuuaaaaauaaaagagcuugagugaauugucauagauggaguggggagaccuacaaggccugucuguucagauuccucuuggccucuguguaacauuucuuccucucggguaugggaugggaccccucuggaaugagggucuuaauuaccuuaugacagcuuuaccuaaaaagaugggggaagguuacaguaauauuuuuaggcuuauggcuagcuuuggggaaaagggguuuugguuucuaugaccugucuuagggaugaagaauucuaguuccuguggcucaggggagaaugaggggcaagagaucaggagagcaggagaagcucagagagaaacuuggcugcaucugaggguggccuuuacuuugggguaucaguuuuccgagccccagcaagccccucccugcaaaguugcagcccccagcaagccccccgccgcagaguugcagccuggugcccugauuuucuaaagaucuugggugggcggggcccacaggcaugggggaagcgguagcugaggcuuuacggcaaguuguggggcuucucacuugauuuucccacaauuaaucuugucugucuccugaauuucuucaaguccugaugauaaauuauggcauauauuccagaauacauguuugaguuugcauuggugcauugcuagaggaaagcacccaguucacuguguaucucuguguaccuguguauuucaucgacacauccuuuggagucuuaaacacagcagcagcacuguuguggugauaauuacgcacccugcauaugguacuguuuaagcaacaaagagcugagacuucggaagguucccaagggcaucccugagaugggacucgguccugucacaagcagcugugggagcuggagcuuagaagcuguccaucaaaaaaccaaguuuuugugucaaaauggagucucucaggcugugaagcaagcccaucucuaaucaguucagccaccuguauugcagacuaauugugaccaagacacugcgaaucaucagagaaagcugagccuuguagggaaucuggggacagccguaaguucuuccuccacauuccauuuuagagaggcuuguguuccacauuuuuguggcuuuuuccucaucagauuucucuguguucuugcuuuaguuugaaacugagaacacuaauuuuuuuuauuuugaucaaaauaaaaccaucuuuucaaaaugucaaaauguuuaauuuucagagagaauugaguuuacguaccacgaaggaggcucuguuuuguuccggcacacgcuuuggcugguuauugguguuaggauguguuuguuccauguacgaguggauggagcagacagugccugguccacccccaccuccucacccucagccucccccccgcuguagacaguggccaaccguguguccucagaucugcauggaauuuccuguggcgcuuucucaauucugggaccaguuuucccucugaagcgugaauguuuccucuccaguugggaaucuccugccucaggaccugguggucuagagguacugugguauaaguagaaagagcagcuggacuuagagacaggcguccugaguguugaugccagccuuacccugacccuguguguggcagcagugggucggucaaaccuuuccaagccuccguguccucaucugaaaaugggaaugaggaugccuauccgaggugacuuagcagaggaugaagcacucccgugagugagcugcgcacagucuccuuguacaagcaggacauuucuccguuucuccuuuucucugcccguaggauugacuuucaucuugccugguaauaagcccuccuaggaaaacaaauuacucugaaaauuugucauuuugguguggugaauucguucuuuuauucaucauccaaaaaguuccauuguuugagaugauucaacaugauuuggaaaccaugggguaagucucugaggaacaagaagacagaagaaagaacgcacuuugguuuucuuuuggaaaccuagagcaaccuacuagaucaaugaguuuucuagggaggcaucagaguuagccauggcaccuucuccaaagcugccucgcuccugcacugaugcugugcuaugaggagccacguugcccggaagucugaugcgugaggcgggaagguuaaaacuuguuggcuuuggagguuuacugauaggucguucugaguaggacaaauguuuuccuuuccgugcuuuaaaagucucaucuuagaccgggcacagugacucaugccuguaaucccagcacuuugggaggcugaggcagguggaucuugaggucaggaguucaacaccagccuggccaacauggugaaaccccgucucuacuaaaacuacaaaaaugagcugggcaugggggugcaugccuguaaucccagcuacuugggaggcugaggcaggagaauagcuugaacccggaagguggagguugcagugagccgagaucgugccagugaacuccagccugggcaacaagagcgagacucugucucaguaaauaaauaaauaaauaaauaaauaaauaaauaaauaaagucucaucuuauggagcaaaagauucuaaagagaaaggcugguccugaauuucauccagcuugguucugguuucuucuccuuucuucagcgagugcagggccuuuauccuuggggcaccuuucugggacuuuaucuggcugugugcagacagacaggaaaguguccccugcccccaauuuuugggaugaccacuaaaaaaugaacacacccacucagggagcguuugugggaucacugaagucaaauaauuuacacccaggagaaagcccuucgcuguggauguguucaugccuguggaaagggaaguuggcuaucuggucucgaacccucagucacugucagggacggcagagaacucauccagaaaccaaguguugaugugaagccuccccuuccagaggccccccagcguccacuccccuaggcaucccucacuucuggacccuccacaucagcaucccaugacauugggcuagacucacuguuccaggacuccgcuggcccagaggugagucggccugaccaagucgucgugucaucacuuguuggggguugaaguccuaacgcccggugccuaugaaugugaucgucucucagaauggaaauaaggucgucgcagauguaauuauuuaggaugaggucaugccagaguggggugggccccucaucuaauaugauggauguccuucugagaagggaaauuuggacgcagaugcacagagggagaacaucaugucaaggcugcgguaaugcuucuacaagccaaaaagaaugccaaggauaaccagacagccgccagaagccaggacagaggcucgcagcagacccucccucaccgccccuaaaggaacccgcccugcugacgcuuugaucuuggacuucuggccuccagaacugugagacaauguaugucuguuucugaagccacucagauuguggcacuuuguuagagcagccccaggaaacuaaaacgucaccugacucacugugggauucagcaucuuguacgaggcaggugccacuggucucaguuucuuugucuguaaaaugaggcuaagaccugcuuuauacagugguagugacaguuugcccagcaccuccuaggaccucaaaaugugacuuuuuuuaaaagacagagccuuacucugucacccaggcugggcuggaguacaguggcgcggucauagcucacugcagccucgaccuccuggguucaagugauccuuccaccucagccccgcaagugacuaggaccacaggugcaugccaccaugccuagcuaauuguauuauuauuuuuuuuuuuuuguagagacagggucucacuauguugccagguuggucuugaacuccuggacucaagcuauccuccugccucagccuccugaguagcugggauuacagguaugagccaccgugcucggccuucauuauuauuuuuaggacaaaagugaagguggaaaguucggaccagugggcuguauguuucagaacuuuacacauaggaagaggaaguauuguguauggaagaaagugaguguugcauuauucaggguucucagagaagcagaaccauauggaagaggaggucuguuaggggaauugguucgugagauuauggagguccagaagccucaugaucugucugcacacuggagaacugggaagacugguggcauccuucagcccgagaaccaggagcucugauguccgagugcaggaagagacagauguuccagcuccaacagagagagugaguuugcccuuccuccaccuuuuugcccucuuuggguccucaguggauugggugaugcccucugcaugggugaggcagauuaucuuuacucguucuacugaucgagcuguuaucucuuccaggaacacccucauagacacacccacaaauaauaucuuaccggcuguuggggcguuccuuggcccagugaaaugcccagucaaacugacacguaacauuaaccauaacagguguggguagacagucaggagagcaagacucuaguugguucugucacacagcagagcugcguggccuggguauacuccucccaucugccugggcugcuguauccugggcuauaagguaggagguucgaucagauuacccugagaugugcugugagaggugaguguggcccccucacaguugcagcucuucgaacgggagccuggagacuccaggccuaugucuugggaggugcacugcacaggguggcugcucuguaaaccuugacugaagucguggggaaaacugcagugugcuccaagaacaaauugugaauagagacuaguuaaaauaaacaucacaauggcgauggaaaauguuauuucacuuuauuaaguuaaaaacaaguuauaaaauaguaggucacauauaagcucaguuuuguauuuaaaaacccucaaaacuguauauaugcccagaaaaaagacaggaaagaaagauaccacaguaugaauggugguucccaauuaguaggagaacuaggagccaucauugucuuugcuuuccagagaauaauagcgugguguccuggagucacauggcugcucuggcuugccaguggagaacaggcugaggccggaggaggagggagcagccaggaagcugguuacaacccaggcggagggcuggcgugggccucaggggucuucagccucagcacuauugacauuuugugccggauaauuauuuguccugugcaugucaggauguucaggagcaucucuggccucuaccuacuagaugccaguaacaucucuuccaguugcggugaccaaaaaugucuucaggcaauccagaucaaauguccacuggggggcagaaucaccugcugagacccacugguuaaaauagugucaguagggguggagagaaggggacaaaagagucuuagagccauuugagagggagcuucuagaggacuugauggauggaauuuggucaaggcaggaaugaggguggauguggggcauggggaauuggacggaugauaguggcccacagguugagagaggggauggguucagcuuuggccaugcuguugugagucugugguucccagggagcagcugaguaggcuguugggugagugguucucaagcucagagcugagcugggggcauccauuugaagguuaugggaagauggaaagcacgcccuggaggugggugggugagcucacccaggaccacgguguggccugagaagucggccugcgauagaacccggggaaucccaguguuuccagggugggcagaggaagaggaggcugggaagggaauuuguuucucuggccagagcuguugcucagcgacuguuggcuggugaggaugaggcucaugaacagauguggaaacaucgugggaugaucucauggugggugggacuugucgccgucaugcacucagcacucucuggccuuuauuggucaagcugccugcuguguuucuggugcccaaauguucugggcacacuguuguuuggggaagaaucgcagggacucuccuucacucuuagauaguggcagcgcuugccucgcugcaucucguguucucaaaaucagcacaugccaucccacauucuagaccauccaguuuugcuucucaggcucugaaaaacacuuuuaagagcagguuaaacuguucucggacuucuuuuuggauuauuugcaacgucuugagggguccacggauugauagagucagcagggauggacaguuuccccuucagcaccuuuauaguuguaauuugcccaugaugggguuagagacccacaguugcucaaaagcaguuuuuguuuuucuugauagcuggauuuggguuaucucucaggaagcgguuagcagucuuuagggcaaccuaauugcauuucuuuguuuacaagcacuuaacuucaucccucucaggcgcacaccagcacugucuaucacuaauacuggcaguucuagggugagguggacaguugcucuuagucagaaacucacuuugcuguuuuccacuagauucccagauagagaaggacaguuguuucaggcaagcuuaagacccuguaacauuucuugcccuuuuugauuugaacucccaucucccuagcucuggcuuguuuuacccugcaguuaaaagagaaaaugaucucuacuggcuauauggccucaggccaggagaaaaggugcuguuccuuccagcagaaauucaaggguccagggaggcuggcccaacccaggucagaaggauaaucucagaaaaagaaggaagcaugcauuacccaucucagaacuuaggaacaagaaaauccuaaaacuccaaaggaccauuuuuccccacugacaggcccagcuuaauuagagaccagcuaggaguugcauuuccugguuguuuacugacuguucucuucgguaaacagcuucagccuguaauuaagcugucuaauuggcaaugacugcaggaaaaaccaugaauggggcuggccucccucucuagccccugugucugcugucuguuaccuaccaccauuuuuauuccccugucuucuauuaaaaaugucgugggggcaaauucuaaagaauagucuaggcaggcaaacccuuugaacuucacuuugcaaaccugccugagagugagucugagaggcaaauucuuuuucuuuccacuugaagaagugucagaaauuugguggauuggaaaagaugggagagaaaaguccaggaguccugacugcuuucacucauuuaggugggcuggcaagcagugcuggcugcuccaccuguuuuccugccuaauaacagugucuuuuauaguugucugauaacaaugucuuuuauaaugucucauaacucugccuuuuuguaaugaccggccuaauaccuuugccuacaauaguucuuuuuuccucugggaguuuaacucagguugugauuagagaguauuucccauaaaucacgcaaagcacauguccugcccaccagccaauuacagaaauggaguuggucagaccuacacuuuaucugaaacaaugcauaaugggaguuuugaacuaaaaaaauuacccucuaauguuacaaauaugauucaggcaaauaaaacugcagauguauguguaaguccucaguacugcgauucuuucuuucucucucucuuucucuuucuccucccucccucccucucuuccuuccuuccuuuuuuuuuuuuuuuaaguguccugguuguguuaggguaauuugugauuuaaaaagaaaugccucuccucuccccgacccgauuuuuuuuuuucuuuuuugguaggaugccucccuuugcauuccaaggcagcacuucaagcagcacuuugguaaaugucaaaaaguuggagaggcugaguggguugcguggcccgucugugccugugggcuccucucccgcccacgcggcugugccucucacucagaacccugccucucuuguguuugucccaaggcuuuacuuucccccccacauacguucaguggcauuauuuguuacauuuuuaaaaauacauauuuuauuuauuucacaaacaauguuacuggcauaauguuaccacacuauaggauauaaugguugaagaaugauuucccauaaucuaauuucaacacauuaccugauucaguauucuguguccucuccagccuugcuuuucucugugcacagguaugaccugauuccagugcuuuuuaagaauuauuagcauuuucugcauugcuccuuggccuucacaguuaucauuugaacaguggcacaagauucucugaaacugcuccucugucuucauucccauuuugugagcauuuaagccguuuacuguugauuguccauuucuucagguaucuucuuacaucaucuugcuucuuuacucagcauaaagccucguaguagauucucaggucccaggggugcacaugccuguguuuuuaccuuacuuccccaggggcccuccagagggugcccauccacggagugcggcgccugcucgacuuggccuucuggcacuggggauuccucucccaagucuugcuagcucguggcaugugcaaugggaucucuuuccugagugcgcauuucuuuccucacauuugggggcauucagugggggaggauuuacaaagaaacuugaggugaggggcccucugcacucaaccuccugggaccuggggcugcacccacuggcauugauuagaagagagcuugugacugaggaaaaccuggcuuagggauuuaucugcagggacuguccccaguaggucuaugagagcccaccacagcagcagcccucuggauggggauuugggucuugguuuugccagcacucccaguggacagucaugccuggacuugucuucuccaccuuccacuuguccuaacagcugucgggaccaucauccaccaggggccagcuguccagaggcagacccacccuggaaggcaggccagccuccgcucuccacaccagcuuggggaugaaucagcgggugcucugaccacuacuuucccaaggcuacuuugcuucaggaaguuacagcagccauagaggacucugcuuaugugagaugugcagacauaauucuugcuuuuagaaggaggggggaaaauagagaaguaguuaucucauugucuuggaauaaaauuauuuugcuuugcaaagauuaggcaaaucccagguugcugagucuuggcagauuucucguggccuagacugugguguuuggggccgccugucuguaaugugcugccaugacaaggcacgguggugguggggaccuggcaagguaccgaacgguggaggugacuguaggauuagccccggcuuugcagcagguuuucuugggaggagaaaauacacaguugggacagacuccagggaccagcuccuucccccuuuuuucuauugcagagggggaaacugaggcucagagagggggacuggcugugcauacauggauucuuugaaauuuuaaaggauggccaggugcaguggcucgcacguguaauaccagcacuuugggaggccgaggcggguggaucacgaggucaggaguuccagaccagccuggccaacauggugaaacucugucucuacuaaaaauacaaaaauuagcugggugugguggcgggcaccuguagucccagcuccucgggagacugaggcaggagaauugcuugaaccugggaggcggagguugcagugagccgagauugugccauugcacuccagccugggcaacaagagagagacugggucucaaaaaaaaaaaaaaaaaaaaaaaaaaaaagaaagaaaguuuaaaggauguuaaaaauuuuccacacauuaucuuuuaauguguugucaaggagcaaugaucaucauaauggcacuggggaaauggaaaaaacuggaaaacucucuugguuugacagaaagggauagaucuaacuguuuaguguugccaagugagcccccaaacaucuccccuggaaaagucauuaggaauuuaccaucuccaucugcaggggccaagugagauaaccguaucuaguauauccaucugagcaaaacccuguuucucuucccuugaauaggaagccagaaacugcugcagcgcacuguugaaacauagcuuagaaauagauacuuuguggggggaaaacaaccuacuuaucuuucccauuaugcuaucucuuaauagggccccugguaucugagccagcauacacauuugguucuucuguguccugugaucuuccucugagugaaaacugauuaucuacucaaaggaagcagaugacagagcccccgugaugugugcugccuuugcucugugccucuguaguaagggaggccuggaaugagcagaaagauggcuccccuggccacaaaggggggucagucuauugcaaagcagccuucacguucuggaagcagggagcagugggagcccgggaaggucagccuugcagacuuguagaugucauaggauuauuugagcugcuuccgcugcaggugguugggaaguacuggauggaauccuuggaggcgagaugagaggaugggagaagaaagucuggaagaacaguuagauuucuuccugauuagauaauacugagugagagugggaagaacggagcggagccuguugccagcgcgaucucugucccguucacugucauguggccucuucacggaugugugugugucugcagggacuccugagagcucuuguugauguuuagcccuuggaccugcuggugcuuacacauacguuuccauggagucuguaccaaaaccacagaggaucgcccccguuuaucugagaguagcucaucaucauucucugcuuggguguaaauagcucacugcagaaucuuaauccccagaacuggagaccaaccauuuucucugcacuuggagggaaccauucaaacaucccuguugggcuagcaugaggaaaagccaagucaggcgcuuggccaccaggggaucuuggcaagagaggccgugggauuugagaguuagaacugauaugcagcacagugcaccuuggugccagaguucugaccaguaguguugcguccauugguccacuaugauccauggauugggaaccccuguuacugauguguugacgcuauagcaauauuauggugugucagcuucgcugucuuucaaggaugacuugcguagauugcauuuaaguauaguggagcaacagcaaucaagguguaagacuuuuuuuuuuuuuuggagacaagaguuuuacucuugucacccagacuggagugcaauggcgcgaucugggcucacugcaaccuccgccucccagguucaagggauucuccugccucagccugcugaguagcugggauuacaggugccugccaccaugcccggcuaauuuuuguauuuuuaguagagacaggguuuuaccauguuggccaggcuggucuagaauuccugaccucaggugaucugcccaccucagccucccaaagugcugggauuauaggcgugagccacugcacccggccaagguguaagaguucuaaucuuaggccuucauucugccauaugacaaacaaaguagaauuacaguugaaaacuaauuaacucuacauaaaacaaaaaugaagaggugggcucacauaccuaucucaaaguugcucuggaagauggauuuagcccauuuaaaggaagcuaagggauagaauucaugagaagugaggucuccggcuuuguauuuauuagggcacuauuauuagauggcaacagauagaucccaaauucucaaugacuaaccaaagggauguuuauugcccuuucacauuagguuggaaagagaugcuucugcuuaguaacgcuccuuuagugacugggcucagccauccagggccaccgugaaagaagaagaguucagagaaugggucauugcagggguuuacgccccaggccuggcaggggcacacagcauugcacaucccccuuccaugggucagcacgcagucagaugaccaccccuuccugcagagggagguggggagacaaggucggccugaguguccaggggaaggagaaaaccggcacagaaacaacuagccagucucugcuaccuguuucuuguguuaaaucagaauuuauaggaaggugauuuuuuaaacaguuuagagagcuuuucuaauuuuugagcgagggucuugucugagaauuauagcuugagauaaggacuucagaaucuaacaauucuuugcuccauugcuacaauuuccccaacccagaaguggugaaaccaagucuaucaagcuucuugguugacaucaagaagguuguucugggcgggcgcagugguucacacuuguaaucccagcacuuuaggagucccagaugggcagaucaugaggucagaaguucgagaccagccuggccaacacagugaaaucuagucuguacugaaaauacaaaaauuagcugggcgugguggugggugccuguaaucugagcuccucgggaagcugaggcaggagaaucgcuugaaccugggaggcggagguugcagugagauugcgccauugcacuccagccugggcaacagaucuagacucugucuccaaaaaaaaaaaaaaaaagguuguuuuguuugguaaacagaaaaggagccaucuuaagauaaugcaucuuuauuuaacaguuaugaauagaaucucucaagguccaaaaugaaucuuuugaaagaacuagaaauucuugccuguaccaaccauauuagcaagacuugaaaugcaacauucuaagaugugccucaggaauaauuuuauugaccaaaaccagacgucagcuugcagccuugugaagccuccucuccauguaggaacggggggcauuuugguuagcuggguuaggcuugcugaauuuuaacaugacaugcuugcuuuuccuguguuggugugucgcuucucucccuugggcccccgccccuaacuuuuccaccugaucucugacuucuccaucuuucuaaccccugaacaacaacuagagauaaguucaaggucacugcuggaacugaccuuugggugcuugggccacccuuaggccuugagaggcacaggcugaggccuucuguacaaccuccuggccaguguggaggggccgggcuccaagcaagcuuguccauaucacagaaagucaagagucuugccgcgugcgguggcucacgccuguaaucucaguacuuugagaggccgaggcggguggaucacgaggucaggagauggagaccauccuggcuaacauggugaaaccccgucuccacuaaaaaauacaaaaaauuagcugggcgugguggcaggcgccuguagucccagcuacucgggaggcugaggcaggagaauggcgugaaccugggagguggagcuugcagugaaccgagauugcgccacugcaccacccgagacuccgucucaaaaaaaaaaaaaaaaagaaaagucaagagucuucacaaugaauguugacaguaauacaaggucagcuuuuuguuugcuuuuuaaagguuccagucuggucacaacugcaugcaacugaguuuuguaauuaucaucuuaacaaugugaucacagucugcccugccauuaaaguauuuacuugaggguacccauguagcaugacugucucagaucagauugaagccuucgaacuugcuuuauagagguuuuuagaguugagcaaucacauuucuuuuuucuuuucugagacaaugucuugcucugucacccgggccggagugcaguggugcagucauagcucacugcagccucagacucccaggcucaagcgauccucucaccucagccucccgaguagcugggacuacaggcgcacaccaccacagccagcuaauuuuuauacuuuuuguagagauggacucuugcaguguugccuggguuggucuugaacuccugaacucaaaugauccuccucccuugcccucccaaaaugcugagauuaugggcaugagccaccaugccuggcugaggaaucacauuuuaauagccucacaaagaaauccuaguguugacaauauagguuuuuaggucuggaaugaacuuccauucuagucuaauuucauccugauuuuacuguccaggcucuuggcugaccaguguguggagacccugguggcagccuagggauccccuccaggucucuuccuuguccuuacuguagaccaucacaccgccacuaauuuccccccucuggccaggugagagcagauugucaccauuucagagaaauuugaaccaaucagaaagagagcucaggaguacuggggugacugagaugagcacauguggcuucuugaggaccuuccaacccccaaguuauucuuagaaagcugcacacaagccaggcagcuguaggcuggcguugaaaaguuuuuagcuuuagcuaauuacauugugggagagacugacugggggguguccaucccgugugugccaugcugccuccaucucuuucucccucucuucugagaccuucugguuauccccagcuaccugccccuccaccuccugugcccucagggugggcaguuuggguuucuuuccuuuuucuuuugucugcuguuguuuaggauugugaaagugcagcagugcacucugucccugcaacaggcucugcggugggcuagcuccaguguugcauucucccuucaucaguggagaaaugcacucuuggaaccaugaagagucugcacaugacagcucugcacucacuaacauucaagcaccuugauucagaguuucacgagacuaaggugagguuaccuuucccucucuguuguucuucccguggaaagaggguuuucuauucacacuguacauucagccacagcuggaaaccucaucuuccucuuccaguuaagacagucauguggccgggcgcgguggcucaugccugucaucccagcacuuugggaagccgaggcaggcagaucacuaggucaggagauugagaccauccuggcuaacauggugaaaccccaucucuacaaaaaaaaaaaaaaaaaaaaaaaaaaacauuagcugggcaugguggcaugcgccuguagccccagcuacucgggaggcugaggcaguagaaucacuugaaccugggaggcggagguugcagugcgccgagaucgcaccacugcacuccagucuaagugacaaagcgagacugucucaaaaaaaaaaaaaagucauguaauugugaccucaguucgcaggacuucggaagcagggaccccuccccuguacccccgccaaagccaccaugguagcuccuccuaauuggaucuugggggacucggaacaggguuuagccugagaaugugacuugugagaaccccagaugagaguaguuacacuuuucuggaaggcuuauuuaaaaccccagaacauucuugcauuggaauugaguugcauugcucucugggacgggcagugggcucuuggaagagguaagugaagucacugagugggacgcuccucgggggaggauuuuguggggcagugggaacaucagucuuuccuaggcucaggagugagucuagaggccauguuuaugcacaggaagcaucuggaagcuuauuaacacagauuccugggcccugcccaagagauuucaauuccguggggccaagcaggccuugagacuaugcaguuuuaauuuauuguuuuacuuuuauuuaaagacagauucucacucuacugcucaggcugggguguagugguaugacuguagcucacugcaaccucaacccccugggcauaagcgauccucccaccccagccuuccgaauaacugagacuacaggugcgcaucucuacacucagcacauuuucuuauuuuguagagauggggucuugcuauguugcccaggcuggccucagacucguggacucaagcaaccuuccugccucagccucccagagugcuaggaauacagaugugagccacaguggcuggccgagauugugcuuuucuagcgccucccagguggcugugcugaugcugcuugucugggaccuugcccugaggagcacuacgcuguagguucuaucacgguaacgauacuguaauguacagugcaucagaugucacuaauuuaaagaucuaggcugaugaaaaugaaaccaauugaaguacuucagcuccuccaugcaagcaugggcuggcuucccuuauuuuacuguggagugccuuuuauaccagaguaguggcuuucuaaugucugacucagguuaauugaugagauuccaaggcaacacaauucaguaaaucaaacuggaugaacauccucugccaucagaaaaauaucuuuaugauuagauggugaucuuuggauggaaaauauuaaaauaagaauugauuaaaccagcuagggaugguggcucacgccugaaaucccagcaguuugggaggccaagguggguggaucaccggaggucaggaguucgagaccagccugcccaacaugaagaaccccgucucuacuaaaaauacaaaaauuagcugggcaugguggugcacgcuuguaaucccagcuacuccagaggcugagacaggaaaaaucacuugaacucgggagguggagguugcaaugagccgagauugugccacugcacuccagccugggucacagagugaguucugggaguuggguuuguucauucauuuguuuauucaucuauccaucuguccuuacguccuuccauccuuccacccaccuagacauccaugucuuccuccucuucucccucugcccacucacccauccauccauuauauguuaguugagcaugcucuguuucaguucugggcacuggggauauggcaaagaaguaaacauagaaaacauaaaacucugcagucucaugcuguggcaaguggugccuucugagguccugaguguuccuggaaauuagcuugcucuuuacccugcucugcugaagaaaaccuuggcaaauagggcacagaaaacucaaugucaaaaacguaccaauuuucagaguaggaaaaaguguguuuuuugcagauugcaaaucugugagcuuagcuucaaguaaaacucuagaaagacuuauuaaagaaauguccuauaaaaagagcuaguaugugcucugaagaccugggucuggcagagcagccucugacauguguggcaccauuaggagacagccaagauagagacccuggccaggcgugguggcucacgccuauaaucccagcacuuugggaagcugaggcagacagaucacuugaggucaggaguucaagacuagccuggacaacauggugaaacccggucucucuuaaaaauauaaaaaauuagccaggcaugguggcaugcuccuguagucccagcuacucaggaggcugaggugggacaaucaguugaacccgagaggcagagguugcagugagucaagaucgugccagccagugcgcuccagccagagugacagagugaaacuccaucucaaaaaaaaaaaaaaaaaaaaaaaaaaaaaaaaagagacacccuugcaggcaguggucacaggccgaggaaccugguggacaagguggggaacgacucaauggaugaugauaaacaggaaguucuaguaccacugagaaaacgaucugccagauaucuccaucagcaauguucuuaacauguuuuguuuuugacauacuccaguccucauuuugacaagcuuaagggaaacauauuugcagugaauguugcagacaaaugguuauuccugauguuuaaacagcccauacaaauagauuggaaaaacaugaagauucccauaggcaaauagacaaaaaccaauuaaucugaaacgcucuuauugaacaaaucagcaaagacuaaaaacagugaugucgacgacguagacagauucagcccucuagucauguuguggcuguuggcagauuaagccugugugcuggugggugggcugggagugagcaacguugagccccccgaaauaaugauggugggaagggaaaccuuuuuauaaacuuguuuggaaaugugaauguaugaaaugcuggcuuccuuugacucaggaauugugcuucuaggaaucuaagcuaaagagauuuucauaguaauugacagguugauuuauauuuauacucguaucuuguuccagaaaggauaaagcgguccacggggagggacaggcauauaaaggcagcagggcacccagaagacagcuugucuugaugagaaggagaaggagcccuguuuuacagcaagugucuuuugguaugaaauucuuaggguuuggggcaccccuuuuguuuuuugaacgcucgacuuuuuugaugguuauaauugagaaauacaggauauugcaaacccuagaccauaucgaagggggcaaacuuaauuucauuugaaagacaccuggagugggcaggagacaugcugaucagcuuuccagguggcagaggcagcuuuuauagugacuucccugacuggucaacuggaagcuugauugaauguccugugucccucugggagcagcccaccugucacucuguggcccugcaacagggcccugcuugucaggagauggccaucuuaguuaucugaccacuuuccagccuucagccacgcagcccucagacccccccuaccccccaggccacugugucccuggagaccccuguccucugcaugcuuccuacuccuuagaggcccaucagccuccaagagccacccuaagcaagucaccugucugugggugacagcauugaguccauguuaagagagcagccucuaucugucuggggguggagagcccaugugauucaggagacaccacaucaucauuucagagccaucacugaacaucagggaagagaacucaaggguagaguugaacagaaacauaagugauccuaggccgggugcgguggcucacacccguaaucccagaacuuugggaggcccaggcggguggaucacgugaggucgggaguucaagaccagcccagccaacauggugaaaccccaucucccuuaaaaacacaaaaauuagccaguugugguggcgggugccuguaaucccagcuacucaggaggcugaggcaggagaaucguuugaucaggggcagggagcagggugggcagagguugcaaugagucagcuacucaggaggcugaggcaggagaaucacuugaauggggcaggguguagagguugcagugagccaaguuugugccacugcacacucuagccugggggacagagccagacucugucucgaaaaacaagaacgauaccaguagguguucuuugacccaucaacagguguggggaggcagcacugcaccgggaaggauaagaggguaggcuuugcugucuggccuugggcaagacacuugaccucucaaagcccauuugcugcauuguaaagaggaaaucauacccuacagcagcuaacccucuuaccuugcuacuuaagggcacauuccggccgggcgcaguggcucaugccuguaaucccagcacuuugggaggccaaggcgggcggaucacgaggucaggagaucgagaccauccuggcuaucacggugaaacacugucucuccuaaaaauaaaaaaauuagccuggugugguggcgggcaccuguggucccagcuacucgggaggcugaggcaggagaauggcaugaaaccgggaggcagagcuugcagugagccgagauagcgccacugcauuccagccugggcgaaagagcgaagccuccaucucaaaaauaaauaaaauaaaauaaaauaaaauaaaauauaacauaacauaacauaacauaacauaaaauaaaauaauaaauaaaaaagugcacacucccuggccaucagccucaucucuucuaccugaguggauuaaguaguaaagggggagcuauccaagacagauuuuaaaauggucaguuugaguaaaccaagagauagguuuaaaaaacaauguauguuucacucagagcauaaacaaaauuguugaagagccagccuacaugcaaguuuaaaaauuaaaaauggccuuauguauuaaaaacaauccaggcugggcacaguggcucacgccuauaaucacaacacuuuggauggccgaggcaggcggauuauuugaggucgggaguucaagaccauccuggccaacauggugaaaccccgucucuacuaaaaauacaaaauuagccgggagugguggcaggcgccuguaaucccagcuacuugggaggcugaggcaggagaaucacuuaaacccgggaggcggagauugcagugagcugagauugcaccacugugcuccagccugggugacagagugagaguccgucucaacaaaacaaaaacaauccauguuaauuuuagaaaguacaaauacagaagcagaagaagaaucugacaguuaucuagaggagauuuuaaucaguguccuuuagguucauucguugcuuauuucaaucuggauugggacaggaugacaaaggcccaugaagggauuuuauauauaacugugugcuuaguguagcguggguguuuguguuuuaucgccuggccucuuuguggcaugugacaucuuugacaggaacaccaauugauuccucugugcucaauaaugucuucacugccaugguauuuccugcacagcuggggaugcuuaacuguguaacuacaauagcaagauaagggaaacagauuuuccaauuggauauuuuaauaaaugauggcuucagaaggggcacaauauucuacgccacugauugaaugaugacaagaaauauuuuaaugggugcauugcugucgcaguguaguaaaaaguaaagaaugguucaccaagucagaggucauccucagaugucccuaugugucuguuaguggagauaaagugaucucaagacggugacacauuuaaagugacgugaacuaguuuauuaguagucagugguccccccggccacuucuaaagaugacaugcuucuaaucauacccacaggauuucuaagauccuuuuuuuuucucuuaucaaaugacagugcuugaugauaauuucaucagaaaggucuccaucacuagucucugcuuuauuuucacguaggcaaguggucucaagaaaauuggaauaaaaauauucaaaauaauuucucccagcuauaucuggagcaagauuaaacaauuauaaggaguaggcaguauguuuucaaucccuguguugucuuugucaccaugauuugcauucauaucagaaggccagcaaacucggaaagaaaaugacuuucugauugaaucauaucauuuuaaacaaagcucuuucaugaauaaagaauauuaauuacuauauccagaaugauccucuuuuuuuuuuuuuugaguuguguguuaacagaaaccuuugugcauuugacacaaggucagcauagauuuaacaggagacauaagcuuugaaaauuuauucaugcuggaauugaacauggaauuaauuaaauguacagaagcuggaagguagacaggucguugucuccauuuuuguucuuuaaagcacuuuauuccauugggauaucacaauuucguagccugguauaugcauuccuugugguguguauuaauaaauugaguaggugaaaaagacaauagauggaaagcuggaaagugauguggccugaauuccuuucuagguaauuucaauguuggucaugcccagggaucuccuuaaguguugcagaaucacaccuggacaacccaggugcccaguccuucauugccucaugggcucucuagucuuacuuuugaucccuuuuccuguauuucaccaguauaauacuccccacuccuaguugggaauaucuaaccuguguugaguaccuguaucugaugaguuaguagcugugaaaacguuucucuagcaaggcugccugugagugggaucccaggccaagcaguuaacugcguuccagcgaagcaggugccccguguguugcucugcaaguccacauggagcaggauuccuuauuuugugaagaaaggaucuuuagugccacguguguauuuuuaacacauuuccaaaagcaugauuuauucaggauuaaguuuauucaguagaaauuuccaagguauuuuuuuaagugaggcaccauccuggaugcuggggaagaaucuuuguuggaauaugacccuggguuuuguauggaaaagggagggggcagugcaggauguggcaaggcaguuguuggagcuccgauacuuccaauaaguaacuagcagggcuguacacacucuaccaggaaagacaaagaaaugcagaguccagggaagcaguccaucgcacguuucuuccuucccugcaagggcacuggaguucuccuucaccaggaagacugcagcccccauucugauuggccucagggggccgcuccugcugaugauggcuaaugaggacaagcaguagagaauauugcuuucauuuaucuuggugcuuuguaccuugauggagacagauauucggguuucaagaagacaacuuuuuuugcagggcaggcauuguuugcuuguuuuaaggcuacguucagaagcacgagaacaaacaacaguuucaagccuaacacuuggguuuacaugaagcuaauuguuagauaugaguucuaaauuucuuuucaaagaaucaguaugucaguauguucaguucuuugccuucuacuucuaaacuuaacuuucucauaaagcaacauuuuucgauuaccugcuccacccugacucauuucaaucaccugcuccacccugacucauuccgauuaccugcuaccugcucugcccugacucauucuccacccugcauaaccauuuuucccaccgaaccacucaccgggucacucucuuuaaauuagccaauuggaauuaguuuagccugugcggucuaacccuagccaacaggggaacgacacagcagcaggggccacgugagucagggauaagaaccccuucccucccuuguccaagugugcgcucaccauugcuccaucuguaagggcgcacccuucuguagaaguaacuugccuugcugagaauuaaaaagaaaauuuuauauuugagugcuauuucuuuuguggcacugaaacuuuauauauaacauaauguugcaguccuuuaacauaacagaaaggaaaaggagaggcauccuauucgguuuugcacuagggguccccacugaaauugcugaccacaaucacauggauuaugauuuaauauuucagcaagacaugcaugauuuuaaaugaauccaauuaauauuccauugaaaaguggaaaccagagucuagauaagcugacccagcucucaugcaugugcuguuaacuuuccuacuuuccccaggaguaucacagugaaauugagccaugagggacucucugcuucuuacaguuggaagccucuggacuuccuccucagagacgggagaucuugucucucucaauccugaguuagucuccacuuuauagcuguuacuucaguuguagggcacuggguagcccuggaguugaguuguucaaugcaugaccuuguuuaugucgcuauuugaguuuuuacugagaaaaaggccuucugugaauccaaaugugacuauuacacacugaaucuucccauuacuuuaagaauaagugauguuguuguuguuguuauuauuauuugagguggaguuucccuguugucuccuggcuggaguguaauggcgccaccucggcucacugcaaccucugccucucggguucaggcaauucuucugccucagccucugggguagcugggauuacaggcgcccgccaccacauccagcuaauuuuuuauauuuuuuaguagagauggggguuucaccauguuggccaggcuggucucgaacuccugaccucaggugauccauccgccucggccucccaaagugcugggauuacaggcgugagccaccgcgcccagcccaguggugugauuauuccauaaccaugguggugauuccugugggcuaaacugugccucccagaauguguguguuuuaaguccuaacccccagugccucauaaugcgauucuauuuggagacagguucuuuaaagaggugauugagucaaaaugaggucaguagagugggcccuaauccaguaagacuguguccuuauaagaagaggagauuaagacgcagacacacagaggaaagaccaugugaggacacagggggaagacggcauguccaagccgagagaccucaaaagagaccagcccuguccacacugugcugaucucggccuucuaggcuccagaacuaggauaacuaggugucuguuguuuaaaccacacagcccgugguacuuuguuaggucaaggcugguaaacucguacagugauggcuucaaauguuaugaacauuaaaaucuuucuauugcuagggaaggucauuaaaaccuugguggccaauuaaauauuuauggauuuuuuuuccuuuacacuuuugcaaagcguuuuuucuaguuugugcauaccuucuucuauuagcaaaaugucuucuauuaccagcuuuagaaauaacggugcugcuauuuuccuuggaggggucuggguugacagaccugcgaaaggucuggauguguucagagaaauaagcgauuuuuccaaggcccaggccuuuguacugcucuaauucuauccagaaugcuucggacgggaagaauuuauggcuuuauaagugaguauuuccguauuagcaaagagacaucuacacuugaaagacuuuccugcagccucccgggggucgaggucaagagucugggaggagguguggagcagaguguccgggugagagggugcugggggcacgugcccagcagggguggagggguggacaggcucaaaagagagaccugggcaguggacagggcugggcuucccuggagcuguuggcggggcagagccagcucaaggaacagcuacccagccuuuccaggaacucuggaaggaaacggggacuucccuggugagggugggauuugggagauaauccuaaucacugggcuguucuuuguccuuugacauucaaaugaaaugggagccuguuuuaccccaaucagccuugaguuuucggcacccucccccucggaauacccgugagggaccuucuguuuuuguuguugguguuuuacuaccauuucugaguacuuucuccgaaagcucuuuuagcacguugcuuuucucucugcccucccuccuccucuuuccucccuucugcucucacucugaagcagcccagcagcauguacagcacuugcuuuccuuugagaggcccuccauuguucccgcccugccaacuuccacgccagccuccuuuugcaaguccaccugccguucugggcuugcccuggggaaggcccuggagcuggauucccacacccugccgaguuugugcguuucugugaaucugaugaguggguuguggacuucaauccagccccacccuuuacagugagauccagggaccuuuuuaaccugugacugacuuuuuaugucuuucuaugucuguaaaaucgggauaauaauaguaccuaccucucuguggcacuuuggggguagaauggaugaacugaauuaacgucugaagugccacaguguuguaucugagugaguagcguccuccuuaagcauuggcuuuggugcacugggaaggggcgucagcugggcaggcugagccugucaccuuuuucaaaauuuccaacaacuguggcuucuugggaaauccuuuggcagucagggugcuauaugaacacauguuuugugggucacuugccaggcgucagugcccugcucggggucccuuugcagcuccccugaacgugccauuugaagcauagcaaccauuacuuugagaaccugugcagguccaggugccgagggcugucagaucccugcaucaacucuggggauggguucaauuauuauccucucuguaaacaguucucaguuauuccaaguauucuauuucuuaauggaucuucuaagcccuggaucaauaguguauauuucuuugucucucaguuggggcccuggccucugcagauaagcccucggaugcgaaaucuggggaaccagccagccaccucugguccugggagggucagggacucgugaaucaacaucuggcucuuugugcacaaugggccuggcaugggcccaggcugguggggugggcagggaaggaacaggcccauaggcaccccuccaugggccccucaaggcuguagaccccucugucugaccagcaucccauucccugaagugaagcagcugccaccaggcuggcuuuucccaggcagucacacucugggaugcccccaccccucagcacacacagugacuguguuuucauguuuuccaccaagggagggagggacaggcuuucucaggggggcggccacccaagaucagcugcggcugaggauuuuuguggcuaggggaagaagugaaucacccucuucucugugucuuucccuaaccacuggagacuucauagauaaacuugcggggucacggugagggaggcacuguguggaaggguaaaugggcuuccuggggguuuaguacaaguugaccaaccuucuuguugguaacaugacugaggcauuaccugcacugauuaagucaaccaucaagcagcauuuauuaaguagaacauugauaagggcuugagggugagagaaguuguccuuaacugaaggaggggguucuauaaauggaagugucagagcagggugacagaugccaaggaagagugcccaggugugcacaggugugcccagguaugaggggagaagaaggggucagggccagcagggaaagagcuuggggacuccugaguccagcucccagugauguguagaguugagcuccauccugcugaucccagcaggagauaguggcgagacuggguauggugugguugggaacuagaaaggacacugguguguuuagauggggaaucuugggaugcaauagaaacaaccucuguugguuuucagcauuggagcagaugcuccccauacaucaucacaucuuauugucgcagcuaccguauuguucuugucccguuuuugcagaaaugaaaaccugaugcagagccucaaggucacuuucccaaggucacaugugguuugcaucauucuggccuuggagcccagccucuuagccacucagugcaacuguggagacuggagggugucggggcguugaauacugguuaaggaaacggacgcuuuauucugcaggugacagggacucacugagggcuccgaacagaauuguacccucagacucugauugcaggaguaaggaugguuuacugagaguaggcuacgucugggggugggucagcaaggacgugugugcugugggaauccugagacagaugaagaggcugugaacaguagagggagaguggacucuucggguaguucagacagauacgcagguggggagagauuggcaggcggaggagaggcuuuuguugagggcuggagggagggaggagaggcaggcuguuucuguuuucuguuaagugggacguaaucgaguguuuuccucugccgccugaaggaaaggcggugauugugauugaggguacaggguccauuugccaacucugagcgggagaguugggugugggcgggaggcaggacauugagggagcucugaagucauggcuggaggccauccuacugaggggauggggcagugauaguuucaaggaauccuaggaaugggaaagggggcuggccagggcugugggggugggggggcuguaggaugcuggaagcagccccagcacaugugcaucugcagcgggacuuggugauguggacuuggggcuuccgaugcucgugcuagccugaaucuccgggagacauggagcaucucaggguggggucagguucccaggugaagccccugcugcugaucuguagaccgugcuuggagaacacugguccagugcacuggaguucguacagauccgccuuuggggcaugcccaggggggucuuacaggagccagggacagguggggccaugucuggaguagacagugauacagugaugucccuuggccucugcuggacagagaaggaggcgccaggaggcagcucugaguugggauggaaaggaugcaugacagucagcuucccuacagcuggaggggaaguuccagaaagaaaggauggccaaccugggacuugugggcagggaaagggcuuuuggaggccaagauuguagggcaguguuauccugggugaguugggguauggccauaggagggggcuccaggaauucagggaaggaaaagaccauggcgcugaggaggcggcacggccuggcccuccaccuccaagcugaccacccuacucagcuccuuuaggguggaguggcuguaaggccgugaccaggaaaaaagggacccagggugguggcacaugaaucccagcuuuguguauccacucaguugcaugccagguagucacaucuuaacuuguggcgcggcuuuagagagugucugugcaggcugccucugaucccucagucagugugcagagcugagcugaugaggaaagucuugguauguaaccaaccaggucucaccuucagccacacuccuagggacagagugcguccauggaggggaggacucacagcaguuuugaaguaauguagauuguguggccaucccaauuuaguuuaucauuccccuacuuggucugucugccuucauggaaguuggugauuuuuuuuuuuuuuuuuuuggcucuguugcccaggcuggauugcagugguggcaucucagcucacugcaaccucugccuccuggguucaagcgauuuuucugccucagccucccaaguagcugggauuacaggugugugccaccacaccuggccgaaguuggugauuuugaacagaggaaagauagcacagugucauaacucagcaaaggugcucagcagcugcaggaguugggguuuucugggcucacacccagccugugucccucauccccuugcuccgcugcaagaaccccucacccugcucagugcuccuggccacugcugacuggugcauggcgagcagagguuuuauuccaucuuacugugucagaugugauuccggggacgcaguucuuucuuaagagcucugaugcauguucuaacuaggagggcagguagcugccgcucccagcagccccugauguguuuuccuucaagccuggggaacaccgagcuagggacacgcuggcuaauagaggaaggagagcuggguaugguggcucacaccuguaaucccagcacuuugggaggccgaggcggguggaucaucugaggucagccugaccaacaaggugaaacccugucucuacuaaaaauaaaaauuagcugggcaugguggugggcgccugugaucccaucuacuugggaggcugaggcaggagaauugcuugaaccugggagacagagguugcagugagccaagauugcaccauugcacuccagccugggcaacaagaaggaaacucugucucaaaaaaaaagaaggggagcgaucacgugcaucccucugcugagaugggagcagcagcgugggguugggcuuugaacuggcaucguaggcauuuuguuuucuacauuuagaggaaaaauauacaucaaauauucaaguccccugggcacagauaaaagaguuuucagauaucucugcagccaaaucccaaaugggaugcagaagggagaacuguguaaaaucacgcucuuccagaagcugggcuuuguaauggggcuggcaaaaauucccagggcaucguuuguggccucaaugugauuuucauguaagucauggauuuucuaaaucuuugagguuaguggaucuaaagaaaagcuugguaaacauccagauguugucaaacauauuuaggucauuguucucugacaguucgugauauucguuccuacuccaggaagcucuuaggagaauccaaauccgacuucccugugcuuugagaaggaaugucugcaugaagaccaucguacagauggcgauauuagaagaguucccucccgugaauccuguagaggaaaauguuaccaaauaggccuguuccccugugcacccaauacuaggaagauuagauaauguguagggauuucuugguuuuucugcacaaaagcuccagggcugcuuugaggcugucugauagacagcugcaguguuguguguuacccuugaccgcaucccuccugucccugagcucgaaggcugaauggucgaugggagcuccuuuggugacuccguagcuguggccagugccuggcagcuagcgaguggccagaacugggagcugcugugugugacguggcuguucaguguuguuuguguuggcucuguaaaacgaugcuuaauagauuggauuuuaauauauaguuuguuuuuuuguuuuuuuuuucgagacggaguuucacuauuguugcccaggcuagagugcaguggcaugaucucagcucccugcaaccucugccuccuggguucaagcgauuucccuaccucagccccccagguagcugggauuacaggugcacaccaccacgcccagcuaauuuuuuuuguauuuuuauaaauauaaaaaagauuucaccauguuggccaggcuggucucaaacuccugaucucaggugauccaccugccuuggccucccaaagugcugggauuacaagcaugagccaccacacuuggccugauuuaauaucuuaagucaccuuugccugacacuuagcaagaaaaacuaccaagaaauaucuaauauuuuccuuuuguuugggaauaagaaucuacucacaauggacacuugcuggcuuguuuuaaaaccaagcuugcuucucacuggccuguuuaaguggaaaugaagucucagugugggguccgaugcuuccuauggcugcauggaggaaaggagucugggccugaaucucccguguuccucaugcauggguagaacuaaagccucuucuucuguaauguggcaguucccauucucagaggauaaaguacgugugagugaugccaccucaacccuuagccaggugcaggcguaacaagggagacccaccugugcaauauagugagacccccaucuuuaccauaaaugaaaaaaacguuagccaagcaugguggcucacgccuguaaucccagcacuuuaggaggccaagaugggagaaucaucugaggugaggcguucgagaccagccugggcaacauggcaagacccuccucucuacaaaaaaauuuaaaaauuagccagggguggugacaugugccuguggucccagcuauucaggaggcaggaggaucacuugagcccaggaguucaaggcuguagugagcuaugaucuugccacugcacucuagccugucuguguggugguguguucauacacaauagacaucgccaguguucuguuggcaggaauugcuaucguugguccuuaaggaaaaacacaggaaggaugcaggugcucagaggaccuucuggggucuuuuuuccugccagaucaauguuccugcccuacagacagaccauacuuguccuuccuccacuagcagauaagggucaaguccucaucucuuuuacaguuccacguuuaaccuucagcuuuuaaaacgagagaaauaggguccccagugaguucagcuggagugucccaggcaaagggaugcgugcagaauuuucaguuccuagaagcugagcaucauggcaaaucuuagcuuagaaaccauucuaccaugacauucucagaugagaauuugagucuuaugcuaaaaauauaaaaguauuaauaagacguuacugucuugguaauugcuucuucuuacauguaucugucagucaacuggcuaccagaaaauagccuuugauguacccacggaggggcucuuggugggcucccggggugggcaugcucaggccugggcaguaccagugguuggccaguuucuaccaucagcagacgcgguucugcuaagauacugcaaacgugauuacuggcugucagguucuguuauuuggaaagccagccuguguagcagauggcucugcugacuggcuaccagaaguuuccuuuaaauaaggcuuaucagcucuagcaacacuuggaaauacuauucuccaggagaauguuugauuuauagguagcuagaaaugacccgggacagaggagucgugagacgguggccaaagcaucucauaaacuuggaacuaagggagcgaagccagcugcugagggugaugaauggggguuagcuagggcuggcaccuuuccugaacucuccucugcagucuuccucucucgcgcagcauuagucccugcagcacggaggcauuacccggcugcuguuugguuuugagguagcagugaaaucaacuacaugcuuuaaaaaaaaaaaaauggugauaugcuccauggcaugaaaaaauucaagaaauggcagucuaguguuuaaaaagccacaggaaaauaaagcauaaugccaccugaacauauauaguauugugauuuuuuuuuccucuucaaaaaaggcuggucuggcuuuguagaaggggauuuagauuuuggagugacaugucgggagcaugugucuucuuugcaucgggagagcccaucucucuaaggcaguggggaaaggcaauucucugugaccagguuuuucagcacccacaguugcacuugacauggcaucauuaugacugguguggaaaauaagugcuuccuucugagguggaaaugcugaaagaucacaaacacacuggcuauggcuggaagagguucccuggaagagucagugucaucuaagguggauggaauggauucuucuacuccgcagcccgcaucucauauggcaaagugcaaaaccugggauggauucucaacaaagguacaguaauugggagacacaaacaguccaguguuuuagcccugaaggaauacuaccuuauuuuuuacuuugggcucuaugaaugcuucagauaacaagccagauagauuuacauaccuuaauuauggacaagcuacuuucauauuaaaguucaucucaguaugugaacauugcccuggucucaaacagugagaauugaccucccccucccacaccuggcuaaguuaggagcccaggguucuggucccacccuugacaguagcagagaucucuaucuuuccacguugcuguuuguuucucagcuuacagaccugggugaccuuuaagucuguacagcugcagugauaaaauuuuagacuuuugccauauuuuagugguguucaucauuaaagaggcgggauggcccuguagcugucucugggauuaucgcgaagcuuuucucucccucgcugucuuucugugguaaaaucacguagccuuagcauuuuucgggaguugggucaauucuuugaggacagaaccccugcguugucacuguguagcauugcaguagguacucaauauauauucgaugaauaaaugaaccaauagaaaaccgaguaagucugugaaaguuugcuaaaaaugcuaccuggaaaugucaagguaacauuuacauuugauuuguguggaguucaguaauauucacauguuuacuuuggucuuuguuaucaacaaagcagaaugcugaugcuuacuaagacaaaaaaaaaaugagcacaggcagugugacccccaaaccccagauuucacccuuacugaggagcuguguagcccuggggaggugcccucugucuccgagccucugcaucucccuaaccagaugggcgcuaggcugucauucugaaccauucugacagaugaaucccgccuggcugcuacucuagaaguuggggguucuugguucuuaucaaagagggcuucuuuagccuggcgugguggcucacgccuguaaucccagcacucugggaggcugaggugggcagaucaugaggucaggaguucgagaccagcaugaccaacauggugaaaccccaucucuacuaaaaauacaaaaauuagccgggacugguggcgcgcaccuguaaucccagcuacucaggaggcugagacaggagaaucacuugaacccaggagguggagguugcaggagccgagaucgugccauugagcucccgacugggcaagagcgagugagccucugucucaaaaaaaaaaaaaaaaaaaaaaaaagucuucuuuauugaaacucaaaagguaaaaugauucugucuuggagaccccuccuuacaaugaggauguaaucagagguaccacauccagagcccuuagaguuugaguagcagguaggcugagguaugacccugugauggugaaaaucauguuaaggucgaggccacagagggugcucagguguauuuuaaaguauccuuucaagauaaauaaagugaaucaccuagcagucacucugacuuauuucauuaaaucugaauauuaaauuuaaugcugucauaaaaucuagauuuccuaggcuauaacuucuauaacuuccuucaaaagagagcuugcccaauucaguuuuaugccacuuccagugucgugaacacaauagguacccccacaauaagauuaaaguagggaaagcuggcaccugacaaucccugccugcaaauagcaaaucccaaaguaaugcuuccaccuggccuggccgccagcaccuugcccagaaacagccuguagcaagcuguggcauuucuaggccuggagaaggucguguaagcauguggugugauuaggggacauuguauuuuuccuucugaaacuuuucaucaaggaaacucugaaacaauacaucuguguuuaagacagcuugaggaacugauaaguugaucaucuaugucuaaauauuguggccuccgauaacauccuagaccaguaucuaucagcccaccagguaggaaaucgaggauuugauggaagagaaguucaguuuucauuauuaauggugaauauuuagcauguacacagaaugccuggcacauaggauuuuaaccaauuuaaucuucacaggaaugcucaaaguuuaggagcuuuuauuggcaccccuguuuuacagguggaaaagcaagugguuugucagugaauaagccuggcuugcgggcaggcacgucugucugcuugcucuuaaccgcaguauucuccugucuguugucauggggagcaagugcuuaccuguaaggaauccuuccccacacauugguaaaauaacccuacaagauuauuuuagaaguuuugcacagaggcaguaucguagccauggagguuuaucuggggugagguuauugauaauugaaaaugaaaacaauaaagacagaauuauguuaggagacagacuguggcccuucauugggauggcauugguguacacagcacccucacagucacaucucuuuguucuugucuuccuggaagcccacuuguuccuaggugagguuggcgguaacagguaccaaagacuguuuuuuaaacaagucacaugaguugcaucuucgaggcugcaugguuaggaaagaugccucauuuaaacgcgcagcaggugagacaugccccucguuuuguucuugcaggccaagccccagagugggcgugguuuuagggugcaggcuggugcugggcugggccccucggaggcuccgguccgcgcugcgucgauccaucccggcgcuugggccugcacgccgccgcgcucgccgccgccgccgccgccgcgcucccgggacucggccagcccggcugggcgcgcggcccgcggucccuugcacgucggcccccgucgcccgccccgccccggcgcgcguuuccauuuuaaaccgccgcccgccgcccgccacccgccacccuucggccgcagccggugcagcuguccgcgcgucccggagcccagggaguggcggaggcugcggaaccgccgagcugugcagccggagcgggaggaugcgcacgggccccgcgucguagacaaugaagccgcgggcgccgccgccugcccugggcccugcgcaccgcggccgcaccugccggcgagagcgcucuagcgccugaccggccgccucgcuuggccccgccggcccauggcucggcgccccgggcccggaccccggcacucgggcggcgcggcgcacgggccggcgggugccaggggcgccguccccgcagccugagugcggcccucgcggucagcggggggcgugggccacacucccggcccgccugcccuccccgcuuggcccggcgcccucccggcccgcgggcucgcuggaugcggcggggccccagcgcgcgggcgacauguacuuguuggacggcaguggcgagcccgcgucgccacccgcggacgcgaugccgcgcgggacgccccccagaaagacugucuaccgcaucuccgugaccauggucaggaaggagcagcuggccgcgccgggcuccggcggcccggacccacgcccgguucggcggccccggcccgcgcgcuccccggacgcgcccgggaggcuugaggaggaggccgaggaggcggagggcgccgaggaaccggaggguccccggccgcgcgcuugggauuuccgcaccuuccgcacccgcagcaccgggcagcuggaacuggggcggcuccggccgugcgcacgcggccuggaacccgcggaccuggccggcagcgccccggccgaggaggagggacgcggcucgcccgcguccggcagccccgacguggagggggcccgggccgcgccccugcggcggagccugagcuucaggcacuggagcgggccugaggcgccgcaaggccggacacugggcggcggaaggcgccacagcagcuccgggagccuggccugggcgccgugcgacgaggccgcggccgggaccacccuggagcccgcgaccgccacgcagcccgccucggagaagcgcaacacccuggacgugggcgaggugcucagcaagaacgacgcgcucucggaccuggagcguugggaacgcaguaagagcaagaaccgcacgcuggacaacagcgaccugcagcggcuggagcgcgcgcgggcggcggccggggccggcgcggccucggagcaccggcugcugcgcuucuucagcggcaucuucgcgcgcagggacgggggcccgggcggcgggcccucgccacggagcggagccucgcggccacgcggcuacuucagccugcggcgggccccggccgaagcgcacucguccagcgccgagagcaucgacggcuccccgcgcagaggugggcagcguggccgggggucccgggacgggaaggggcgugguggggacuugccgguuccgcagcggcuaugggacccgcccucccgggucgggagccugcacguggccucgagggaugcgaacucggguacugcgguuuuccccagcagggcgcagcgguccuggguuuucuggcugccccugcgccuggcugugcgugcuggugccccucggaguccaccaccuucaucaaggagagcuugacccgggagaggucgccuugccagccggcgccgaccuccuucgcgugcucgcugggucuucugcgggagcgggcccugagcuggcugcccgcgacaccuguggggccgccccagggagccgaggcucgccggucgccgccgcacaggugcggcugccuggaugggagaagccggcauucauccuggcgccccucccugccucgagucgucucccuguuagugcuaccaucugucaguguugugauguggacucagcugacuccguggcccucgguauugagcuggcuguaaggacaccucacuacagugguggggccuggggugggacggaggccccucucuccacagcuuuccugccagguggcaucuuaaugaggagagcgagucugggacuggauucuguuuccucauaauguaggcuagcaaaagggcaggaaaaccgcagcccugcagccuguucugaaaccucaggucuguguucccuuaaguccucagacagggacuuugcauggagggaucuccagccagauauguuauucucugcaggaaucaguuaaccuuuugguagcauuucggggucagagccuccagaaaccucaaaacacagacuccaucaacugcgcaucacccugagggggauucuggggguggaaguggugcuagauugcuacaccuuauucuccugggaggggguuguaugccugaagauauuguggccacagacaagaggccaugcauuuuuaccaccaaaaaaaaaaauauuauucauccucuuaucugaauucuuuaacuuggcugguacagauaaagguaguuggagagugggcuuuugauuugcaguucagacugcuguguaacccaccucuggagaggguauucaucccaaguggacuuaacaggucagcugacugccccuaggguuuauguuaaaaccaacucaugcaaauaaaugacuguccuuauggaaauauuuuuaagguaaagugaagauaaaauggucauguucuaauaugcuccuaaugauccucagaaugugcuagaggaugguugaaaccaagcaguggcaugugcgguaauguuaaaaucugaccuguuucacuagugaggcuacacuguugccacacuuauguuuagcuugucauggcacaucuaguuuuaaccucccuuggagcacuuacuuuagaaggcacuguauuuaacuccaaccauuaucccaucccuucauguauucucuuaaaauaugagaacaugaugcguguuauuuuguuaaaagaauugguuugcacgaaguugcuccugucaucauuggcuuucagaggaaguuaagaccugaaggucucaguucucuaauagcaggcuugcaucuuugcucuguggacuuggaagaaaacaguaauuagcugccucgguuccagacaaguuuguaucagagagagaaagaaaaacgcacagacaugauuuagagagaaugcauuucauuguggucccucuugauacaaguuaaaagcauuuggaguuuggauaguuccucucuggucaaauggauugauaguagauuuggaguaguaagggugugaaguguguuggaauguuuauaguaaugcucaguuuguuccuuguggucaguccuucucugggcggaauuacuuuggucugagacaugauauuaccagcauuguggguuguauagaaaaacggaaauuuaaugaacuacauuauagccauauggucagaacucuagggccucacuuuuuucugaaguucuaaguaaucacaugcucaaaaaagcuacaucuuucaccuggauaaauucuuugccuuuggcuaaaaugucugacaugucaauauucuuaggauuuuggugaugccagugucuguuacagguaaaagguguagcccccauaggugucacaacuucucauuuuauuacauuuuuccagucuuuacauauuugcuuccugugacauaaauuauucagaauuuaggugcuguuuaagauuuugaauuuaggugagaaucucuaagguaacagucagauacaguagagcccaagcucaguuucccuguaaauguccauaggaugcaaguccccaaaccacuggggacagguggguuuguaggacucggaaauuuuggaucugaggaagguaaaaugguguguguuauauagaacgcugcuugugagaucggguggcgcccuuuaguaacacacuaguauuuugcagcaaagccugaaauauccauacucagugaaauaaauagugauuaaaaauagccucgugccaguuagagucugguuuugccaccaaaguaauuugccagccauuuaugaaaagaaguuccauucucagaccuuuuuggauuucagauugacagcuaaacuaucguagaccugcaacgugauaagcaucaugagaagcaccacuggcuuucuguacauuuuggccauaauguuuuaaaauuuggaguccuugaaaauauaaaggaaauuagaagugaccucagcugguacagguuuuucuuccguuagaaucuuuucauauucuuuaaaagagcuaguaaauuuuugaauuggcuacagaaaucuaaagacuaaguaauuauugcauuagucuauuuggcuuagaguuaauugcuuaggcaagguauuuccauuagcacagggaagcaagauggcuggagucuuauuuuaaagcacacacaggcuccuacauacguguaccuuugguuugccuguauucugaacugaaggcauuaaggaugaaaggauuggagcaccuaccuuuuguaggaugauucucuuguacugucugguccuuguuggaacuugucuauuuaggcucuuccuaguucuucccucuaaugcagaacaguugccucggugaguucagggcugcucccucuguguaaggcuugcaacugauagcagcaagccagcagacauuccagaaagacccugugucagaucaagggcaguuucguguuaacugauacacauguguuagggcagaguccguugacucaaguauaauuuaauacaaggaaagaucaaauaauaaaugauaaaugacauuguaggggguccccuugcagcgcaugcucucugcaucccaguggaugccgucugggccggcccuggaaccagcugugcugugagugaagcccacacuggcuaugcccauccagaacauucggugucuuuagaguguucucuugcugucugggaggauugauuacaguaauaaagugauucauugauaccucuuacugagguuagcuuuuaaaauuaguaauuuacaacugauuuuugacagcacauuuuaugaguggcuuuguucuuuaauuucugauucccuugauuuguaucagucaauuacuguagggugauagacuuuuuuuuuuuuuuuuugauggagucucacucuguugccaggcuggagugcagugagcgaucucagcucacugcaaccucccccucccagguucaagcaauucuccucccucagccuccccaguagcugggacuagaggcgcaugccaccgcacccagcuaauuuuuguguuuuuaguagagagaggguuucaccauguuggccaggauggucuccaucucuugaccucuugauccaccccccucggucugggauuacaggcaugagccaccacaccugugguuuuuuuauuuuauuauuuuauuauuuuuauuuuuuaaaccauuuauauuuuuauuuuuuaaaccauuuaaaacaaacagccuucaguggagaacgugaggacacagcaauuaaaugaaauaaaauuacugaaacaauuugauaaaguuugauuuuuaaauuugauuuguuacugaaaaggacacuuuuuguugguugguugguugguugguugguuuuuuuuuuuuuuuuugagacagagucucgcucugucgcccaggcuggagugcaguggcgcgaucucagcucacugcaaccucugccucccggguucaugccaugcuccugccucagccucuccgaauagcugggacuacaggugcccgccaccacgcccggcuaauuuauuuguauuuuuaguagagacgggguuucacuguggucucaaucuccugaccucgugauacacccgccucagccucccaaggugcugggauuacaagccugagcgaccgcgccuggccugaaaaggacacuaguaaggaaacuauguaauucaguguuucucauuugaaacauuuugaacugauuagucuuuuguuauuagaauugauuaucuacaguguuuuguuguuacaauugaacauuccuagaguuugcuugcuuuuuguaaauuacuccagauagcaauuuaggaaacuccucauuauuuuuguuuagggcuaaaaugauucuccuggagacagagcaguuguacuugggguacaaggaagagcugugcugaacgucagccagggaaccuucuaagucaccgcugugggcuguguccugcuguuuauuuccuuagguuggagcccaaguuucagcauaggucaccuguuaacaucuuucucuuugauaagucaucaaagagacuugggcuggaauauccugccaccagggggaauguucaaaaguacaucugcuccagagguccuccaguguugacaggcacauuguagcaaauuauuggguuauacaguuaacaaauaccuuuuguuuggagcuguaagacccaauuauaaagcacuaguaguuuuugucuuuuuaaugcauuaacaaacauauauugcauguuuaugguguguucugcauucacuaggcaguggaagcuggagcuaacuagagcacaguuccugucuucagaggucaguagcauacuggaggagauggaaaagauugaaugaaucacagccucaugggguacuugagggaugauaugacuauuucucugcauagcauaucuccauuagagcacuaguccacuguguaacaauaaccuugcauacaugccugccacuucuaacuagugaguccuuccugggcaugaagcacguaucauuccucuguguacugcagaguuguagacacugugcuugacacauagauuuuaguaaauguuuauggguggaacuaaugagagaacuagaagagggagugaauugaauguucuugaguuaaugggaaggaguuaaugaaggccucacagaggggcaaaugagcuggaucuuguaggaucuguaggaguuuaccagguagagaagagugacuccaccagcaagguguuugggauuucuauaguuaauuguuaagaauuuauuccuguuccccagauccuuaugacuaaugccaacacuaaacauaaaacaggauguuacucuuucuacaaugagcuuugguguuuuuguuuuugaaaaauauuuucgguauaugguuuuuguuucugauaggaauucuccuuuaggcuauugucaauuuguuuuccuguaaugauuugaaacaauuauauuaacuuaaaaugaugucacaaugagugaaauaaugaaaaaaaguuauaguuauugaggguagucucaugaugagauaaagugcauacagcugcacucaugucgccaggugauuaagaacagaauugguauuaaggucaacggauuagcaaaaagggaggagauuauugucuuuucauuauuuugaaagaaguaccaucugcccuugauuguuuugguuuagguuuuauucagcccaaauuagaauccgcugugguguugauuguuccuuguuggugauagcccuagaacuguguuucccaucguugauacuugcauucacguuugcuaguucucucuucuccugugaagacaugaacguagcugcuccuuuaauuacauuuagcuaguuuuaauucagagauggcuauuggcccuuuguuuucuuaccaucuuuuauuguguucauuuuccuaguugauuuuuaauggugacaucacuaacagcucuaaagacucaaagcuuaccagacagcacgcuucccugggucagaagaugagaguccucuccucucucauucaguaccaggguguaccagugagaggcuugugaagggauuguuucggcgacuccuuaucuaagaaaugaagauaauuuuuaugaggugcauuuuggucugugggaguggaagggaaaaugacgguuucuuuccuauacuguccuuuguuuggaauggugaaaauguuuugaaucuguuucuggugugaucguuagguccaagauuucacgugacguugugugccggguguuguggucaacacacaggaaugcuccuuuauucucuguacggccuuugggugcaucauuugaguggauguucauuugcuugagacgauugucagagggaaucuugugugcccuuugcucucugugccugucauugcgaggguuucuuugagccggucugcugaccgucaggcacuugagauugacucggugaacaaugccgccagccuuucugaugcggcuccugcccucucugacuccuacacaggaucagaaucacucagauaucacuucuguugguggaggcgagagaagaauauuuauccaguuucugccuuucugcccccauuagcucuuuaccaaaaaaaaaaaaaaaaaaaaaaaaaaaaaaaaaaaaaaaaaaaaaaaaaaagcaaaaccaguuauucugugaaaauaugcaaagcagaguuuuggccuugaggaugcguauuugugacuugcuuuccuguacaguaagugcugccgccucaggagcgggcgcagucgcuuauggugccggugagccugcgcggcgcuggcuuuugcuccucuggugccaaugcagcucguugacagcuccaagauauuuggauaucucacucuuccggcuauuucagcugccaaacuagaaucccaaccuucugagagucuguucucuuuuggauuuguucauagaugucuauucucuccugaucugguucaugaacacucuggaagccaaguucauugaagacacucuggauguguaauuuggaagaggagacuggagcauggaggcuuuguuccuaguauuagagaaacacauagaaaggacacagugucuagcgcugguuaaggaaacuuaaaggaaaaagauuggggcucagaauuaggaaguaauuucucacaagcauagccauucugcuuuggaagaagcuggcuucuccuaucacuggaggcacccagacucgggcuggcgagggauuguuaggacgggggcuguguguguuguugcugguagaauugauggacuucaagucccauccuaguuuucaaggucuagaguccuuucaggaucuaggauuugauuuuuguaccuggucuucucucaggggguaguuuucucccaggcuuaaaggaagauauuugucuggaguuucuuuggacuguccuccugccugccugccucccucccgcccccaccuugggauccugguauauucugccggcucaccugagacguaguaagaguucugccugucagcugcaaggugcuggguggaaggucccugcuucccacucccgcucuccugccugccagccccacaguagugcugccugggcuuguguuucgccauguagccccucucgauaccgaugccauuugucuucugggcauccagauggugagugguggcugggcaugaucuuaaucggauucucccugugcacagccagccuugacucgaaaacugauuucagguguguggauaauacaaugauggcggcaagaaagaaagaaugcuuuucuguugguuguuggaacacauuuaaauugccacauggagaaagcacagugucuugauuugguggaguggauuuagucuugacaacaauacuucgguuaguaaggugauucugccuaguuaucuacaucccugagcucugucuaccuugugccaguaaacagauaugucacugugcagcccagcaccauaucuuugcuuuacuuuauuuagcuguaauacggguuuugcaaaagaccuaaaaauagaaauauugcauauguggcuguguuugcauuuauaguuacuaugagauauacauuugcccagguggauuucuuauaucccgaagcuccaaguauaagccaaccuuguauuuugcuuucacuguuuuccccuguauuuucucaugaucuucaauuuaacuacuuccuuuaaaauuauugaccacuguuaccuuaaaauuauaaauggggagaauagaguucucuuuuuuuccuuuggcuuaauccccuucccacuccucuuauucggaggaguagcgauuacuuggcagcauauggauucgucucauuccugguacaagccaaauauguguuuauuuuggacagcuagucugagugcugcgucccaacaucaccuuuccuaaucccugcugugccuucuccuggagggcuggcaccagagagcauugccuggaaagcagaguaaucugugcucuugagauuuuagagaauaaggauggauauuccuuguugggcgugacuuuuagucuucagaguaagaaagcacugacacaguauauugaucagguuuguucaguggaguguaguaaaggucauuuggugaauuccguauuuucaaauauuuagguuucuaauaugaugcgaaugguguuacguggaucuguguuguacugacgcugacauuuugacugucguuucuaaguaacguacuacuacuuuggauaaaaagcaccguggcuuaaccauugaagauaauguuacaaacuuagauagugguugagcuagcaaguaacuagugagaggaacuuuagcucuauaugcaggagaucagagcacagggagcuggcccccuggcugaccuuccuugugggcuacccacgccuugcaacugaagagcgguaauuaaauauauauucauagaagagugguaaaaucugcuuuguccguggaaaugagcuaaaauauuaagaauucaaggauguugggccaggauuugggcuuuaauuuggcgcgggagaaguguugggccugagcccuuguaggggugggacagggcagggguuugagugugaaugcugguguccagaggggucaggggcccugcagcccccucuagaagcugugacuugggaagcacccucguguccauuuggacccgucucaggugacuugaugugugugauccccccaucucuguucuguggcucucuaugggccuggggaaggggucccaggcauccucuugaagccauguggggaggcaccgagagcaggaggcuggcuucuccuggugucuuguccuuggcagggagcaagugacauccauuuugacuggugcugacagggugaauguacuagcauaggugugugcagcuggggcuguaccugccaggagcauccuggcgcgggucuccugccugagcuucuccuuguugggaaugcuguccuuaggcagauccucauuuucaggccucaccagaauugccuggccuggugggaagagaguggcugcgggcucccagagguucagcucagaguucuacuccacacuuccugggccagcuuccgccucugaacaccugagcugacacugggacugugaacccagauaagaugaucaugcucacagcugcagcucaggaugcagccagcuguguuuuuccuacuuccucucagcugggcaguuugcuggccucugaaaauucuagcccccccucccccuuuucuuuuuaggcagagugucgcucugucgcccaggcuggagugcaguggcgccaucucggcucacugcaagcuccgccucccagguucacaccguucuccugccucagccuccugaguagcugggaauacaggugcccaccaccaugcccagcuaauuuuuuuguauuuuuaguagagacggggcuucaccguguuagccaggauggucucgaucuccugaucucaugaucugcccuccucggccucccaaagugcugggauuacaggcgugagccaccaugcccggcaauuuuagcccuuuugacacacucuaugacccuucuuacgcgccucccgaggaggaagcaugcacuagagcgugacuacaaaccuggugccaugcuagagcgggagaggagugacugcaaaccuaggccucuguccugucaccuuuccuccagcuggugaaccaccuugucuacucccuugccccaacacagccgacagguggacagccagacacaugcagagccauuguuuuuucaaagaccuguuaaaguuuaaaggcuuuguucacucauucuugagacuaacaguucaaguucacaagaauaaauguggaauacaguaugcaccuaaaaauauaauacaguuuuaauuuucaucuguacuguuagcauuaaccagcacuuacugaauaauguccucuuaggacucuguguuaauugacuuuuuaagguugauuguuaauagagcaguagguugggaauuacaguauuggugaaauuuaacuguuuuucacguguguauaccuaaguccuauaaagggucuaauuuaguuugcuuuuuuuuuuuuuuuuuuuuuuuuugauacagagucucacuccgucacgcaggcuggagugcaguggcacaaucucagcucacugcacccucugccucccagguucaagcaauucucugccucagccucccaaguagcugggauuacaggcauccgccaccacgcccagcuaauuuuuuuuguauuuuuaguagagacaggguuucaccauguuggccaggcuggucucgaacuccugaccuugugauccacgcaucuuggccucccaaagugcugggauuacaggcgugagccaccgugcuuggccucgguuugcauauuuuauacuguguuaugaaaccguaucagcacuguuuuuuuuguuuguuuuaauauagaaauaauauguacguuguggacuccuccuuucaagcugggcauauuucauuuucacucugaacuagcuugguggccaagaaugaggcgucuggaaccaggauccuguuuuguggggguuuuguuuuguuuuguuuuguuugagauggagucucacucuguugcccaggcuggagugcaguggugcacucucggcucacugcagccucugccucccggguucaagagauucuccugccucagccucucgaguagcugggauuacaggugucugccaccaugccugguuaauuuuuuuuuaauuuuaguagagaugggguuuugccauguuggccaggcuggucuugaacugcugaccucaaaugauccucgcaccuuagccucccaaagugcugggauuauaggccugauccaccaugccuggcacagaacccugauuuugcuucuagauuugugaccuuuagcaaguuauuuaacuuguuugugccucaguuuucucacccgaaaaacuaggacugacaauggcauuuaaccugcugggcacuggugagugaacucgaugugugggugugugcacacguguguguguguguguguguguuuucaggcagcacgagcacggaauucauguuccggucuguugccagcugcuguaguucuuuuguugauggacucaucucacccccuccaacacagggaauguucuggaaggaaguguggcuacccugccaugguucugugucuaugggaaaucuuauucuccuggaaaacgcaaaguaaauucuucccuuuaagacagaacugagggccggugcgguggcuuaauuccuguaaucccagcacuuugggaggccgaggugggcagaucacuugaggccaggaguucgagaccaccuggucaacauggugaaacccccaucucuacuaaaaauauaaaaauuagcuggacaugguggcacacacuuguaaucccagcuacuggggggcugaggcaggagaaucaccugaauucgggaggcagauguugcagugagcugagaucgcaccacugcacuccagccugggcaacagagugagacuccaucucaaacaacaacaaaaaagacagaauugguaaaaauacugaucccuuggaaagaaguaacuauuuuagauaccauuguuuuauuaaaaauguacuugccucccucauauacacauauugauauaaugccaucuacauuuguauaauuuauaaauauuauacaauacuuaauacauauuauauuuaauauuaauaaauuauacaaauaaaacuuauagauuauaaaauaaguuuaguuauuuuaauauuuaaaugugcuaaauguaaguuuguaaaauuuaggaauaacuuguuagaaaggugaagaagcucuggauugaaagguaugugcugaggucaggaguccagcuugcucuccuuugaggagauggccuuguuuuuucuuucucucucucucuuuuuuuuuuuauuauauuuuaaguucuaggguuacaggugcacaacauguagguuuguuacauagguauacaugugccauguuggcuugcugcacccaucaacucgucauuuacauuagguaauucuccuaaugccaucccucccaagccccccgucccccgcccggccccagugugugauguuccccgcccuguguccaugucuucucauuuuucaccucccaccuaugagugagaacacaugguguguuugguuuucuguccuugugauaguuuugcugagaaugaugguuuccagcuucauccacgucccugcagaggacaugaacucauccuuuuuuuguuuguuuguuuguuuugagauggagucuugcucugucgcccaggcuggaaugcagucgcacgaucucggcucacugcaagcuccgcuucccggguucacaccauucuccugccucagccucccaaguagcugagacuacagguggccgccaccacgccuggcuaauuuuuuguauuuuguuuaguagagacaggguuucaccauguuagccaggauggucucgaucuccugaccucaugauccacccgccucggccucccaaagugcugggauuacaggugugaaccaccgcaccuggccacagccuuucuuaaggcaaucacgagacccagcccaucguggccuggugaaggagcaagcccuaggcuucauucucaguuuggaaaaaaccgucauugcccagaaugucccauuuacacauuaauuccuaaauggaaugaugggagcgcugggugcucagaggcuuccuuuugaggauuugccagcugcuucuggacuguaacuuuugcagcaacuucugcacucauucaucaggugcagagcagugucuuagaaaugagugagucuuagugauuucuuggaguguggauccauacacacuuaccucuuuucugaacuauagaugggaagcugcugcaaaaaagcaaggugcagccccuuucuuguaugagggaagcuacuguuuaccauccauggcugcuugaguuuuuagagcugcgucagaugaauaacuuguugguaucacucgucaaucuuagaggcacuuucagagauuaggaauugugaccaacaggagagacuaucuggcauuaggaacaccagggccuauuuuggaucaugcuguacugcuuacggucaugcccuguccaaucugggaugacuguggcauacaagucaccauggccauugugaagcccuuguucuuggagacccugugcuccagguguggcugguugguucccuguggcaggacccccagaggccccagggguugugagagucaggggugugcagguucugagggcuuugcugggugggccgagguugagugggcugguugcagaauccuggugcccagaggguucuucuuugccuguugcuggggacucacgccuugugaggggaccuuucuuuauuacccugaugaggacagaagaguuccugagaggaagccacaagccgccucccugaccuggcagcugccugugugcccugguguguggguuccucccuuccuggguucaugcagcagacucuuggcagugcaggccuccuuccaggggcucucagggcucaguucucaucucucugggucacacugagcccugcugaucccccuccuguguggcugccucucugaugccugaaacaccuucagcuguuagucccacggccucucaucaccucgauauccuuuucugcuugcuuucugguuuucaguggcugccagcagaggcuguaaugcuccccugggaccugaccaguagagaacaaaugcuaugaagaccagaggccccucacugcuccacgcguauacagggugcgucugucuggacagccgaaggcccaugggugguuuuguuuucaaaacacaaugaaaaaugacuagucaugccauauuguuagcaccuuucgauuuuuuuuacuguaaaaaucaaaacagaaauauuuggcuccagagcucugugaaccccgaaaauuugagacgggucucaguuaaucuugaaaguuuacuuugccaagguugaggaugugcgcucauuaacacagccucaggagaucuaacaacaugugcccgagguggccugagcacagcuugguacguuuuagggagacaugagacaccaaucaauacauguaaaauaaacauugguuagguccagaaaggcaggaccacucaaaguggggagggggcuucugacauucuuuugaguuucugaugagccuuuccaaaggaggcaaucagauaugcacuuagugagcagggcgaugacuuugaauagagugggaggcagguuuguccugagcauuuuccagcuugaauuuucccuuuagcuuagugauuuugggggccuaagauuuuuguuuuccacaggucuuuuuaggaauuuuaaagauguaucucauccaguaaagcugaaguccccccaagugguagcugaccauagacuaagccuccugcuguacggggcacccgcugggagggaagaggugcuggccaaggugaauagauggucagaugggcgauaggaaugaacacuuugccaugguggaugugcuuuagugauagaauuuguucaggagauuaucuuuguuccugguuugggaaggcagagcuucuauauuggaauucuuugucucccagaauaaaaacucuaacaucaccuguauuauauuguggggauuaaaaucaugcacuuguagccaaaccuagguaugagugugagcguacacugcugacagauugaaauuugacguccgaauucugguucccaggaaggagauauauauauacacacacacacacacacacacacacacacacguguguguguauauauauacguggagauauagauauauauauauauauauauauauagauauauauauauauauauauuuuuuuuuuuuuuuagacagagucuugcucugaagcccaggauggagcgcaguggcgugaucaugguucacaacagccaugggcuuaagcagucuucccaccuuagccacccaaguagcugagacuacagacacaugccaucaugcccagcuaauuaaaauaauuuuuuuuuuuuuuuguagagaugaggucuuacugugcugcccaggcuggucucagacccuugagcuuaagugaaccuccugucucugccucccaaauguugggauuaugggccugagccacugggcuuggcuuaggaaggcuuuuugaauaauuaucuuccucacucuucuuuccacccacucuccauucaacccugaugaacccugcuggacuucauuacauuucugcucacuugacaugcagauugcagaucaggugggcgggagcugauaacauucucacuuggccucaguuuccucguauguccaaugaagggaugcacccuagcucuaaaaguaaacauuguucucaacagaagaaucugggcauuugcuaucaaacagauucccauucuucaggcaguuaauuuuccacaccacaggagauguuugugacauuucccauuucuuugaagucuaaaguagauauugauccuuuggaaggagauuaaguucuccgguuccaucagguguaaugauuucaguuuuaguguuccuagguggggagugcuaacccaaaccuuucauauguaggaaugucaucccucugcagaccuuugaguccagauuucauuuguaguugaccuuugggggugacaguccgauauguguaaaucguaauagcccuucaucguagauaccaguuuaaaauucauuuuaggugaguuuccaaacagauauauuggauguauaucaguuuaauuugauaaacaugcagauaaaaacuuauuacaugaggaccaguguuugaaagauggcuuacaugaccugaugaguuuucauuuuguccguuuccaaaauacacaggaaugcaggaaugccaccuucguucagaucagacuuaucuucuucgcaggauguggccagagauuuauuuaagacauuagcugugaugaggaaggucagauaauuuaagcaggggcaaaguacacauuacugaggauucagcgcucuuugguagaaggauguguuccuggauuuuuuuuuucuuuuuuuuuuggauuuuucuucuuaaucgccgcucucugacuuuuuuuuuuuuuuuuuuuugagauggagucucacucugucacccaggcuggagugcaguggcgccaucuuggcucacugcaaccuccgccuccuggguucacgccauucucccgccucagccuccagaguagcugggauuacaggcacgcaccaccauacccagcuaauuuuuguauuuucaguagagacgggguuucaccaugcuggccaggcuggucucaaagucccaaccuugaucaagugaucugcccaccucggucucccaaagugcugggauuacaggcgugagccaccacgcccagccuugcccucggaucuugaaccuccugucuacucuugcugggcuguagauggacagaggugucaguauuuuaggagugugaucucuccuuuugcucauugguguuugaggucuguggugucuguuuggggagcaggugugugcaggaaggaaucugcacucuccacuuuugcuuucccaacauuguuuuuuucauucucucuggaaggucaugacgguccccuccacucacucaccucucacauuuccagccccucuacuucagacagacuuccgaaacuuucugccucucuugggguacuuuaguaugcccugcagauguaagcugcuuucagaaaaagccagauccugccacaugagacugcaggcccuacuagaaucuguucuaucccacaucuccaguuauaggugggugggaagugggaauuggaauuuuuuccuuuuguucagauuuucgucaugaccacguguguacccguuaagacuagacaagggagucaccgcugcugaaagaaaagucauuguguauucauuuugcauuggaggaaaugagcauuggggugcuuuggugacagcuuggaggagcaggggagucaguggcaugacuaggccuggguccccucaucccgccccucauucacccgcuagugcuguuugagggccagaaccaacugugccuguguuuagacuggguuuguugcugugucacaguaacgcaauugcagcagcagcagccgcacccguguaacguucgccaagcuggguacuguuggaagcacuuugcuugcauuugugcagcgauuccagcaacaacccugugcgguagauuauugucccauaaaucuauaagauugauugauugguuaucuguaggagacaucuacguauacguauuuauagagcaaugaagaaauaagcccaaggcuaucccaugaguuaggggcuucagggcuucugcgcuuugcuggcccuugugcugccuucgguagauggccccggcccugccuaugccuuggacacucuucauucgcuagcaccgagaugguucagggcacuuuggagcuagagcaagagcaauggagagagugagguugccguguccacaagucacugcacagcucaccacgcgggccuggagugagccugcugcuguucaucggcccguagggucuccagcacaauaccggguuagugagcagaaaguagugcacugauuauguuuccauuacaccauagaacauaacaauuuugacugcagagaggcaggcagaauagcuuguccaggaaaauaauagugcguuuguaagccagagaaagaugguacugugugguggggaauucugaaagucuuaagucuguuucucaacuccccucuuguuuucauuguuucaggcaaauaauuucugauggacaccaaauuggcaggucaccauagggaccuccccuaaccucaaaucuguguaaugaaguaucugcaacauuuccacucauuugagaguuccacuuuucaggacagucauagagcugcacuguugguaaacuguccugcauguguguacgugcacacuugugugacgugucagcucgugccugcagagacucugccagcagggcugaggcugcugccaggagagcaucuggggugguguccuacaccuccuuuccaggaguuucugugugcaugaugcacuucagaaccuauagugucauuugugguauuuuuuuuuuuaaauacugcuuuuguuuauuuucccuggucuaauuuuuucagaugguaaauagaucgcguuguugcaugcguuugaugaaagugauaucacagcaaaugcaaaggugacugggaguucuaagccccugggugucucucccucgggguuuucaugcaguauugacacucucuucuccccaggugcugaguccccagguuccccucucccccuaccugagguacugagggaucucacuugcuaccugcuuggagccaguccaguggcuucacuuuuaccacucagagaacuuuaguacacagucuuaaacaacccuggaauguugagcuaaaagggacucugacccucccuccgcaccccacccuuuaaaggugaaagcagcaggugggguggacuccuggggcuggggaggccgugcccugggggcaggugcaggagggagccuggcucuucagguuaaauuguguuucaaaggcagagcucacauuggagcacuugauauuaugcauuugaaacauugagacacagcuucuaguuuaaaauaaaggugauagccaaggaggaaagcaugguuuauuccuagcuuccgguagaggaggcuggccaacucagacaccuaagcagccacaucagacccagaguccgagguagaauggauauugcuaaagcugagagcuacagcagagcgucugcuugaggagcucugacgggcugggcagccagugcuccuggcccugaauguguuugaaggagcucuuuggaaagaggugcaggcuuccggcuauugguagacaccugucugcuuggggcagguauacugacuuuuuguugcuuuuacgguuaucuucggguaaagucauuguguuucuucuugauuuauuuauuuuuuucuccagucuagucauaguauugguuucgagaagucaaaaucaauguuuuauuuucagaguucuaaauccagccauauaaauacuucggaucuggccugaggguuuggcagggauucguggcugcuauuuuagauaugccaggagccuucuuggaagucgcucaccaccugguuuucuccaauuaggcuaugagccuguaucuuagaacacucagauuagugugccuagagugccaagguggggguuguagacaagauucuacccccuccuccagacucugcucccuaggccgaggugaggccagcaaggagucugccccaugcgauucugaggccuuggucccuucugagagaccccagccccgagaggcucugggcugcuggaugcuggugccuuuucccaccgucaaucaagcacaugcgcauagggcucugugccuggccccaggacugucauauccagggaaaggucacucucuggcaguggaugcuacccuguugguggcaaguuagaaaggcacacguugguaauggccaaugguugccagugccuuacuuuuggagacaggaauuguuacacgucuccguugcgagaagcaaaaguagauuuaacacaucuuuaaaauccgcugaagacuguaaagauacucauuugagaugugccaacauuuagucggauucugugacuggucgugagucccucuuccuccacacagcaacacugguucuaaaacagucggauagccguggucauuuguggaugugagcacagccaggucccauguugacaagugcuggacaguggacaccagcgggagacucaguacaaaucauguugcuuugggcuuaugcacaucugcagaaggcugcaagcuggggaacugaggggccucuuggucuggggaccacgccucccuucccuuccuucccuguccugagugugaccuccgucauguugaccccugcacuccugcccgccccccauucacccacuaggagaaaguacuggauagggaugagcuuggggacaauggccagugacauccaggagagggaacuuagaggcaaggcagggaugcaaaaucggaguuccuaguagaaacagacaugcagcauauugugaaauguuucagagaaauaacagcaucacgauagcacauucucuaguugcugguuaucuaguuacuagugguaagacagagccaguuaacaaagacuauaaaguuuucucaagaggauguaaaccaaguaaacaaaauaaauucagaccccaagugcgcauauugaguuugaauauucaucuaagaagcuuuuguacaugcguuauguauccauaagccaaagccgggggcucccuggcagaugccccuaccuggccaggucucgucgugucuagguggugacagccauguagauaugcccgcugccuugcaccuguuccucuggccucgccucuguaacagaacguggccccugccuuccaucuuccccagggugccaguggggaccuugccuucuccagcacugggccguccacuuugcuccuuugugccugcacugccaggugcacaucgagccuaaucuggcuuaggaaacaggaggggcaccagcuagaaaaugugacccauguugccaacucccaaaagccaccaggugacuuccacugccguuagaaugaaacccaaacucugcacuccagccccagcaucaaaccauacuucgcccugcugccccuaugcucuccccccuugcccuccccccuugccuuccugggccauccuuuucugacucagccucagugccuagccaguggguuccccucgcugacccucagcccucaggcccagcaccucagagaagccgaugacugacgugcaccccgccagccucccugcuuauccuucccugccgccucguguguccugcauggcauuuguuacagcccgcagucacaggucuugcgguggacuugcuggucggcugcucugcugauucucgaaggcggagucagggugugcuuggugugcguaucucccuugauguggcacugccuggcuccggagauagcgagggagggagggaggcagugagcaggaccuguugcugucggugguggcaucaguggaguuggcagguacugugcaugggagagggaguguggccugcaggccaguggcugaggcccaguguggacuguagagugucagauuccacuugcuggccuaggggccuuccugaugugggcugcggcagucaccacuggggaaggccaugcagaggcugacuccuugggaaggaggcucuggaaggagagcaugugcagaauguuuccugcagugccucuugagcucccgccugaggguuugcucagccggcaggccuagaggagggggcuuuggggcugcagugcagucuuugcaaaggguucaaggguccugaaggugguggcacuguggccuuaggagcugggguaguacucaaagcuauccccaaguaggcacgggggcugggccuuuaugccugucaccagucuaugauuggacguguucugcccuccaggggucauauccuugggccacaccacucacuucucugcccaagugcagucucuggcauggggacucagccuagagugaucagccaccugcacucccagcagccagguacugaaggcuuuaccccugaacagagggacaggcuggugcccaccacagucaugcgaaggcauugcggaaagcucucauuaaaagagcauuaagccaggccugguggcucacggcuguaguccuagguacucgaagcugcggcgggaggaucacgagcucaggaguucgagugcagccugggcaacauagugaggccucgucuccaaaaaaccccacaaaacauuagaaguaguaguacuugcuauucucauaggaggauguagaaauuagauaagaguuaacugagaauagauuugaauuagcuuuuauucccacugaaaaaaucagaaauaaacuugauuuccucuggcauaaguguggguccugugaguugauccucagcccuuacuuggggguuaaugacguucccauuugaaaaacauggcaguuucaaugucuguuaauguugcaaagcauaccaggaacauuuuauaaaaaguaacagaaacuaccaugugauucuggaagcugcauaguuaacuguccauuuaucuugaagucuagugauucaaagcaugaggaauaagaucgggaagcuggccagaugugguggcuuacaccuguaauccuagcacuuugggaggcugagguggguggaucaucugaggucaggaauucaagaccagccuggccaacauggugaaaccccgccucuacuaaaaauacaaaaauuuggccaggcaugguggcucacacuuguaaucccagcacuuuaggaggccgaggcgggcggaucauggggucaggagaucgagaccauccuggcuaucauggugaaaccccgucucuacuaaaaauacaaaaaguuagcugggcgugguggcgggcgcauguauucccagcuacuugggaggcugaggcagaagaauggcgugaacacgggaggcagagcuugcagauagccgagaucgcaccacugcacuccagccugggcgacagagcgagacucugucucaaaaaaaaaaaaaaaaaaaauuagcugggcaugguggcagugcccuguaaucacagcuccucgggaggcugaggcaagagaauugcuuuaaccugggagguggagguugcagucagccgagaucgcgccacugcacuccagccucugcaauagaacgagacuccgccucagggagaaaaaaaaaaagaaaaaaaggaagcugcuaccuucccaaggacacuugcuccuccucgucuugcucaggcaucuccugggcaccuuucggggcaaguccugcugucacugcacagcucaccuuguauauguggggugcucuucuccucuccugaggaguuaugggugauuaggaagcaaacgcgucucagacuuggagaucaaaugaagagaggcuguguaagcaccaggaugcaugggggguuccggcuucuucgcaguuucaccugguuuaacccaaaggcaagcaacagggaugcccagggcgggugagaggugcugagcggagcuccauaguuggagaauguaaguauuuaaaaauucuugugucuauuuuacuauuaaauagacuguauaaccucaaaaccaguuaagaaucuuugacauucauggugugaaggaugagaagcugggaaauaacaaggaccuuuuccucguguuuccuccuuaauuaugcuugccaguguuuuaagcaucgaggcugaccuucgcaggcuucaggguuucagcuugaucaccauguggauguggaugagucaguucacuccauaauagcucuuagagguguagaaaggaacuacuucuuuccaugagugcaccuuuauugcccuaucuuauagaaauaguagaugcucaucguaaagacuuacaacaggauugaaauugguaaagagaaaaaggcaauccccuacccccgucccucagagauagcugcuguugucagaucaguuggauauucuugaagacagcuuccuucacggguguuuauaugucgucucugucagucaguuacauggugaacagacagcggcucagguuacagacgaucuguagcccaguguuugugcucaguauauuacacuugaucugucguggaacuuuuuucaagaacagacagcuuuuguucuggacacaguauuugguggggccuaggucugccuguaagcauacauauuggcagagcagugucucuuccacaucugagcuggucaggcagagggccgggcgcagugggggcacuuugcugggugaaagagguaagagguaagucagcaggggcacaaagaaaccaugcguauucacaggagcaucugagcuccaagcccagggagcugagaggggucacuguccuucacaaggagguggcuucuuuucuggacaucagacagcauuguugcaggagauacugaauaaccaaccccucugugauguagucuucaaguuuuauucccuugggugcaccagcggaaggucugugcugagaacagaggagggccgaggagacacuugcaugggguugucgacagaggggcaccaggauggguauugcccagagggaaccugcaugauuguuuuguuuaccauuuuucuugagacggaguuucacuguguugcccaggcuggagugcaguggcgugaucucagcucacugcaaccuccgccucucgauuucaagcgauucuccugccucagccuccaaaguagcuaggauuacaggcgugcacccccaugcccagcuaauuuuuguacuucuaguagagacaggguuucuccauguuggucaggcuggucuugaacuccugaccucgggugauccaccugccucggccucccaaaauguugggauuacaggcgugagccacggcccccagccuguuuaccaauuuuuaaaccauggcuuaugacccuuacccugagcaucagugacaggggaaccaagagucgugugaggucccagggugcacaguggacauuucagugugaagggcgggucgggugccccagcuuccacgcuuuccagccuggauuguggcaucuuggaugugaggccacagaccaagcucacagggaugagagaugguccgugugggucagccggcucaacagaccuucucccaggaggcugauuagauuugcugagcauuacaaccugaugggcaggauuuguuuuaaucauguaacacaaucacaaaauuaguaguggcaccaugcuaucgcugccccuuucccaugcaugugcugcagacuuaucugugggggaaaaauuauccaugccaccucucagaaugagccccguccccaccuuauacgagaccaucccagccaacacagugaaaccccgucucuacuaaaaauacagaaauuagcugggugugguggcacacgucuguaauccuagcuacucgggaggcugaggcuggagaaucucuugaaccagggagucagagguugcagugaaccaagauggcaccacugcacuccagccuggcgacagagccuggagacucgaucucaaaaaaaaaaagagaaguauccuaacuuuuguuucauucgauuugccauuaaguccgguuauuuuagcugaaccuuccccuuaggucagugccagcccauuaaccugagagaagcugggacagccccaggcaccagccagcuuuaggucugcguggaaaggguguucuuacuaagagcagauucugggaggugagagcuggaagaaccggaggcagcccucccauuucacagaugaagagauuaaggccccaagaggcuaagugacucgcagaaaagcugcccaggcguuccauguagagcauggauuugaaccagcauugccgcaucgggauggggaggugcugguuugcuuguuagcuguguuggguguacauguuguucgucuucaugugagguuguuagaaguaguuuagccacauuaagugcccagugcccccacuucccccugcaauccccgaugaagcaaugcuucucugugagugacauggcaggggggaccaauaccuaguggacugucugugucugucaccccugugccugggaggggugacccuuggcuucacagacugugcucccuucaccuugccccacggacccucccccaaccaauuucuuagucugcucuuguggcgaaaauucagcaacaguaaggagugaguuaauucugauugcucuuucugugguaaucuucuggauuuauuugugucuauuauugagccaucccuuauuauaaacauuaauuucaccaugaauuaaacaguaugacugacugaguuuauaauucuuucuggaaugaaaacugucaggcccaauuauauccagcccaggacugacagaaacucagcauaugaauuguaaauaucuugucuccugcguucuuuauuuuaaccagggaaaauguucucgugucuaucaacuugucuuaacuucagcaaauacaguggcucuugcauacuaccagcaucuaagcugcagucgaaauuaucuuuuaauacagcagucuccaagcuuuuuuggcaccagugacugguuuuguggaagacaguuuuuccagggacccaggggucgagggaggggggaugguuugggaugaaacuguuccagcucagaucaucaggcauuagauucucauaaagagcacacauccuagaucccucacaggugugguucacaguggagcuugcacuccugugagacucuaaugccgccgcugauaugacaggaggcggggcucaggagguggugugagcuuauggggagcagcuguaaauacagaugaagcuucgcuuugcuugcucacacgcugcucaccuccagcuguguggcccuguucccagccagccacggaugaguaccaguccacgucccugcgguuggggaccccuguuuuaauauacaucuccacccaaacugcaguaagacaaauagcugucuacucuuacaucucaugaaaaaaaaauggcugugaauuuaaccuacggauuuuguuuuuucuugcaguuucugacuuguaccuuuucauaaaauaucccuauucaacauuuucacuuucaaggacucagcaguuucauuuuagguguuaaaauguuuuaaagcauucucgagaucuguucaaaauucuacgucuuauaugaaauguaggauucuggcuuuggucuaaggugacaauguucuaccgcuucuuaggggugccaggaaccccuggcgggaggccgugucucccuagugugacagcuggcguucuggugguggcgcucaguguguuccuacagucauuuucucagguucuuguuauuguagcagcuugaugguugcauaauuauucaucauaccuaucacaauuuuuaaauuuuuauugcucuucccacuuuagauagaagcucaguuacucagaggcucaacaauaaauugaacauguagucagcaugugaaaaccccaggguggguuuuuagcaagcuccugaaggcaggugucuggagauuagagaggagaggagcacaggggagccccgugcccauaccuguggcugguuggugguguaggcaggagaugguggccuggaccaccacgggcaucagacaucccccccccccaccccaccuaggcucgcacaggagggacggggaggcaggagggaaagaacuggucgggcaggacgucccuacaugcccccucccuuccccuccagcuuuucuccuacuuuggugggguguuacugcuggggcaugggaacagcggaugagcugggucagggggaugggggucuagggcuuggggagaccuccuguagauacaggcagugucuuugguugcguugucuugcuacagagagccugauguauuuguaagaagacuaagaagguuuuggaugauggugaucaggugcuuguucccuuuagcaggggaaauuggggcugacuuuauaacauuggagcucacuauauacuagaaguugaauuguacuuuuuuccccuggaguucugugacuccuuugaauucucacggguuaaaugggauccuggauacucccucccucuuuguaaaaccccuggagcauuuuguggcugaaauuuacuucuuagagccaugaaaugcccuccaaaaagugaagcaccacauccaaauugcauuccaugcccaaagugguuaacaucccucagagaugcaaacucagaagcauuuuugguuuugagagccacagugcuuuacccauaggaugggcaggccauuccuucugcugacugcgucagcaguccgggcuccaggagaaccagcauucgcagugggggugucugcacucucuaccaagcuguccagguucaggaauuaaagauggaagugagagccugugaaacaaggaagcuaugagguguggggcuuugccagaagugccagggaggcuguaaaauguguuuuggaggcaaccucaggcugguucuucuggggaccucgguguugggggaacggccuguuucuguagcuugggaugaacuucuucccugcaucugugaacaagcuuguacucagccuguagguuaacaagcuggggccagaaggcuguacugcacuggacccaaaaccugcccuaggaagaugcuugcaacaaaacuuguuaucaccuugguuuauaacagugagauggaaacgggauggaauuggggcauggguuucaggacuaugaaguuauuauuuaugcauuaaauauuccgaagcagccucagcuaauggaacacaguucuucugaaggaaaugcggaagauaaucccagcagugcaggagagcugugcuccacuccucaaggcuguaggugggccucuguuuucacauuuuaagaaggaaagggcaauuuucuuccuugccguuuugacuuucaaauccucacgcccucugcuuugauucucucagacgugaauccuuuaagcagugcuuuacacacccacgacaagggcguucuuggggaacaccgugauucuggagggguauuaugaggcacucaggaaugcuuuugaagaaacuguaaugaaaaugagggccggguguguuggcucacacuuguaaucccagcacuuugggaggccgaggcagguggaucauuugaagucaggaguuccagaccagccuggggaacauggcgaaaccccgucucuacugaaaauacaaaaauuagccaggcaugguagcgcgugccuguagucccagcuacucaagagacugaggcgggagaaucacuugaacccuggaggcauagguugcagugagccaagauugugccacugcacuccaggcugggcgacaaagcgagaaucugucucugucucucucucucucucucuguguauauauaguauauauuauauauguauauauuguauacucuacauaguauauauuuauaauauauguauauaauguauaauauaugcauauauuauguauuacacaugcuagcauauuuguaauauauauauuauguauuauguauauauuauauauguauauauuauauaugcuauaauauaguuauauguauauauuauauaugcuauaauauaguuauauguauauauuauauaugcuauaauauaguuauauguauauauuauauacucuauaauauaguuauauguacauauuauauauuauguauauaugauaugcucuauuuaguguauauuuuauauauuuauauauauggggggguggaaaucacuauccucuaagaaguuacaaaccugcaaauccucuagagcccauuugggccggcaaacuuuugccuugggauuuccuuagaggagaagagagaggacccagucaaaugcugacguuguugugacagauucuaagucgccucagggcucaggggaaagagccuuggaauugcaggcaguggcguggauguaccugcaggggugggcaugguggcaucuugguggccagguguucgucacccugcacugagagggccuggugaauggcaaggucaggggaugcuguccggacaugucaggaugggaaacugucuugucuguggaucuuugaggcugcugaaaaggaucuuugagccugaacuuccagggaagccugaaaccaaucugguauccccaggguuuauguuuuauuucauuuauuauagggauucaaggauuuccaaauaagaaauuaaauccuaccauugaaacugugcuggugaacuucugcuaaguccuacauuugaaagucaucagcggauuaugucugauccaguuugcagcgggcucuuuuccggcugcguugaaauggauuucuuuauucuauuuaagacuccacuuccuuccucggcacagaacugacaggcuguggcagccacagccuccuccgaugcuccucuccucuguggauguaccaucuuucuuccauuguuguuuuguuuuauauuugggggcuuuacggcugcuuuaaacuaaaaauaaaugcuccuccccuuuucugugcuaaaaauaauaguuaaaauccuugugacguuuaagguuuucaaagaaaauucccaauuucugagauaauauguuguuuuuaaaaugucaccugcaauuucagguuccuuuuuuuagccuuguguauaauuucacgaguuuugucuggaaugcguauuugugguuccuggagccaaacagaauugggggcugggcugggggugaacgugacacgggagaccaucaagucauucuaauauuggcugcaugcugugcuucuaguugauaauuuggaggagaaaauuagaguccauagcucugcuggggaaugagcccaccugccagacgauggcugucuuaaugaagaugagguccuggcucccuugucuaaugaagaaugugggggagccuuuagcagaaggcucugaaaucccgaggaaggacgcaguggaggcaccgcuggacaggagcugccuucccugguccuugcagccaggcuccugcagccugggaagguggggcuuccucaucucagguccagaauccucugaaaguucucuuccuugaccauaguccuugggcccuguucccuuguugguguuguuugcugagguagaaugcuaagauaggccaacuggagucauuuccaggauuacuucccauucuagaauuuuugguauauguugguagucauaucacauggaugacuuuuuucauacacguuuaugugcuguagguugaaccccacugugaaauugccacuauucaaacauauuugaccauauuugugccuccagcacagcagcgaguacaaguagcacaugugccugucuccaagcaggaacaucuccuccuggcuguggucagauugaucuggcaauuuuuaugugguuugauggaauauaaauugaccugggaugaaaacugacuccaguaaagccuucuaguuuguuuuacuccauguggaguuaguggucacugugagccaguuuucuugguuuuuuuuuuuuggacagagucuggcucugucacucaggcuggagugcaguggcgcaaucucagcucacugccaccuccaccucccggguuuaagcaauucuccugccccagccuccugaguagcugggauuacaggcgcacaccaccucacuuggcuaguuuuuauauuuuuaguggagacugggugucaccauguuggccaggcuggucucaaauuccugaccucaagugauccgccugccucagccucacaaagugcugggauuacaggcgugagucaccacgcccggcccgagccacgguuuuccaucccuggugugguugcuucaucaggacuuggcaggccauguguuacuccaggcucacuugugccuccagcgcagcagugaguucagguagcaugugugccugucucugagcgggagcauccucccccggcuguggcaccugggcaacgggacaucaauuccugcucuuuaauccuacccccaaagguaauaggagagcuuccucuguggguaguugggcccuuucccaggcauccugccaccuccuuggcagcaucuccuuggaaccuuacagaagccuuaggaaagaauugcuccccucuucuccccucccccuccuuccccucccccgcuucccuccccucccccgcccauccuccaggcuggagugcagccuucccucccucgcucuaucccccaggcuggagugcgguggcacaaucucggcuuaccacaaccuccgccuccugggucaagcaauucuccugccuuagccuccaaguaccugggauuacaggcaccugccaccaugcccggcuaauuuuuguauuuuuaguagagauggaguuuugccauguugacgaggcuagucuggaacuccugaccucaggugauccaccugcaggcuaaucucaaacuccugaccucaggugaucugccugcaggcuagucuugaacuccugaucucaggugauccacgccccuuggccuccaaguacugggauuacaggggugagccaccucgcgcccgaccagaaaugcuucuauuuuauggugaggaaauugagagaccagaaaguuaaccgaggucacugucaaacccauggcuccuggcucccugaccccucacacccauuucccucugcguccucuugaucucccauggacacugggaugggcagggccaggugggagaagcagggcucaucucugagggcugcguuaugggguaggaguuuagccucaguaacugcagcacuuucugcccauggcaaccugugcuguuuucacauuucucagaaauucccgcucuuggaguuuuacacuuguaacaucugcuuagcaaauuuugaaaaauugaagaugaagaguaauaaaguguggacaaagcucugcagggagcuuguuagaaaugcugauuugaggccgggcgugguggcucaugccuauauucccagcacuugggaggccgaggccagcggaucacgaggucaggagaucgagaccauccuggccaacauggugaaaccccgucucuacuaaaaauacaaaaauuacccagaugugguggcgggcgccuguagucccagcuacucgagaggcugaggcaggagaaucucuugaacucgggagguggagguugcagugagccaagaucgcgccacuacacuccagccuggcaacagagcgagacuccgucucaaaaaagaaaugccgauuugaagguucugauuuccagagucccggcugaugcucaccuguugcuggcuuugcuaagcgucccagguuagucuagggcgagcaggcucugagcaacacagcagauaaugagggagggauuuagaaucuggcauugccaaggaggucaagggggacuuucccaagugucccgcuguguccagaggcagcagcagggagaaccuguccugaagggcugcaguggucggcgagcccggcaccugucuaguucuugggaaggaucauuacuaucaccaacgucgauuguaaaauacaagaugcuuuuuucuuuuuuuuuuuuuuuuuuuuuuuuuuugcgacagagucucacucuguugcccaggcuggagugcaauggugggaucucggcucgcugcaaccucuaccucccggguucaagcacuucuccugccucagccucccgagcagcugggauuacaaucaugugccaccacgccuggcuaauuuuuguauuuuuaguagagacgagguuucgccauguuggccaggcuggucuugaacuccugaccucaggugaucugcgcgccucggccuccuaaaguguugggauuacaggcgugagccaccacgccuggcccagacacuucugagaacgagcuacauccucugugccacuggauucuggcugguccaggaacacaggugugcacacauccggaugugcauccacacacucaugcgcauaugcccagcuguguuucccugaagcauauuuauccuuccaguguuccugcaccuuggaaggaagcaggacagcuggccuggacccugccccacccuuccucgaccccaccuacugagugaugaacaauuccacgccagcacaguguccagcccacagauaggucccuguaguggaguaggaggaaggacuauuuugguaugcauggcuuucgcgaauguuuuguuaauuuucguuuagcuuuguaugaggcagcauuccauuuugacugggcgguaacagaguugaugaaaguuuuuaaaauaaauacuuuuuaaugggagaugaagaguuuuggccaauugagucaagcauuuauuuuauuacucuuauugccacaaacacaaauauguuccauucaagugaggauguauuugcaaguaaaaagaugcuucacauuguuccaauguuuauauaaucaugcaucuuuguuuaauggagcacugcuuaauuuauaaugaauauuuuauauuguuagaaaguuaaucuuauggugguauguguugaaaaaucagcagugcauugaugaauagagcucauuuuaauucacaguuuacccucuuuguuuuacuauuaaaguucauuuuuaaaacuucacgauuuaauuucuuaugugccaaauggaauaaaccuuaaaaggugccagaagguaacaaugaaaggaaaaucaucucaucacccuugacuucagccaucuaguuccuaacccuaaaucagcaccuguuaaguuggaaauuuuaccagaaauagucucagccuugacaagcauaugcauauuuauuuuguuuuguuuuguuuguuuguuuguuuuuuaaauaacgagauggagucucgcucugucgcccaggcuggagugcaguggcacagucucggcucacugcaaccuccgccuccuggguugaugccauucuccugccucaggcucccgaguaacugggacuacaggcgcccgccaccacgcccggcuaauuuuuuuuuguauuuuucaguagaguugggguuucaccauguuagccaggaugaucuugaucuccugaccucgugauccgcccgccucggccucccaaauuacaggccugagccaccgcgcccggccaagcguauacauauuuugcaccccucacccccgauacacuuuuuagaaaugcauuugugaggauccuauccaucucuguaucgcaccuggcugucaucacuugauaguagccuggggacuuggggaauccccacugcaguauguugagcuucaguuacugguuuuacuauuccaugauguggcuauauccacaguuacuuaaccagggugugguuuguuacagugcagcaacagagugacguucugagaagccagacacuauuggggccugcauuuuggagucaucaucauugaccuuucaguuuucccuggaccauuagggucacuuugcagauccucuaaggccacauucccauuuuucugcaagaguagucgauaacagaaagaaguguuuuccaaauuaauugguaaugcuguucacugaugguauuaagacacaauuaguuaccccugacugagcgcuugcugggugucaggcccacgcuagugcguuccucgcaucaucuguccacggguaauguuugucugcagcauguuggggugguguuugggugcacaauuaugcaaaauuuugcgcccccgauauuuagcucccaauguguccgugucagugggaggagaguagaggggcagugacuggaagucuuugcgggcagugcagggagaaguccgccucccaggcaucuucuuccucagggcucuugggcuuuccuccugagcuccugcagaugggccucugccggucugcucugccagcuggacaggcauguugugccccgaaagucucugcccucuagagaucacucagaucuccuccugaucuacccagcuguccuuuccuggagcagggaguguuccucugacgggaugucucacucggcaucgggagacccuugacgcugucauugcagggcccguggcaucugguuugcugcacaguugcccuccccaugaccccccccccccccgcccagaacacacugggcagaugugccccccacucugugaccugguggguugugcucccccggcgugugaccuggugggacgugcuccccagcgugugacaugguggguugugcucccccggcgugugacuuggugggacgugcuccccagcaugugacaugauggguugugcucccccggcgugugacuuggugggacgugcuccccagccugugacaugguggguugugcucccccagggugugagaugguaggacgugcuccccagugugugacauggugggaugugcucccuccccagcgugugaccuggugggacaugcuccucauuugugugaccugauggguuaugcucccccagugugugacaugguaggacaugcuccccagcaugugaccuggugagaugcacuccccagccugugaccugguggguugugcuucccaaucaugugaccuggugggacgugcuccccaucgugugaccugguggguugugcuccccagggugugccuggccuccuucagaugcugguuuugcccuccugugucacacccauggugugguuagccccuuggcuuccagcccugcauccaugcgguccucauaucacacaguucugugaaggugaugguguuucuuaacuuuuaggcaucuuaugaaucaggucacuucuuagacauaauguagagugaguaaguuucagcauuggaggacaauauauuggaaguaaaucccauguggaaagagcuauuuuucuaucagugggaugcaccuccucccucugguccagcccacucgucauguguugcccgagcugccaugugaucaccaggacaaaugaugacuacuaucauggggucucauuuaugauaagaaauggcaugugguggguguggaaaacuggguugcagguaaagccauggucguuugggucaucuguaucgggugggugcacugugcacaggcagucaggggaggcgggggagagugcaccugcagagggcugggcucuguagaccaccccauggagcuuaggaguccuccaucuuucugacauagucuaaaccauccuggcugggucuucaguguuuaauaucuuugugagggucaaaacucuagcaccagaucuuucuucugagcuguaaccuguuacuuacaaacacugaaguguuaacuuacacugugagcauucaaaucuucaaauucaaucauacuuuuugcugugugugugggauuucagaaaaaugacuauuguaguagacaagcaaaagaccaaauguggaccgacaggcuauaacagaaucacuccucggaaagcuagguguguccucaaauaucuccacacuugccaacaggcacagucaggagggucugaagauacacgcuccacugaagggcuguggcuuuagcaggggaaaaauggaaaguucgauuuucaguaacuuuugaagucauuggauagagcauguguuaccgaccacagacuuggaccuggaacuccccacuggcaucuagcugagugucgugaacugggacaaacugaucuuucuggggugagagugacacagggaggcuugucugcaccaucuucagugaccuucggaugugaaaauggcccauuggaggcauuuugacuuggccuuuacgugaguuauggugucugacuuuguguccuccucuuuuucagaugccuucgugaacagccaggaauggacgcugagucgaucugucccggagcucaaaguggugagugguucccucuggcccuggcaccugugggaagggaggggcucugugcacacccaagccugcauucccaggcaacuggucaucgccuggggcccagaguggaagugugacucuggguguguuccugggaagggccagguauaguugauagcuugggacuagaguccaaguuccugagugccccugggacagcuaugacagccaugacugccacucagccagggcggugucucaugugcagggcagaggccaucaucauccucucucucacaucucguggguguguguguguccacacacacacacccccauggguugauuuguccuuugcaggaugucacggaaggcuccacacacacacacccccauggauugauuuguucuuugcaggaugucacggaaggcuucugucaugagucaccaagcuuugguauccaucauuuuugaaaugugacuauuuacccugugaccaaguauuggcaugaaauuaaaauuuuugucuuuuacgaaccuuacccuuucggugaaauuauguagagcuucaaauuggcacguguaaaaagugguccaucgcagccacccuuuccagccgcuccccucuaccguaggauggaaggaaggggcaagucuaacuuugaaacaaccagguucuuugucgugaaauauguggcauuuguguguaugguuauguaucuguguauguauguauauauguguauauaugucuaauuuccguguguauguuuauauuuauguagguaucuauguauguauguauauaugucuaauuucuguauguguguguauguauuuucuaauuugaccgugaaagcaaagcagaugagcucuugcuguucugcagacuccggcaugggccugccuagugugucuguccucugcauuucuauugauagcaccagauccccugcggcccguggacuccuccccacugaccccaaccucauugcaugcuuggaggacaggacaagggccaggagacaggauccuuccgguccuucaugucugagaugaggagauagagcaacaaagaacuucuaggucuuugaagagacuuuugucaccaggaaaaguauuuguuuuuaaacuuaggaaaugaaguacaaugagugggaggugcccugaggugggaaggcccuguggucacugugccgucucucucauuggugucugacacacccauccccaccgcaaccgcggggugucaucagcugggcccaucuccuucccggugucugccccccgccccauuccucccugaaggucucugggcugucucugcagcacuugcccgugggagacaaagcgucucucaguccuagugcugucucagaagccugggguuccgcaagacuggccuggaaagagccgccucuuucugucuuuugugugcuuugucaccgcggcacuggcagggugucuuaagccuauugaagccguccaggaaaugugcguugaaugaauggcacaggcuuggcaaugcuguuaccaggagauucucagaacaaucccgcaguuuccguuacuuccuguuaagacagccgcugccacucgggugcugugaugggcacggaacaguagucacggugguuuacugguggugaugguguggauacagcgcuggcucugugcgggucguguucuaagugcuuuacaaaauuacuuaauccugacaagugccccauggggagggauagguacgguuauccccauuucacagaugaggaaacugaggcucagagacaugaagaaccugcccaaggagccacagugaguaagugggggagcugaggugugagccuggagcuggugcuuccaccaccgcacugccugacagaacuuucucgacgguaaaaaccuccugcgucugcacugcccagugccgucacggcuggcgccauguggcuguugagugauugaaacguggccagucagugccaucaaggagcugcauuuuaaguuugauucuaguucauuuaaauugaaauagccacacagggccagcggccacccuacugccagcauuacagacuaacugaucgucaaguauugaaccaccugacuuggcaguucaagguguuacagguucagagagggcccacaugaucauaccagcccauaaucgaggaugcuuaccaccaaaaacuugugcucugccgguauuuugaaagcauaugauuuucuggaauaucugcccagagcuguaggagacaguugcguuugaggcagcaugggcuccucauucugaaacggacugucuuaaggcuugcuucaauuugcugacaccgugggcuucgaugcuguugguucuacaguucucagaacgguccugucccuggccugaguguggauggacgagauccuggcaggcccaccagcucugcucuagcccaagugccuucuuguuguggcaucagcgggcacucguccucaucggcacccccagcagaucccuugugugcugaggagugcucagggacugaagaaagcgcugcuuuguucccuaggcagccuccaagugccuauagggcugcaauuguuucccuccuagcgcagcccccccaggacagguggcacuuuaggucagcgucucaggaacccagccccugcuucacaaacgcagcagugacaugaugucauggcaagccuccaauaggcccuuuauguaacauuuugcaauaaaucuuuugaaaucugucagagaaaaaaauucaauguucgcuuucuucucaagagugguaguaccaugccuuauguuuuauuuucuuucuuucuuuuuuuuuuguuacggggucucacucugucacccaggcuggagugcaguggcgccaucucggcucacugcaaccugccuccuggguucaagugauucucgugccucagccucccaaguagcugggaugacaggcacccaccaccacaucuggcuaauuuuuuauuuuuaguagacaagauuuuaccauguuggccaggcuaugcucaaacuccugaccucgucauccgccugccuuggccucccaaagugcugggaugacaggccugagccacugcgcccggccugauguuuucugaaguugugcuguggucagaucguccaugaccaguugcuuuuggugcugcacaggagccaaccgcugcuggcugcagaugugugcccaacagcaaaagcuugaugcuucugucagaggggaaggcacauaggcucuggacaucuugccuguguaggggaccucaguccccagcuccucacauccuauuuguguguuuucauugaacuccaacuggaauuuuuacuaaaagccuugauuuccuuuucagcaaaccucaggguuaguguggggcucuggagaaaucaguuuaggaagacauugcauucccuuuggccuugugaugugaagggccgaguauggguuccaacgcacuucaugugccugcacagacggugaccccugcacagagguugacaguggcaaccucuuccugccuuaaguacguaguucugugauuuucaagacaccucauuccuccucauguagcucuuuggcucgcucuggauugauuuccuccgucuugguuuacuuccagcagucgcuccgacagcuucacggguggcgugacacacuugaaacggcauuuugaccccuuauuuuauuuuccuuucaccaucaacuguuaauuuccaccagcguuucaaauuaaaaugaugccaucgugugugacugagguggucugugagauggcuguuccagccaaaccaaaccccuucccacuccacuccaagauugauugcccuaagggagaacuuaggggagagcuuaaucuuugcccaucuuguuagguggaagaaggcaggaacguugcuaugcagagaaggcacagaccaaaggauguuugguuuuggagcauuuucuuccucgagaaagagaaacugaucuuaauuaaaaauuuaauucuguggcauacuguuuuggauuuucccagcaugaagcugacaugaagcgggugcccuugagcaaaagaauaauuaguagguagaaauucuccgauuauagaggcccaggguaaaaaaagauguacgucggauuaggaggggaaacagcuuuauuuagaaucuguccacacagccuggcuugagccuggcucugagccuuaguaauaagcaucucauucacucaccagcagugcagucaugcauguacucauccguucuuuuacucggcccgugcucuugagcgucugccuugggcucugcauuacgcagggauucagagaacaaggcaaaugagacaaggugccuguccuugaggaauugucaguauuggaggaagccagaucaacacacugauguuuccaaaauaauguguucccuugugagauauccuuggggcagagaccuaagggagcuuugaggaaaggcacccaguugaggcuguggcaucaggaaggugucuucgucucuucuggcuccuguaacaaaauaucauacacugagcagcugauaaacaacagaaauauauagcucacaguucuggaggccaggaaguccaagaucaaggcaccugcagauuugaugccugaggaccugcuugcugguucguagguggcaucuucuugcuguguccucacguggaggaagacgcgagaggucuuucucaggccucuucuacaagggcgcuaaucugcucccacaacugccacaccucguaauacaaucaccuuggggauuagguuucuuuguuuaaaauuuuauuuauuauuuuguuuuuauuuuuugagacagagucucacucugucgcccaggcuggagugcgguggugcaaucucagcucacugcaaccucugccucccggguucaagugauucuccugccucagccuccugaguagcugggauuacaggcaugcaccaccacagcuggcuaauuuuuauauuuuuuuaguugagacaggguuucaccauguuggccagucuggucuugaacuccugaccucaggugauccaccugccucggccucccaaagugcugggauuacaggcgugagccaccaugcccagccagggguuagguuucaacauaugaguuuggcugggaguguggggguaggacggggaagcacaaacauuccuaccauauaguugaaggcuugucagaggaggugacaucugaacugauaguaagaguagguuucggggaaugauugauauggaaagcuuuaguugccuggagacagcaaggccuguuaggauggggcuugguagcugauugacuagaaggccaagcagggagcgggcagaugagaggcgggaggguuguaacugggguguaagaggacaggaccgagcauagguuuuagaaaggccacucuggcugaugaguagagagugggagcggccaggacugggugacagagaacauuuggauccaugagccaucacucagacagcagaccacgguggccuguaaaucacugagaaccuuuuuuccacacugucaugccaaauuuguucucuuauauguuuguuuguuuucuuuuuuguuguuguuuuuguuuuguuuugagacagagucucgcucugucacccaggcuggaguccagugguguaucucggcucacugcaaccuccgccuccuggguucaggcgauucuccugccuuagccuccugaguagcugggacuacaggcgugugccaccacgccuuguuauuuuuuuguaguuuuaguagagaugggauuucaccguguuagccaggauggucucgaucuccugacuucaugaucugcccgcuucggccccccaaagugccgggauuacaggcgugagccaccgugcccagcccuguguuuguucuuaauagcuauuggcuucaucaucuacuuaaccaacguuccuuccucccuccugucucuccuccucuccccuuuauuuccaucucuccucccucccauccuucuuccuugucauccaucuauccaucgacccaucuuguguuuaccaggacuuuguuggagccagggacuaugacaaguguacagauucggagcuggugucuuggcccguauccagagacagagaucuuggcccucgggguccuaaguguagugggagguggagcccagggccucaccagccacugucaaggcugucugggggugaggggaaagcagggaagcuuucccaagagaaagugaagcccuccucaggugaaaggggaggggugcucaggugacaggagcagugaaguguucuugcggcaaguucauggaccugcugggccuguuagcugccagcaaaguugugugcgaggauuuggaaggagacaguuuguuccuaaaauguuuggaguugggccuccaggcagcaggagucucccacggcuuaugaaaugaaggagugccacuuucucauggucacuuuguuucuaggaaccucucugguguucucggguugaaaagcaggugcuugcaggcagagagaggcccuagaggcugcuuccuugauccgugcacacuggagaguccacacugagguggcagcaaggugcccaggagggagcggacucccugacuuccagccacugggagucggggauggccuccagcuuucuggcuugagaggcugggugugauguggccucagaagcugaugaggagacugggagagagaggcaagguguggacccaucgaggcgugaauaccgcauagguggcguacggauguauauaaaguccuggugggagcuaaguaggggcgccuggagcugggguggacggcggccaggggaugcgauuugggaauaggcagcuuuuuuuuccccccacauccaaccuucuaucaaugaguuaugauuccagagucugcagggugucuccuguuaaauggaaucgcagcucauugagagaagguuggauguggacaggcgcauguugggacauuagaguggaggaucagcuggagaugugaggauggagcccuggcgagucccaguaugucccugcagauggaggaagaacccacagggcugggagggagguagaggcggaagccagugugagaguuggaagagagugucuuaacagcagcugcuggugauggggccaggucagagcgagacaggcuaguggcuuugaaauggaaguugcgggugaccuagugggcaguuuccugguagcaacagggccagagcuucagauaauuugaguggaggcaggagggaggucaacaaguggaaccgagagcaagcggggugagucccagcucagggaauggcagguggccuuaaugagcaccugugccuggggaugggugccuugugauguuuugggcuuuuuaaggaaucgauuagaucaugcuuaaauuugaucacuagcgauguucuagugggggaggaaaagguuaaaaugcaggagauuuuugaugagcagcuucccagagaaggcggcaugggggguauccagcucccaagcacagggaaagggaggcucccuguaggaucggccacuuggaggcugggaggccaggugugucuccugugucaacagggaggcuuccugugaagaauccccuggaaagucagccuugccgccagguuacugcuaggacagaggcccucaugucacccucccuccugagggucgccuucuaauccagcacaaacgagcaccuuugccgucucucccagcagcccuggcacuguccccuuuuucucggagaugccuugguggguccugugucugggaggcaggugugugcccuccucgccuguguggccggccccugccuugcuccuccacccccaggucuccccacacugcccuuuucugcuccuguuguccugcccccaagucuacccuagacucauccccuaaagaugcuaccaugcauggguccucgccacucuccccacgucacucaccucugcccucgggugccaccucaccugcugcuuuucccagucucuggagggugcacaguagaugccggcgggcuaacucaaggaacacagcccugauguaaacaaugugcuuguuuucuggaagaaugccaaaccaguguuuauaccagcauugcugaugccguugcagcuguugaggcugaugagaacgugagauguuaauuaagaguguuggacucccuuuuacuccaauggaaguauugaaugagcuuguuuuuggccauccagccagugcuugguuauguuuguguuuaggccuccugucuauuuuagccucuuaguauuugcaaaaugccaaauagagugauuugaugaugcuuaacgguuguccguuucuguuucagggaauuguggguaacuuggccagcggcaagucugcccuggugcaccgguaccugacgggcacauauguccaggaggagucuccggaagguaugcuguuuggcaggcaguugcaaacuuaagaauguaguuuuuuaaaauuuuuccuuagcauauuauaaaucaugacuuugauguaucacaggucaagaaagcaauaaaacauaccaagcgguaaaaacccuuaaguaugugguuucuucuguaguauuuuuagcaaacccguuauauucacuuugauaucuggaauagcgcaguagaaccaugaaauacuauugaauuuauuucuuaucuaauuguucuguccuuucaaauguccuuuuuaauccaguguccuucuuauccauuguugcuccuuuaaauauugacuggacauuccugugaucuggauauugaauuuauacauaauuuguauguaauguuacuuagucauagauaagagccuuccgggauaagacguucagauuaccaccaccauauguuugaguauguuuccccccuuauauuauaaacauuuaauaaucauuuugcaugagaguaagauuuuuuuuuuugccauuaggcauuugcuucuucaguuaacauguccauauuuuauuuuuugccuuaaauaaaauuaugauaaugguaggaagcauuuagcucccguguccccuaacgaagggguguaguugacaagcaguuuucuaaaugaaauuuucucuccguguaacuuuguuaaauccaacucugagacacugaauuucugguuccuucuuuuucuuacuggcuguuccauucuuugcagauauggaugcagguaacuauucauuuucuucauggcagcgcuugucuuguuuuggagagagaggaaaggcaccacuuuguacuguagcguucccuucccuccuuguucuguguaccauccuguuuuguuucauuuuaucuuuuucuucaguugaacauuccacccuguuuugucccuuaguugucuuuuuagcaguagucccaagcagcuucaccuguucccuguaacaccuguccuagcauuuaacucuuguccugaauacugcggaaccguucggagaaguauaaaaguggcuugaggcucugccaccguuuugcagaauuguguagucaugucaugaacaccucaugcaucaggaagagaccuuccauacugaaaugaugaucuaggaagauuagaggugauaaugaaggcuuguauguaggggucaauaggagaaagcuugccuguucacugagaaaugcauacagaugccagaaaauggcaugauuuggagaaaugagcaaaggccacauuuugucagggcucugucccuggguuuugacggcuuuuauuugcuccuuugugucggaauaugaauuuuagccacggccagcuggugacaccuuuuagagaaucuuuuagagauuuuuccuuuggguuuuccacuuauuuucaagggcuagcuauuguagagguuauacagagguuaacucaccugcaaaugaaaugaccaccuuuucuaaguaaaucuacuuucagggcccugcaacucuguggauuucaagcugggaccacaggaaguuacaugagucgggccugguuuuguugcuguugcucuggcagucucuggcccugggguucaggugucugguggggcagcgcuggaggcccuggguuucuggaguaagaacaaggaccacgacucacucaugguggccuuucugcuauauggcuauuuggucauuuuuguggcuuuucgcuguuuucccuuugggcauucacaguguguuccauuguauuugggcccagcugggaugucuuuugcagugcauaauugacccuuacauguugacucacaccaaagcauuucucuugaacguuuauacaucaaaaggaaggauuguggggugaccuaaacugaucacuaacaucccugcuucuuugauuuuucaaguaaugcauuuuacugcacugaaauuucauaguauuguguaugguuuuuaaaaauacauuauuuuuaagaguaggagcgugggugaguaccuuccuuucuucaucugcaaaguggaaguagcucauccccuccauggggccccaugcccaaggcuuccugggucaggggaaagaucaugaucccugaccuuuucucaugcccugcagcagcccucccugggcauguggccucucaccuuuugacucgaggucccagggauuguucugugggagugugaggagcugacagcagcagacacccaggugcaccccagugggugugugucuagggccccugggugcugaaagaauuaugaauacauggcuccuugugccuggaagcuucuuaguccugcugaauucaugcuucucauggcugagccaccuuucccguguagaaccaagcagguggccacugucuuugccccucuuaaugagaccagggaauggacuucuacuuccuguucaugugacugugugccucaugacaguggcaggagggagccauaacuuguuguaaugucacuuguaaugaagggagccauacuuguuguuugggaaagaaaacaaaugagaagccguguuucuuucauaccacggucuugccauccugaaauucccucucaugcucagggagccuguaccuggaaagugauuucaauuuuuguccagugaguuaguguugaucaauuacccaugcuuugcuuaauugagaagcuuuagguauagaguguuguggguuugggauauaauuuacuguguugucaccuggguguguggagacuaucaaagggauguguuguccucggggagugcuggaggcugacaaagcugaugauggcccagccucaccugugguuacuuacccacacaaaggugagggcacucccacaguggugggagugguuggcgcccgguugagggauuggauuuugagugagcucuguggccuucccauuucuugguguacugcugccuucucaucagaccuccuuuccucuuacaacugcuagagcgaucaacugggcagcuacuuugaaugaaaggcauuuugcuguguaucugccuguccagauaguuccuuggauucucccugcgcuucuuaaugucugugcccuguucuucugauuuaauuagugcgugaguauccuuuaugucauaauccugacccguggcugggauauguagacugcugggaggggugagggugagggccuuccugucuucaggggagagcucucucgugguagaaacauuucuggugcagagccgucuccagauccaagccugcuuuuccucagauacaucagaugcauuuuagcuccaucccagaggguaauaucugcugucuuuucguuguaugaugcauuuugguugauauuuuauucuuguagugaagagagccaacucacaagauuuagauuauuuuauuuuauuuauuuauuuauuuugagauggagucuuacucugucacccagacuggagugcaguggcgugaucucagcucacuccaaccucugccuccaggauucaagugauccuccugccgcagccuccugaguagcugggauuacaggcaccccccaccgcgcccggauaauuuuuguauuuuugguagaggcaggguuucaccauguuggccagacuggucuugaacuccugaccuuaagugauccaccugccugggccucccaaagugcugggauuacaggcaugagccaccacguccagccaagacuuagauaauuuuaaagaugcaguucaaaugagggaaggauauaaauauucuguuuuucaauuagugaauuaacaacacaaaaguggguaacaccguagggaacuugugauuccaugaaaucagucaaagaguaaaccucuuggauugacagauuccuuaauauuauguguguguguguguguguguguguguacaccuagguguguaauauauguauguguacuucaguccuagcacuguaguaacgaacugccacacacaguguggcuuaaaacagaaauguauucucauaguucucagaagucugaaaucaagguguugacgggguugguuccuucugcagcuuagagguugaaucuguucuaugucugugcgguucugauuuaauuagugugugcauauccuuuauauucuaauccugacccauggcugggauauguagauugcugggaggggugagguggugagggccuuccugucuucaggggagagcucucuugugguagaaacauuucuggugcagagccgucuccagauccaggccuccuuuucagcagauacaucagaugcauuuuagcuccaucccagaggguaacaucugcugucuuaauugugugaugcauuuugguugauauuuuauuguuacagugaagagagccaacucacagauuuagaugauuuuaaagaugcaguucaaaugagggaaggauguaaauacuguuuuucaauuagugaauuaacagugcaaaaguggguuacuccauagagagcuugugauuucaugaaagccaucaaagaguaaaccucuuguauagacagauuccuuaauugggugugcgugcucacacgugugugugcacaucuggguguguaauauauguauguguaccucaguccuagggcugugguaacaaaguaccacaaacuggcuuaaaacagaaauguauucucacaagucggaaaucaagguguugacgggguugguccuucugcagacuuugagguugaaucuguugcaugucugugcacaguuguucugauuuaauuagugcgugaauauacuuuauccuaaucaugaccuguggcugguauacguagauggcuggguuauguagauggcugggaggguuaagguggugagggccuuccugucuucaggggagagcuucugguggcugucagcaauccaugcuguuucuuggcucauagacuccuaaccccagucucugccucugucaucacaguguuuuccuggcuaucugugacuguccaaacuuuuucuuauaaggacaccagccauuggauuuagggcccauccuccuccagcaugacaucaucuuuacuugaucccaucugcaaagacccucuauccaggugaggucacaccauaggucccagggguuagggcuugaacguaucuucuaggggauacaauucaacccacagcaguguguguuauauaccugugauguucuccagggauguccaaucuuuuggcuuugcugggcuacauuggaagaggaagaauugucuugggccacacauaaaauacacuaacacuaacaauagcaaaugagcuaaaaaaaaaaaaaauuauacacacacuaaaaacucauguguuaagaaaguuuacaaauuagcguugggccgcauccaaagcuguccugguuggcagguuagagaagcuugguuuagacggucgcugcacuuagaacuguuggaguuggccccaucacuuggugguggucaugguucugccagugaugcuuuugcaagcucugcugguguucuagaaccucacaaggacucaucggcuggcagugaccuucacaccucugaggacaauuucacagcugccguucacuuccuauaaagagaaugagaugaaaauuaguuauuugccaauugagcccuauuaauggcugcugauuagaaucgugugacauuuuggguguguaaugugacuucccucgugguguguuuaugugcuuaauauucagcgucccccaacacagaccccacaugaugccacucagcuuuuaacucuccuuucaaaagagaaaaagucaaaggaaacaaagcuaggauguccaguauuauguggacauuagauaggaaauguggaccugcccaagacacuucacccccugcagguggggagaguguggcguccuccugagaucuuuucagguugcagaacugagucauugcucugagacccguuccccaggacaacucucucugugucacccauggcaucacaggcacccugggccaugggcccucccgagcugugcagguuagcuugugugccagaaggaccugaggaccagaaaagcugaaagccagcaccacgcugagaucguggcacaccugaggagggcagaaagguggccccacaagcuucccaagaugaaacuaaacuguauauggauugagugggagcuuuuaucguugguugguugguugguugguugguugguugguuggucgaucgacagagacuuaagaauguucauagaccaacuccaagcugcaaaaugaaaguaccgagaggaaggugggccaucugagagccgccuuuaucccagaucuggaagaaacccacaucuaggugugaaaguggcaaaaggagggccggggccugccugccacugaggcccagcggcugccugcgagggucaguggugucguagccugcugccgccacacagagggauuugcagggaagggccuuagccaggcaugaugugggagcguuggcccuggcauucccgggucuucaugagcuuaauucagcaggggcuccuuccuucagugauggaaucuggaguuucugacugauucuuaaccaacucaaaauuuuaggcagaaagcuagcuccaaggcugaggcagcccugaaugugccuaggccaacagccagcgagcuccuggccgggagccugguaauggggauggcugguaaaggcugugccggcccugccucccucccagaagggcgacccuccagccccauguccaggcucucccaucuucccagcucgggccacacauaggcagcagcugcccccaugcucugucccagagacggaacacacuggucacugggagauuagccucccucauucauuuucccgauagaauaugauagcugagguagcuggaagaguauggucaaggagcucaaggcagcucuuucacucaggagccugccagcguagggcaggggaagucagugcccucccagauggaaaagguaccugcggugguggggggagggggaguucccuauguaaagaagaguccaaaacagauaagggagacugaagaaaccugaacauccagugcucaugaggaaaagcuuuaagagaaaauaccaggugcuaagaguaauuauaacuaccagguaaggaccagugagaaacagugggugagauuaggcucgacaguucccuaacucaggaaagucgaguuucugagcauaagucauaggaaauucucaaacauacuuuugcuuugugccugggaagcaggaaaguacaccagacccaccucauuucuuacaucucuccaagagaagccuuucgcuugucuguuugguuuauuugguucacaucagaguuugcuaaaggcuuggagguucuguaggaaggaaugagccgcuucaccuccuggagaaaggacgucucguuuccagcaugucgggggucaggcugugcugcacugaggcugaaggguucugggauuuuccacuguguguuugguuucuguugcuuguuccaagcugcugacgcggugugcuggaugagaguucuacuggccacuggcuucuggccuccagggccagcuggcuguacagccaccugcaagucuuuguucccgggguuagccuugccacccuccuucaggacugccuagaauuguuuccugucaucgggguaguaaauguguucucaggagcacguguaucuuaaauauguuuuaacgaauguuuacuuaguuucuuagaaacaaaacgugguaaacacccagucuuauuuucugggacacaugaaguguguuuaagcugucagcuccaaaaacccuuuccaagucaaauaacuuaaaaaaaaagguugucagcuaccacugcaucccagauguuagaguuuauuucuaaagcuguucuugggugcuguuuaauguuccaguggaaaaaaaaaaaaaacaccuguaauacuccaguaacauuugacuagucgugaaaucuagccauuuagauuuuucaaccucaauuugaccguuaguugcaaccaagugauuauaaacacaugauaauuuuuuaaugagaauuaucuguaaacguugagaugaugagccugcugcuauguugguuuaauagauaaagcagaagucaguucagccaucuucacugaugauuuucagaauuaaccugaucacucaccauggaaauaccauuccccuuuguucuugucuuccuaugugugugacagucccuaacuugaccccuggcauggaagccaucagugaggaucaggugauauugucuaaaaauagguaaaggaugcuaacauuauuauuagauguucaaaaaaauaauaaaagggaagcauguucuguuucauuuugagcaagaaaaaaagccguaaaaucagaauaaggagauagucauguuuuuggcauugaugaaauuggcaggacaaaguguguuuuugaguuggcuguauggaacucagaauguauugucccauauuguuauaauuaauuugacaagaaauccagggcuuaccaaaagccauacugggccugcauuggagccuguguuccagagaaaauaccuuucugaauaaguaacugugaugcagggcugggacuuacacccggucugggagcgcccuaaagaggacaagcccgcuggcuucuguggggagucacugucuccugagggcagcgcacagaggcucaugugugucccuucacucacagagcccaacaacagcacagcacaugcuguugacacaacuguugcuuuccuaagaaaccucacggcaucagauauuuuaacaaaaccguucuuuaagaggaaaauggagacuagagccuagaaaguuucacguauguaauuacaaaucauuuuuccuagagaaauuuuaccccaaaaguguucugaggcugugggugcauuuaccuguuuauugcggauuaacagagccauugaaucuaucccaauggaaccaccaucacacacuuucaccuguguucacugcuccucccgucugcccaugucuuuggccuugaucacgccaucucucuggaagcccagcuccagguccaggaaaccagauuauagcagaccacugugccccuggccagggaaccgccugcucuggucuggaagccccggggccaugcucgcuguguuagucaaugcucuuuugguugcaugagauaguugaccaacuuagguuagcuaaaauagaaaggcagggagggggugggccaguggugaauuauuaacuucuuaacuugcaucucuggagcugccaaggggauggauuuaguuuuagaaagacccuaaucuccugaugcacugaaguucuugaggagcccucucccccauuucuugccuguguugggugggcaucaugcccagcaaggucuccccacuugguagcaagcccuucauggugguuucgguccuuagugcucagauguggugaggagggaaaggugaggauuuuugucaauagcuacagcaaaagacucuaagucaguuccauguggccucauuugagucaggugcuuuucccuaaaacaaucaguaucacagguuggaggggauguuuugauuguucugucccuucggguggggagaugaggucagccuaauugagcugaguggcuugagcaggaguaugauagacuagggcugggcagaagguggacuccagaaaaggccgggaggcaagucccaacccugugucuucaggguuuguccguuuuaaacauuuuagccaggguggggcuggggggaggggguguugugcaaugcaguucucuuuccuaauucacagaucacguuacacccagcuugcacgguuugaacuugggugcuaaaggagaagcaccugggguauguuugaauucaccccaaagcuaccucugguaagugucuccuugugacuuuuacagucucacuugggcuguggaccucugacauuuucaggcaaguuuuugcuucuuaaucuccaaugcugaaagcuuagucuuuggaauguuauacauuguuuggaucuuaaaaaugucagcucacaaaauaauguuuuuacauccuuccuccaacaucaucaaccgcauuagcucaccaccacuccuccucuccgcuucucccccaaccuguuuuaucggugucaggaaaggggagcgaucagucucucaggagguacccauauugaucauaauauagccuuucuuaggcguagcaguccagcaaucaggguucaaugguuuccucuggaagguagcauacugaaaaagacgaagugcagagaaaagacagggugggggugcagcaugucuaguuugggggccuggcugugggucagaauggagagauugacacuucagagaaggccgggaaugaaauugaaugugcagagcacacguuccacucagcaccgauuagagcugggauugccucucgcaacuccccaaagaaaaugcugcguccuuguaagaccgugucugcccagugggggccuggacacuaagugccacuucucugcccauggcaaauuccaagggccaggacgauggagacaagggaaguagaaguugaaagaaacucccaacggcaaauuaggucgagugccagaaagaauuacaucaggagaaucugagauguagugaaagugcccccaagcuccccgcuccauuucaugugcuacuggcuggcugugagaucugaaaaggacugggcccagacucugugugugugugugugugugugugugcgugcucuuaaaucaauguaaauuaggcuauauacagcugccaauaaucugcaaaagaugacaguuucauaugauuccaauggcuuaaacuaacaaauucaugaaugauugacccagaccagaaauggaaaccugauucaacucacaguguaguccuuuauccaugcuuguuggcuucuggaacgcacaguguucaggaggauucugaggcagggucugugugcaggaggagugcuagugugagagcugcuggugccugcccuggguccgaaagcuggugguggucuguucuuguuguaugagggcagcccaugucgccagcauuuauuuucugagccccauuucuuaauguuguauauuuuuuuaaaaauuaacaccaccauaagcaagaaggaaaaaaucaacacuugcucuuugaaggccaaauacauugaaaugaaagcgugccuaguggagcaagagcggggcggggaggaggggaagccagccugcagcauugcccucuagacacuaagaagaagggaguagguuuagguuggaugaagaagggagguuuggagccuggacgagagcagggguuguggaggaauggucaaaacccaggcgugaugugaccacaccaucuggcaggggaccaggccagcugcugugugggucuuccaugucccagggacggagagaggagaagugggguuggccaggcagaggcaugauaagagucagaguggcugggcuccagggcuccagccaggcuauuagcaggagcacuggcuuuggagggggaccuaagaggacagauaggggaauccccaggccaccucuggaccuugacauugacuaaugggaugagcugcuggaacccaucaccaugaagcccccugcacuaacuagggcgugugccccuugaggagccgcauccgcuuauugggccuaagaaaaacugauucccagguguguuugggccgucuagaaccaugugaccuggcagccacuucaacuugggcagcaucucggcugggagccccagggagccuggcaguaccucaguggcagaugcagcucguuccaagauguuccagaggcaggagguuccuggaagaaccacugggccuugcagggucagcucagccugagagccagugacccccucccccaggaggaugcuguaggggcagucucacggcggucucaccucugccaccuguggaugagaggcuggaccgggucuuggugcuuuccagcucagggcguugguccacuugguuauucuuggggaccaaaauccaagcuaggauggggacagaggccuggagacaaccugcuggccuccuuccauuaaagccauuacagugucaccacaggauuguaagaauuacaaaugcguuuuccagaguccccagagaaaaaggagucuggcaguuagaagaguaaagugcaucugucaacaaaagaaauaccaaagaugagacuacagcagcgacuugucaccucuuccguguugcuacugccugagaacagagguuuuuaguuucuuuaaaggguuguaaacauaaaaacaaagaaggauacaacaugcaaggccuaaaauguuuacuuucuggccuuuuacacaggcaguucgccagcccccuacccuacaguauggaaaaaaggcauagaacagucaaaucacguaggauuucuuaguuucuccaugcaggcucaucgaauagcaaccauccuuucuuaguuucuugaaacaaguaccuuauuuacauucagagaauuauauguggacaaacagcucauaagcccguacuuuuacauacucacuuccugaauugcauauugaaaaagagaguucauguaaagccgauuauuauuuaaucuaaaguuauguucacauaggaagcacuaguguagagaaauagggucugagggacaaggagccugugugcccgugucggcagccgaguaacugccaaggguccccugcuuggcacucugcugucccacuugcuuccugcccucucuggauucuaacacuugugccauugugcauccgucucaggucauggugcuguuacuuggugagaaagcauuauuuaaauaccccagaugaggaguuaggcacuuucuccaguuuugcaaugcucuuuuguuuaccuuuuaaaaaaaaaaaaaaaaaaaaacgagacaaggucucacucugucaccugggcuggagugcaguggugccaucauagcccacuauaccuugaacuccuggguucaagcgaucuucuugacuuggccucccaaagugcugguauuacaggugugagcuaccaugccauuuaccuuuuuuaugcuuaaaauaaauguauaaaauauuaaaaaucauuuuccucccaagaaccaaacguguauuacuaaauauguuuaguugaccaugcaggcuauuugagagacagugggagaugcugaaauauucaagcaccacuguuuugguggguaucggaagauuuucaaucaauaguuuacuuauuugguuauguauuagguuguauuggguggggccaaucauuaugugacuauuuuuuucuucagaguggugauugaaaagcagcccccaaccguuuucuccgagaggugcaugcugagccugccugcagcuuacccccaacccccagccccuagcccggcucuccuugucuuacaugagucaguuuccuucugcugcuauucuggacaaaaaccucuaucaggacagagaccuugucuuguucacccuauuccuggcaucaaggcugugucugacauguaauggggauggcuguuuguuugguggugguugagaugaccaagauguucuugaccuguguagggugguaguggagaaacaggcacaggcccuugugguguaguugcgaaaaaggagcucacacuaaugggaaccagauuguaucauuggcugaguauacagcagaugcguuccccuuuguuauuuuaucacuugcuuaccuggaagcucuggucugacuuuaggaacaugccacacacuuggauaaacauggacuccuuuacuagagauuuauagaaucuuuuuccuagagccauuugagaagcacuuguccaagacgugcuauuuuauaggcuauuuugauguaagggaaaagacguauccuggaucuuccagaaagcauggaauuauggcugcguauuaggaagaggccuggcuuuccugugggaauugaacagaagacaggcaucucucauguucugguuguugcaguuuugcuucuucuguucauugaauuagcguuucagagcucuccaugugugaguuuccauuuggaaaugguauagucaucaucguaauguagcagucauucguuaauuuuuaugagccacuugugacguuucaggaagcugacagccgacauggauuagcucauuuauaccuagggaaacagaggcaccagaggccacaaaagcuauucagggucacacagccuaugugugagguuuacauaauaaacgucaaaaaacgcaggcucuaaggaacaaaaaggaagauuugagcuggguggaggcuccuuaucucuccuacaaccugagccaacaacaccccaucacuucaccccaaagugcgcagggaagaaauggaaggggcagccguggccucaucuuuugugcuguuuuucuccagcacaaaaaccugugugcuguuuuucugcagaccuugguuuucucaucuugaaaguugugaaucugugucacauuuuccugguguaucgcgugcacuuuugaucugcggauucagaucuuucugcgucucaggaacauuccuuugucuuuuaucuucgaauagucuuugaguucuuuuguuguggauguguugucagagauaccauuuauccuuuuguuuagguccguuugucaaugaacuucucucuuaaauacuuuaccucugucuuuuuaaucucauugacugugucuguuucaagccauuccucugugucagaaacucagcuuucagccuugucucuucugcuccuuacuuuuucuaauuuuauucaucaguuccccaaaugccguuuugauccucagaucuggacguuuccauuuuaucucauauuguuucaaauucucauacuggagguucucgucuccuggaauggcuguucuuucuuaagucacacuggagugggaagcgguuguaagggacuuccuucugcuuuuugagcuuuguuuucuucuccauuguugcuuuguuucucuucuguucccuucccuccuuccucuccccaagccucucccgccuucccauuuucccugcuggggagccuuugcauaauguccccagcccugcucuucagccuucuuggcuuggaccucucuucccagacauugucuuucccugagaccgaugcugaccacugggaagacuucucccucauucugagucaaaucuaggcuguugggagcccgugaccgcccugcuuccuguggugggagaaggugagggagaggagaugcucucauccugaguguccuggacgagaugggccagaccauucuacccacacucccauuugccagaccucagccaccucccccagccagccccagggguguugggggcaucuuucgagucucacugcccacgcugugggagcugagacuggaugcuguucuggagaucccaggauuuacugagcauccaugcucugccauccgucuaguuggagggagcugccucccguugaaagagucugcccuucuuuagggaccagggcucugcucuuccugggaauuuaccacauccucuuccagguucccuucacccauccugcggggugggaggaauauaucauuguuccccuugaggugccccccugcgugggucacuucucccgcucaccaggcaacacgggcaucuucuuugccuccggagagccuuugccggccauucacuuccaaggcuuucuuauuuccauuccucagucaggagacgaaaaagaugaggccacggcugccccuucuguuucuucccugcgcacuuuggggugaagugaugggguguuguuggcucagguuguaggagagaugaggagccuccgcccagcucaaaucuuccuuuuuguuccuuagagccugcguuuuuugagguuuauuauguaaagccgugccccuuuuccuguuggauggugaaguuccuuccuucuggcuuuaauguuucccccuuguuuuauuaggaaaggaggaaaggaaauucaguuauagugaaguucuaaucugccaucuuaaccuggaguuuggcuuuuuucuuguucuguguuccuuuuguaccuuacuuagaucucgguuaaaugaaaccaugagagaccguggccugcccaaggaaaucguguuaagugcucacuucacugcgggucagaaccccggaguguuucacccauggaaauagucagcagucgccacaugcaggguccucacucacugcugguaccuuuguguaguaguuacuuuguauuuuacaauguaaauuaaaaaaaaaaguugggagaggaagugaaaucugauuuggcuaaauuuuguaaacaaagauguuaccaauaaaaccuuuuucccaguguauaaauaauaugugguccaaaauuccuuuuaaaugucacaauacaaaacuuuuccaaaaccccaacauuagugacugacuucaguauuuuuaucaaaguuaaaugagccaaacuuauuuuuuacaaauuucuggcgcauucaugauugaaauuuuaaauauucuccuagggaaaaacgagggcugauuguccuuuucaagguauccaucucaucccacuuguuaaaaauaauuagggaauaauacaguuugcagauuuucucccgaugucaucauggcacucaguaacaaggaauauuguagaugaauuuugaaaauguuuuuccuggaagagaaucccaaacguguggccgaaagggacccaggaccugccagccaugcuccuccugucuuucucccuuccagucugaaccccacagcgcugggcgguugacgagguguggccagcuugcaucugcugaaagaaccgggguggccccacugcaucuugaucagacacugccaugaggucccuccccucucugauggcaaagggaaacagugggcucuacacauggagcuuugaagucaagagucauuuucauccuuagcucaggcaugaaaaaaaaaaaaagaauaguaaaaauuaaaaacccuuuaaaaagauaaaaaucaacaguaaaaaaugaaaguuacagacaggugucugucuuuuuaguuuccuaagcacagugaugauuauuggagcuaaagacagaggccacccuucccaagugugaguggaguaaggauaagauagucccgccucucugccuguuugauguuggcccuguggaugcugcaaaacgcagcaaacacggaggcugccggcuuuguuucuguagggcuugucuuagcagaaguucacauggaagagaggaggcguaagaagcagucagaacgucuggauuggagucuugguccugccgcgugcuggccguggagcucuugcucugugucugaacuccuuuuccuccugaguggauuuggguguugccagugauguuugcgucauaagauggggugagggcuaacggagaugaugugggaaaacaagugcuuuguauccugccgcgcacuggccguggagcucuugcucugugucugaacuccuuuuccuccugaguggauuuggguguugccaaugauguuugcgucauaagauggggugcgggcuaacagagaugaugugggaaaacaagugcuuuguagacgauggcguuggaaggcacacugucguugccauagcugucgcuuggaggacuguuaaugauacguugauagcuuucaguucaauuagccaaaaugacagaaaugccaaacaucuguugcaauguugacucccaaaagggcccuuuuuuuggaaugggaaaauucaguuuucucuuuauuuucuuuuucuuaaagcagaaaugacagcauagaugaucucccucuccgacuugucucuguguagacugcacuuguguucaagaggcuccgcuguagcucaaccucgcgugagugcagaaacuugaaggaacccaguuguuuuacuucccccagcaccccaaauuuaaaacuggcucucacauugugagacagcauucagaauaguaaucgugaaaggcuaugaggacuuagaaaaagguauuuaaaaaacgaaagaguguagcuguauccuuuucuuccuggugcgcuguucauucacggugaacgcacccacuucagcaucuugguggaaauaacucaguuccaccuuccauauacuuuucucucugcagugugggauuuagggagaaauuaagaccucgacucgcuuaugaauacaagcucaagggcaaacuaaggcacccagcgcaguuuccacauguucugggaacccugaacacuugccuuggggugaaccagaaaccuaauacauugcacauugcacuugaaguugaguucagacaagaagaugggaccgcuguauccccaaguagcucgggcgaggugagagcacuccauucugcuucaaacucagugcagaaagccaagcccagaagggaugcggguuccguucucaccucccucugcucuaagcugaggauuccaggugaugcuguuuaccuccugugauauccuuguguccuggggaagcacagauuucagugagacugggacucuguuuuccccucucacugagaugcggucacagcugcccagcgaccugguuccaccuuagggucaggcagcugcgaccgaucugucugguuccucacccugggggugcccgccguugggaggugcugugguuccagggugggcgcuggucccuucccacggagcucgccuagcaccuguucacaggugugccugggccagaugcaugucugacagggacaucagguuuggggagacugaaaaccauuuuugaaaaugaaguuaugcugaugucauuuaaucguacgucaucauaauuggcagcagagaagguugcacaucacucauggcagauccauuacaugggccaugggccaagcugugcaccaggugcugggaggauaccggugggcgaaccagaccugcaggaaaauacauggaaauggggacaaaacaggcauuucagaagcuacauucagcuugaaacuggauguaaaauuugaugguauccucuaaaauucugguggaaaaaagaucucccuuugggaggcugaggcagguagaccgcuugagcccaggaguucgagaccagccugggcaacacaaugaggccccaucucaucuauccagguguggcggcacauguccguggucccagcuacucagggaggcugaggugggaggaucuuuugagccuaggcagucgaggcugcagugagucauguccgugccaccgcacuccagccuaggcaacagagugagacugugucucaaaaaacaaaacaaaacacaacacaacaacaaugaaaaaucuaaugacugggaugagaucugaugaaaugguagguugaauuuaaaauggugcaagugguggugccugcagaguaccagcuuguugccaacgaugcugucauccuaaggcucuccuucugugguuaaagugguucaaguguagaaaaugaauuuuaaaguguuaccuaccugccagcccagacuucucaaggcccagugguccuauugagcugaaccugcucccaucaguagugcccugcgggaccuuuugaaaaucuccccaguaaagacauucuugcuuucauacaaccuggcugcuggagcaccuggcugaauuuuaucuuauuauucaccuuugaguucguggcaaauacuuagcaguauuuaauuuuugcuuucugauuuaaguguaauacgaaaaaaaaucaugcaaaucaauuaccaguaucugguguuugaaauuguaagaugcugaaaagaacuguuaauuauacucuguaucugccgggggaauguaaacugacuuuaggauucgaagagaccuugcugaugagagaaggaaucacugcuccuuuuagaggcaaugaaaguugggccuggaguccuuugcuugagaucacaaagccagagacuucaggagagcagaaaugagaaggcucagugcccuccuagggaaccuuucguaacuugaauauugugauucagccaccuggaagcuucacuugugaacgugacucugcaaaaacauguuagaggaagcaaaggagaggauggacgugaaauccguccuaugcaugcucaccugacaugcaacagggagggucaucugccagggcgucacggucauuccacgagagcuggguggugacgcuccccaaguucccacuccuggagagguaggcagcgagggacacuggcguugcagggccccugggacaggcuccacuccucccuucuugcucuggaggugacacagucuagggaucuagugaggaaugggaccuggggccagcgugcuuggacaagacgaagccucaucaaaguugaaccuuaggguucaucaagcagggagggcuuccacauacccuuguaucuggggcaaccaucagagggcagggcuggagcuggggcccuguagggcacucagcguccggagggcacagaggagcacauguggggcucaggacacagggucgggacgguguggcggcgaggucccucuggcugugauauauguuaggggaaggagggacugaggccgggagugggcacgggcaggcaggaaacuugugcagaaaccuagcaaagaagugugggugauuucaaugaaugugagggguagggaagggagagcagagggagauuaaaaacacuugggggugagauaaauggggcagggauggugaggaucccuguuugcugagcuccucugucccaagcaggguucuaagagcuuuucaugcauuaacucauuaaggaaggcucuguuuacccucauuucacaggugaggaaacugaggcaucgagcaguugaguuacgugcuggaggucacucagccagggagggcucggcagggauuugaaccuggugggcuggugccuggggccacacacagaacaggguaugaaggagaagauucuucuccaaagaaagaggaacagauuuccuuuucaaauguuauuuuucuuucuuucuuucuuucuuuuuuuuuuuugagacacagucuugcucugucacccaggcuggagugcaguggcgcaaucucggcucccugcaaccuccaccucccagguucaagcaauucuccugucucagccucccgaguagcugggauuacaggcccccaccaccacaccuggcuaauuuuuguauuuuuaguagagacaggguuucaccguguuggucaugcuggucuugaacuccugaccucaggugauccaccugccucggccucccaaaguguugggauuacaggugugagccaccgcgcccagccuuaaauguuauuuuucuuaaaacagucaaauucaauucacaucaccaagauacagcagguuuccagcaucucuuuuuaaaaaguuuuuuuaaagggaaauaauacuacuaucacuguugcagacuuuucugucguaagcaggcuuauucaauguuaaauacgacuuuuauuaaagcagguuaaaagaaccuuggcagaaauuucaaauaagacugggucggguacuguucagggugcuuugugucaacuuauuacuccucgccugcuaggacaucauccccuuugcaucuggggacacugagauggggcgagguggggcaagacuacacagcuguauguggcagagccaggguucaggcagagcuaggccaguaucggggucugggggcgaccgucugcagcaccgucacauacguggggacguccaccugugucagauguuucccagcuuguuucaugaugacaacagcucugcuagaaaagcauuucuuuuuugccuacgaggacucucgauucagggacccugagucuuugggacccucgugcagcuggggcucacccugucuggacccagcggccugacuggccuggauguguccccugcuaacgggccucagccugaccauuuccagugggcccuaccgucuuguuucagugacuggggggacagcaaaaugagaguuuaucugcuuuaacaucaaaagguuuucuucauuguuguguuauugaaugaacugaacagcagauuuauuugcuuuagcaaaugcggcugccugugaugguggcauagguguugagugugagcacacgagcauggcaggagcucgcgggaacgggccaacgccccacugccccagucagcccucuguggccucagaggguagcugcccgucuggagggccucggacacuuucaggcugggauggggacucugauuuuuugcuucucaggcacugaugugguucagacccaggauucuaggagggaagguucccgucgcaggggagggaaucagacgucgcucugggcggcaguggagcuggcaggcagccucugggcucuggcagcauuguccucuggguccagcgauuugggguuuagacaggguuucuggacggcaucugcacagaggagcggaagacaagagcugggaaccgaugcgugccuucccucuuuaaaacaagaguuucgaauccccaugaggguucccuagcguggucucagagcccaggaucuggagggggacgucugucauuggagaaggcagaggagccaggguggaauccuucccgcugcccagcaggagcagggcuggccuagcgggccgggcugggcacugcagcaaccuuguaccauccccuccugagagcaucaggggccgggacguccaagguagcaccaggccccucaugcccgcacccccuccucauggucaccucuguuccugcagggucccgguggucucccgcuaaccccgcguggucucuaacgccuccugucagccgcugcucugcugucuccacccgugcggaggucccauccaguaguuucugucuaacccauguguaguagugaagcgucccucccuaauuguggccugugacucuggaaacaccauucucaugauguucuaugucucccuuucaagaacuggguuucucuugaggagaauacagguucucggcccuguaauuuaccaagagguugcagaucaggcaccuguuaagcaugaaaaauuuguuucaguuuugugaacccaacaagagaaugacaauuuuaauguucucuguuucccagugagugagaauuccugaauuuacauagaaagcccacaugagaaguccacacuaauuggccacgagugucuggcauugcgaaggaagcugugccuuccaacuggaaacgcacagggguucuuaaagacaaacauuuaaaucugaguucggcucuguuaaaauucagcauuugcuggcaacauccuaaauacucaguugccuccagggcgacagccuaggguguauuuuuccacaagcgaagcccacgucugucugcccuccucacucucuguuguucucguguaacgagauguuuuguguguguggcagguggcagguucaagaaagagauugucguugauggacagagcuaucugcugcugaucagagaugaagggggccccccggaggcgcaggugaguauacaugcaugccccaagccugcuuuuuuucccuuuguuuucuaagguuugauucaagaagugcuucuagaaaucggugacuugguuuccaaaaaaguggaaaccccauaaaaaauguuuccucucacugcauuuuuuucucaucucuaagaagcuaauucuuuuuuuauuuuuuucccagacuaaauccugcagggaaguuggguuuaugugauggcuuuucacuuucuguguuuuuaaaaaggcaggaaacgcacacucugcccugguuggggagcccaguugaaaugacaucuggaaauuucugucguuugguuuguuuuuuggccuuuuccuuugagugguuugaucucuagagcagugagaguuagagagcuugcugggugcaauugggagucccaccuucucucugucucugguaacuacaggcauuggccccucugugccgcccuggccuuggcccaagcaaggcagucuccaccgaaagccgguaugaagcauauuaugauuucuuuggaaguuccuggaaagauggucauucuggaaauaacaaaacaugaguguggaagaucucuuuuuuugguuuauuuaaccugcuuuguuuuacuuacagcauaauuuaccaguuaagcacuuuauuauuauuguuauuauuauuauuguuguuguuguuauuauuauuauuguuauuuuuuauuauuuauuuauuuuuuuuuuuugagacagucucgcucuguuacccaggcuggagugcagugacgugaucucggcucacuacaagcuccaccucccagguucaggccauucuccugccucagccuccugaguagcugggacuacgggcgccugcuaccacgccuggcuaauuuuuuguauuuuuaguagagauggaguuucaccauguuagccaggauggucucgaucuccugaccucgugauccacucaccucggccucccaaagugcugggauuacaggcgugagccaccgcgcccgacccauuuaaacacuucaaaggagccgagagcugguaacggcuagugaccucaaaugcaaacggaaugucagacauuuucuuggcauuauuuccuggacuuaaccuuuuugugaacgggcagcauaggauuguaagauggagaaagugaaagauacugaauacaggacuucuuaggccucaggucuaguacuccacagguuggagggcugugcgguuauacagaagaugccacagauuugccauguugcauugacucugaccauugacagugaccauuaagauguaccaguauucgaaagaaggaugcugccaauuaaacuaugaaacagccgcaauaauuaggugcauucugauuucaaagcuguuaaaguguguaacauuuuguuucuuagcauuaacgauaccaugaacuugaucauaacaaggaaagaccuugaagacguguuaaaagugaaaacuuaguuacaaagcaguuugagcccauguucagugaccgucugguaguuuauaguauggcagggcaaaguuagaggucugauaggauccuaucagucagaugcugauaaaagucagcucuuucuuagucccacugaauguauaggaccguguuuguucugcuacaaaggaacucuuggaggcaaggucccuccuguggcuggugauaggagaaagaaguagguaacauuuagaaucaccugaguugauuuuccguuuuccccagcacauaaauguuuugagugacuggaaacaagcuuuuuucuccacaacugaagagcaagucuuaccaguauaugaagcacaaaagcuuaaauauagagaaaaaucuacagaagaggcuaggugcagcggcucacaccuguaaucccagcacuuugggaagcugaggcaggcagaucaccugaggucgggaguucaagaccagccuggccaacauggugaaaccccauuucuacuaaaaauacaaaaauuagccaggcgugguggcacgugccuguaauccuagcuguuugggaggcugaggcagcagaaucccuuaaacccagaaggaggugguugcagugagcugagaucucaccacugcacuccagccugggcgauggagcgagacuuugucucaaaaaacaaaccccaaagcauaguuucaguuuucugauggugaacauguuagauugggggguuauuuauugggugccccccacacaaguugcuggggaagucagaaugcacccuuaggagaugagagccacaguucacguuuccuccggguggaugcucagaugggcuucagcucccggcucgggaacugaggucugguuccgggucagccaguacucuuuaugggcgcagugggagucugcuccuccugcuuucuuagaagagacaggaagagccuuucucaaggcagagaagaggaaaaggagaugccuuccgucagccuugguccuggcacucucugugggagcugcuaucacgaucuucccaggucucucccggccuucuuuguuuucaaguccucauucucauuuaauuuuguauuuaucacuagaacuuuggguuaaguuuuaccauguacauguuuuacauauaacugaaugcacuuuucacuuacaugcagaagucagaguuuaaccuguuaaaaacuuagaccaaauguauuagaggugauaaccuuggccauaaaaaccuaucuaggaacuacagcuucuuuuagggaaagcagacgggauggauuucgguuuuguuuuucaaauuugcacuuggaaagagaaggaucuuuguugccagauagagcugaugucagaugugcugcgcugguugcagugagugugggaagucucugcccugcaggcagccuccacucacucagcuccaguuuuccaagauggcuguugguacuaaaugagguacuaguauaugccugacaguguggguaucugucaaaagaggaugugauguagguucaacuggcaagacaagaauaaaaugaauacggcaaagcaagaacaaaauggcgagagugaggcuauugugaaguuuucuucccuaaguuuuguuaauuucccugaaaauaaguagucauuucuuugcagaggugcagcaggaguucagccaaggaugagccuggguugaaucuuuacccuucaacagaguaggccagccgcugcgguagcgagugggaaggacugagggguggggagguucugagcaggcaugagggguccagcaaggcuuccuuaagagguugagaguacaguggaaagccuuagggcuugaggggcucuggcaggaggugggucuggccuucugucugcggggccgccuuggcaggucggggcagcgggcggacaggccaggagcaugaggaccgcggggacacugugugguuuguguccucugaagacagaguggcuugggugggaacaggaugaagggcccauucccaaggggaacaccaggcauggugugcucaggaggaggacguggaugccgugacaguguguaaaagugacagucaaaagucaagcacccagugugugaccgaggggauuccugcagcccccugcugccugccgccaugcagacaucucuguucuuaaucaagccugcucacucagcuccugcucuccuccccuucuucucucccuaguuugccauguggguggacgcuguuauauuugucuucagcuuggaggaugaaauaaguuuccagaccguuuaccacuacuacagucgaauggccaacuaucggaacacgagcgagauuccucugguucuggugggaacccagggugagugauguucgugugcagauuguuuugaaaggguucuaacaguuacauauuuucaguauggaggaguuuaaaaaaugcuuuaaagaaggaaaaauugccuacugaacgcucacuuuuuugggaaaaauuauggaacugaaaugaucacauuuccugauuugauucuauggugaaaccacucauuuaacaaccugaaaacaacacacacacacauaucccaggugcuuuaugaaaaauaaaaucuauuuucccuuguuuucuggaaaaaaaauauauauguguguguguauauguuuuguauauauauagucaaauacauauauauauuuucugcuauauuuuaauucucuguucuauaaaaugauuuauaaacaaucuauuaaagcuuaucuuucagugcaccuugaaaauagugcugauuuugaacauagagcaguucuguuuauuaaguucuguuugucaccgucuuaugaucuguaucuuauuuuuaaucugacaggccccucagacagagaauccaacugggcacauuucuuguuuucucugagggucacuucgaacuuggucucuuaguggaguggccgucacauggccugagacacaauguccucgcucuugaucacagaccuaugguugugcugggucugccacuagggucuaagaugucacguaggauguuuguaaaagucagauggagguuagcuuuacaacugcuuugucagaaauauggguaacauacaaauaauccuaucaggaaaaauuguauaucccuucauuuuuguuguggcuaugaauagacuguuuugcgaauucuuuuagaaugagccuaucugacaugcccauccaugcucugaugugagacgcuucucuuuaggacgucagcuguacauacugcacuagguguggucuaaguaggagguugcccaggcagaugauuggcugcuugaucacgaaccuacaaaagcccagauaaauaguguggcauaaaccacaaacauuuuccagccagacgugguggcucacgccuguaauuccagcacuuugggaggcccaggcaggugggaucaguugaagucaggaguugaccagccuggcccacauggugaaacccugucuguacuaaaaauagaaaaauuagccaggcaugguggugcaugccuguaauaccagcugcucaggaggcugaggcaggaggaucacuugaacccaggaagcagagguugcagugagcugagaucacgccauugcacuccagccugggugacagagugagauucugucucaaaaaaauaaaaagccgggcauguuggcgggugucuguaaucccagcuacuugggaggcugaggcaggagaaucuuuugaaucuggggagauggagguugcagugagccaagaucgugccacugcacuccagccugguagacagagggagacuccaucucaagggaaaaaaaaaacaaaacuauaaguaucuuuucagugugcuagaugagagauguuagaguugggcuuccuggagagcaccucccccaacuuuuuuuuuuuuuuuuuuuuuuuuuuuuuuuuuuaaagcguacguggucgcucucacuccugaaaccuucagagccagagcucuguuuaauccuaacacagaagggaggagggauucuuaggccuaaugcacccucuaguguucaccaggagacaaggccgcaccacccaaaaguccuugguucuugugagaaugcagaguugccguauuugagguggcaucuugaaaaugccuaaucguguuuuaaaguggaugcucauccacagcagauucugcuuaaagcugccuugaagucgaauagagaaauuccgaauaagcuccccuuccugcaggcccgaccguggcauuuuugagcaggguccuucggggcugugugugcagacaccacucacaggcugcuggagcucaggagguuugacuuuaggacucagaaugggcuuuugcuuagacucacugugaaaagugacagugaaguucccagccuggaaagauccccugcgaucagguucuguucucugaguucugaguacacauccauguuccaucaguaggaagggagugucugagaucccgggaguugggaccacacacaccugcgugugacuggcugcuggcugggugaccuugacaccugggacuuuggugggguucaacaggaauucccagaagacacucagugcauccguggguaugugauaggcaucuuaacaauggcugcuuuuguuccucauauuucaaucugcgaccaguguuccaggguccugccuggaauccugaaccccaccccccacugucccugccccuggaggcagcguaucccucugagucuccugccugagccaaggggcacaucgagccuccugccaggguggcugcuuagauucucgagaaacccugaugaaguugaaguccuugaguaaaagaaaguacccccauuuauucccaugaauuccaugaacauccguugaucggauguggaaagaugcccaggaaggccccaggggagugugugcgugugcgaggguggccucugggguugggagguaagucagccccacacccucccggggugaacagguaagcuggccccacgcccucccggggugagcagguaagcgggccccaugcccucccugcaggacuccucuuagcugggccacccccagaugaaccagaacgaaaaguugcaaucagggcuguauuccucaccugcgggauucucuugguccuucccuagacuucagggagcaccccagaaagccugauggcaggaagcuggcaugcacgugggcucugagggucccugccgcgacgcuugcuuccugcgugcagacuugcucuccgugaagcccgugcucggcugcucuuucagggguuuggcuuccugggaugccagagacaaaagagggaucagguugucuaggaaggcaccuggcauuucucuuccugcugcuuugggguaggcagcguuagaggucagagcauaugggaugggaaagaacggaagaggaauuagguucauugccaaaggauuccugggcuggggugaggccuccgcccgcuggcgggaggggcagcucugccagcaggagcucuuucugggcaguagccaaggacugcacgaauguucauaauugggcaagaugggaaugaaugagguaaucauuuaauguuuguuaaacaaguucuguuuuaaagacuugcaaauuaaauugauuugagggagaagcacgaucuguaaaaagcuacggaguuaaaaguggaaugaaaaugagacagguauagaaccgaaaugcgagugcagaagcccguuuuggugcaguggcagagauucccguggugcaccuuugaagccgaaauuugacagaaaccaagcgagcaugccgcugaggacggaggggcugcgggauugcucggccgcaggucagggucucauggaagcuggguggaugcuauguggccuguguuuucaaaauuauccuagagcauugaaacaucauggacuuguaacuucuuuuuacaauuaaaaagaaauguuuauacuuaaaaaaaaaacuuucuuuucuuaaauguugugaaaugcaagucagauuuacuaaucagcaagacaagaaggcaggacgaggugcccuuugaccguaucccuggaacgggggugcagccuauggaggcuguaguggugauugucagagaagaaacccuuaacugcagaguucacuugccuuccaguaacgaggaaacgucagcccaacccuauuucauagggcuaagaaaauaacaugagaaaagagaaaagaaaaaacugaauaaauuccucaggacaucacuuuuuaaauauacuucaaaaaaugaaguucucaaaugcccuuucuccacaaaaauaaaaugucaaagguggucgcucuguuguauaacuuugcugcuauuucuuugacugguggagaaauccuguugguggauuuuuguuuaaagaguuguuuauuguuuucuuuggcauaagagccuucaagcccuaugaaaaagauucagguuaggaaacugucucugaaggcugggcgcaguggcucacgccuguaaucccaacacuuugggaggcccaggcggguggaucacuugaggccaggaguugagaccagccuggccaacauggugaaaccccgugucgacuaaaaauacaaaaaauuagcugggcaugguggugaguaccuguaaucccagcuacuugggagccugaggcaggagaaucauuugaaaccaggaggcagagguugcagugagccagcucacgccacuguacuccagccugggcgacacagugagacuccaucucauuaaaaaaaaagaaaaaaaaagcugucugugaaaaguccucucuccucccuaagcccuguggcuguucacauuccagcuccucauuucucuguuccacgugccacuguaacucaauaguaauggaauggauggggcagggcuggggguggggaauccuggcagcugagcuuaaaaaaaaaaaaagcucaguuucuuuuuuaggaaacuggugccgacaucccugugcagcugcucaaacgcccccgugugcacacaugacuuagauuggggggauccaggucaccugugacccugaggggguccaucaaaaccucaggggacucgcugcuccccucuccacacaccucccucccaccccucuaggccucaccccuacaucucccucauauacaccagcuguccugcugcccucugccucaggcguucugccccaggcagugccuacugcgccccaccugcugcaggugaggguucccugaccucuugcucuaaaacccagagucacccaagccuccugaccuccuucccggcaucaguuaacaguguggccaucuuacauucagaaccauucaucacauucaucuuucuuuucugcuugccucucuggccaacuagaaugucuguuucaugagagugcagauugugucuguuucaacaauucacugggguaucccugugcauagaacagaaacaaaccccaaaugggggcucagugagcauuuauuaagugcgucauuggacaagugaccacaccuagaagaagaaugccaguguagggaguaugcuuagccaccugcguggugcacagaagggggccugcacauagggacugugugugugguuuuuccuccuuucuaaaguauguauccucuagacccauauuuaagucuuuuuccuucuuucugaacauuuuaaaauugcaguuucagaagcgcuccuguaaaacaaauaucuacgaaugaauaacuuucucuuguguuugagucucuuaguugggaggcaaacgaugcucuacaauuccagauucauaaacuaauuacauuucugcugaguaagguacugguuuuccguguuguggggaguguaggaaguauuuagagcugucauugucacugugccguuacuuuuuggucuucuguuccagaugccauaaguucugcuaacccgagggucaucgaugacgccagggcgaggaagcucuccaacgaccugaaacggugcacguacuacgagacgugugcuacauacgggcugaauguggagagggucuuccaggacgguaaaugcgcguggcugggaguuuaauuucaguucaugauagacgggaggcacuucaagaagucaguccugccugcacuugugcaugugggugguggaaauaugucguugaugggugggcauuaguaucgagagcaguccauuccagaggcaauucucagguauguuucauauaaacagugcuguguucagaagagacaacaaggcauggcuugagaacagccugguguugggucugugugucuccuauggggccuuuuuguguacaggauagaacauuucuugagcuguuacucauccaugugcucuguaaaacuuguuugugagcauuucuuuauuguaauugcccauucuuaauccagucccguccuuuaaagcaguuuaaauauuugauauuaggcuuugagaagagaacugaaaggaggagagagagagucaaguuuggaccuccccccaccaaaaaaauaauaaaaugacacgauaccacucacagcagagggugaggaccagccuuuuggaauuguuuuuagguuauuuuauucauuauugaucaccuaccuucaggaacagccacaaaucagacagaaaauucuccuaggagagcaugagguucugcaagagggucacauacuuguggaugaucauagcgccagacgucgucuaugagagaggagccugugcagaugcguggggugggcgggagagguggcgucacccuggggauaggagggucugggguaaauaaggacugauacuucuaaagccagucuuuucaaguuggaagcuugggagaggcaugguucuggcagaggguccccuugcuggugggagugguggaagucacuuguaggguccucuccccuucugguuuaaauccaugggggcagagccaccugucccccugcucuggugcccaggggguugucgggggcagagcagggcagccacacucgggcucuccagagagugcuggagccgcuucaaggugauggaggacucgccgcgcucugaccuugaagacccacggugaaagcaguggcugcaggacuguucccgggacuuccuccaaauggggcaauuuucuauuacauguuuaaauuagucuucagaugaaauuguagggauucuguacauucacuguucaacucaguuucaaagaugacaucaguucucaaacuucacauuuucuuuccuggagcagugagguuccuuucuaagccugccgucucuucccgcgcaucucugccucucagauacuuaccuguuuuucagcacguugguccuaguuacugcuucauggcuuagguuucuucucgccuuauccagugccaaugcugaagaagcgcaggguccccugaggaucagcacaaagucgcuggggucccacagccccuucuucccuccacuaacguauaucucgggcaccuccugcugccucugucgggagaauguccuguggggaguaaaccucauuucaagccgugcuggugaacaugagugagauguuagugagacuuggaagaacugugcagggaggcccuuagagcucuucugagaggugcacccuaauggagcaaggucacugucggccgcugcgcugccgaggccccugugaauguugaaguaaagcgucguagaugaaggguccccaggcccgugcaugaggccagcugccuguuuucauaaauagacuuuucuucuuuuuuuuggagacagagucuagcucuuugcccaggcuggagugcaauggcgugauggcagcucacugcaaccucugccucccagguucaggcaaaucuugugccucagccuccccaguagcuggaauuacagguacacgcugccacaccuggcuaauuuuuugcauuuuaguagagaugggauuuucaccauguugcccaaguuggucucaaacuccugagcccaggcaaucugcccaccuuggccucccaaagugcuaggauuauaggcaugagccaccgcgccuggcuguaaauagacuuuucaugacgcagagccacgcuuugugucgaugggcugcagcggguuugggccccucuccagcugugacagcagagaugagggucuuugcggccugagaagcccagaauauucacucucuggccccgugcagagagcuugccgguccccgaugcaggauaucagggacucaguugucuggauaaguuuaguuuccacagugacuccuuugcuuuuguauuuaucacgguuaacauacaugaguuuuccauaaauugaugagugcuucuuauaaaaauaauguugucaauuaaugaauacuggggguugucaggaugaugcugccuuccugccaaacagccuuuguacguucuggcugcucuaacaagacccaguggcuuauacaacagacuuuuacuuguccuacuuacggaggaugggaguccagggccaggugcugguggguguggugucugcugagggccauccuccuagugggauauguguuugcauaguggagaacagaggacacaagcccucgccagucccuucccauaaaggcacuuaacccaucacaggguuccacccuugugaucagucaccuggcagaggccccaccucuuauuccccugggggucaggauuucaguauaagaauuuggguugaguuccauaccacacccagcacguucaaggcagaggacaggcagccacccaccucuguguuggaagcauuucguuuucuucagguuggggguggcaagaggagaauaaggacugauauuucuaaauauuaguuuaaaauauucagaaaaagcguuuccguuacugugacagcucaugucgcaccuccccaggugaugcugugaugaguguccguuuucaugggcacaggagauuuccguuccaguuucguauuauagaaauaauacacucucauuauguauucggauuuuggcugggcgcaguggcucaggccuguaaucccaacacuuugggaggcugaggagggcagaucaccugagguccauaguucgagaccagccuggccaccauggcgaaaucccaucucuacuaaaauugcaaaaaauuagccgggcaugguggcaggcaccuguaaucccagcuacucaggaagccaaggcaggagaaucgcuugaaccugggaggcggagguugcagucagcugagauugcacaauugcgcuccauccugggugacagagcgagacucugucucaaaaaaaaaaaaaaguaggauuuuauggaauuugaaaagcaaauaccugugaagcuacaacuuccgugacuauugcgauuuuuuuguccuuaaaauauuuucauaugaagauaacauuuuuaaaauaaaaucaguuacuuuguauauuuuauaucauaguuauaugguauaugguuucuuauuuguauauguauuuucauguaaaucacaaacacucucauuguuagugagaaaaguaguugcugaguaggagcuuuauucaguacuuagcaauccuuaauaacaaaguaaaaauccucaaggaaaguuaaacauuguaagguuuauauaaaguugaagaaauugaggcucagagaaaugacauagcuugacccaaagggacacagccuggacuggaucccccaucuugggaccugagagccucgacuuaaccacagcaccgggacauuuugucauuaaaauggaagcaaaucagguccuggggccuuaagaacacaccagcuuugcccacaggucuggggagggccuugcaggggaugcacccagccagcagggccccugccugcucgccgacucaguuuauucacauuucuugauaacucucuggcuucuuuuuugcccuagggcuuacuuuguuuauuuacuuuuuauaccuguauaugguagaaagaaaacauaaaggaaaagcguguaauuucuacauaauguuuggcuuguaaauaaaaaaaaaaaaaaaauccagcugcuuccauugcccugcggaggccauguuccugauuggcucuguaccgagguucauuuaaaaggccagggaccucauucuuucuucuccaacauuugacuucuuagugucuuguaacaaaaggacauuguaaaaaugaauggagaaaccuugcauucacuuuuuguucgcuugugugguccuguuuacuuugcuuucauggaguuuccagauggcuacuggcaaguggcuguagguguugggaagcagccuagcaggcugguucauccacccagucacucguucaucugagcaccagcuucccacacacugugcgucuggucaggggcuagaggcagauugggaagcgcaggcagggucccuuccuccgugaaguuaagguccacuagggaggguaaacaucaaacggucacccagaaacaugaccuugugucuugcucagggguggaaaagaaguguggcagcccaggcugcuuucuggggguggagcguucucgcuccugcucacaggcgaguuuguguggcuugcggggcugggugagcugguuccacaagaugguuucugcuugaccugggcagcugagccggacgugggcuguggguacccaaccguuuggauucucagcagagcccuggggaagggaggcacugggggcuggggcgggcuggaugugcggacuuggcagcugggggcugcagguccgucugcagggacugcacagggcucucguuccuagauugcuucacagccagcggcucugugccugucagauucugcauggcucuguuugccucuuccugcaacugggaaauaaccuauauacaaguuuuucuauuuuuaaaguuaaaauggugauuucaguguuuggcauuaaauuuuucaaaagucccuguugauuuguucuccuagggccuggauacaugaacaugaaggauuacagaaaaauaaaguucauuccauguagacauuguuccucugguccuacgaucccuccccuuccccuucccuuuuuucgaggcagggucucugucacccagguuggagugcaguggcacgaucuagacucacuacagccucuaccucccggguucaagcaguucuccugccucugccuccugaguagcugggauuacaggugugcgccaucaugcccagcuacuuuuuggcuauuuaguagagacugguuuuugccauguuggcuaggcuggucuugaaauccuggccucaagugauccucuggccucggccuuccaaagugcugggauugcaggcaugacacacugcacccagcuugcgauucuucuuuaaagagacauuuuucccacuucauaugaagaagcagcuuucugaguggcagcaagcagcucuucuggacagacagagugugugucugacaugggacuguagucaggucuccggaaggucaggaaggguauaguuuuggugaugggauuuuucagccuacaugcugaaaggucaccuaaaauaguuauaacuuagugacaaaaauaaauccucccuucagaaggccaagucauguucaaggugguagcaagcuguguauagguagcaacagggccccuuugagcauuacacgugcaccuugggaggaagagaguggagagcgggcucugccuguauauucuuggagauggugcauucagcacugucguucccugcaguuagguuuuggagaguguaaauuuuagccugucuucaaaugcuuugaguuucucgucuuccugaguagcguguucggagcuuucucugcugcggguggcggugccacagaggaacacaggggccuguguuguggcaucuguucaaucggggagacaggaucaggguuuuuuuguugguuuugacauucuugagccaaugcacccuaacuuuuauugggcauaguuuaugauuguuaaauuauggugucuuugugguagcuguauggcaugugggauuuuaaaggccccugauuccuaaagaaagagggguuucccuuucauaggcaaucaggaguacaaccugauagugguacaaagaauuguuuucauuucuucuccaagcagcucgaugcccuuucucucuucacucccccucuccuagaaugagcugauaaagauguacgugagugguccacagugugguuuuaugcauggauuguuuauuugcaucccagcauguuuuguauacagcagggguccccagucaggcugcacaggaggugagcagcuugcaagugagcauuacuccccgagcuccgccuccugucggaucagcagcagccuuagauucuccuaggagcacgagcccuguugugaacugugcaugcgugagaucuagguuacgcauuccuuaggagacucuaaugccugacgagcugagguggaaccguuucaucccaaaaccauccccaucccccaccugccccccaaccccugauccucagaaaaauugucuuccaugaaaccaguccuuggugccaaaaagguuggggacugcugcuauauagaauuuaauauucuugcaugcauuuucugaaccuucuagucacuuguuaaaucccaguucagaacaucacauuagauauaugaucugcacugugcuaggacgugcuccccaccaaaacgucagcgucuuaagcuuguauucauaugaccauaggaaaaccuacaugcagaacuuugauaguaguuguuagaccaggucaagauccaugucaaagagauaaauuacaaauuaucaucucucugcuuaacggucuccagggccaguuuggugaucucacauagacuucuguccuagaacagaucugcauuauuguggagggagagacaguagguucuagguguaugggaaagcugggcaguggcacuggaagggcgcugugugccaggugcuagcgcucccgggcccugugugccaggugcuagugcucccgggcucugugugccaggugcuaguguggccacagccuuguggcuuauuagggcuuccucuguucacacgcuguguacaucguccugguggauggguguuuaucugguagaguaguuccuggucuaggcagauccaugucaguccuuugaccucauugccccuggcuuuuuauguuugugcugcaguuaacauucuggaaagcacuuuuauagaagccauuccauuugucuuuugucccuucccaguaacggcucaccugggccuaucuaacccaugccgagagcccgagcugggagagguugcaugauuuuuaccaagguugugcgggaagucagggagccucggugugcucuugaugcuuugcuuccagagauugaaauccuggugugugcaaagaaccccaucucacauuaaauggcugcagcugccugguccuaauuacaggaguguccagaaccaggggagcuauguuaaugaguccguuugugcaaccuaauugcacgcacuagagcaucugugaauguaagcagucuucugggccucuucuccuggguccugcaucaucuuggaccauuuuguuuugcucacaccacaguccuugugcuguuaaaggauguaucaguuaagccuauuccauucuuuccugaaaucagcuuaauuuucauugucgggguggccuguuuuaugauuuguuuuuguugcuauuuuuuucuccuuuauuacagauuagauuggaacuagugugugugugcaugcgugcauguguguguguauauguguguuagcgagggaauacuucaaaaaauaagauuuuuuacacuugaaagcaagccauguauauguguacauuaggcacuugauauauguugaaaagguggauuaaugggucauuaauuguccauuuuuuaaucacuuguaguaaugacuaauaauuaugcaacaauuuaacggcuuaugauguaggauaguggaucuuauuaggcccaguuuacagcugggacuacauuguuggaaaugcugccuucccagagguacauggugcagcuggugucaggcgaggccaucauuucccguuucuaccuguggucuuggcugugcaccuguacucaucacuguccccgucucuacacccucacccccuccacacauugaaagucuuauuucuaagacuuccugggacagaugggugguagauguguauugggacaguaugaaagagguucagcugcuuaaauuacacuucauuaaggggguucauauuugaacauuuucugagaacaaagaugacaugaagaaagugaccucuguaaggcucuggcagcacuuaugcgguaccaauacaaauggggguugggggcugagcagaaaacauucuucaagaguuaaaugaucaagucacguaaggcguguuguuuuuguuuuguuuugagacaaugucucacugucacacaagcuggagugcagugacacaaucuugguucacugcaaccucugccuucugggcucaagccguccucccgccccagccucccaaguugcugggauuacaggugcgugccagcacacccagcuaguuuuuguauuuuuaguagaaaugggguuuugccauguugcccagccuagucucgaacuccugagcucaaagcgauccgaccgccucagccucccaaagugcugggauuacaggcaugagccauggcacccggucauauaaggggguuugaugcugguuugggagacauucuggugucguuagcccuaggguuguugaugucauucuuuuuuuuuuuuuuuuuuuuuugagauggagucucgcucugucacccaggcuggacugcaguggugugaucucagcucacugcaagcuccaccuccuggguucacaccauucuccugcuucagccucccaaguagcugggacuacaggcgccugccaccacgcccggcuaauuuuuuuguauuuuuaguagagacgggcuuucaccguguuagccaggauggucuugaucuccugaccucgugauccgcccgccuuggccucccaaagugcugggauuacaggcgugagccaccgcgcccggcccuggcagcuucacauguagggccauccagugcaugugagaaucugcagauggucuccagaagagccacaucugaccugccuaguagcuuaucucccagcgaaugggagaggugcagaccugcuguugacuguaaggagacuugauucagccuguuggugggggcgcacaugugaggaagaagccuugguggguuugugugggucuuucucuuaugccauaucccugguuuauauuuggaugggaaaauacauaaauguuugauggugaucauuuuuaugaaacaugacauugucaacuccuuucuucauaugcauuuucgaauucaguucuuaaccaaagaagcucuuucuacaacaggguuaaauuauaaacugaaauagcaaauuaauaccaaaacuaaaauaaagcuuuuuguauaguaaaccauacauucagagguuuaaaaaaauccaacaaaaugaaaaauacuuuugaguuacuauuuuuagaaaaaaauuaguuuggguugaaaaauucuuacccucaugaagcuauaaaagcacauguuuuacugaugagagaagcuucuggcacaucaacugagacaaaaaucuuccauauucacucgguaaauacaaauacagaagaugggcugggcgcagagguucacagcuguaaucuaagcacuuugggaggcugaggcaggcgaauuaccugaggucaagaguuugagaccagccuggccaacaugccgaaaccccccucucuaaaaauacaaaaauuagccaggcaugguggcgugugccuguagucccggcuacucgggaggcugaggagggagaaucucuugaacccgggaggcggagguugcagugagcugagaucacgccacugcacuccagccugggcgacagagcgagacuccgucucaaaaaacaaaaccaaaaacaaaauaaauacaaauguguaagauagaauucguuaugaagcuacaccagacauuuucaggaguaauuugagaaugugcuugaggugauuauccuuaaaucauccaaguguuuuugaauauuauuucaauuauuucaucuuagaaguaugaaaucagcuuguuucuuguuuagaguugcccuuucuuuuuauuauuauuucuuaauugagacaggaucucgaucugucacacaggcuggaguacagugaugccaucauagcucacugcaguuucagacucuugggcucaagccauccuccuaccucagucuccugaguagcuagcgcuacuggugcaugccaccaugcccaggucauuuuucaaaauuuuuguagagaugagggucucgauguauugccaaauccagucuccagcuccuggucucaagugauccuccugucucagccuuccaaagugugaugggauuauaggcguuagccaccacucccagcagcccaacuuuuaaaggauucucucucagucuaucgcuugauuugcuuaacaccagccauuuaauaugaaaauguuuaggugggggagggaauaucuuaauuaucauugugcuccauacgcuacagauggcaccugcuggccuuagcaauauggggucaaguaugaaacaugauagagugacacccaaggaaccuauaaggaaaggaauuuugauucuuucagaaauaacaggaagaaauuaucuuaaaaucuuaagguugaugcugcaaacaaccagagacaauaaauaaauuguuauuuagugauguugcagaauauuguguuaauagagccugugaucucuucuggcaauuucuuacccuaagucugggauuuuuccugcugugcuucucuuacuagaaacguuaagugugcacagaugcucauacgugugcagagaaaugccugaauuaacucucacacugccaacauuagaucauuaaacacacuauuaguaaauguucucuauuuugauuuucauguuaagacucaucucuuuugcucauagaauuaauuuuaucaaugacauagaaaaugguuauuuuaauacuucucugcacugcgguaucauagcuguguuuugccccaggacuucucucuaaugacuugagccagcuugaauuagcgugauguaucauuaaugcauacaaauggcuuuuauuuuuguucauaaucuguucauaaugccacggcauucugcucuuucuaauguuuuuaaaaugauuaaguagugauguacuuuuugaccuaguuaacccuccauggaaucgaugaucaaaagaauaagagaauauuacuuaacuaggauagucagaaguuguuauaaucuguagcugauguuuuccaguuauuuugaaguuuuuuauaauuuuuuuuuccuuagggaauauggacauaggccgggcgcacaguggcucaugccuguaaucccagcacuuugggaggccgagguggguggaucaccugaggucgggaguucaagaccagccuggccaacauggugaaaccccaucucuacuaaaagcaaaaaauuagccggguguaauggugcaugccuguaaucccaccuacucgggaggcugaggcaggagaaucgauugaacccaggagccggaaguuccagugagccgagauugugccguugcauuccagccuggggggauaagaggaaaacuccgucucaaaaaaaaaaaaaaaaaaaauugcagagaauauggacauagccaugugguccuuuuuucuaaguaaacuucacucaucgaggagcuacccacaaaccacuggguuagcagcacugaauuuguucacuugaugaaagaugaggaauaguaauccuuuuuaaguugugaaguucuuuaaccucagaaaggguggcuuugucucauggacuuugauauuuuuugcauaguccuuguagguugagccuggccagacacuggcuccaagaggaugugaggaauucaggcuccgagcagaucaggggcaucccuaaagguuggguucuggaaucgggugaguuuguguauugaaugcagagccucaucgaagcguugugacgaggagagcgaugcacugacggccuuaggagucucccugauauaagcaaaagucagcugggaagaguggauuucaacuuuguuuuccuaagagaaaaauaggccagaugugguggcucacaccuguaaucccagcacuuugggaggcugaggcagguggauccccugaggucaggaguucaagaccagaccggccaacauggcgaaacccugucucuacugaaaauacaaaaaagaacuuagcugagcauaguggugggcaccuguaaucccagcugcucaggaggcuaaggcaggagaauugcuuggacccaggaggcagagguuguggugagcugagaucguggcacugcacuccagccugggagacagagugagacuccaucucaaaaaaacaggaaagaaagauagauuguaaaaccuucagugaguacguuggauguugugaaauuugccaaagagaagaaagaugauuuuuaaaggauauaaaauauggaaauaaaaaccacugacaacacugccacccgggggcaaugauuguuaaggcucggguguguguguguguguaugugugcgcgcgcgcgcacacgugcaccugccguguuugaaaaaaauggacugucaugcauugugagacuuuauagcauacucuuucacauacacguggagcaucccuaaucugaaaauccaaaucuuaaacuggaaaugcuccaaaauccgaaauguuuugagugcagacauggcacacaagugcucacgcagaauuucggauuccagguuuucaguuuagggaugcucagccugcaaauauuccacaaaaaaaaaaaaauuaaaacacccugguuuccaagcauuuuggacaagagauccgcgaccgugaaacuuuucccacccugugguuauugauuuuugcacggcauuuccuugagcaaacagaacagcuuuuggacccagucuccaauuagacauuugguugguuuuuuaucccucuguauuugauuuagaugagugcuuccgugcaugguuuucuuuacugaaagcugugucucuguccuuccuaauuucccgaggauccaucucuggaagugagacuguguguccacauccuucagaauguuaaggcuuugaauccuugguguugacuggccuuccaggagaccuguccuaauucagcguucuccagcagcugcccuuuuucugcaccuggccacacuggguauauucauuuugaaaaccucuaucaguuuauacacagaaguauuauuucauguaagucacccccaaauaugaaaauaaguccacguccuguaaucuguuuuguuaucugauuucccaccuguccuagguaggaaagguguacuccugaggaugacacgugggacccaggcaguccuugcugcucuuacagaugcgcgcuuuuggggucaucaggcgguugcaaaggugggagcagccgugcuccccagaaugcugacagcacagagcacuggucugaagaucuguguguggcugugauccgugcguggcugugacccgugcguggcuuuggcccgugcguggcuccggcccguguguggcgguugcccauguguggcugugacauguggaggcgaacuuccacggcagaagugccaugcuuccguaagcucuuccgacugguugguaggcgcuuuuaucggcacaugagcaccuuacagacaaauaucugaaguacacuucaaaggaggcaaagaaaaagcaaaacugccaguuccuugagcauggcugugugucguuggugcucugaagggcuugagaaucucucucuacccuucauuuucaugcacagaaaccgauuuucagggaagagcuguggcccaccacggucgcuucagccccuccccguugcccauguuuauuccuuuucugccuuuccucauuguccaucuggacuggggaucuuggucacguagauccauguuucccaggcaccuaaagcacaucccccccacuuuggugaucguaaaaaucuguuauuccauguuugaaauaucaggauuucagaacucagucacugacaggucacugccacaacagcuaaagaauuaaaacccaaacaugucuccuuaucucugcugcguccugagucggcucggcugccugcauguucccaccccugaugggggcaccugggagcgcccguggggugggggcaucugggagcgcccguggggugggggcaucugggagcgcccguggggugggggcaucugggagcgcccguggggugggggcaucugggagcgcccgugggguugggggcaucugggagcguccgugggguugggggcaucugggagcauccgugggguggggguaucugggagcguccgugggguugggggcaucugggagcguccgugggguggggguaucugggagcguccgugggguugggggcaucugggagcguccgugggguugggggcaucugggagcauccgugggguggggguaucugggagcguccgugggguuggggguaucugggagcguccguggggugggcguaucugggagcguccgugggguggggguaucugggagcguccgugggguuggggguaucugggagcguccguggggugggcguaucugggagcguccgugggguggggguaucugggagcguccgugggguuggggguaucugggagcguccguggggugggcguaucugggagcguccgugggguuggggguaucugggagcguccguggggugggggcaucugggagcguccguggggguggggguaucugggagcgucuguggggugggcguaucugggagugucugugggaugggggcaccugcgagcgcccguggcagcugcuuugcuuuccccaugggugguagucucacgcugcccccacaggcccggccccuccagugggaacaugugccugcacuuuuuagucgaacauguaaauuaaucagcagcaguccagccuaaaaagagaagcugaacacuguucguuugggggcucaucggcucacugccgcguggucaguccuggugccgugagcacagccaaccggacuguaccacauguucccuucucccugggcugagcaaucgcuuccccgcuaaauguucggcagcacuuugccuuguacgugucuacgucugcaggaggggcugugacucauccccagccaacuguauuccaagcacagccauaguucagagugaaucuuuauggucugugaauucuggaguuucagaaaacucucucauucaacguugugaguaaaccguaagaaaaaauauugaacaccaacauagucaucuggguacugggaaauacucccaugcccgcaccaagauuucauuauucaaugaaaaguccaagguagugcuuacauuucuggccugaccucuagauguguagaauuucagagcuggaaggacagagaccccaccuagcucgacccuucccuucacagguggacaggaccggucuugucagauagaguguuuaguagcaaggcaggugcuagaaauuaggucuguaucuuuuggcugcacaguucgauucuuguuuuaugaaugucguacuuagaagccauuggcuacauuaaaaaacuugguagugagcuaaaauaaaaugcuccuuuaaguuauaauuguuuuuaguaaaauuuaagccauuuuaacacagggugcuuggauuaaaugcaguacgauaacacaucgauuauuuuuauaagcuaacuaauaaaaauucacagagcguuuucugcaugcaacagaauauguggguaacaggacauugggucugugacaaggucugagcuagaaggaccguauggcccaugaagcacaguguaugcaagugcuguuguaauuuaguaaaccgccacuagggggcauugaaagcgcgucuaaggauuauucuccugcgcaaauguuuuccuuuugcugucaccauggagaauacagauauaauaaaacacacugguuuaagagaccauuuagaccuguaauaagauacacuccguaaagcgugugaaguuacuggaucagcagcacacaaaugcagaaguaaaaaaguuucauucauuggaaugaggaggagaacacaauuaaaaagaugaaauguuauauucugugguuaaagaauucuacauucugugguuauauauucugugauuuugcccugcauguaacuuuacagaagaaucaaagaaaaguuggccaaagauacaaaguuuuucuuuuguauuuuuuugagaaggagucuggcucugucgcccaggcuagagugcagugguaagaucucggcucacugcuaccuccacuuccuggguucaagcaauuuucaugccucagccucccgaguagcugggauuauaugugcgugccaccacaccggcuaauuuuuuuuuuuuuuuuuuuuuugugagauguaguuuugcucuuuugcccaggcuggaguucagugguaugaucuuggcucacugcaaccucugccuuccagauucaagcaauucuccugauucagccucccaaguaucuaggauuacagcccgccaccacgccuggcuaauuuuuguauuuuuaguagaaaugggauuucgacaucuuggccaggcuggucucaaacuccugaccucaggugaucugcccaccuuggccucccaaagugcugggauugcaggugugagucacugcacccuggccugauacuucuuuauagaguauaauaaauggacuuauuauuuagcccaucauucucucuuaacagaaugcaccaagaguuucucuggcuugagugauuggccaggcaccucacguuagcgucugcagccuugaaucgggaggcagguugggcgcaggcuucucgugcgcaccagcgagcacccgggccaagcguggaggcucugcgggcuggggguccggcccacaccaucagccucugugcagccguugcuuuuuccguugaccaaagccaugaccuuaccuuuaugcagucguguucagagagagaugaagccucaaaggcaaagucagacugacacuccugggagcaugacgggaguugaucauuuuuuggaaauguagauauuccguuuacaaaucuaagcaccguuaccaagagugguaaguuucugcaggcaguaggaccuuuccagaggauuagcagcugcuguguucccugugggguuggcagugggcugggggcacagcacggaugggauuguaauguauaccauuuaucuugguauagaaucuuccaguuucuugucuuuuuuuuuuuuuuuuuuuuuuuuugagacacagucucgcucugucgcccgggcuggaguacaguggcgugauuuggacucacugcaaccuccgccuccgagguucaagcaauucuccugccucagccucccaaguagcugggacuacaggcacccacgccaucaugcccggcuaauuucuguauuuuuaguagagacaggguuacaccauguuggccaggcugguuucgaacuccuggccucagccauuccacucgccucugccucccaccgugcuagaauuacaggugugagccaacaucccuggccagagucuucuaguuuuugaagguuuuuuucuuuucccucuuaguuuuucuuacccuaagauagagggcuucucccuaccaguuuuucguuuguuuauuguuuucacccuuuauuuucucucacuacacaagguucauuagaauuugagaaauuguagcaucucauauuagaacacuuucaauuucuauauuuguaaaaugggacuaauuguauuuucaguaccucaaaugagaaauagauccaaucacaaacucaguauucuucaaacauuuucucuaucagaauauguacaaauugaaugucuagaauuuauaaagauuuuggagaauuuuacuacuuucaguauauagaguagugaaaauuuggcagaaagucaugagaaaagaaguuaaguaaaaguggguauuucaucagagcggagagccacauuccccuuaggaggguagcuuucucaaaguagucuuuuagugccaaaggacaauguuuuaccauccucuaagauguagggcauucuguggggagccaauggguagagcuggggcccaagguucagguguugcagucgaaucaguaaacuccggcggcauccagggaugugcacggugccggggcacauucacagaaccuaccugcaggugggcacggcuuuguagagaggguaggcacagccgccgugggaugaagccugcucccagcacuguuagcgguugacaguguugucggggaucugggcagccaugugggccaggccccaguuuggccagcgcugcagcuuccucucucugauucaucgaguucccagaucuguuucuuacagaagaagaaacaccugcugccgaaauacaguuugaaaaacccugaucucagaaauaggauuccugaugacagaccuuagcaaauauuccaauaauuauaccaacuguacuaaagaucccaguacucgaguaauucaccauaaaugagugaaaauuauucaacuggauuagaaauugccagccuuggauccuuuucucagauauuuuguuuuccuggguauuuucccucuucuggguucuuagugcccgucccccguagcuccgucacacaguccuguugcugcuaccuuggggcccaggcgugucuuuugucccccagugccuggcacggugcccuccaggaguacuccugggauugguggcaggucaugcagucauugcucaccagagccaggacaugccugggcugcugaguggggcgugcccaacucuuucugcuuugaguuuucuuuuuccuccaguggcaagguuugcguggucuucacucuuuugcagaaaauuguuggcauugcaucauuggcuuaugcuacuaaauaauguuuuaaggaauuggaguuuugcgaggagauggugacaagccucacucaggucuuugguuucuguccuccuuccugggcaggcccuuugcccaaaugguuguuaaagaaaugcaaacaguuaguuguuccguucaugcuguugcgugagauaaguuaggaugcucuugaagaaguuuagugacauucagaggaaauccuuccaacacaauauacaauuaauugcuguaaaauaucguggucaaaaucucggggaggcagugaaaaaaaaacgaaagcagugacuaaagggcaucuccaggugccgccucucaccugguccuggaucaugggggaggcacaggcgacgcuccgaggcagccuggcuuguguuagcugaguucugcuuuggcacaggggagggaggacauggcccucggcugccaaggagcauccaguccuuuccaaggacuuugguuuuccagaguuacacuucacauguauuucuauuaagauacacacuuauguauguuucauauauuagcaaguguaucucauaucuucugaauacacacauuuaaacauguuuuugugauuaaaauaacuuguuuguaaaaauacaggaaacuguaagacagcaaguaaaaaucaccuauaaucccaccuccuaguaauaacacauauauauacacacacauuuuuuucuuucuuuguuucuuuuuuuuuuuugagacggagucucacuguaucgcccaggcuggaaugcaguggugggaucuccgcccacuguaagcuccgcuccccggguucaugccaugccauucuccugccucagccuccccaguagcugggacuacagacgcacgccaccccacgccuggcuaauuuuuuuuguauuuuuaguagagacggguuucacaguguuugccaggauggucucgaucuccugaccucaugaucugcccaccucggccucccaaagugcugggauuacaggcgugagccaccacgccuggccucuuucuuuuugagacagagucucacucugucacccaggccggagugcaguggugccaucucggcucacugcaacugccgccuccuagguucaagugauucucaagugggggcuccggaggguuccugcauugcccaugauggauauucacgcaaucauaaaaucuccuaaaguagaagauuuaaauagaagcuuaaacugaaggacaaggcuuagaacacucagaaucauuucagacuuuuauuuaaacugcuuagaaaagcugguggauuuugagaaaaaaauugccuuucauggauuaucacagucagugcuaggauaauuaagcucaaaguggcagauuccaaugcuucaggaaugucugaccccuguaccgagaugguguggugagcaggaagauggggucccaaaagauacucaaguucuaaucccuggaauugacgaauauuauauuuuguguccaaaauauaaagggucuuugcagaugugguuaagaaucuugaauaccuucugauugggcccugaaagcaauugcauguauccuuauaauagggagggagaaggguccacguggagcagaggaguuugaagaugcugccuggauguugggacuaacauggcccaggagugcggccgccgcaggugcugggaggcccacagauaacugcucaccuguagucucuggguccggcauggcccccagcaccuugucagccaagugauggcgauuuuggacuuuggcguccagaacuuugagaaaauuaaguuucuguugggccacuggguucaugggaacuuguuagagcagcugcaggaagcuaaggcagauggucagaggcaggccgccuccagagggcuucugcuggggagcacggucuccaggcugcgccauaggugcagaagguucaggugcaccugaggagccuuggggccacucuggggcucccaccacacgugggcacagcugggagcagggcacccccaggaacccacggaccugccacaggaugcagccagggugaccuaaggcaugugggcgugcaaagaugacgggcguggcuuuucaacuggagacaugccggucucugcccuguggaacugguggccguguguucacgugacuugagagcuccaucugcccugucuggucuuccccgaagagugauccccaccuggagaggcuuagagcccaggaagcugaagcgaggagaggcugugugacuccggccguuguggugggugcucaucugcgucaguuacaucuugugcagucaggggcucccuccuuccuucuuccaacucacuccuuaccucccccucuucccagcacuccugucucuccccaguguuagaaaugaguucugaauuucucuucaaagaaucaguaugucguuuuaaccuuacaauauuucauauuuuaaucauucauccuuuuuacuuguuucgaggccugugacaaaaaauucagauggaauuacauaacuguucuguuuagaaaauagaaguaaaugcaauguuccggagcugacauguuucuuguuucuuuuuuuuuuucuuuucuuaucuuuuuuuuuuuuuugaguuggagucucacucuguugcccaggcuggaacgcaguggugcgaucuuggcuuacugcaaccuccgccuccgaguucaagugauucucuugccucagccucccaaguagcugagauuacauuaauuaaccagccaccaugccuggcuaauuuuuuguauuuuuaguagagacagggaugucggccaggcuggucucgaauccugaccucaggugauccgccugcgucagccucccaaagugcugggauuacgugugugagccaccacacccaaccccagauauuucuuauaaucccgcuaaugacaagacaagcagagcugaugcuuuaugacagaccacacugagaaacucugauuucucuugacgaacuucccuaaagacagcuguugacaaauagcuccucaccagcaggcgcauguauuccagccccaucagaucuccaucuuagcuguuccucagucagcuaccaagaagccagcacuuguagguuauggcuuguggauggauaaacucugggcuggaccacagaguccucccauucauggugcuucagcaucucacuuagucaguugacccagcugugaaauggaucugccuuuucuugauuaucuucuucugggaaugccucucauagcugaaaugugucuguagcuugggccuaagaaggugggugacacugaacacaaggcagagaguucauugucacaggacugagcacagcugagcggcugugaccagccuucacauggaaccagccgcgaguagacaggcagaggccgcccucggagccugggaugcaagcgggucucucucugaccuucaggaggucacugaguccuugugggcccugcauucuuuaugugcccaguaaagcugucgggauggcucuguuugauuuuguugggauauggagugaaaagcaccaagcugucuguagccacuuuuucuccccucuguguuuuggaagcagaucaacuuacuauuguuccugguggaggggguccagguuuuuggccuuuugagcaaagaauugaacaaaaugcacaaacaaagcaaggaaagaaugaagcaacaaaagcagagauuuauugaaaacaaaaguacacuccacagggugggagcagccggagcauaggggcucaagaacccaguaacagaauuuucugggguuuaaauauccucuagagguuucccauuggccauuugguguacaccccaugcaaaugaagucauggcccccagucagucugauuuguugcagaaagcaaccaauccaagguggaagugagguuacaaagguuacacuucuaugcaaaugaagauuuggccuacggucagucugauugguuguggaaagcaaccaaucaaaggcugaagcaaaguuacaaaguuacacuccuaugcaaaugucugauugauugguugcagaaagcaaccagguggaggcacuuucaguuuuccaucugccuugcagaaaaggcagggaggggguugcaaagggagcagccucagguccuuuuguuacuuagguguggaaaguugggguuuucguucgauuuaguucuaggaagucagcgugaaucggccuuagguucccugcccccauacucuguucuacuaccucacuauagauucugauccuuuuaaauaauagcgccaguucauucauuagaaacagugguuggaccugggaauggacuggugagucauguccucuccuauggaaguuuccugagaugggggcugguuuucuucggagaaucacaguuuaucuucuaauuaguugagugcccuuuguuuuccuuuacuguccuugcaccaaaaaaagaaaaaaaucucgaaaauauugccaacauuuauugaagagacuuuuuucuucuuuucuugcuugagauauuuuacguuugaagacaaucaacucuucaucucaccugcugguccauucagccaacuuuuuuucccccucuaagauuuuuaacaaaaauaaaacaggaccaagagauagcaauuacuacuacuauuaugacuacgaugaacaaaaguuaaauuucuuaaucucagauuguuuuacugccuugcaauuaaauauccagaucuaggagaaaacuauuuguagaagucuugaaaauucaacucauaaauaaaugcccuuauucuugauauuauagacauuucuucuguaaaguauggcacaucuauaaacuaaaaaugcacaucuggaaaauccguaaggcagaaauuccagccuccccuauccacagccaucagaggagucccucacacaccugucgccagcccagggcugggaagauagaggugcugcugcagagggaguuccaugacucaccccugcuuccaguuuuuaaaaagggcugagucugucggguugaguacuucccuuccaucacggcaggcagucacuuuucccaagucagcguggacuugggcaagaccaguaggcuaaugggaaaauaagauuccaaaccuuuaaguguaguagccuaaaaauugcugauaggaaagcgaucaaggacugaaaacugucgcauuuaaaauggaaaugaagccagggcucugaaguagagcugggccuaaaugcagugauuaaaauagucguuaggcugcucgcaauuacccuagaugcagcaggcugccugcaucuuuauggcgguacuuugauuccaaucagagauuucacaugaacuuauuuuggucuuuucaaugacgucucagaguagaaaacagaugcaguccuaaaguaauuacuaaccuuuuuaucuugugaaagagaauucagaugagcgagaucucugcgguggguugaucugagugauuggcgccugcauucacucgcccauucauucaccuccugugcuugucaccaggcuacaaaaacgaagccaccaccccucucuggugccaaaaugucaguuuggggaaagcuggagcucccuucugagagccaaauuuauuuuuuuuuauggaagagauuccccuguaaauucugggaaaguuugagagaaagcuccaggaguagugacaaagcaaaaggacugggugaacagaaggggcaucggagauuguccugucugccugcagccagcuggggaacagagaaggugaguggggacagagcccacagguccugcagguguccaggaaccaaccagugaugagcaguaaccaauuugggauuccugucccagacuguagcacacucuuuggcacaggauuuugucauggggugugucacccucaacgaaaggagguuugcaucgguauagccuguguuuggugcccugaugacugaaagaauuccugugagaucauuuugugccagccaaaagugaguuguauuagcggaagcauaaaaagcuguccucuuaaaucauagguguaaugacguccuuuccaggacgaguuaccauagaaagcuuuuuaaacaacauuuauuuuccuaccuucugaaccuauuucuuaaagacaaaaaagaaaaauaaauguacuuugcucuguuauugucagccuagauuucucugucugccaggagauaaagccuuaauaauucacggccacugagaagugucauaguccuuccucccaccccgccccgaguuaaguguuaaccccaguacauaccuggucacgcucuaauuuaguaaugaugauacuuugcuguuauaaauuuucucuggggacuugcggggauggaagagccuuuacuuugucuuaaauucuauguacguguaauuaaucaaaacauugauuaauaccccuggaaguauuucaaagauagaaaaacauuggaaacacauuuuaggaauuucugauauaaguuuucaaggagguugugcagaauugguaaagagaauugaguaugaagauggccuguugauuccuuuuaagcguuuaaguuuuuccgugccugggauugccuuaugugcaaccgccagcuucuguccuuugaagguuuuccuaagauauuuuccuaguuuaauaggaaguguggacaugggacauuguacggcuuaggagacugcguuguguuugguuuugaauauauauuagaugcgugacccucccucuuaagaacugauuuugcuuugagaagaucuacaagggccaaaaguggaccuguuucaaaauucuggucacagugucuaggauguggugaauucuccaucaguguggcuuaaugaaugagagugacaagggaggaggguggggcuccaaggccucgcagggguggucaggacugguguugccuccucccucagccucucucccccuaccuacugcccauucggaaguccaggccuccuccucagucacugagacugcuuugucagccuccugcuucuguauccaggcagaugaccccacacugaaucuuugcugugcuggccucugcucuugccugugacagagcucagauaggauucuuuccuguucgaaagccuuugaugccucccuagcaccuaccauagugguuuccaaacuuguuuuuggcugugaaccccucuugucgagggucuccuaaguugaaggccaguguguaaggcagugggcagugcagggcgccaguauuuccgcccucugaauguggcaccaccugucccagugggcgucacucgcucaugagcagcuauucccagagagccuccuguguugcaggugcuaugcccugcagggagcggagggcccucccccuuccccuugcacaccuuguacuccaggcacugcaagcucgcacccuuuccuuagccucaaagccuugcucugagcgaaaaccugcccgucccucaggcaucggcaccaacucggagccccuuuuccaaaaucucgaggcucuccuagcccuuucuuggcugcaaccucucuggcuuuuccgccaaacuggaaucagccucggagcaggaaaagcuggggccgugcucaccuuugcuucccuuugcugaguacauggugaguucccagcacguuuuaucaugugagcgucugcucuugagaggccaggcuggauccugcagagaaacgaggaaguauuagacagaagugaugcugggcgcgguggcucaugccuguaauuccagcacuuugagaggccaaggcggguggaucacgaggucaggagaucgagaccauccuggcuaacacagugaaacccugucucuacuaaaaauacaaaaaauuagccaggcgugcgccuguaaucccagcuacucgggagucugaggcaggagaaucacuugagccugggaggcggagguugcagugagccgagauugcgccacugcacuucagccugggugacagagcgagacucugucucaaaaaaaaagacaaaagugauuuccugagcugcuccgagcuggagacagaaccagcagacaugggacagaagaagaauuacaggugugaagcgcccguguggggcugauucccaccugccuccucguuaucagcaggcagccuugcgucugccucugggagcagaaaccguuguuucaccagcaaauuacgcuggcuguacucgccauguccuguugccauagaggacgagucacagcugucucaccugcaccccuccaaucgccuucucagaauccgacgcugguccuaagugccuucagcugucaccugagcacguucaagccuccugcccagcaccuuccuagagcaccgccauuggcauaaggacuagguaggcagauguccugauaaaggugcacgcucaaguguuugagacguuaacgaaugauggcugugauguaauugacucaguugacacauacagagauagaacaaauauggcaaaggacuuguauuuauuggauauuaguggguuuaugggguuuaucuguuguauguuacauuuucuguaccuuugaaauguuuguagugguuggaaggaggggacuuccuuggccccuccuggcucugcccugagcccgcugcccucacccucugccucagaccugggcgaucucauaucuguguguuucaccgaggcacucacauuucuggccacugagacccuuucucugagcuugagacuuaaauaucagcuguguccuugacaucacaccugggccccagcuggguggccccucugucccuggcucagguuagaccccugggccacucugacuccccucccuuccucccuguggcugcuugagcaccagguuguauugguucauguaccuuguacgacccuugccaucagagcccuggccccagccaccaucgccccgccuggguuuccuucugcacuuuccacuuuggguauccacccauuucccccaguucuuugaccagugcagccagcagggaauuuuauuucacgucuaaucagacagcaucucuuuagugucuuucucagaccaccacugugcuguggguccugagagccagaagguucuucgagguucuuaagagucccuguccucaugcuuccugcuccgugcucuuccuccugccccaggccccucacucacucgcuccuuaucugugagcauagagcuccagcuucuggcuucccagggaguguuucuucccccucuccucccuaguucaguucugaggucggaauucccggcuaccauguggcuccccugacuggagacgcagugccaggguccucaucugggaaacuggugaugauagagguccugccagugcuuggagcagggccccacacaagguaggacucagcauggccuggagaugacgguggccucugauggcuguguucuuggucuagacuguaaaccccaugggaucaggaacaaccacaucuagacccucauauuagggaugccagcccgggcaccacaucuuugucaccugcaucucuguggccucuccagccccguggcaguccucacugcaggaggcuggcacccucucugugccucacauggaucaacugacuucccucaccaaccccaagaagcauauccuguguguauguuuuacagauaaggaaacugagccacaaaagggccagguaacuugguaaagaucaugcaggucauaaauugccucacugagcugggaacccaggcagucagcuucggcgcuccccaccccuguuaggcaaccuaugaacauuuaccaagaacacagacucaucugcaaggaagccucaguaacuugaugaggagcagcuagaagacucgagggagaaaaauccuuguagacacaucaguggauucaggugacuuguguuauuuuuaaaauacagccucgccaagauacaauucacacagucuccaaccuaacgauuuagcucugcuuuuaagacuguguuggguuugacuuuuuuugaggggccucggccacucuuggguuguuuguaaucuaaaaauaauuggggaugaauauugguuacauuucaucccguaggaccuuagucugucuggucaccacuuaccccuccaggcucuucgaaugccauauuuggcuaugugagaauuugucagagcucagcucagcacucagaacccgcuggcucuccggguucugcccuucagcucugcgaguccagagcccaagcugcuccuuggaaaagcggaggccacuagauggcaguaccgcccuggcuagaggugcccuuggggcugaggcucagacaucccugccccugguuuccuucaggugagaucaucaguaaccuacaggcuuugcagacugaaggugaaaaccaguuaaugugcuacauccauuuuaauuugaaagauacaaugaauuaaauuaggcauaaagugaaugugauaggaaacuggaagcucauggcugaagccuggaccgcugucagaacugugcagccuaaagccgggaccccugguagcugcuuuguaaagggcagcagcagcaaaauccucaccacucgugcuuggaauguacgcugcaaaguuuguacuuaacagcaaauggcauaaauagccucuauuccauuaaagaauuggacugcacaaucuccuuagagaaaauuugaugaagcgguucaugcaagaccuggagugaugguaucaccacguuagccuaaaagaguguuugaaauaggaggugacauuccuggggggggcugccccucccaccuccaccccuaccuccuguuuucaccauuucuugauacaguggugccuaauuuuauuucaagaagaagauaguuuguugcuuuuuuucuuuuuuuacagcuuuaaaaaauaaguugaggaauuuagguuuaagaaaauuaauagcuacagguaacugcaaaagauaucauuggcagaugcagcaaaauauauauauauguauuuccacagaaaauuggauucugcccauaaaacuuaguaauacuaauaaagacaggucauuaccaguuuuaagccaaguaagcaaacucaaagagaucuucugucagugugauucuuggugguuuuuuauuuuuuuggagaaguguaaaucagcuuuagugcagcaagcacaccacagauuugcugaaaucauuccugccccuucugacgguggguagaguugcucggccaaguaauuuacagugcuguggcaagguauguuuauauuuaagcugugcaacgguguagcuaaugagaaagauaagaaauuuauaguccuuggugauugauaggauuacugccuaggcauuaauugaaaucugagggaucacagcuguggguuuaaguugggggaaaaauuacuucaaguaaaggaaaacuuuuagauuugcuucugaacauuuugaagauaguucucccgcugacagucugguuggugguagaaacaguugauccuggccgaggcugggguaauuauacugagauaaugaugguaucugcuguguagccucuucaagguaggugguuuauaagugugggaaaaaaaauuaaauacugugggguuuuuaaauggcuuuaaaauuuuacauguauaagaauaaaauucucugcagccacucuuugcuaaauauucucuggacaauuauuuaagacauuuuaaaaaaagaaacccaaacuaauaaugacagaggcaaaccugugauauuagucauugccuuaaaauuuccacugauuauauuuaaucuggguaugucuaaaguaaucuuacagaccuuucccuaccugucauuuuuuaaauguaccauucuuguugaagcucagucuugugaaaaugucuaaauuuucccauuaagugcuuaaaaaguaauaaaacuaaagucauuagacuucacucaucagagcuauauugggagaaauauucuuuggugcaauaaaucuguccagggguucgacauucauaucccuuggauucauucccuggaaauggacguuugaagguaaauugcuuaaguagggcaguuuaaauuuuuaauacaaucuuauuguaacuguuaucacaugauuaaagugcaaaggggccuuagauguuuuguaagauuuauaauaaaugcucuaugaugccuuuucugugcugaauuauggauguuaugacaguuaaaugcuuauaaaggccagaaaggcacaaaugaagaguugggucuuuauuggagacuaaaucacacuuauugaaugcagacaguuuuucacuggacacguguucauuccuagauucacagucucggaggcaccuagaagccuucguaagccaaacaguauccagugccucucuuuucuaaugcagugggcucuggaaggguaaggccugagccaauggaagcuguuuugaaaaauacccaaauagcaaauuauuguucccaucaccaguuggcuuuuuuggggggaggagggacuuuuuuuuuuauguaaauaaucucaucagaggccugauucucuaauggaugccgcuaguguauacggaguuuccgcauuccuuuuguagaaucaaggaagcuugaagcuacgucuucaugcaucaugggagcugugaugcccuuuaacuuucuagacccagugacacaaugugguuccuuucauguucacuguuuggccauaguugauuggaauuguuguuuuaaggccuaguuuaacuggacagcaggacuaacucuucauuucagaaggaaggccugcagcccaggagauggagcugggcaggugcccuccucacgagaggcuacaggccagacgcagggcaccaagagcauggcauuugauucaaagccaugguugaguggauuuucaaucuauuugaaggauaacuuuggcuacuauauaguauuuacacuccugcccauuuuuuuuuuuuguauuuuuuccaucaaaagagaaaucuguuuugaaaacagagguaaugucuuuaccaucuuucucauguauauuauuuuuuggaggaaggaaauagccaguuuucuauacuuugacaaugucaccauuugccaucuaaaauuucacaagcuguaauuugccuuuuacuuacauaucucauccacagauguauuugaguguccacagugaaaugguugcauuacuuucagauuacuuccuuuaauucuuuagaugggugcuaaugguuuggguuauuaacuggcacagaucugaguucuuuuugucuaugcuuguuguuuuuuucccccuucaaaaugaauuugcaaaagcaucacuagaaaagcuuauguguaaacauuuaugcuaguaauagauaaaaggugcuguguagcaguaccagugggagaacgcugaagcccagaaggaaagucuaccuucuuuggaauaacugaauaggagucccagucaccuauucccacuuucucuuuaacuaucacccuuggaugguauugaggaaaccguauugcaugccuaauuuucacagcguucaguauuaagguaaaccuacugauuguguuuaaguugaaguauaccuuuuccaaguagcuguguaacuggcagugacagaauagguguuguaugggaggcagcauuuucagcuguaagugcaauaaauugugguuuguuuauuuuaguuuuuaaccuuuuagacuacuuugugaucggcaggagauugugugugugugugugugugugugugugucuagguugcagagugaggaucuggucagugauugacacuuguuuucaaaguguucaccaugaauuuuuuuucuuaaauaccauuuuucucagugagcuuugaaccaugaugucaccaaagacaaaguguuucucaggcuuuucuuagugaaagauacuuuccuaagguaguuuauagcaagauuuggggauuaaaaaaaagaguugaauuuauggccugaagagucauuauaaccuuuuaccuauagcuaacauuuacauaccucaggucaaauaaauuuagauguaugcuuaauguucuaaaagcucuuuguuccuugcucauccuuggccggaccagagaaguuauugauaaucagguguugcuuucuuugugguaggacaucaccauguucucauagaguccuguuaggaagcagaggacggacugcugugugucacuguggagagaaaaagaccuugugacgucccugucaucacaggauucuaguaucuuguuaugccagagaugugguuugaaaacuuguuuuuauggacguacccacaaaacauuaugcucuguggaaagaggcacgcacagaaaagaaugauuccauuuauaugaaguucuacaacgggcaaacugauuggugaugaaagaaaucggaagaaugguugccaggaagugagaaggagggauugguugggguuggggguggcccagaggaacuccucagggggauauuuucaucguggcuuggguuacacggcaucugucaacauucauggaccgguacaacuaagauguuuugcauuucacaguauguacauuuaaucucaaaaaaagaaccuaauaguuaaucacgugcauguugaaaugugugggagugaacugaugccugcaccguaguugaauugcaucagaaaaugaaauggacggacggacggacggauggacggacggauggauggguggauagauauauaauaaagcaaguauguagcaacauguuacaauuauaaaauguagccggaguggaaggagguguucgcuuucaaauuuuuuuuguaugcuuaaaaaauguguuaauaaaauauagggggaaaucaaaaaaauuguuacuacauuaaaaaugucauuguaggucucguacauuaagauggguccagauaaaccuaauuuaaugugaugugcuuucucacaaguagaaguguacaguauaaugaggagccacaauuuuuacaaaaaugaauccugccagaauuaaaaggcauacaugauucuuugaagaauuucacuaaugcauagaaacugcgguaacagaaaagaauacuuugacuuccucacuauuccuaaaucacagcagauuacagauucaaaaucaaucaguauucucugcugaacucuaauuaacacuuaacauuauuagucacaaaugugaaaucuugaucggagauggccucagguauucuaaauguaaauaaaauuagguuuagaucccuuuuaauuaccugaggugcugugagcgauuacaauggcaauugauaaacuuaauuucuuauuaaagcaaaaaaaaaaaaaaaaaaccaugaaaaguuucucucugcuauauacuuaacucuucaguagccauggccuaugcaaaaaaaauuuaccugguuuauauguuaaucauauagaauuuagaucguuuuaaaaauguuuauguggacccucaaauucaucaugcaucuccuaaguuuguggguaauguuacuauaacaucacaaagggcaaaacuuccccagaggaacuucacguaucagaaaagguagguuucugggagguaaugcugguuaaguaauaauaauggaugggugcuggggagaguauuacaaugacuuaaugcacaaagcccuguugaagaccaaguggaaaucuguuuugucaucucauccuucuuccuaauugcaucacaauacauuguauaauucaaccugugugucacugucacuucuucccgugcacagggccaccgcugcuggcucauuauuaacagagcagggaggagacgaauaauucucucagguuccaaccaagacaucuucucucccccacuuuaagaagaaaaugucuuuuuuauguagauuguuguaaggauaauuauuucuggaaauaggaaaacagcuucaguugugguagauacauccauuuuucuuaaaagugagaagcuauccgaaggagagugugccugugagaaauggaaagauuacagaaguuucuaaacuccuucuucuguugguguucauaucuaaaaauaggaagcaaauuagaccugauaaguuguuaagccuauauuaaucaaacuguguuaauuuuuuaaaaagaaaaccaauuauugcacuuaacuggaucugucucaagguuccugauuucaaaaucgacuuuuggccuuuacgucuuacauuuucccuucuuuagaacucuugcgucuccuguuccucauuuaucuugaucuucucaucuuuuuuucuuuauaauuuuguguaguuucuuaccuggaauaauuuagcauaaucuauuuuucuuuaaaauuuuguauaguuucuuuagcuggaauaauuuagcauaauccauuuuucuuuaaaauuuuguguaguuucuuuagcuggaauaauuuggcauaaucagucuggcacgcuaucauguuguuggugguaccuuuuucucuuuguauguuuuaaaauccuuugccagucacuuuuucuguauucugucuucauaguuuaucguauuccuuugauaccaccauguuuaucugcacuuaucuuaggucuuucuuucauuccacugacaaauuguguuaguuuacuuuguaaccccaaauuugggccuuuuaaaaaaaacguggauggaagagggaagucccguagcuuugccuggcguggaagaguguugaggagccucacgugcagauugaagaauugccgggugagccuucaccuucaggggauggcagaaacauuucugcuccaggaucaucaacuuucucugcgagacagcuugaugaguugagaagaagugacagguucaucuuucccuucuuuguuuaagucauuuaucuuugagauccuugccugccaucuaaauuguauugccaauuuacugggauauucacuugccucgucuuggaagacgcugauuugcauccagcuugagaauaagugagagagaaaguuaaucaucuccuggccuuuugaacagauuuguacuguguuuaauuguagcauuugaaauguuacauauuuucuaaugagagucuauauucaacucuuguguuaaccuguaucaugaggagaauagcacagugaccuagucuagaaagcucugcucuucggaagaucuuuaauuuaugcuuuuugcauaucuuucuccauuucagauuaaucuaagcuauguuagcugcuuuuaaauucugccuacuuguuuuugaugaugauuuauucaauuaaguggaauaauuaauaaugaauuauaguugggcauggagggaaaugguacacucagcucucuaagagauucugaaauuuuuaucgagauuguuguagggguaauuauuuuuggaaauaggaaaacagcuucaguuguaauaaguccauuuuucuggaaaaugaaaagcuaucugaaggagaaugugccugugacaagaucucgucuaguuucuugugcccugugacgagaagagcacagcucucuuacucugagcaggugaggucuugaagaagcaccucauuaauaagguccugaagaauaaguucauuuguuuauaggguucaggagaccccuagaguuccagugagaaagcgugagcuccguccauugguccuccuggcccugccacucucuuccccgcuuguucuggcucccguauucuugacaccuuuucccagcauaugcuaguuuuguuuccaucaggcuuccuugagggagcugucgccccccaaaucagggucuugacaccagcuccugccacucugacacauacuuaggcagugcucagagucgagcuggccuggggccguggccccacaggcuugugaucagugggcuccgguucucacuucuugucuuugaguucucaggcuucuccccucuccuguuguaagaguugagcuagcaggggccgccucuacccuuggcugcugcuuccaaaccauguggguuuccuaugucaugaaagcuuuucuucaucacgugcuaaugacuuccuguuccacaggcguaacacuuucuaauguuucauucaucuaucugaguuuuuccugcuuuaagugccucuucuaugucugugcaacauucauuaauuucucaguauuucccccuugcagauuauuccuucuuugucugcaucauagacacacgccucucuuuauagcacuuucuauaucccacaugcugccacuuaucuaacacauugggagagaaaggugcagacaaggugugcaggagguggaugugauguugugguugguugguugacauuuucuagaugaugcagcuggcagauuugucuggauuucacaaucucccacaucuagcaaauugccuggcauauacuaguugcucaauaaaaacagucaguaaaugggaugagugagggaugcuauaaagcauaguaaagaaaccuuccuugacacauuaaagggaaaagcagccaacuccacauauuaaagaaugggcagcaacuugcuugguuucugugaggacuugcuuaauucugcauugaccaagagcaagcugaagagcauucugggaucaagaagaugaccaaguacauugugggaccaagagcaagaucaagagcguucuagaccaugagcauucugggaccaagagccaugaccaugagcauuccgggaccaagagcaagcaaggccaagagcauuguaagaccaagagcaugaccaugaacauucugggaccaagaguuugaccaaguauuauacauucugggaccuuccuaggccauuggcaucaacgcugcagccucugagucaugcaugccucauggggucauccugacuuaaccugauggguaggacuuacuugaguagggcaggagguuuugaaaggacaugaucauacacaguacuuagcucaagugcacagagaagcagagugccauacugggacccuacgguacagccagccggagacacaggguuccagacacagcuuaauuccuucacgcuggaguaugacuuggauguacaaacuccuaaucccuaaggauaggaaaagaccuagaagauuugaggauuuuaauucaggaaaguccaccaaaaggauaaacagcuaggagcccacuaguaagccaggaugguguggugcggaucuuggaugagguuagcugaguuugaaaacuggagaaggcauggaugagagcaaugcugagggaaggugaggcaggguggggagaggagugggaggguaggugaggcggggugaggagaggauugggaggcaagguggggcgaggagaagagcgggaggguaggugaggccgggcaaggagaggagugggaggguccaucggugucgucagugcacaucccggugcuuggaacugacuggugggcguccuguuggugcauggggcagacugaagccugagacaugacccccgaggguucuccagacaggaucauuuggagccccuucuuucccaaaugguggggagaagugcuggcggaagcagaauggagcccucagaagcgcgcauucagaccggcaguagacaaaaccagcugcggggccacaccacguuagggugcuuuucggcaucucucaguggggugaacguuugcauguuggugcuucugaacacaggaucccugguccuccugaggccuggagccuggcaguuggucagcucccuggccccugcugcccucuagcccagggugacuaugggaacagacauuccugauuuuuggcagcucgacuuugggauuaaauguuaaggaacuauugugcuuugaaggagugcauggaagaggaagggauguguguuuccugcagcgugauuugaaguccccuuuaccacaaauaacuacuuuauaccagaauuggauacacauauuaaaaaugucaaauacaccauauuuguuucagcacaggguuuuuguuuuuguuuuuaauuauguucuuuccccuuuucucugaaaggaaaagggaaaucccgcugcccuagacaugguagaaauuuccccucauucuaaaauucugaaauuaacgucagcagccuugacuuugcucuguccugaagguaacuguuuauuacagucggcauuuaaaucccccgauuaauaggagcaauuaaacaauagcuucauuuccagcaaauuaacaacccuaauagguaauugcgacauaaaugaagauaaauuuguuuuaauacaacgagauaaaaagaauacagacaagaacugaauuucagauuaagaauucagacuucaguacuucaggaaaaacuuaaaagcuucacuagaagaaauuuaagcaagcuuggcuuuuuaaccacagccuauuuuagauuagaggguuguuugcucaaaaaaaaaauacauauauauagucauauuuugugcuucgauacucagaagguaaggcaucaaaggauuacuuugauauacgcaagguaagucaacaaaggauuaccacccaccgaacccuuucuccugcuggcuugcuuggggcauggcauguccuaaugacuuacucgagcaguugaaucuuggccacagcuucucauuaggcuuucagugacaaggaaccaaaaagcaaaugcauagaagagcauuuccuauuuacacaccccuaaguuaaauuuaugaccuguuuaguugcaggaugucuuaccuuccuuguuaguauuuguucugauuggaaaauuacucugaugguuuagaauuuguccuguugaaauguggaaguagcuggaccagacuuguucauaaaugcagcauccaugugaaggaugggugggaaucgguagauuuggggugaauagcuaagugcugauuuuaaagguaguggcaaaaaaaaugaugaaagccucuucuagaacaaggauaaugaauuucuccuuguggggucgccgugcuuaugggaagauggaacguacauuaaagaaauuuucggaguuuagcuaaaacuguaucacugagcuuguaucaccuuaucagaacucauuuugguagcuuagaaucaucagaugacacauaauuagccuagaauucugugugcugccaaaauacuaauccaguaaaaggguagagggacaguuuuagauaugggagucucaaaacaaaauauaugugugcuucucgggaaaccgcuggaaccaggcugcugaguucagccccugaggcucuuucccagccccuccgcuccccacaccccugcacacucccuuucuugaguguccagguagaaaugaccuguaucuucuaaccaccccagguaucuuuccaaagcauagaucucuucacuucucuauucaauuugaauaaccccccauugccuuaaggacaacuucacacuugccacucuucucugcauaucagguccuuagaaaugcauuucuaguugccuguuucagcaucuucucccacuaccuucuuauaaccuucccaccccagccccacuguugacucauccauucauucauccaguuguugugugcccacugagugucaggcaggcccuggccccgggaaguuaaauacagcauggccucaagcauuuccagaagaggucccagcucgguggaauuggcccauugucuuggaacaugggcugacuguacucuuuaguagacggcacaguuuggcaggaucuccgcagguguguaagugccaggcuaugccaugggucccaugguucacugauugucauuaaggaacauacuguagccagaaaacccaagagaccaucauggaugugugugcuuccucacauggcuaugauuugacuuagcuuuucuuuaucgcugaaaacacagaucauaugaaaacacauuuaggagaugggcuugaauuaucaacaauauagaguacaccuucuuuaacauuuaacuuugagauuuucauggugagaaaaauucuacauauuucuuuucacuccgaagucacacauucugaacuauauagauaauuugguaauuaauuucuucuuaauaagauaguuuaaugaucacuuuacugugauuuaaaauggaguugagacguuaggggaucuuuuauuuguuacuggaagauuacagccgguaguggcuuucauuauuuaugggagggucuccagguaagcccccuaugguucgaauggaagauucuuucuuuuucuuuucuuuucuuuuuuuuguaggggcgggggauggauuagggacaaacugucccugauaugcugauaugcccuguccaaacuccugacgcacagaaucgugauaaacaauaagauggcacguugauuugauuugauuuuuuuuuugagacggauucuugcucuuuggccagacuggaguacaguggcaugaucuuggcucacggcucacugcaaccucugccuccuggguucaagcgauucuccugccucagucucccaaguagcugggauuacaggcacacgccacaaugccuggcuaauuuuuguauuuuuaguagagacaagguuucaccauguugaccaggcugguccaaacuccugaccucaggugaucugcccgccucagccucccaaagugcugggauuacaggugugagccagcucacccagccgggaagagccuuucaaugaaaugugaaguaagugucaccuuuggguggagacaccaaagacagagacaagacaugcagugcccucagcugcauaaauuuugcuuuuaaaauauuuucguggaguaaaauuaguguuuagucucaugugaauuucaucagugugucuauggugagcauuuaaaauacgguuuuauuggaggugugguucguacuuuauaaucccuaccuaacagugcuuacucggaauugcucccccgccucccaaguuacuggccucacugugcuccagcuuucccaguagcagaggaacccucuucccaaacgugggcuugauuuacaccgagucauuaguugucaucuaaugguggcucuucagugucacugcaaucuauacgcuuucucugugucuuccuuaguucucugcccccacuuuuccccacccuucacgugucaucuggucccccacaaagcuuuugcaugggguucaucugccuauuccaggagagacuaugguccuuauccaguaguacuaaugugcggaaauaccaggaguggacaagccaccuuccccaaacaugaaagagcccaguuuugcuaaggagcuguugaaaaacuggaaauagaacagcgcugugguaagauuugccuuugaggucgcccugugguguguuaggggcauuuaggggacagucagggagacucauuuggaaguugcuuuggucaccagcuguggaaggauaagucuuagaccaaggcaguggcagugaagacgaauuucugagaaacucuggugguugaaccaaucaucuguuaggucuguucuguccauggugaagagcggguugugccaucgacugagcuagaaaacagacgagaggcaggucugagagaggcuaggaggcccaggcugggcggcgcggacuugaaggcgccucuagcagauccaaggggagaugccgaguuggucauuggcuacacaacucuagaaggcaggaugugaggcagagcucuucguggcaguggcgauccugggagcuccuggcacugagguggugaccgagacauucgcgaggagguugcccaggcagagggcaugggaaaaaggacaccaggaggaugccagggaagcacccgcacuucaggagccagcaagggaggaugagaaagagaaguuccagccggaggaggaaaaccagggacgucaggguucauggaagcccgaggaggaugcagaagaggaaaggagggaaugacgaggaacgccacaugcugcucagagguccaggaaggugcgaccuagccucuggaccacucccagugaccauggcaauggcaggcccagccuagggauugcagagagcaggagaggcagagucgagcagcauccccgggcuuuccagaaggccuggcugggaauggggcguggcacacgguguaauccgggcagccuuggcgagcaccuccugugugccagucaccacacucaguccuuuucagcauuuuguuuaguuacccaauccauuucauuuagucacccaaguagaaguuagaaauugaugacaaacugagggugcagggcaaaagaacacaugauucgugcuguggaaccaggacagucuguuggggugcuggcaggguguucgauugccacaugguggugucaugagcagucccagagccgucggauugcucuggugcacuugcugccugguuuuucucaccugcaaaaugaaagagcugacaggaugaaaugaguuaauagaugggaagugugggccgccuagcccugcucagccuuugagcagcaaaaaggaggaagggggaggaggaggagcuguccucugguuauagagggcgugagguuggcccggaggcuccuagugugaccaagggcuauuccuugccucauuuugugugauuuagaaacaagauggaaguagaaauugggcauuaugucaggauuuaaugaagucuuguuugggagcuguugucuuauuuuuaaccacuaauuaaagggugcuauuucccucuauagaauagaacauuuacaguuuguggauaaaguaaauguauaccucacuuuuuuuguuaaguucuuaaacuuuuuuuuuauuauugaagaauggaaacauacaugaaaguguauuugggcuuaaaaaguugucacaaaauuauccucaggucaaggagggccuauuucuagaccccagaaaccccuguguccugucccaggcaccugccugcucugcucccugaagaugggcacaauucucccuucugaccccauggugaggccagcuugguuuucaccuuuauacaauguacacacacacacgcacacuugcacaguugaaggggcuaguuagagguaucuuuuaucuguuaacccaaauaaaauuuuaaaauuauagaggaagugacuuuuaaaagaacacugagcauuacucuugggagucucaggaggguaauuaaauugguagugucaguaguaagcgcaaauguuuucaguacccguugacaccguuuuagauuugggaguagcucaugugacagagucauagggaagugugcugcccaauuugagaaaagaucaaaucucagugacaaagcuuccagauuuuuuuuaaauuaaauuuaauuuuuuugcgauagucugacucuguuacccaggcuggagugcaguggcaugaucuuggcucacugcgaccucugccuccccgguucaagugauucucgugccucagccucccaaguaguugggauuacaggcaugcgccaccacauccggcuaauuuuuguauuuuuaguagagacgggauuucaccauguuggccaggcuggacucgaacuccugaccucaggugaucugcccgccucggccucccagagugcugggauuacagguaugagccaccgcgcccagccgcuuccagauuuuuuuuaaguaaauccacgugauuguguuucugaucuaugcaccaacacacauuuacauugaacauauuuaugucuaugcacccacacacauuuacauugaacauacguauuuauaugaaacaacacauuuauuucuuggauaaucaaauauagacaaaaacucaaugguuauaaaaagcuucccagacagcacagucugggguaauauucacauguuaaaccuauuaacauuuaaauguucuaaauaguaugaguaauuaacgauuacagccacagaagagcagcucccucccgugacauuccauccauuuucuuugaguuguuuuuuuggggugggaauggagggggguuccuccacucacauagacacaccaagcuuuucccucuaggagauuacccagccugcugcuggguuguguggggaaggacugcggaugucuuggauggcaguugucauacuaguuuuuugcuuccccaaacaauucauuuagggaugucuuuaagugaggcgcccagagauuccaccccgucccugggacaucaagcaaauagcagcaacagccguuggcaaauuuguggcuauuugcagcauugacucuguagucaguuugcauuuucaagaugggggagacaugggcagacauuacaaaggaguccuuuccccuuccuauuccucaugcucccgcuccuccuccugaagucagauacuuuuuguucuucauuaaaguuuucccuuauucguauggguuacccuguaguuuuaaagcauucaagcaguccguauauuuuagaacaauauauuuauaaaucauuuucuuuccuugauuuguguauggaagcaggaaggacauaacagguagaggggaaauaggacaaauaugaaaaaaaaauaguagaguuuaaaaacuacuaccaguuaccggauguugugacuucauuuuauuuuuuaauuaaugugguagaauaguaauuaaauggacagaagaauuuuagcaguuaacaaugcuaaauacucauacuuuguacauccugucuguaguuugaugagaggcuuuguuguagaaauauucucuuuacucaugaacugacucuuccuagacuccauagaaaggauagaacauucauuugcauuugaaguuucauacaacagucguuuccauaacauauuugacuuaucuuaggaaguuucucgcaucuucccuuaguuucuacaaaugaaaaugucugcaaagcucucaaagcaugcauccuaguccuauuuaauucugacaucugcacauuucuuacgaauguaaagucaguguggccauccagcugaauaguaacucugaagcugggaguaaaaucagauuucaguguaauugauaaucaaagccccuuauugcuauuuuucaaaaacaaaguagcaauacuuuagcacucacccaggcaauuaugauuuuuggcuaauuuacuuuugguuuuugcaauuucaagauaccuagacaacacauuuugcaucuguugaaaucuuagauuuuauuuuugaguucacauaaugacuuuaaaauauucuaauaaaugucuucaaagaccccagaucaauaugccaaugguucugagaugacagagugcugcgauauuccucuguaauuuaaacaugauuagcugaugaagguuaugugauaucaauacacuaccggaagauaaauuaauugauaucauccuuucaggaugauaagaggccuauuggaggugggauguaacuaaugaagcugcuucuuccucucugugagccauuuuuuauauauugcauuuucacuuaaucauauuuauacuaucauucauuuacaugaaacccauaggcuguggacaaaccaguuucuuauuaaaauuguauucauuuggaaaagaaauuaucugcaaacacuauaugggccccgucuacguuauaaccuauugcuggggagagaugacaaguuccuuuccguggacaucuucgaaaauagcaacuaucuaggcaaagucaaggauugaauaucauugaacuuaauuacugcuaguccccaaagacacacaucuauucaaaucaaaaguguaguuauucugcggcagugacaccauugguguaggaagaguuuucuaaucguugacuuccuuuccaauuacauucaguaugcuuuaucagcgagccuauuugccaagagaaguuauggcugguugaauuuagauuuguauugauuaagauaaacuuacaaugugugcagucauauauuuaaauaaaaaaggucuuugauauaauuacaucuccuugaauauaauucucuaugauagcuuguagagugaagaggauuucuuuaggcuuugggggaaaaaaaaagauuuuugucuuuccaagggguuugguuaaauugcccugccuuauuuaggauuauuuuuguuccaaguaacuggaaaaaaagaugauuuuaugagaauaacuuaaaugagauagguguguauuuuuuugcuuuacauuccucugagguggucugugcagggcugcugaggccuucuguggaguugggggaccggcucuaucugucucccauguggcuccuguucccagugucgccucguguuccacagugcugcugaggccauguaacguuugugcauuucaggcaacaaguaggaaaaacauacgagaauuuaggcaaagggaggcucuccaggaagauccuuaaaagcugcccugugauccuucugcucucauccugcuggccagagcuuguguaccuggccauguucagcugaugcggggguggggggacgggaggaggcucuggcaaaugucauguuuauucugguugucauuugcccaccuaagaaccaggaaugcuauuacugcgaaagaaggaaauaacagauuucgacaacagacugaugaucucugcucuguuccugaauuuggaaauugauugacauggauuucuuuuugucuguguguccaccaguugcccagaagauuguugccacaaggaagaagcagcagcuguccauaggacccugcaagucgcuaccuaauucucccagccauuccuccgucuguuccgcgcaggugucugccgugcacaucagccagguacguuaggugacaugagaagucagacucuuagaaccaaagacaauaugcaaauaguguucccagccaaugcuaagguugauuuuuuuuuucuuuucaacuuuauaaguaacagcauguuguaauugacuucacauuuucuucagaaacugcuguggccaagugauuuuuaugggaaucauucuuuuauguuuucugucuucaugcugccuguguuaugaggcaugcuggcccggguggugaugggaggugugugcugcaguccucgcuggugauuuaaaccacccuucucuggucuugguccuagucugcuuauagguugaacaguugugaguaaaucuuaauggccaaucucgcuuuauacuuaaauuugguaguggcauucaauuauaauuaccaucucccuuaggucccauagaaacugcuaucuuuccauaacaacauuuugcaaaaguauuuacuuggaagcaaaugaaauaauggucacuuugaagaacucaaccaacaaccuccuaaggaaacaguugacuuuguuuuugucugugcuuguuuuuugauuacguuucuugggcagguauucuauuggcacuguuuuuuuaaggacaugguggaaggguucggugucguacuuucaguuugcuugggaagccaguaaguuauggcauguauugucagagccugucaagguacagucaugaauguucaugcuggcugggcugaguggcaguugccuguaaucccagcacuuugggagcucaaggcagguggaucgcuugagcucaguaguucaagaccagccugggcaacguggcagaaccacaccucuguaucuacaaaaaagagaaaaauuagcugggcgugguggcuugugccuugggaggcugagguggggggaucaccucugcccagcagaagagcuaggcugcagugagugugauugugccacugcauuccagccugggugacagagugagacccugucucaaaaaaaaaaaaaaaaaaaaaaaagaaugucuucacuugcuguguuuaauuuucugugaaucuugaaauacuuuucaaaaacacuuagauuuuccaggugucauuuucauaauguuggcugugguucugcugaucuagagcaguggagggaccauagaaucccuuuaguuuaaccaaccccuuucauuuucagaggaaagagaaaauaaucaaauuugaacucucagaaaucuuuuaaguuaaaugaaagagacuucuuugucuucagucacuuuucucaggggaugccacugagugagaugauuggcauguuccaggaugagacucuguagacaugacacuaauacaccuggcaaagccauagacgcaagucagccauucccaugcaucccuuccauggggcucaugcucacuuguugguuaugaccuugccuaaguggaggucuuggguuccugaguaugucguuaaugaaaccuuggauuuuaaucauuucagacaaguaauggaggugggaguuuaagcgacuauuccuccuccguuccaucgacucccagcaccagccagaaggaacuucggaucgauguuccucccacugccaacacgcccacgcccguucgcaagcagucuaagcgccgguccaaccuguucaccgugagugucaacccuggguggagauuugaaugcgauuccgaagcguucccauuaacguaaaccugguugccacaugguucagugguauuuguagaaucucaacuauauuaaagugaauaacauugauuucuguggaggacuaagaaaauuaagagaagcaaagauuuggauguugaguagaaugggaauuucuucauguagacauuccugacuucgugugucugaaaugaagagcuggggguguguauaaaggcacuuguuauccuguggcuccagcuaaagaugugucacaguggauacaaggagaugacaaaacucuaagauucccagaugugugucucuaaccguucagaugauauauaagcuauuacuguccacaggcccucuucuucuucugcuggggugccuggcgcugcccucgggguggaggugggggacugggaggugcuuccuggaggcucauugccaugaggcucuccacuuggguuuuuugcuguagagcauguugaaagcagagaugagcuaucuggguucagguuuauaaauucacaaucugggugcacucgggcaugcauuguuccuuuuuuuuuuuuuuuucuuuugagacagggucucacucuguugcccaggcuggagugcaguggcucagucauggcucacugcagccucaaccuccugaaauccucccacuucagccuucuaaguagcugggaccauaggcacucaccacuacguguggcuaauuuuuuuuuuuuuuuuaaagaaauggggucuuacuguguugccuaggguggucuugaacuccugggcucaagccacccucccaccuuguccuccugaagugcugggauuacaggcaugagccauagugcacagccagcaugugaagugcuugaaaacucccugggugauugagaugcagagaaucucugagcuacagagguggcaaaaaugcugccagccugucccuucccugugcauagcagacauuaccaaucaaucuggauucuacacaguugagccgcaaacuccaggcacagcugcugucaggugacugaagcauuuggacuugagaagaacgcuuuuccucccuggaucacgcauuacaaguacaugcuuuugaaacagugcuucugaaccagggugguuuugcucuccaaggacauuuggcaacuucuggagaaacuuugggcucucacaacaggaguaugggagugggaagguaaagguucugcagacgucuagucguggguagcaaccaggggugcugcaaagcaucccacagugcauaggucagccccucacagcagggaauuauccagccccacauguuaguggugcccuguuuuaaaccaucugacuuccauuuugguugauuacugcugacccagaugcaaagcucuagagggguggcugggagucagauuugcugccccuuugugaaucugaucuugauguuacauugcgauuccugccaagucugggagaucccccgccccucugccacaugucuggggcagucucucauuggaugcucaugacugcggaggcgguugccagcugcacacacccccucguccccagccuccccuugcuuuugcuaguugccuugcgccacaucagcucccacagaggccacugcugggcagcagggugaggacugaucagacagaccaagcucccaucccggccuccgcugcugacggauguuugaccuuaggcaaauuacuugaccucucugggcuggaaaccauaguacuucugcaguggggcuuccgggaagacuuccuggaggaggcagaagagaucugguggcauugcuuccaugguuuucucacuccauugaugcuauaaaaugauuucugaucguguuaagcauaugugauagauuaggagguggguauuuagguuucuguaaaauacaggugaguaucucacaugcuuaaauuagugcauggauaacauguuuuauugggcaguuucuucacacacaccgagaacagcagcagucaccuaaauagcugcuucccagcuccgucuaacaccuggagcagccccugucuacccccaggcuggggggcuuuggguugaaguguuuccugcuagaacaggcugcacagugacucgguggcuugagaaaccaauagccaaagaugcagcuggauugagagaaggugggcugugggcaggcggccugugccccgggaggaggggcgggcuugucaucgugguggucgagaacaccuucugugucuuuguuaagggaguggaagggggagagcacucauucucagacgccuucugagggccacauuuucugcuuguugacuuugcuuucucuuuuaaggagagaaauuuuaaaaccacaaaguaucuuuaaaaaugagacuauuuauaaggagaauaccagcaccuucccauccccucccuuuauaagcucuggaacugcagugugccagaaaguaguaucccacuggguaccugacaacccaggugacuuagggaggagaacacuugaaggcagagagaaucaaaauaacagcccauuuaauaaauauugacuuaacaucugcucugugcacagcccugguuuugcucagugucuaggaggaagacucacugccagagucaacccauguucaagggaaagcgauuuagggugaaggagaaggggcucugcacacuaggaggagagacccuguugcugcggauucacccugcagacacacaggugcacuuacaggcauccaugaagaggccgggcagggcaggugcagaagccaguaaaaacucauuguuacagugaccaaaaaucaccauuaauuauuucaccauuaaugugucacauaauauaauggucugccuauggaucuaagggugaccaguguuuguuaucuuucuccuuaaucuuggaaaauaaauuugagaucagaucagaaauugaauccagcugucccauggcauuagugggaauagaaauuuggagucauaaaagaagcuaccacugcaauagguuugcauuguggcauuuaaggaaaagacagugaaaguucugggcagggauccauauguugguccucaguggguuugacacugaacaaaaugaugguggugaugaugguuguggugaugaugaugguugugguuguggugaugaugguugugguggugaugaugguugugauaaugaugguugugguugugauggugaugguugugauggugguggugaugguugugguugugaugaugguugugguugugauggugaugaugguugugguggugguggugauguugugguugugaugaugguuaugguugugaugaugguugugauggugaugaugcugcuugugguugugauggugaugaugguugugauggugugaugguugugguugugguuaugaugguuguaaugguggugaugaugguugugaugaugguugugguugugaugguugugaugguggugaugguugugguugugaugguggugaugguugugauggugaugaugguuguggugaugguggugauaguugugauggugaugaugguuguggugauggugaugaugguugugauggugaugaugaugguuguggugauggugauggucaugauggugaugaugguugugguuguggugauggugaugaugguuguggugguagugguggugguggugaugaugcaugcgguguagucuuaaguugaaguuccuggaaauaguaacuccacuagaugucagugucauccaaggaacaaaaagaaggcaaauuaauugugaaaucauagcaauuaagauauuaaauuuuuaucaugaccaguuuucuucuauuuuuaaauauguaaaauugaauagacucuucaucccuggcaguuguuggugauuauaggcauaaacugucaaaauguguauuuauuuggaagugucuagucagaggacagaugcaugauaugcagacaaucuuagugaauaaaaauucgugcagacugggauuguaacacccagcuggaggggcacuauccaccuuauuuauuagaacaucauaaagaggccauaguuaauuaaguaaugcauguaucauuuuuuccaauaccauuuuacacauuuuauaaaguacacuguaaugcacugcucugggcuaacauuuugugcucccagauguuuguuugcauauauucauauacaauuuuuaaacaaaaauaaaugacuuuuuuauaaaauaguacaaauaaaaucucuguauuaguccaaauuauauguuacauuugcaguaggaauucuacuuuacuaaucaaacacugaguuauauuuuauuucacuuauuucuuuggaaaaaaaacaaacauuaaaagacuguauccauuuaaucccuaguuugguaauauggguucuuagagcaauuaauuuaguuuagcggcccuaguuuacacgugguuaaaguguuuuauuagaaaaauuuuucaaacauacagaaauaaacacguguguacucaccacacgcuucaucaaauacaagcccuuuucugcuacgcugcuacugcaagaaauaagcaaauccuaaguaaaaguugcagcuccuuccaugugccuccagaacacguuucuccugccugucugccuagggaucagcauuaaccugaauuuggucuauauuaucuguguccaugcuguaaacuuguucuagugugagucuugaaauuauacauuacauggccuuguccauuuucaagcuuuauaauaacgauguuauuuaugugauauuuuuaaaaagcuuaccauauaauguugauaccauuaaacagagccaagugcacccaggaaccaaagauugugaauauacauugcccagcucagaaacuugccauaaaaaaauaaggcagcaaaauucauagugcgaagagaacuguuucaauggcauuuauuuguuuuugcagaggagcuccuggguaccuccccuaguguguuccagcagccguugacuuagccacugguugaaaggggguaaacgggcuucucuuugauacagagggcucuuggcaaugaugcgcuuguuccuguaggcagguaguuaguugaugggaguguccuccauggcuucucucaccacggcaggggaaguuaaacauuuuuguaaagaagcaggugauaauuggauuaccuuaaccuuucuuuccucugcaucgaguguuuguuggaggcuaagcaguuacuaugguggcuugcugugcguugacuuaaaaucugcagcccuucugggugugaucugcugcuguuccauuucuggcagugugcagcaggcuguaugcagggcagggucacuccuggcagacgccgugggugcugagggcugccuugugucugaugauuccucggauccauuccagcaucacggaaggaugugccauuagugaugaggucucccaaguuagcagagaaaggaaaccuuacugggaauuuguauaugcuggggugucuauguccauuggauuugauuuagucugguuguuggauuuaaauuuuauggauacagccugauguagacaaacuaauuguggggcugagguacagcaaacucuuuugccuaacaucuugccacuguucuuucccgaaauuuuaguuuuuugacugucuccggcaaauuguuaaaguugucaggaaauuuuuguuuuauuuuugcaaugaagucuuaccgaaguuucagucucuuuuaucucagagugugugaucagauauugaguuuggugguucacaguucauguucuaagguguuuacagcagggcaaugagcuauuucuucccauuucaaguggaaucugaaauucugcucugagaauggauuggcuggggggacagaugagcugccuuguuacaggaagauguuaauuuuuuuaaaguuuguuuuguuaauuauucugguuuaauuaaccagaauaaugaagauggauuuccaaauuuagaaauuuagaauuuguaaaauucccaaaguacucuuaaauauuuuuuguuaauuaaaaaaaaauuuuuuuaauguuaucacugugugcuuugaaauucauuuuaaaacuaggaaccucaggagccagcuuuucucaucaacugugauguggagaaaagaauuuaaggcuauuguguagcucuuacuauacaguauuaagaauuaauuaaaaagaaaaaugagcccuugacaaagaauugauaaauaucucuauuuuccuucuagcccaaaggguuaaccuuacguuuuauauucuucugcaacuucauauuuguugcuugauuuauucccugucaucucauucuaggcauccaccaaccuaagggggaaacaagugcacagugcuuggcacguaguagguguucaauaagcaucagcucuuaucaccaucugagaagcauguuuccuaaugagcacagcugcccaggagaguagcacccuuugaagugcuagaucugaguuuccaucaugggaacuguucuccuuguccuccuccuuaauuugguagcagccucuucuggaauccuaaaugcgucccaucagcccuuguuuguauuaugacccaugacauugccccuuuaauauguauguuuuuuaaaucagcuguuccagcucacaucccuuugaaccuggauuccauuagcuuuucauuguagcaguggacaccacaaagucuguucauuucauauaucaucucagauuugaaaagcacgugaaaauguuucuccauuuucaauauugugugaguaauguucccauugaaaaguaauggagugaaguugucacuugucagcacaguuauuaaggaggacgagucuccaaucuuucucucauaauaaaauaaaucugucagaaaaucauugugcucacacuuucucaugccaucgagagaggagacugagacgauggagcuccuucaguuuuacccaagucaaggugcgcuuuugguuggggcuucccuggguuaaaggucaccacccuuccugcccgguggcagccacucgucguccgcagcacgucagcagugcaucggagauaauugacucaggaccuugucaaauaaagcuguucauuauuucccaaauacugaccuuucguccaaaggcgauuaucagggguuuuuuuuccccuucauuauuuuuugugguauuguccacuagcuuaacuucgaauuugccauuuuccaaccauccagaagcaaaaacggaaaauguuaacagcaccuugauacuaaucaagagugugccguuaaaucgcacagcugacuagucaacagaauuuuaaaaucauucaaacauuaauuaaauacauauguugauguaguagauuuuccaaauaaacauugagcagccccuuuuuuccucggcugugugaacugcagcuuucaaguguuuuucuguugggcguuacuuucccauauggcccauugguuucuaguaguugaauuuugaacuuuuuaaaaaagaauuaaaagauaauucugugguggaaaagucagggggaaaguuuagaugauucucuuuaaaaaugaugagucaguggagaugaacuacugagcugucugcucgucggacgugucugugcgcacacauagaucgcgcauguuuucuaaauguguauuggcaggaauucugcaaacaggggcagagccccgucugugaaccacagcccuuacccagaugccaacuuuccuuuugcuuugcagucucggaaagggagcgacccagacaaagagaagaaaggccuggagagucgugcggacagcauugggagcggccgagccaucccaauuaaacaggugagcagccuccccauccuucccucccugucgccggagauacaccucaggucuuccuggagaugaugcuggcucucgcaccaaggucugucugaugugcucuguugaugaauguagaagucucucacuugacaucaauuagcagaguuccuguguguauucaaaugggaucauuagaaugagaagagggaacggagacaacagaccuaaugaagugcgggcugcccgccugcauauggagugcguuuccaggcugagagcuuucaaaggcugccuuuguagcacggcuuugauugggccgcgggccgccgggcaacagggguaacucagaucgccuacaagagccccuugugaucacaggaacagcccgacguggcccuaauuugcucucacagacggacaucugaacacuguuucaggcugguuuguaacaacgaggcaauuaguugugauaaucauagccggugugucagcugugcgcucuuguuuguaauuugcuaaugaaggaauuguaacuuugauuagguucgguuucauuuagaccuuauuauauaaaggaacauuuacagcuguaauguggggccuuaauuaaacuuucucauuacacaacaggacuugaauucaaccauuuguuuuggccuauguugcuagccuggaacaggguuucauuagcccagaaaccagauucuaaaucacuuuauaucuccaauaagaaaaaaaaaaaacccuggaguccacgugugacguagauugugguuugauuuccaaggagaauaaaaauagaguucaaccccacacaguggcuucugaaaugucaucuuuugguuuguuaaagaaagccaauugauuuagagugcauccuucuugagcagaagccucugugggcaggagaauggcuccgccucucaggcacagggcuugugaccggugugcaccuccgguccagcucacugcuuugcucuccucucuccugcgggcaccuacacagcaucgguaaucccuuaggaacuguguaggcacuggcugcccuuaaaaaggggagagucuuuccacacauggaguuggauuauucugguggugcagguuucguccauuugaagcaaauaggaacgcagccuuagagaggggccagccagugucagcgugaagaugugggagaggaagggguuaaauagggccacagcaucuugggugagaccagaggagggaguccacagaguuucccaaggagcccaggaacuacugcaaaaaccacaccucugcccacagcguaaccgacccugcccgggagcaagcuuucuccuuccgugcucacagggcacgccuuugccaggcagagaagaaggaggccugcaggucaucaccaaggcccucaggcaucuauguaagauacaugaucaucuacugggccgcaaauauauggauuggcccggggcaccuuuaggagaaauucucuucccuccauauauucaaagacaacaacaacagaacuuuccacuuugaugaugggugguguuuucacuauaaaacacuucagagguccgugcacauaguugcuuauucuuucuuggugccuuuauuuauaaccuaacucugcauaagcuaauguuacuguguaauuuuuaugccacugauaccuuuuucaacuggaauuauaaaaaucaguuauaaaaauaauucuuuuucauaaacugguaccaggacauuuccuuuggggaauauuaaaacuuaauaauagacuguuuucuuaaugccugucugugguugauuugggugauuugggugggagcgcucaccagccuggcgggagucccucugugcgagccaggugggcccccgguauaauuggaaccuucauucaauuuguaccugcucaucuguggagggggcuagcuuugcaggcuagcuuuucaauaugugugcagauuggaacugaccaucaagcguaaaaugaguauuauccaguccuuggaugccuuucgauugugaauguucaaaggaaucucguugaaaucuaaaucauggucugauuucccggugacuccugggcacagggagcuccuugucccuccuaauugucccccucuugcagccacagacagcucccuccucacauccacaccugucccagcaaagugcccccguggccagcucuccaggccucgggugccucgucuguaaaauggggaacuggaugaugucugaagcccuugaagcaguuagauguggagguuccacagagaauuuuuaaauguuagcaaaacuggauuuuuaaaucggggcacccuugucaaagccucucugugcaucggacggauugauguggguuugcagacgguuguaucgaucuaucucacaucccuguguguacccuuguuucuaaaggaacauagaucacuucagguagccugaauuccugaccuuccuggugugaugacuucaguguggaaaugaaaugagaggauugcaggggauggagccugauggccauauucuagaaacucaaccaaauuauuuguugaauaaaugaacaauuaaaugagugcuuauuauguaagugcuguucauacaagaucccacuuaauccucgacauugccacaguuaugguagcuguguucuccuuauuuuaaacacagagauagggagggcccuauaccaggcagcuaggaaguagguccaaggauucggaccaggccucucugccccuaugucugcgcucucuccacugcccauugaugaaaagccuucagaaagcuuaggaagcaaaguuacauguuuuaaauuaaguaagugaaccacgaccugagacaaaaauaucuuacgacuguauaaagaaacuucugagacugccugcagcaacauauuucuccagggauaacacagcccugcucagccauucuccgggugggaggcgucauuccauucccauccuuaccguguuugccgcaaacauguucucugcucuugucacuugcugcagagaacugugucuuaaugcucagcccaugugaaagacucgggucugcaugaucgaagccucacacaccagcuaauggaccuuugccuaauggcagaggagucguuuuagaaccccagcaaccugcguggaguugcuaaugcagacucuucuuucccccagcaggagucuuguaauggaugguuuaggauccaggcaaggcagccuucaacacucucugcaaucuaaccccagaguuuacagauaguacgugucgcaguggcuuauguuaacccccuuucacuuccaucugauaccucguucgcuguaagcauccaggcuccccccaccucagugugggagcuugccaaaucaugauggucaaugacguugucucuuucuucuuucucccgauuaaagauuccccaucaagaauaugacuuauuuucuggacuauaacuucauuucuuguggaccugggucuacuucuccuuugguguccuuucuggggucuuggaggagguugguucagagaauucgguuucuuuuuuuuuuuuuuuuuuuuuacuaauaaggucuauucgaguaaaaauuaagaagcaaagcaagaaaaagccagaggcccggcucagcggcaaguggguuugucacguauuaauuuuucauugcuguggagaguuguacauacauaaucacuugauugcagugggaguuagggagcuccuauggugccauuugcauaaaucuuguuaagucaauggcaguuaaugaaguacaaaugagcccggagaaggugacaugcaaaucguggguggcagaugggaggucuguuugggggacagcagcugugugcucuccuuucuuucuuucucuuuagcauuuuuuaaucucuauauuugaguacagauacacagucauacgccuuggccuccuccgugcccuucgcagagccccggccagagaaccuguccauccccuccugccucugauguccaggcugcauaaaccguucaagacuugccuuguacuugguagcguacgcuagaaggauuugaauuuuuugaaaaucaugcucaguuuaucucaucgugcuuacgcaauugaaagcguaucauuuuuacuugguggggacacacagaaccuccucacuacaucuuuugagacguuguguugucuccugagguuucagagaauaaaaaagaauagaagauaccaucuuugccuuaucaugcuuccauuugggagucuuuucuuccuuuuucagacaggccaacuguauuuacugauuauuccccgucccugguucgugguuggaccaucaggggauuggcauuccuaggguuagucaggaaugagaaauacagaaagugugcggggcaugcucuguaccucaggccauggggacgaccgcucccugucaugcagaccccucagaggggccgcccccggcccggcccagcucuggccagggugucucacgcucuugguuuuguguuuaaggauuuaagugcuagcaggacucacagagagcucuuagagauucaugggaaaaacauugccuacgacuuucagaaguuuuguguuuauuugaucaccuggcugauguuuugagagaaccaggucucugcuugccuugaagaaagguaggcaaagacgugugcaucaggaggcaacagcccuguugacagcugcgguggucacaugcuggggauccuuuucuugcaggccacccacucugguccguccucugcgaugcccgccaaggugcuguuucucaguucuuugggcugcagggcgcugcgggggacccuccaucaggcacgcucccuuuugugaugcucgguggaugcaccaaaggagcaacaucccucaaaaaaacuuuuuuuuuuuaagucuucauuuugaccuugaacccugaugucauggccaccuccagggagucagcugugagagcagucauuucccagcagccaucugaagccgugggaaaagccuucccaagcugucagaggaagagccggccugcccggggcaagcccgccgcacccgccaucgggccugugaacuguuuugaagcugugcguguuuugauucucaguugaguagaaagaggcaauugucaauuaagugaaaggaaccucuggaguuaauccccucguccagccugccgcaggccaccgaccuguguugucugguaccugggaucaacacgagggguguauuguguggcaugggcagaaugaaagcagccuaaugacgccagcguuaacagcuccugaaacuuugacacugcucacagcgaguugguugacugcuucaccggcgugugcugcuuucauggaggaaacaaaugugaagaccacgcugaaacuugauagagaucggaggagauggagaggaauggcagugcccuuccuucaggggcauggagagaggagcuccacaggccugcggccucucugcguaggcagagguuuacaggaggacggcucacguuuauuaagccccaccauugaggaaccaaggugagcgagaggcccgccgagcguacgauguccacccacguggcaaaucagcucugccugggcguaggggcccguuuugcuccccagaagcagauaauuuacagagugaacugccgugcccugcaagcuaauugaccucacuugggugaacaacucccugagagucuuauauucagcccgguucacaacagacccagcccaguuacgaugauuaauguaauagccaggcagguguaucagugcuuuuacuuugacuccucaaaucucauacugucauugccagaacaguccagaauaucuggaggccuacacgugaaaugacagucauccgucuuugaguauaucgggcacacccuccccuacauccccgcccuuuuggcaauguuggugggugacaauauguuccucacaagaugugcagaauguuuauuuggaauuacuuuacccaaagcacaaaauccaucauuuauaugcaaaucugcaaagcaaucgaaaagaauacuucccuuggccgugaggguugcaugagggugacaggaaguaguguagcccuaggugcaucauacacgaccaacugccaugcuaacagaauggcguuuccaagaacggaaguucguuuuaagacucaguguguccucuguguauccauuguccagagcuggugaaacaggaaaaguuccuuuaucucccucgcagggcaugugaugggcuguggcucacuucuucggugucccgcagcucagaccccuaggggggcgggcaggcagucaggcggguuguggggagcaugggcuccgaucccacagcauggucuagggcugggcguugacagcuccugaagccccagugggcguguguuacagugugcuuuucgguuuggcuguccacaggcagccugugaccaucagcucaguuagucccucugccuuauugcaaggacagaggguuucuguaucccaggguucuugccuuaguguacuggaagaauuggaucacacgucagcuuggagaaugagugcaacguuuaaugaguggugccaguaguucucagcagauggaugguagccagaagggcgauggagugggaagguggucuuacccuggagucgggccacucaguggccggacucuccuccuaccgcccccgggugaauuccacgucacccacaucguucugccauugguggccugccagagucuguugguguguucuucugccggugugcuucucucgacgcccagccgccugugugugugcccacuagggucucgggguuuuuauaggcacaggauggggggaguggcaggccaggguggucuuggaaaaugcaguguuugggcgcaagaacuggaaugccuguccucgccuaugucugugggcacaggcccaagggcggagcucuugccagggagccugcccuucucuacccagcacuucccugccugccucccauuucaccgggauaauaucuaagugauuuguuucagcaaaauagugcuuauuuucuuuaaaaguugaacagugguggugaaauccaauuccccuugagcucagaaauacaagcucuccuacaaguagaggaaagauucucaaaguuaauguugccagaacuuguuuuugucuugaugaaucaaaaagauacuuauuucuggaauuauuucuuaucagauuugaucaacuaguaacaauuguucacugguccuugugugacaugcccuggguccucugcuacggcuggaggaggcagaaagugucugcagcccccaggcucagcucagguguguacugacgaucccaucccaugacccccaaugcaaguggacgggugucacgccaaggaguggugaauucuacugaguuagacaggagagggugagggaaggacagggaaauggagguggggacaaucccacuggacugggacauacaaguaggugguggcagaacaggagggaggcagacagcagagcugcggauggagggguucaggaggaaguggggaggaggguccuaaaggcccaggguaucugcuugccaaggacucuggcugcucugcagagaaggguugauuuccccauauuauuuguaggagcagugguguuggggguuuagagacucauggccgcacggaguggaucucccuccccuucuuacucuguccccauaggguuugagaugauggggguucugauguaccagagucuuggcgguaaccagcguuuauugaccacuuuuccgagugcccuguccuagagcuuuccacugcugucccccuuaccuaggaagugccacgcuccccuuucccauaugagaacauuaaggcuuggggagacaguggggcgugcccagcagccccacacagcgcaugaguccccagggcugcccuaaugaaauccugcagccugggcggcuuaaacagcacaaguugaucucucgguucuagaggcuggagguccaagacaaggcccagcagagccuguuucuggagagcccucuccuuggcuugagccuguugccuucuugcuguguccucccguggccuggacuccaugugcacacgccuggugucucuuuuucuuauaaugaugccagucccauugaaucagggucccaucuguacgucauuuaaccuugucuccaaauacagucccacugcgggugagggcuucaacaugcaaauuuuggggggacguauuucauccuguaacacacagcuggguaguagcagagcugggacgggagcugagcucugugugaccgagagccaucugccauguucuuuccaucuggaauguccuagcuuaggccuuccuggucauauaagguaaggccacuugauuucuaaccaacauauuugagaauaaaaaagaaaaacuuacuugaagaggccgcaugcguuagauaggaagcauacgagacucaaaguacuccgacuuggggguuuccauugaaacuuuccuaaguugugguaaacuguugucauuugaaauaagacuguugcuggaacgaauccuuauaccaggugcguagcucucacucugugcagugcguuuuacagcuguugaggccuuucagucccguccaugggagaccuccuucaggcugguuuugaaaaccaaagcucccuucccuugcggaggcagcuccucagggccgcggguaaauguugggccuguagcuggggauguucaggaagagccuguggauugggcaggugcucacuguccgucaguugugucacugguugcuuugacaguggcugugguguuuuguguuuugguuaauuucucccagguauaaaagauagcuauauacucacuucauuacugaaagaaagauacagcugggcauaguggcucacgccgguaaucccagcacuuugggaggccgagguggguggaucgcgaggucaggagaucgagaccauccugacuaacaugguaaaacccccgucucuacuaaaaauacaaaaaauuagccaggcgugguggcgggugccuguagucccagcuacuugggagccugaggcaggagaaucgcaugaacccgggaggcggagguugcagcgagccaagaucgcaccacugcacuccagccuggguggcagagcgagacuccgucucaaaaaaaaaaaaaaaaaaaaggaaagaaagagcaggagugcagagacuccaggucagacuuaggaggccuuucaccuuaaagguuaaaauccccacacgugacaaguagcucugacuacuucccacagucuuuggccauuugcaaacacuacauagaaacagaugucuaccagcugggugugguggcucacgccugucaugucagcacuuugggagaccgaggugaguggaucaccugaggccaggaguucaagaccagccuggccaacauagcaaaaacccaucucuacuaaaaauacaaaaauuagcuacacaugguggugugcaccuguaaucccaccuaccugggaagccgaggcaugagaaucgcuugaacccaggagacggagguugcagugagccgagaucaugcuacuggacuccuuuuuugaucucugucucaaaaagaagaaaaaaaaaaagauaucuaccaagaccaagacuccuaaggaaauuguaucauuaaagucuuauuucaguucugcaguauuuauuuaacaguuccugacagcagacucaguuucuccucguguaggaacuuggacuguggaauaggacuucucccaagcugaguuuuguccuuugugaauagaggcuuugacaaccaaacaagcaccucuccuggcagagagaaaucacuggcugccagaauuucauguuuuguuuagaaacagcaaccguggaacuuauggcacuuggcauggcucuuagaccagacacauuuucccagaaauggucaggaaggcccagacugugcacucugucccaagacugucgcugugguucucccucacacaccccuaugacaugguucugcuuguugccuacuccagagccuuuggcuccacaaguucuaaagaagguggcggcuuaauaagucuucacaguccccuuuugaggcuuuucaggaaagucaucagacaaugacauuuuuaucagauaguuuugaguagcaaaaacacuuuuuccucuccuacaucuaaaaguaaaagaauuuacuuuuaacugacucacugaaggccauguuuugaaaccaaaacacucuuuccuugguaccaaagcugacagcuauaaguaaauauauaggaauguaaauauuauaaaguaggcauagaagaguuuguuaguuuuagguugggugcggugcgucaugccuguaaucccagcacuuugggaggccgaggcaggcagaucaguuguggccaggaguucaaaaccagccuggccaacauggcgaaaccccaucucuaccaaaaagacaaaaaguagccgggcacgguggcgcaugccuguaauuccaacuacucgggagccugaggcaggagaaucgcuugaacccgggacggggagguugcagugggcugcgaucgcaccacugcacuccagccugggcaacagagugagacucugucucaaaaaaaagaagaguuuguuaguuugggaaauauguuccuaguuagacauuguccauaaauuaccuaauacuauaguuaauguuugcagacuggugaaaacagaaacauuucaaaauacuauuaacaucuuagggccgucccaagucuaguccuccugguucaauccgaucugcucccugcaauauuuacucccuaaccuuuccuucugcuuaaaaacucaucagaaucaaccacauuauuaucgugugagacuuguaauaagaaugcuggcaguuacaugccgaguacauauuguacauuacguugguugcuucaucacaggaccucauuuaauucuccaccaaccuaagauacaacuugcuacucuguucuagacgaagaguuugagguucagggauguuaagguaugagaccgauguuauauagcuccacgugaguggaagagcugggauucaaauccaggaguccucucugaaacauucuagaaaagccuaugcuguugcauccccuucccgccccaugccaucugugcucaccaugaccgucuuuuuuuuguuuguuuguuuguuuugagacagucuugcucugucacccaggcuagagugcaauggcaugaucucagcucacugcaaccucugucacccagauucaagcuauucuucugccucagccucccgaguagcugggauuacaggcaugggccaccaugcccagcuacguuuuguauuuuuaguaguggcaggguuucaccauguuagucaggcuggucucgaacuccugaccucaagcaauucuccugccucauccuccuaaguagcugggauuacaggcacaugccaccaugcccgacuaagguuuguauuuuuaguagagaugggguuucaccauguuaggcuguucucgaacuccugaccuuaggugauccaccugccucggccucccaaagugcugggauuacaggcgugagccaccaugcccggcccauggccaucuuuucugugcaagaucaagcaucaaguacacaguguacuuuccugguggggcaccagcaaggcaggcuguuuuacgcagggcuguccuggaaagucugugcugucuggcaccuggaucaagaucagaugagguccuugagcuccaguguucaucggagucccugugggcccagagguugccugaguaggucagaaucgaguaucgggaaauuguauuucuuuucuuuucuuuucuuuuuuuuuuuuuuggagacagagucuacucugacacccaggcugaaauaaaauggugcaauaucuuggcucacuguaaccucugccucccguguugaauugauccucauaacagccucccaaguaguugggacuacaagcacacaccacgauaccuggcuaauuuuuuguauuuuuaauagagauaggguuuugccauguugcccaggcuggucucaaacuccugagcucaggcaauccacccaccuccaccucccagagugcugggauuacaggcgugagccacugcgccuggcaggagauuguauuucuguguucucaagugaugcugaugcugcuaauccaggagccacacuuugagauccccuuucuaggcacauggagucacuuagggcuucuuuccuuucccgccucacaaauagaugacucuuugauucguaccagccccuuuaaucugugcucgugaaaauuuuccuagccgugaggcccgugucagaugccuucuguuccagguaaaccaaugagaugugugcucuuuccuuuucuuuccuccgaugcccguccgaucuugggaucuugcucucuaucuucccuguuuauagcuaugugcaucauucacgccuccuuucccacguguuuccggauggugcacacuccgagacauguucuuucuccugcguuguguacacagcagggaggguauuugguaggcagguugcuggugguaguagcacuagguagcauagguuaauuguguaaaauggcuuuuuuuuuucuucuuucuuucuuuuuuuuuuuuuuuugagacggaguuuugcucuuguugcccaggcuggagugcaauggugcgaucucagcucaccgcaaccuccgccucccagguucaagugauucuuuugccucagccucccggcuagcugagauuacaggcauucaccaccaugcccagcuaauuuucuauuuuucauagagaugggguuucuccauguucaggccggucuucaagucccaaccucaggugaucugccugccucggccucccaaaguacugggaguacagccaccaugcguggcuaaaaugucuuuucuucaccaaaacagauuuuguuuguuuaaaagaauauguuauauuggagaaguuacaguauucauuaaauuguauuuucaggaacauuauaauuuuuaagucaacauucuuuaacuuuuauguaucuaagauaguauguuuagguuacacagaaguggucacauuuuuuuaaucugcaaagaagaaagcuuuugccagugacccaaaauaauuucagaaaacugguuucuuguacaacuuuucuacuuuugaguauuuauccagaagaagauuuguuuaaauaaaugucuucacauacaaaauuuuguuuauaaggaauucuucaagauuaaacccacaaauuuuaguaacaccggacuguuuuuguaauugccaaguuuuuaccauauuguucagucucuaucagccacagccucugugauuucauucaugcuaaaaacaagaauguuuauauuuuuaguguacauaaaaauuaauuuuauacaaauauauaaaacagcuacacagaaauacuaguggagagacgaguaaugugccaaguaaugauuaggcaaugaggaaccacgagaagcagauagcucugguuggguguguuggccuuccuuugcucauaucuaaaguauuggagauuuaagacaauaugaaaucauuguauacuaaaauguaucauuaacaaagaaugauaaaauccuacucuaagaaaaauaaggaagagcagaguuguggaaaugcacugcuauaguccugaaacuugacccagucuucuugaagggcaaucuaacagucauacaugauggacauaagaaauuugauucacuuugucccagugaucugucuucuagaaguuuauccucaagggaauaauucacuaggagaaagggaaaaagaccuuuaguguaaaacaguguguauagcaguuauuuauaauauuaaaauucugggagcuacaaauuuucaacaagcaagaaguuaaauuaguaauugcuaacugaauaguaccaggauguacagccauuaaaauggccaauuugaauacccuuuagagauaagugaaagcauaaaacauaaaacuguguauaauaauuggagcaugaaaauauguauacauguggcuuuaaauuggaugaauaggaacgcaguaacaagugaacugggguagguuuaaagcagaacuucaauuuuuuuuuuuuuuuuuuugagacggggucucgcucugucacccaggcuggagugcaguggugcgaucuuggcucacugcaagcucugccucccggguucacaccauucuccugccucagccucccgaguagccgggacuacagggaacuuuaaaaauuuuaacuucauguuuugaaauaauuuuagauuugaaagaaauuugcaaaaaauaauacaaagacuccauauacccuucacccagcuuccuucacuguggacauuuuuauauaacuaguacagcuauaaaaaccaggaaauuaguauugguaagguacuaguaacuuaucuauaggccuucuucacauuuuaccaguuuuuccugaaauguucuuuuuaaucucaggauccaauccaggaucccuccuuucacuuaauugcuuuauuuauuuugccacuuccacccugagaaaauuccucaagucuuauguccaugaccuugacacuauuuuaggaauauugaucaguuacuuuguagaaagcucuuuaauuuggauugccugaugucaucuccugaauagauagaagaucuacauuucuggcaggaaaaccacagaagccuugcacccuuccuggugcucuguaccagaggcaccugacagccaccugucuuauuccugggaacacugaccuuggucacuuggacaaggcgagaccuauuggauuucucccuugaguucuuauuuuuccauuugauaaaguuagggaugaaugucuucggggagauacuuugaggcugugcugaucauuuuuagugauagacguuguacucaauaauaaguagguuuuauaaaaugaaaacuauuuucuucugauaaauguguacagucuuaaauaaaauuuaaagugcuuuuuuaacucuuccuguauuggagggaaggaguaaaugaggaugauuuugaaacuuguugguuacuuaaagaagaccuggggaaaccuagaggugaggaggaacuggagaagcccaggagcgaggaggagcuggagaagcccaggggugagggggagauggagaaacucaagggugaggaagagcuggagaagcucaagggugaggaagagcuggagaagcucaagaaugaagagaagcuggagcagcucaagaaugaagagaagcugaagaagcucaagggugaggaggagcuggagaagcccaagggugaagagaagcuggagaagcuugggaauggggagaagcugaagaagcucaguggugaagaggagcuggagaagcccaagggugaggaggagcuggagaagcuugggaaugggaagaagcugaagaagcucaguggugaagaggagcuggagaagcccugagugagcccgagcugggaguggugagugugaguggaccuucccagauagaucuggugagaaugggguggcaguucuagaacugaacaagaggggcuuccuggucguggaccccgacgggugggcaugcgguagauacccagcacauccgagggaaggauggauggcuauugauuucccuucaggccaugccaauauguuugucaagcaacagaugcaauucaagugcuacugugauccagguguggcucgcuguuuagguaaagaagcuucacaaaggcgcugccacaaaccaacauguguucuuuggguuucaucucguaauuucauucaugaagguugggaauucuguuacucagaaucuuaccuauuuuuuccaaguaguuucucucagagaacaaaaacuauguauaguauguguguacauauguaaauuuauguaacauauuaacauguuauuaugauauguaacauaucauuauguauuauguuaacaauuauaaucuauaauucuauagauuaacccuaagauuuauuuuucccuaccaucuucccauuguugcccaaauaacugagugcugucuuuccccaccuccccguaucacccaggcuggucucgagcuccuggccucaagcaaaccuccugccuuauccucuccgaguagcugggacuaugggugcgagccaccacgcccagcucuagagugcuuuucccugugcucgcaccagaauuacagugaacugcccaacaaacaugcuguuuuuaaagcuagaagggacccucaucuuauaccuagggaaacugagucccaggaaggguaaagagcuugcucaagguccuuccagaugcucuuccaguaccauuuccaccacugacaccagcauuuucuuauuccuugugcacuucucaaaaaaauagaaauaacaaguagugguuguuuacuguuuugacccagauauuuuuauuguauugcgacuggucagcuuuuucuaaguugaaucuuuaagcuucaugcuguuuuaucuguuuuuuuaaauaugcaagggaauagauaaaaagcauuaccuuugaaagcaugugguuacuaagagacaacaugaccauccuuuguguguuuauguaucuagcaggcucauugauucccagcaguccugugaggcuagguggcauucauuccucugcacauuuuauagaugagaaagcugaggcucgccuugcaugauuuccuagagccuggaagaggcaaagauaagauucaaacccaggucugccuauccuaaaaccaguggucuucacauugaagggccuuauguagcaccgagcucccaguauguaacuuaacuuauauauaacuuaacauucuguuuauguuaaaaauucaggcacaggacuacacccagggacuacugcagaaacguuuucuaaauagcgccaacgcugaggggucuucgauugguggcacccguguuccacgguacagcuaggccuucugugagaucccuuuccccuuaauacagaaauccucuaaguguauucgaaagcaguuguuuguaauuggaguaucugggauugacaguggcuuuaauuaguugauuacuaguucuuuaaaauguacuguacucacugugggucuugcaaauugguaacugguagcuaccaguguaauuaaauauuucagagcacuuggcuacaguagcauugaacugugaagaaauaauguuguacagccaaucaaaaagagauacuuguaaacucauuuacagcgucaguguguguuaggaccaucauugagaugcuuauugcaggagaaauuaaagauacaauuuugugcuaagaggcaauguagaaauuaguucccgaauuacuuguuaauugauuuggugauucccucgggucugcaugcuccuuuucccccuuuuuguuguugcauucaguuaacagugacuauucccagagcaauaaaaauauauuccacauguagaugagaugugcccuuauaugagacggccugcauucuuucgcgguaccaagaaaugcucaaccuaaaacacaacuguguuuuucucaggcauauuguuguuuuauguauacccaucaagguaaccggugcauucacggguuuggauaauuucaggaaaaggaaagcauguuuuuaugucucacguuuacaggcgcuuuucugauuuuucuuucccccuaauggaaaccuuccuuuuuuuaucaacaguggaggagauucaggagacuugauuuauggaagcuuuuucuuauuugcaauucagcaagaauaaccauaugaaagaccauuuguagaaaagugcaaauugcuacugaaaaugauauugaaagaaaaugagaccuguuucuccuuguugaaauugaguguggauagaaggagagacagccaucgugggucagagggagccucccaggcuuccuggaugcaggcucccgucuccagaccccuuccuucuugaccgaggggagaggacacugaaaugaugcacauauuggugcugcuaaugugaaagaugcagaaaccguuauccuuuugaauuuccaguggaagauccaacgacccuuugaacagcugccaccaugguggcuguggcuucauuuugaggaaaacauuuuuaauaucuuguuggccgugcuuauggccugaaaagcagcauuaacgaguuuuugaaaacuauuauuauucauuuuaggccaguccguuauuuuuuucuauugcccuucccgugaucacuuaugcauauaaauaucauuaugcuuuugcuuaacuggggcaaaaaucaugugcauuauuucagugucugcuuuuaaaaguagaugguaguauuuuauuuucaguuaggugaagcagaaaaauguauccagcaaagucuucauuaaaaagcuuaagauggcuagaacuaaauauacauugaacacaauuacuaauuuaucaaauauguuugcauguuggucaguauauacaauaaaaaauaguguuuaauuugaaauguuaaaacccucucuagguccaaaaaauagaauggaugagaccuacuauuugauagcacagcagggugacuuuagucaguaauaacuauacauuuaaaaauaacuuaaaagagugucauuggauuguuuguaacccaauggauaaaugagaggauggagaccuuauucuccacagugugcugcuuucacauugcaugccuguaucaaaacaucucaugugccucauaaauauauacaccuacuauguacucaaaaaauuaaaaacagaaaaaaaaaaauagaaacccucucaauuguugcugcacccagcguggaagaggaggugugcgaaaccaugcuaacguggcgccaugcccugugaugaaagagccaccugcuuaguuguuggcuccaguagaaggagaaggaacacaccguuugcuuacuggauggcagagcguuggcaugcucuuuaucccucauagauuccuuucagguuacccccaaauagggugaccuaguuuuccucaugagcauggcuuauuaagggccccaaaagucuaaccucugccaacucagagaugcugcuugggcagauacagggccugagcagggauaaggaaagguaaccaucagcugcauaaccaugcauuugcagguucauucuuucuacuuucgucuccguugcuccguuucacauaucuuuuuuuuucuucccccacccccacuccuuuuuuugagacaagagucuugcugcucugucacccaggcuggagugcaguggcacgaucucggcucacugcaaccuccaccucccagguucaagugauucuccugccucagccucccaaguagcugggauuacaggcgcccgccaccacacccagcuaauuuuuguauuuuuaguagagacgggguuuuaccauguuggccagggugggcucgaacuccuaccacccgccucagccucccaaagugcuggaauuacaggugugagccacugcacacggcuugcuuccccauaucuuuuuaaaaauguuuuuuugcaacauuagccacccugagaguuucuucacgaaguuccuguggagguggcuggcugucuucgucacuuuucuccacagaauguuucuaaaacacacaaauuuggccaaacagccuccaaagcaaugauuucauaucuccuuccuccuauuguucacuaacuuugauuaaguuagagaaaaguaccugcacuuuucagauacgguggcuccgcguguuggagaauucaguaccagauccauggcucauccuaagcagggcaaggaggaggggagcucuucaccccugggcggguuuguagugcggcuugugcgucuccccagauugcagaggagaggaaauacauccccuucaagaugagaggacacagcugcaacgucuuauuuuaaaaauaugugugacuuuuacuuucugcuucauacaugcaucacguguuugaauauacuuucuauuauuugugaguuaacauugcuguuuuucuccaaguguuugagugaaauugauucuccacgcagacucuccuugcucacccugagguuucagggcuuugaccugagggcugagaccacagggcacagcuccugacccacguggcugaagggcuuggagcaggagguaagggggcugccggcguagcuccaaggugaugaauauuucuacuugauauuucuccugguauuucugcacuuuaaugacuauuucuacuaauacuuguacuaauaauuuuuaaugguucacauugaguaggugacauuuugauacauuaaugagccuuaucaaugacuuuuaaaaguuccuuagugugccaggauacuuugcugcagcccuuggaaggaaggggagaggguguggcuguggcccccauucuacccucugagcaugagucacagguggcacgccuaagaguaacauccacggcugaaucgucaccggcauugaacuacacuuccaagguuagucagggaggcuuuccuuuaacauagcuugcccguacuaaaagcugucagaauacuggagaaauguaggccuugaagauagagggguguuuucagggguggcugccuucacucuggaaugcuuugcgccugcugggauguugcuagcaugccuguggggagaggcccggagggcugggcugcgagggaggcugcacuggcuucugggaagcgcugguuucuggagcaggccagccugcgggacuccaggacugaggcuugcccagccacuguggguccugacggugcaguaggggcugcauuuugacagacuuacaacaaguaucccagagaaagaugagagcagauggggauccugaauuuugguuuccuggggacaaauguuuucuggcuuguucucauguuucugggaaauaaugggauuaaauucgaguaucuuucuuggcuacaggaauugauggaagaggaaguauuuugaacucagugaaaugagcauuccucugcacuaggccgaccccuuucuguggcagcccacuggaacauaagcaccccauguugggaauuucuuuuuuuggucaccaguguaucccagaccccuagaguagcucucaguaaauauuuauguaaugaaaaaucucaauucucacaaccaccuuaggagggauaauagcauaauccccauuucacagacagaaugaaugcucagagaaguugagccacuuacucaaugucacucagccugggagugguaaacuaacacuuaugcauuguauggaacugcccacgagucacguuuguucuaugagaaggcagaaaauaccuggggaggucuugcccagggguguguaugucuuaauugauaaaccucuggaauuggaaacguagaggguaguccaggguagaauuuaggcucaagcuuacuuugagagcauguugcccuaagaguggaaugucauggagcaaauuccagaagcuuucgcucacccagccuuuucaaaguccaucccaagacuguuggguccacauguugcucggaugucaugagaugucccugguugacacguugaggacacgcuaaaccacacgaagauaaugggugucauuuugcaugacucacagcccuuaccauuugaacgugcaauggaugcuccgagaaagaacagaccuugaguccucguuuguaagacacagcucucagacgcagccuguccagaguucugagccucaguuuugggggucaggugucauugucuuaagaugcaguuuuguggacugguacagaguucagucuaaggcagaugucucucuuuuauuccuguugucuuucaacauuugggcuacuggguagaugggcaccagugacugggcagauuggcaccaggacuuugucuacaaccugcguuucccuguuuguucugccauggggcaugaggcagcgccuggcugaccuuggacuugcaggcagccucugugcauccccuggccccuggccuuguuguuagauggugcauuucguuuucuggagagagagagagagcuggaccacuguggccguugucagaauuccacuuucgucaucaaggauucauuuucuuuauguccguaaugugauggggcagcauuagcagucggucaccuguguuuccaaagggagaaguauuuucaggauguagagacuguggccauguuaauaaccagguucuaacuuuccuaagaacccugagaccuugugagcaagaaagggcacagcauuugacaucugagucaauccuggccaaauguauacugaauugccacuagagaauucaccaccacuccugaugaagccaguuggguaguuuuccuucacuugugaaaaauuaaucaugauguuagcuuguuauauauugcgaagagauuuuuuauaaguuggugauagaugauuuuuaauuuuuuggacucucuguauuucuacaucuucuuugugggaaauucuucaaacuccaugggggcuuggugacccagccugaugguaucguccauccuugcagcaguggguggccccucugugcugggcucuguggaaggcgcagauagacaggaggcugcuuggcccuggggaguuugccgugcaggggguggucaaggaccagagaagguggugugaagaacuggcaauagagagugggugucagugggccgggacaggcagagcuucaggaagugacaaguagucucuggggaccggcacaucuggacauggacagucaaaggaagacugggggcacauggggaccaggacaccuggacauacacagucagaaggaagacugggggucggggugggacagcaugaugcagagcuuuggcggcuggcugauggagucguucucauuugugaagacacuguccagggcuaaggcaguacuugccaaggcaaggccaccgugauccgagacugggaggcccagaaaagaugcagacaagguaggagucggcucugugugacuuccccaugacaccagugggccaggcuacagucaccguuugagugcccguggaggauugguuuacuuaguaaauucguuguauuuuaaaagucagauggaauuugucuucauauuuugcucaugucagugaggagauagaugugugcugucacuuagcaguguccacugucuuucuucaaaucaaggccagugaauuuucugauugcaggcacuucaaagccgucaguuccauucauuguuuuucaaaguauucauuucauuaaacaucccaucagaaagccucugauagagggugcccucucaucagguccgugugcaccaggaaguuuacaguucagaaguguugcaugcugagcacucuuugugagauacuuugggggcucagggggcuuggaguuuauuuguugggggaagcaauguugguaggggguggggguugcaccuugagguuucuaggccagcccaggacggugugcggccccaagccacuaacacagcacuccuaguguuccucacagcagguggaaaaugcauuuauaagauauuucuuccucggaauuuuuaagugauuuuacuucuauuggaugcuguugauagccucauucuucucagguccaccugucgguaggcccaguagucaacuccuaacuaauagaguaguuauuagcugguuaguugucugcagcuaagcaggaaugggacuggaugguggggacuccugugagaaugcugaugggugccgccuccucaccugugugucgcagguguaggcgauaccugggaagccguuguacggggcuggcauuugcuacuuuuauaagaugucacaagcaugacccaggagcacaccccaugagagucacagugguaccagcaccugcuggcugcucucugcacugaugacagcuguuagggaaucacauucgagacuuuaacuagauugguccagagugcuucacucuucuucuuuaaaaaaaaaaaaaaaaaacaguaaacguucuuuuuuagagcaguuuuaggucacggcaaaguugagcagaaggacacccacagccuccgccauugucccccacagucuguugcagccgaugagccugcacugacagcacugucacccucaguccaucuguacuuuaggguucacuguuggaguguguucugugaaucuggacaaauguauaaugagcuguauccaccacugcgguguauaggaucauaagaaacaguuucacugcccuaaaaauccugugguccaccucuucauuucccccaccgccugaaaucacagaucuuuuuacugccucuauaguuuuuccuuugccaggaugccauagaguuggaaugauagagguguaaccuuuucagauuggcuuauaucacuaauaugcauuuaagcuuucuccaugucuuuccauggcucaguagcucauuucuuuccagugcugaguaauauuccauugccuggauguaccaugguguguuuauccauucaccuauugaaagacaucuugggugcuuccaacuuuuugcaauuaugauuaaugcugcuaauacacauuugggugcagguuuuuguguggaccuaaguuuucagcucauuuguguaaauaccaaagaacaugauugcuagauuguaugguaagaauguuuucaguuuugcaggaaacugccaaacagucuuccagaguagcuguaccacuuuuuauuuccaccagcaauggaugagaguuucuguuucuccacauccugucagcacuugguguugucaguguuagacuuuggccauucuaauguguguauagugguauccccuggucauuuucauuugcaguuaccuaaugacauauaauguggagcaucuuuucauguguuuauuugccaucuguaggucgucuuuggugagguuucuguucagaucuucugcucauuuuuuaauugaguuguucacuuucuuauuguugauuuuaaggguucuuuguauguuuuggauaauauuccuuuucagauguguuuuuuauagauauuuucucccagucuguagcuugucuucucguuuucuugaucuuucuucuuuucccuccuaauaauuguucuccuucaagguucuccagcuuauugauauguuguuuagguaggucuugggcuucauuuugccuguaacauaucauuagcauuuuccuuacaguuugauaaaauuaauuucaacaauuucuacacugugaaaccuucugagugagcacauccucaaaaucaucaacucuuccgaugagauaauugcuuaggagcauauacaguucuuaaaagcacuuuuauacauuguaugaaauguagaaugggugacauuuuauaaguuauauauuguagacauucuagacuucauugcagcuaauaagcauccaggaaucugugaaguucuuaugaaugauaauucuccccauccugugucagugcuaauaacaucuguaauuaacagcuagggaagucguugccuguuggcagcugugcuuauuggcugaagugaccacgugcaaaccaagccuggcugagccuugggagugaagggauguucaaacccacagacuagaaggcaggugggcagcuggcacccagaucccauggaucaauaccaugugugugagagagagggugggagagccuagcugccagaaggaggcuggucucuccccugcuucaugaguguacaacaggagacuggcagccccaaagcagcuaguauccucugccacugcccugaccgaggaccagggccuuuggcucugagacugugugacaucugauggccagggcauguacaucaucacaaggaaacaagaccuggagggggccggugagccagggagcaugguagaagagacaagccggagagcagcuggcucuggaggggcacuggcaggacccgagggugcaggcagcaagcaggcuguugggugcugcaggcgcucuccauuggagcagugcuguggaagcaccgucggccugccgccgugcugagugaugccagggccacgacagaggcuggcguaggcacgggagcgggaccacacguggccaaaugagcaggaaggaagggacagggcaggauuauuuuagaaacuuagaaaaaucauaccugcuugcuguagcaaaauuagaagauguacauggacaaaaacguagaagucaccccuuaaugccaguacuccaggaugaaagugguuauccccauaguuugcaccccuguucaaguucacucucucugaaacaccuaaaccacccacccccacucuccaaggcccucaugcucaccuugacucuccucaucaccccgcccccuccucagagugcuugcuaaugucacucuggaucccaccuauccuggcuuccauguggguagaaaucuugacuuuucguuacagugaaugucauaaaaggugcucaagaaauauaucccgaaugaaugaauggaacaauaacugguaaaccuuuaaagauauuuaucaaaugggaucccacuacaaauaugguuauaaaaugggaucacacacuuacaugugugcauguuuaugaauacauguguauaacugaaacaaauguucuaugaaaugauccuaagugcaucucacuccaauccuccaaucugguuuuuuuuuuuuuuuuuuuaaagcucugguugcagcucacuaaaguaauuucaugacccacuaauuaucucacauauuuuguaaaacucacauuuuuuuuguaaaaaaaaaaaaagccaguagcagcacuggcucuuuguccaguauugacauguuaacugucauccuaguugagccagcccccuccauguaggccagucuggcgaaauccagugcugugucucuaugcaguccacgggcacacugaguucucauuugcccgguuggaacagcugaugguuaguucucagcgugaucaccguggucagaugggcgccccauguggugccuugugggagaaaaguuccagguuuucuuuagcuacuuccacagguacacagaggugugcuggccaugggguuugugucucugcauguucuuccgcauaguaugaggugcaggcuuuuauuucauagggacacaccagugucagacagaacauggggacaagaucacacugcagauucagauaugccuucuguccuuucaaaggguguauccugguucauccucugucccugccugcuggaauaacugcuucccccgcugcguccuguccucgugcacccacccaggccacagagcccggucugugagcagcaggagggcagagcccuguccuccucugcagcauaacccauaauuauggcucuuaauuuacauauuccaugccugccuugagaaaauauuuuaccuggaaugucaguuuuuuggguaccauccacuggaguucacauucauuuucaccaguuguucacuuagcagaccauuagaaaggaggucccugcgagguccccgugagaggauaggaaaaugccauuuaaauaaaaggucagcaagagcgagagucuccgaaguuagacaggcauccggagaaagguggauguggaaagugagguugacuucugggcgcauguguggaauauccaggcccuuagaggcucgggucuagugguggaggaugaggccccucugccauagggagagccugucuuaaucacgccacgcagguggaacagacucuaugcagaaaacuugcggaagcauuuugcuaacaucacgagaacaugugauucguuaguuggaguggacaggaaugacuucagaaaccagagcagggagucucgcuuaaagucuuggcauccucgccccucggccucacaccucccccguucccgauucucuacuuuugcucuccccgauugcacaguagccucacuggauggacaggugcccucaguguguuccccgggcaugcguuucccacgcugagcucagagguagcuuucaguaagugccagcuggauuuugucacuccuucaguugcaaucuucaguggcuccccauggccugcaccaaaauguuuauaacccuuggaaggugucagagccuguacaccccaacccuggucuggucucagauagucuccccagagcucccagccaucaacuuucuugguuuucaaauacacaguguaucuugugcugccacaccuggcagagaggcuccucagcuuggagcguuuuucuuccuucaucuacgucuguguuuuguaaacuugucaucuuuucagauguugcucauguagccccucucuuguguaaccauucuuauucaucugagguguaaguugcccacugccccacccugugggccucuuagcacuuuguccauuacuuuguuaaaguagcuggcacguuguguaagcuuuuccgaggaggacaagggguucauaucuggcucuccauggacacugaguuccuggagauggcugggacuuuggugcuuagcccugugcugggcacuuuacaacaaaaucgugucuccauugcaaaaaguuuguaucauguuaagcuuugcucguguaguuuacuaauaaguguguaucaaagauuaagguagaaaguaaugauuuugauacugcuucuuagacaaagaaggcggcuaacaagagccaaccacugacuggagaggcuccggcugucaccgugauuauuaauacauuguaaugacauuuuggggauuccgccauauuuuguaugguugccagcaaaauguugacaguuguauugugguuaauaaauucauuuagauuuauaagcauuguuuacagaaccuguucgccugcugaaacucuaacagcaucuguuccuucuuacuaauuaacugcuaauuacaaaugagcuuuguguguuugucaguauaacuggcucaugcauuuuguaaggaacauuaacaaauugauuuacauaguggaaaagcaaucaaaagaguaaacugaacagcacaggucuaaagcccuuuagccggcuuuugaaugaagcaaacuuuugauggcuauaaauauugccauaaauuuuccauuaccuuaauucuuugguaaagguacagcgaucaaaagcaauauugagugaguaauacucaaauuagagcacugcagcagguggccgggagugcuggugauggcccugcagaauccuuugggggccgauagaggagaaacaccaacaagugguccuguaggaaaugcauccacucccuugugggaaugcugcugacuuuugaaagcugcacucgugacugggguugcuucagaacccagucacuuaaguacagguucacacugugauaucgaagucagugucucagccagccugcugcaaggcgcuuagccgggaaguggaaaucuggugucugucacacuuuuucuccucuuggguucucagauuucaaaccguguugaucugugucaugcuucagggggcaggcauuuaaaguuaaccaguuuaagugggugauuccaaaaguccagggcuccuucauccacucuucucaaggagcgggagaagauggagacagcccugaagaaucaaguuccugguauguuuucuaaagcucccuccucgagauagagaacuaugacccaggccagagccacaggggcacagacagaacaggaggaacggguuacacuggugccauuuacauucacaguuaacuuucuaggugauucacaaugcagguguaaaacuggagaucacaacucaggcagcuggauggagaguucaaggguuuuuuguuggguuggggggguugugggaggggguugagacggaguuuugcucuuguugcccggucuggagugcaguggcgcaaucucagcuuaccgcaaccuccgccuccgggguucaagagauucuccugccucagccucccaaguagcugggauuacaggcaugcaacaccacgccuggcuaauuuuguauuuuuaguagagacaggcuuucucuauguuggucaggcuggucuugaacuccugaccucaggugauccgcccaccucggccucccaaagugcugggauuauaggcaugagccacugcacccagccuucaaggguuuuuuuuugaaagguuuaggcuaaauaugauuaacagcgguuacauuaaaguaauacugaguacuuuccugagagggaacguuuacucuaaaggauccagauacacaguuguuggccugagcccugacacugauguucagggucagaacagcugggaagguggggagggcugcuagguccagggcccuaagccauggaaggagacccuacuugccagcugugagccucaggcaaaccccuagaccucuugaaccucaguuaacucaggugcagaaugaggaugauagaacaacccucuuccccaggguuguugguggauuaauaagaugauggagucuaccaguaaaggagguggcauauaacaacagcucacuaaauaaguuacuauugucaugaucucuguauuccugugaaaguaaccacauguaaacacuagacauuaaaccuuauuaggucauaguaacuccauaugggaggagagucucuuuucucaucaauaaauuuauuacuguuaauuccagauaaauguuagaaaaaaauuaagcuuaaaaauagaauagauaagggaguacaggcucccuuaauaaaggcuaagagggaaugucagagccgggggugguggcucacaccuguagucccagcacuuugggaggcugagguggguagaucaccugaggucaggaguaugagaccagccuggccaccauggugaaaccccaucuuuacuaaaaacacaaaaaaacuuagcugggcgucguggugugcacauguagucccagcuacuugggacacugaagcaagagaaucacgugaacccaagaggcggagguugcagcgagcagagauugugccacugcacuccagccuggguggcagagugagacuguguccccccacccccccaaaaaaagaaaagagggaaugccaggguuacuuuacaaagcuguaguuuguuuaacacauuuaauugacaaucaagccaucucacaaauguaaguaaauggcacuauugauaaauaacaggcuugccauuggugaauauuuugccuccaaagugauuuugcuaaaaguauguguauauacaguuucuguaacauuucauaugguaggaggaagaagaggcacugugcuuucugaagcauuuauuccuccuuagaauuuuucccagggguaaguguucagaaaaucugaagaauucaaaauaauuugcuccaaaauauuaugaugugauuaacuacguauuguaccagccagcauuuacugaccauauguauguauuagccaccaucaguaguuauaaaaaggaaauugauuuagugagauacagucuacacuuuuaaaaacucacaaccuagcaagaaagucaggcuugucucaguaacugcugugcagaucugacuguacuagguaugcacuagaaugugccaggggaaccccgaagggaucauuugcuucgcuuuccauguguuacauccauccccaaccuucuaguauuuucuacagaugacauuuagugaacagaaagccucucucucugacccuaauugauuaaagacuuuuuuuuuuuaagaagcauaaauuagaagugaacacaacuuuuuggacuuacaagugaaaaauccagugccuaagacuuucuggugaaauguugccgcucgggaauuucaguuggaaacauaaagccauucauuaagcuaacgcggguguacgugagguuuauucaagagauaaauugcugguguguugguguuuagaacaucaacucugucggauauuucaugugaccgaggucugagcaucagaauccaugcccaugccacugcucuccccaggggccugagucugcauuuacugugaagcaaucuuuuauggaaaaaacuugcaaaaaauagaaugaguuugaaauagaaagucugagaacacaaaccugugcuuuuccauuuaaauauggcacaaggagaucccaaagcuguuggaccagugauuuucaacccuggauaugcccacgggugugggcgugcaggcacacauacacacgcacacacuccguccacggagggucagagucacacucauugggccuggguggggcccgggcaucuauucucuaguguuucccauuuaaagguguucaucagaaucaccuggagagcuuaaaaaagcaaaaagcaagccgggcacaguagcucaugccucuaaucucagcacuucgggaggccaggagcucaaggcugcagugagcuaugaucgcacugcugcacuccagccugggcgacagagcaagaccccaucuuaaaaacaaaacgugauguuggaggagccagacucuaggcuuugggaaggggcuuuccuggggagggcagauuuguugagaauccauuuucccagcgaguucguuuccacccccuuaagaacaaccacuuuagaagaacauuaggcagaggaaaggggcuccuacguguaccuccuuuccaggagaugugggaacaggaggaguacuugccuuuucauacaugaaaugguuuuuuauuugcagauuaucauuugaaagacauuuugguagccugauuuccacucagaaauagaugucaccaacacaggaugagagacucuuauaaagaauuacgaacuucuguuaaaaugagaaagucaaugaagggaggcagcauacccagaaaaggggaaaauuaaaaucugaaauaauuuaugaggaaaauaauuuuccaucuaagaguguauuagcuguuuauucaaaacccuugaugggaauguuuguaaucaggucauauugugaucuucccacagccugugguuucuguuuuuccccuccuggccuuacaguuaggggaguuagggcagguucccuccagaggugacaccuguugacaaccagucuuucaugacagcaagcugcuguccauucugauggcuucagccucugugcauucugauggcuucagccgcuguccauucugauggcuucagccgcuguccauucugauggcuucaguggacauugcagugaccauuaaaguaaaguggcuuagagacauaacacggcgacauuuauguaggggcagagaagacaaggcuguuccucuccuuguucucaccuuugcccagaaaguguuagaaacagccucuuccuuagccuccuuuucuauacuucucccuuuagaagccaugcacuguggugggucagaucucaauacucguggguccguguuguccuagcgguaccauguuguacuucagaagggccaugcuggcugcagaauggaggcuguuggagggcaggagcccaggcaggagguggucgguagagcagcauucccagagagagccuggugggcucucagaguugggggcugcaggaauggaaaggagaagacauaucuggaggcuuucggaaaguagaauagauaggaccgauggacagguugauucgauguggaggaugaaggagaaagaagaguuuuuuuuuuuuuuauaaaugagggacacuugugcugaagguauguauuugggaaucauacagaaauagccauugaagacaugagagagugugagauccaggaauuuggugcaaugagagcuaaggaccacugguggucuuaggagggacaaaggcagaauccccagaaagcaaacaggaccagagaagcgggaaagaaacuugagagacuguucuccuaggagaacaaaaaagaacuugccuuuugaaagagggagauaaaguaggaaaaggacuacagcauguccauuggcuugugggauggaggggucuuugaugacaucagggaaaugauggagcagaagcggcggcagggcuaugaacgaugagcaggagggagccacagcacagcaaguguagacaccgccuaggagaggcccaacugugaugcuaaagggaggaacaggucuagaaguuaucgauucgcuuggaauaauaaaugauacaguggcgaacuguuccagaaagaaguuaccaacagucgccgcucacuaggaaacccuagaguagacguacauuugauuuaaguuaguagcuuacgggccugaugcgguggcucacgacuaauccccgcacuguaggaggccaaggcgaguggaucccuugaccccaggaguucuauaccagccugggcaacauagugaggccccaucuguacaacaaauaaacagauuagccaggcaugguggugugcaccuguggucccagcuacucuggaggcugagguagaaggaucaccugagccuagggagguugaggcugcagugaacugugaucucgccacugcacuccagugugagcugugagagagcaagaccaugucugaaaaaagaaaaauuguagcuuaucauuuagcaauucauaaauaauuaccuguauuugucaaacacuucguacauguuaggcauuguaauuuggcuuuauguuaugaaugcauuuaauuuucaccaagggacgauuccuuccagacagcucugaguuucuguuuuccuugguuguugcugagagcauaaguuauauuccugccuauaggcucauccaggccgcauuuccuccugauuuccuguuuccucacccguauccugcugcucucucucuuccccugaagcucugggaagucuucccuacacgcucauuagugaguuaaggaacuuugaugugucuccguguuuagaagaaaucuugccgucaccacuccaugcagacgcugggauacuaagguuuucaccugcugcuuccugcgggaugucgcucauguggaggagggccucucguuggaagcccaggcucacuccauggcugccccucuccccagccugcuggcguugggcuuccuccgcuccugguuucuuaguucuggagcacagacuccgugcucuggagcaagaguucuucacugugguucuguagauagaauucagggguccgcgaauguggcuggggggaaauucauucguauuuccacugacuucgacugaaaguuaacguuuccuucagauaugaauguaggcaacgauccacagugguguuuuguuagcagaaccugugacuuugccacccucaaaaucacagacauguucacagcgcauugccguugucccagauaauugaauagguuguuuucucuggucaccguuuggcaauggaagguacuaggucugccacugggucucagugcauuaauaaagcagugugcuuauuacccagccacaggcguugcuuauauuuuggugacuguauuuugauaugauugguucuuuuguaauccuaugaauuuaaaccuaauacuuugagaagggauccuuugggacgugccaaaaaagacccaccuguagcaagccuccauguggauuugaguuucuuacccuaugaauucuauaaacugaaguuuucaucccaugugucagguuuguuuuuuuuguuuuguuuuguuuuuuugagauggagucucacucugucacccaggcccgagugcaguggcacggucuugguucacugcaaccucugccucccagguucaagugauucuucugccucagccucccgacuagcugggauuauaggcaugugccaccaugcccagcuaauuuuguauuuuugguagagaugggguuucaccauguuaggcaggauggucuugaacuccugaccucaggugaucggcccgccucggccucccaaagugcuggaguuacaggcguuagcugccgugcccggcccgugugagauuugaugugaaguugaggacacgggucuucauaaugaaacagaagugcucauuguccuguugccacccuugucgguuuuucacccugcagcccuuugagaccaaaucugccugugaagucgcuguucaucccugcaggcucccuguacccccagcucccagaacccaucaccagcccuccuucuuagagaguggucuucgggaggaccugagcuucggcugcggccuuccagcccccugggucucacugcuugcugccuccccuuucucacccacacaauucuuuccuucccucccucugucccacgcugugucccuuucucuuccuuucuuugaguucauuucagaauuccuccucggugucugcuuauugcauggcacggucugguugggccccacuuucuuccuggaaagguauuuucuggggccagggagcaauguuaccauuuccagaaaagcaguccagcuccuccugcacagcacucuuucugcugugggaugccuccgccucccuucguuccccauuugcagccucuaggugcccugucuuggccagcagcacuugccuucucuuccccaucaucuguggucuuucugcaccugggcuccccuccgcccugcaucugagaucucuguuuuaaggccagcucucccuagauguguagccacugggaucuuuuucaucucaucagccuagcucccggcaggaccuccccacuggacuuuuccaagaugucaguggacagcauagagcuggggugccaguggccaccaucgggagucacugccacauuuucuuuuccuuuuguguccacacuuggcacagaaucuucuuccaggcagccuccugggccgccagugguguggagcuggccgagaaaggagccugcuucccagcauggccucacauugucaucagugucacucaggaccuugcccgcugccccagcucagagcuugaaccucucccucuuggaaucuggcaggaguccccaaaggaccacccaggcucagucuuggccccauugagucuguccuccccacugcuaaugaagucuuuccugcugaaagccuucugggccauccauugucugccugugagaguccucggcuugcccccacaggccuccccugccggucuggagcucagcuaguggcucucaucuccacucccuguccaucuugaauguucuaaacaacgaauuaaaauguuuaacuugaaugcaggagccaggcagguacuugucaugaguggguuuggagggggcaagggucugggugaacagggagggcagcucccacccacaggggcagccgucccucacuugcgcccuccucagccucaguggccucguguucccggaugguccugguguugaaggaaagccaggaauuuggauuugcauauaaaauuuuaucauuuuuaaauguuggcaacugauuccaaaaaucuauuaugcacuuuugggggcugaugaaaaugcuucugcagacuagaaauaguccccaagucaccaagauggcaucucugcauuaaacccacccccugaccuucccacgaagcuccugcagcuuggcacggcauuuaaggcucccccugaccgaugucugccucccugucccagcuucugucucauccacucccaacacccaagucccuaggcaucugaguggccuccucuccgaaccugggcacacaguguucuuccauccaucacucauccaccuggcugguccugcugguccaagacauagcguuggugcugucgcccccucagaagucuuccuggcuuuccucucccuggcccgagggggugccucuuuucugugccucaucccuucauucccaagauggccuucuguaagacaaacauuguagcacccaucacacuggguaaugauaauuuauuaccuuugccgccucccccacuagacucugauuuuuguaugagcagcaauuauaguuugcuguuccuuguccccaggaccuaguggggucccggcccagcaguggggcuccacauggcugaauugaacagucaacaaggcagccuccuaacaaguccugugucauccuguuuagccguucgcucaaacagagaacuguagauggggcugaagcuuagucccaagagccacacaugucaaggaaaucugggagcagcagcccagccaucccaggaucucacaaaggcccagcagcaaguacaggggagacagccagaccccugcacaggagucuagaggcugagucuguaacuaauccagcucagaccacauguauggugugcucaggggacccccagagcaaaauccaacaccaugcuggcuucugggagugcagauuuugcagacauggaagcagaaaaucauaugauacccugaguuccugagucagcaaacggaaugggggaaugagcauuguucagccagcugggcgaacccugggcuuccugaggacaccccauucuuagcuguggggucaccacuauccaccgacagcccagccggucgacagcagaccuuuccuuccaguuauuccuuuccuuccaguuauuccuuuccugaccccccccccgaucugcuuuuuaauuucucaguguauguuuucugguauaaucugcuugucuuugccucucggugacauccacggagucacccaagucaccagccgggacuauuccugaugucaucuauuaaccuucuccagcugcuccgagauggucaccaaguccuucuucccuuucuuccugagcaucugucccgucgugcccuccgaaggagucaugcaugugguuuggggccuggauguguguuugggccuccucacugguuuccaaccuucagucuguagcccucagauaugcccuccuuccugcacccccagaguggccccuccacucacccuucagcugcagccacaggguugaaaucuuucccaggcccuccagaccuccuggaugaggcuuaaauuuuaaaaauacuaaauuaaaaaaaaauuuuaauuucacuauauucucaaacuucucaccauugcaguuaccauauuuuacugagauuguauauuuagaugucuuuuucuccauaagucauugaguuugaaagagacauccuuguaaaucauuuacuggacuguuggaaauuucgaucuaggacucagaaguuacagaagauuuuaaagaaagucauuuguaaauucuuacccugagguuuauagacccuugugaaaugcaaaauggaauguaagaguuugcauguacaucuucucagaagagguucuauggguuauuuauuuauuauuuauuuauugacagaaucucacucugucacccaggcuggagugcaguggugcgaugaucucagcugacugcgaccuccaccuccccaguucaagcgauuauucugccucagccuccugaguagcugggauuacaagcaggcaccgugaugccuggcuaauuuuugguuuuuuuuuuaguagagacgggguuuuaccauuuuggccaggcuggucucaaacuccugaccucaagugaucaucccaccucagccuguaaaaguacuaguauuacaggcgugacccacugugcccaaccuauuuauuuauuaaauaauuuuuuguuguuguuuuuagagacaaagcccaggcuggagugcaguggcauaaucacagcucacugcagccucuaacuccugggcucaagugauccucuaaccccagccuccccaguagcuaggacuacaagcauacuccaccaugccuggcuuuuuuuguagagaacagggucucacuaugugucccaggcuggucuggaacuccuggucucaagcaguccuccugccuuggccucccaaagugcugggaugacaggcaugagccacugcgccuggucugguuccacaguuuugaagagggccuguggccucccccucuuccccauccuaagagguuaagagcuguggauugcuugacaugucccagguucgacauguugagcaaaaugcuaggaggguggugcagaggccaccguggcagucacacagguagaccagcaagcacuccaagacucagcgacuuuuugaauauagaggcuuaaagguagaacaucucaugagacuuuagguuucgagaaugggugccuguaagaauggugguuucauuaacagaauagcaaacuaaggaagaaaagaugguuugguucagaaaaaauacugcuuuagaaaggaaacugggacugaaaaacggccaucuuuuucauguauggccauucuggcuuuugacucuaucccaaaauacagaaugcucuuucuacucacugacucuugcuuucaauuuugucuaaaagaaaaaugauucacaaugaaaaugauguuguuacacaguguacauacucaauauuaaauucauaaguaaugugaaccacuucauaaauuauuuagguugaaguucauuuuguauagaaaauuacaucuuugaaaagauaugacaggguuaaaaugaaucaaguuuaucguaaaacuguucuagccauaguaaauuaaucugagucauuuuaucaaauaagaaacauuuuuaauauuuugacuauucaucacucaagcaguacagcugguguuacugaagagaucauuucuauuucaguaccgucuguagauccugaaacgggcgccuuucugugcuuguuugccacgacaguggcucucguacacgacgccuaacguguaucucaugugaaggugcagcccaagccaagcucccuggggcuccguuuuccguuucuugaccaaggauggcagaauccccaggaagugcuccuguuccuggcuuguguuuuacaugauggaucuuaccaggcggccuuggaagccacuucucacaccaggguuauaaaguccuauguuuucacagucugguuaauacaaugaggaagaauuaaaaccuuuggcauaacaaagcuuuuggucaguucuauaagcaaaugccauucacagccuccugagugauaccuuuuucuaggcacugcuugguuucugggugcccuagacagggaguaucccaccgguuacacucucugucacucgccaucauccugaggaugcuguuuccauaagccauggcucauacagccguccccacuccagguuaaggucccuugccuggcuccucacagugcccugggcaugguccuaucuuggccuagcuuucacuaaacugcaucuguccguccaccuauuagagccaccugccaguguugagccucuuuagggauuggccugugcccucaucacuccacccacacccagcacaguaccugggauagaguccaugcaagguaaaugaauaaggaacaagguccuacucagaggcaaaucucuucuuucuaacacugggagcuauucagcugccuguaccauaucagaacaugcuuaagaaaaagagggaaauaauuauugucucaacaaagauuuggguuuagcaaaaacuggaaauaauucacagugaaacuaauaauccauugauugugauguccauggugagaucauuacucucgagaauaauacugguaauuuaguuugcucggaagguacuauuuucagaguacuuuuacauuuuccaaacccugcuguguguguugaaauguaaaucacacagcacccagauaaccagaugauuuuccucguccuuuuaacagaaagaucaggugagaacacacaguugcaccuugaucauuuagugcuuuaacuuuuccccccagcuaguaaguauuugaggaguuucucucauuugggcucugaaugcuuuucugauaguggggaagguuuuaggaauuguauucggggcugcuuuguuguugcuccuuccugcccaucucaguguuaaggguugucaguaucccaagacugauuucccuguccguccgugugcuuuggagguauccuggccauguuguuccuuaaagcucuaaguagaaaugacuuuguuccuuggcacuauguuaaauuggcugguuaauucugguguuauuuacccuguaauucauuaguuucaccccaccauuggcagcugacaggcuguaauuucacgccuugcaauaaaagaugucucauaaucugcuucauuuagcagcaagagaauuuaaugaaauuaacugcaguccuaauuaugccagugaauacuaaagaccgccaucaaguuuucucagaaaaggacgagguccaacucgugaaggauuuagaauauaauuuccugggaaaaguugcaagugucuuccuucuauuggccaacgagggccaauuaugaguacacauauuacuauaauuaacugguuuuuuugugaaugucucuccaaguauucauuguucgaaaucaaauguaaaagugauuucucuaucggagugguguagaugauagaaacaagcuaauguuaaguuuucaggcagugaccucuccugcaguggaggacagguuugcaaaacaucacaguuugagagcagguuuucaugugugacucuggaggguuucuggagugagcagaagcccgggcccccuuaugccuguacgcucagagcucagccucugcagccacgacuucuccaugcugcggggaugcuaggccuggauaaggguugccaccugcugggcauggaguguccagccucacccagccccucgccuggcccuucucccuuccucauggccgcuagggcaagcccucacuucuccaggacagauggccuuucccugcuccaccguccacucugcuucccgccccuggaggggaggaagacgagcauggucugggcgcccagugcuccuguccccaucucacacauguguggaacaagccacucacacccugacaugcuccccucucccucucaccacgacucuuucuugguccugccuuucucacuuuucccucucagccuucuucauagccucuuccucuuccauggaggacagggcagaggaaagguagggaggagcauugaugccuccugagcaggucuggccuggcaccugccuuucccacccaccccacgguguccuggccccagggcucugcagcccacagcaccucuuaacagugcuguggacaaauuccggcaaaccguggguuaguaaccggacgacguuagcaaacacagaggcugcaguugagccaaaggaauggagauucuggaaggaagaugugcguguuccaacucugcagaaaagcagcugaagcagugggagguggucuguuauaucuaaaugcaauggaaaucuccauagccacaagugacuggccucuaccucucuuccaaucuugcucuacuaaugcguggccuuucuguaguucugaaaggagccaucuccccuggggcagugccugauguggucuccuugguccccuugguccuagcaccucugcauuaugcacccuggcaggacaucagccggcuggcucugccaccccgcauuaguguccaugcaccuugguggagaagucgcucugagcagcucugauuucagaggccucacuugggaaaugagggugcgguguugcuucuugguuuccuaaggcugcuggcagguagggcuuuacaaagaaguacuuuaggacauuuuggaaugagcuguuguguauucucacaaaaauagcugcuuuugcaaaaaguuuuccuguuucuagucacccuucgucuuuaugccaucccaucauuggggguggugacuucacacacauuugagauuugaaagcaugaugacuguacuucaaaguuggggaauuccauggcccaccccacaacccacucaugucaagugcauuccagggagcaauggguuuccagguccaaguccaucugggggauuguggucuguggugggcaggggcugacuaaccugcccaagggguuuagcaagggaauggcuguuccgggaccuggcccagcauccucccacuguacacagccucccugcacaaccuacagagggggcucccaggcaggcuguucaugggguugguguucacaggacucucccacaggaagggcgcugagcugcaaaggauccaggagaccugguuucuaggcacagcccaguguuagccuuggacacagcagccaguguuaccaggaccucugagcucacagccuggccuagagugcaaggagccaguggaccugagagggcccuguccaggcugucagugcugaauauagaccaucggugcccaccuggcgcuccugcugcucggucggagcugggagggaaacguggcuccacuacagacaugggguuugggcugggaggccauggaauggugaagaugcuaagcaaggccaucuccugggaagggcagaagcagcuuggccccagguguccgcaugucacccccuuucccuaaacuucacccguccaccaacgcaccaugugccgcaggcgagugaugggaaaauggcccucguuucagagaauuuuuuuuuuaaagcaaaguguauuguguguucuugcaguuacuugcuaccaaugucccuuggguaucuccccccuuggaguguuugcagccggcgagcgccaggaugcccgcggcagcauacucuaggcuuaucuccguguguguggcccugaacccagaacacccggaaauacaagugcaagugcaaggagcccaugaacagaaagaagaagaaggggacggggaagcgccucuugacugcucgccauaaaaauaauugagcugaaauuaaaucugggggcuuugguagccuccuguuaggaaaagaaauaaaacccaguguuuugaugcacaccucgcacgucucaucugcaguacgccagagguaauuuuggcgacaagcaguaaggaaaccugaaguauuucucucccagacccucccagcuuauuaaaagaacuuauagacaugaaaauacauuaaagugggcaaagcggagagagggugaaagagauuaacaaccuccgcugaauagagcccauugaugaaacaggccugugagcugcugccgacucugaaacaaggugccaggaacugaaaagaaggucaggccuguccagaauuuaggggggaaauggaaauguauauuuaaaacuaauauaugccugagugcucauuuuucccccguuucugauugggaagauuuacucgggaagaggaaaaacgguucuguagccgauuacccaauuugagcacccaaauuaaaagauucacuuaaaaugcagcagagacaagcgaggcagcggagaagggcccgggcgugcauaaugccuauugucugcgucugcguuugcuuuuuaaugccagcgcccagcgagggagcagggcccuccuagcgugcgcggagggggcuugggguggaaaggggggggaaccccgaaacaggccgccuuuugacaggcgccugacagguaugggugccuuuggagaucuuuuuaggaaauuggguguuugcgaguacaaauugaagcaagcaugcuguguguguaugugugcgagagaaaguuagccgucagucaaguuuuaucucuuaaugaauagagacugcugaaguaaggguuagguaauugaguuuauaauuaauuagccauaacccucaucagauaaagcaguugugaagaauuuuuuuuaucuccuuucucuccccagggccugcccuucuuuguccuugcacugacagccagcacuuaucucaggccugcuggagcccgugcccgucaguccucccccuggccagggccgagggguggucagaccagcccgcauugugcugaaggcccacaaucagcccagcuguccggggccaugaugaauuagcggugggaguuaacauagaggugaacuccagaucggccgauagcuugcaggccgcugcuguuuguccugacuucagcgcaucucugauagaccuuugacaccuuccaacaaagagguuacaggagggagagcuggagaaauggagcgcuccuccagaaaguucggcaacucacaaaagaccccuuaauuucuauagcgggcaauucaguccacaaaggaaggaaaucaaugagcguuuacgcucuuucuuugaggaaccuuuuuuuaaagaaaaaaacauuuacuggcgcuuugcauguuuuggguacaagcagugguagaaacauaaaacauuaaaauccaagauugagcggaucugucuugacugcguuuuauagacuggaugagagaaaaacgggguaaaauggcucccccuacucugcuucaagauuugaaauaucugacucaggcagguugagugaggaauuguuuuaggaacagggaauguugugacuuucuuaguacugaguuggaaauaaugucaacuuccuugugauuuuaguuguuccuuucuaauuaacccccaggcagguacagauaaaucucucaauacccuagggaugcggcagauaggaagaugugagccuuucuuuuccucuucuacagucaguguuuuauaauagauagauuaaauggaaguuuuguuucuucuuuguuagcaagacuagauaccacuuuuccagaccacccuaugguaauuauuuggggacuuaaggccagaauguuuuaucagacaauaugacugaacagugauuuuggauguuaaugaaaauuuaaucagaugaauauauuauucagccucauuuagggaguaaaguaugauaagugcaucuacaagugcugaaauuuguagaacaaaugaggucauuuuugugaaguaggcugagaacagacugguguguguggaugggggaaaggauggucgcuagcuuguuuugguuuuaaguguaggcuauaccuugaauuaacuugggaaguacuguuacuagcgacagucccuagucauucauugcagacuuguugucagccucccauguggagauacuagaugccauaauugagccauaccuaacaauuccaaguuuuuaaugaagcaaauaugguaaauauguccguuccaggcuuucuuugaguguagaaaaaggaaguugaugcguaggcucaugggaugaccccgccuuauaugacuggauaaaauccaaauacucagcuagagagaguggagccgcuguguugagacaggcacucccccucagccuccccuugucuucccgggcucguggggucaccuccagcaaacccaauuugaaaaccggugaucaaguguugacaacuccugucacagcugagaaacuuaggccuuguucaaggucacauggagaaagaauauugcauggaguagaccccgcuccucccccgcauccaacugaacgugggcugugguccuguuggcucccuaugggccugcucuccuucccucuuuuucuccccgauagaugggaccugugaggccugucucuagcucagcuuggcaugagaugggccacuccugccagcucaccucccugcuggcuauuugcccuucaucacagaggugggggaggauggcugccucauuccagccucagcugcuauuguggcuacaaaggcaaagccagcucuacagcaggcccauuucagcgcauuauaggaaaccagaggcuuuaaacccagaccagcuuggagccuggggcugccgcguccgcuuaccagugguggacuuggggauguuucuuacucuccgagcuugacuugcuuuaucuguuaaguggcaguugcugauggcagugaauuguggagugauagguacugucauggcacgagcucaaaaguggcuguuuccccugguuucgcuuguuuauuauuaguauuauuuucauagaggaguuaauggagcaaaugagaaacaauucuuuauucauucuuaguuuuggagucugcauccuguacaguguccucagaaguguagaucguuucugcugcaggagcccaggacguuuggucagcucugacuucgucacguagacuuugugagagggagggugcuucagaggagggcccgccaugaggucugccuccuuguauuuguuacuucugaaaucuuaaugccaguuauuuuaaacuagggugacuaauggacccuuauuucgugaaggaacagaaaaguagaaaagguuuaaaggcaaaaaaagcugaagguauuugucugugauguucaacaaaccagccucaucaggccccagguggaaaaucggcguggugacgcaugugcugccaucccuugggguggcgcacggaaauggaagcgugaggucaucccugugaucaguaacaaaagucuaccuggaaaaugguuacuuugauuuuccagggagugaguagugugacaggcaugucaaaauuaaucaucaguagauuuauucaaagcuaaaagucaacugaaauucuaagcucucuuugcuauacuacauuuaaagauaauugcuaaaguuucuuuagauguccuuauucauucaguuacagauuuaucauuuuucaaaccaaauucuaaacuguguuacguucaguauguuuuugaagucauaaaaguugaguuauaguaaauuuaaaaucgagcaauuucugcuuuaaauauaggguaucauucuuuccuuuagauucguugcccugaacuuuugauuuugauauuauaaauacacagcuacucaucucauucucuuaucuccacugugcugggaagaccgagaggcugagcagcagcuccacugaauucaagucagaggauauuuguuugaauuggagacuggguguugguaaaugggugacagugacaagugggugauuggggacacguccuugaggcucaugccuuagaggaaaugccuuguuuacccuaugaggucucuagaugcacggaggcuacugcauucccagggggucagccuugucucagaaguacugagaauauuauuauuaucauuauuauuauuauuuucuuuugagauggagucucgcucugucacccaggcuggagugcaauggcaugaucucggcucacugcaacuucugccuccuggguucaagugauucuccuaccucggccucucgaguagcuggaacugcaagcaucuaccaccacaccuggcuaauuuuuguauuuuuaguagaggcgggguuucaucauauuggccaggcugguccugaacuccugaccuugugagccacucgccucggccucccaaauugcugggauuacaggcgugagccaccgcacccggccgagaauauuuuuaaauguucaucucaaguuagcaucacugaagcuauagcuuccucucuuuaguuuguucuuguacccagugauucacccagaauuguuuggguuuuccauauaagaaaaugugauucgcuuggugucaguaaggaagggauucucugacucauagaagcaggggugucaccccaaacagcaccaugaggaggauagccugaguccgaucccucuggguuggggcugccaucaggaucuguacauucucaugaccugugugcuuaaacuugggcccuugagguuccuguccuuuccacaucuaagccagcaguagacucaaaccgaagguccguuaauguccucaucagucgugagcagcucuguguggaccaucugccuguccaguacugaaccaguuccugugacuggggcucauugccuuggccuaggccacauguugacccagaguacacaggccaggaugggaaagggucaccugcccaugcagagucacagguccuggccaugagcacaggaguuggauguaggacaaccaccauaaaugucccuugcccaaguugucaugaaauuucaaaacuucagccaguguucccugcuugacacucagaccugaaggccuccugcaagugccagccacugucgugagcucaggugucugagagcacgcuugguucccacgcugcgguccgguuggacgugguagaugugagaccagugccugaaagaaugccgcuguagggaaacaugaagacacacacacucagccacacuguauuuaaugggccgggauuuguguaagugaucuccauggagacgcagguggugagccugagaugcuacacuuuagagcaggagucauccacucccagauggcagccugguaccagucuguggccuguuaggaaccgggccacacagcaagaggugagcggcgagugagugagcauuacugccugagcgcugccucccgucagaucagcggaggcauuagauucucacagaagugcgaacccuauugagaacggcacaugcaagggaucuaggacgcacacuccuuaugagaaucuagugcccgaugaucuaagguggaacaguuucacccugaaaaccaucccuccucccuauccguggaaaaauugucuuccaggaaacuggucccuggugccaaaaagguugggggccgcugucguagauccuuugacgagcguccccaaggagaccucagacacagguuccugccuugcaggguccugaccccgacccucccguugcucacagugugugugcauguccguugagcagcuucccacccugauugcagcuguuccuuuuuaaacagaaccugcagaaguggauacaccaagaacauggaugcauugcaugucacauguauacauugucuguuucuccacauauacaccauaacagaaaugacacagaagagcaccuccucgguuugccaacuagcuuuuguauagcagcaaauucaaagucaacuagugaugaggaaagacuggaagcagcuaauaauaagcauucuuauguaacugauuugcaagaauguaguacagucgucauuugggaauugacuggguauaaagaguuuuccaguaaaagcgcuggaagaaccagagccugcagaagcaggccuaucgcccugugccauguuuuuugccacacugucugcccauguugggagugugaggcuuauacccagggcugcuuccugggugaucuugggggauuuucauuuuucugguacaggacuggagaguuuaugagauacaccaugacgguacagcauuuaauuuaguaucaccacuucgggagaauguguaucuuaauugcuaaaaucucuaacuuuguauaaauucaaauugaacauaauccagacuauauagcaaucuuuaaugaauuccaucaucaacauuaccacauaaaggaaguuaaguugggcguauaaaaucguaauucaguaaauuuuucuuuaguuaguaagcagauuaguauucauugcuaagaugcauuuuaucaacgguuuugguagcguuaguuaaaaaauguaagaauaaugcuauagaacaugaacauaacauuuuuagagaaguauauuuaucaaacuuuuuaguugcacaguuucuaagggcugcuuacugauuaaaaacauuuuuacuuauaaaaaugucagccuguuuuauuuaagauaagacauugagcuuucaaguuggcaaauugaugggcagaacguauauauccuguuuguacauguuugaguuuaagaugcaguagguuagggggaaaauguuuuaaaaccauacagaauuuaggaaacagaccuuuuaacuaauaacuguuacugagagaugauaaaaaaaaauaugaacuaguucacaaugaauuauauuuuguaugcaugauugucugugauuauuaauugauguguacuuccucuuugucaaaaguuauaauguauccgucuaccaugaaaggucccuagaacaugaaaggugguuucucuacaugccugugaaauugaugagcagggagaggcuuacucauauuuuaaugccagcaguaacagugcucacacccagagaucaggggcaucaaaguuggugguagcaaggaguauuugccacuguaauugacaaauaauaccccucauaaauacugccagucuuuucaauuaguuuucaucuaaaauucuggcuacaaaaugauggccugucaacugacaaugaauggcaaaaauuaauaaauugucuucuaaauagaauggacacuuaagaaaaauugggcagccaauuuagcacagcaugaagcaaggggaacccuuuguacuggugccgggcacuaauguugucucgaucuuuauuaauggugcucggcggcugcugacaguuuuguugcuacuggcaacuuucuucauuaaaauuaaagccagcaucaaauuccauuagccguacucugggcaccuugcauuuuuuuuuuaauacauauuguuucuuuuguuaacucccucuccacccauaagaaguugucagagaaguuaaauggaaggaauuguuugcuaaggccagagaaccauucacuguuguuguggggaaauggccauuacuggcccggugagaacccccauccugaaaucugcaacucuccccccacaaccuccccccccccccccgccuuuuguuccauccccuuucaaaaugggagcauauuaccucuaaaaacgacacacuauuuuggaucugcagcuuucagauaggaacgacuaauugguaugaggccuucuaguuucuuauuuuuucugagcaguuuuuuuuuuuuuuaaaguuccugcuucccuuuucuaacuguauuuccauagcugacuauaccuuaacacaauaguaacucaaugcucagagagacucgcauuuguccggaaggccuuagaguuauuuucccgaaggcauuacuuuuaucuguagaacaaauuucaaccuuugaaggaaaaaaucgagcuuugcugaauaaguucugaacuauugucugaaaagccguugccugcccuucacagcacuguguacaguucaaaaggcucugaaaugccuccgcccuggagcugcuccucuuucgccagcaagaggcaacaaacagcucugauucuaggacaacucaguucuuggcugugcgcagcgccuuccaccagcaagcagagguuguauggccacugcgaaugucucuuguaaaggaacuaggcugggaucaccauccccauggguuaccuuccccucccagcccagucucauaauugcuuucuucuguccucaguaaugcuaaguuuaggggcuaaaccuucaucucaguuuguuuucuucuucuccuccuccuccuccuuuuaacuuguaucuuacacugaaagaaacacaaauacucauuaaaacagugaaaagauaguugucaagcaacaaaggaaagggcauaccagaaaacauacacugagaaauaaaaaauauaacuuuaucucugagcauccuagcacucaaggcaaaaaggaagauaauaaugcugagcucugcuggaagucauuacguaagugcguucgguauuuccuuuaacuguucuaacuugaaaccauaauuauaauuaccuuuuuuuuuugccucaaggagauggcuuauggauugaauaugaggauuaccuuuuucuaacugcgcagcuuucuagucaccacugucuccccauaccuuccagucucacaucacagauacguauuuuauuaaugguaucuaggauaguguuaacaggagucuaacaaauccaguauuguccuugugaaucuuauucucauuuguggaauuucucaaaaauacagcaacugacugagauuccaaacagcucacaauuaaagacaguacaauguuuugcuuuacagagaaguggcaguaguacagauucuguuuuuuuguaauaaauguuucugacauuuuaauagugaaguaaauuaaucaaauaauugcaggaagauucugcuauucagccguucuuuuuugaguaaucuuaaauaauuaaaggaagaacaacaugccaaaugaugguucaauuagcauguauaaaaauaaauauuuaccaagacugcauuauuugccaaaacggagaugugcaauuauuuaauauuguugauggggcccauaaaacaaauaguaccaaaucucucccuguguacggccgucagccuccaagggcuguucucccacugcagacaccccuccucuuaccaccacaauaucugaaccaggcaaggagacaauuguuacuugaugacugagcccacuaauauguuacaggaaauggggcaugaaaugcaauacuuuauauauaguauguacugugugagucuuccauugaaacaaggccauuuuuagcuugcugauacaauauuugcagugguucaucauucgauuguccugauuaacaaucaacuucuauaggggaccauuugaguaguuuuuuuaaaugugaugaaucagaggauuuguucaacaucacuucauccucuucuuuaaaugguaauuggcacuugggaacuugggagugaaauaagguguggucuguucuauguggucauuuccagaagugccguuuugaccacugcugugccuuucauccagauuuuugcaacugguaaaggugucacaggcaccauugaaaucuacucccucaucagggaacacacucuuguugauagcaacagcaugcaaucucuguuacagccucuaaguuggaacagagaaggcuuucguagaggacauuugguggaaaugaaacacauccaagcugucccacguuaacugucaccucugucacccacaugcacuaccuauguuuagcagggcagccucugccugugauuugcagggagcgcaugcugacagcucucuucccucuccuuaguuccaggaagguccaggcaguugaacugacugcuugucuguagaaagacccacugugucccugggggacugguagguacccugauuccugcuuaucaggggauugauucugggcaugacccuucaccuucucugugcauaucuguaucuuaccuccaucuggucacuaguuccaguaacuuggcauuuccuuaaaugaaacauuaacaucuguagaaaagaucucucugacauguuagauguaacaugaguuaaaaagucccauuugggaggaagagaaccauuggggacccugccccgugggguuccugaguguccugggcaccuuugcuugagcucauucuuuucgucagagaucaaaaccaggagugccuccuucagcuuguacuaccggauggcuuagcaccuggcgagugagugucucagaaaggaaacugcaggagugcauuagaccacucaggggcccugcuguccuggguguucauccauggcuccauucauccauggcuccgugcacgugcagcccgggaccaugacucugauucgaugcacuuuguuuuccagaagcacaguuugucuucuaacuucuaaucaguucgggaugguauucaaauuuccaagaaauuaaauuauuuguaguaaggaguuauugccaguagcagugguagcgguccuugucaucgucaucaaaguggcggugguaguaauagcaguauaaggaaauauuugugcugcucguaaugaaacgugcacauggaauguuucuggagaucagggccagauguagggugcauuuuccaugcccguucucauccguagcagagacugcguggagugcuguguugagaaggcuucggaggcucagguguugcagaugccaucugccaucaccaugggguagggcagugcaaacugcaaacugucccagguaccuuuuagccauucuugguuuaagucuuuaagacuaaaauugacacauggcuguuugucugcauaaaccuuuuucuuucuuuaaucaggaggaaagugaguaauccuuuucauuucuccaguagaaccucuaguccaugucugaauugccuucacagaccauaugcaccuuugaacuuccguaauagaugucaggauccugagggcagcccuggguuguucuuuaugccucuucacauccaggguggugcuguccacucaccgugcgugcauugagacuguuuggguugcuuugcucucuggugagaucucugugugcaugcuuuuucuaaucuccucugcucuguguagggcagggcauauguauguaguuaucauaaugggauuuggagcccacagacaauguggcuuccccuuuacugcucacugguuauauuaccuugcccaauuacuuaaccuccaugaaacuuuuuaccauucaugagauuuguuagaaucauucaguaauucauucaucaaauacuuuuugaacauuugauauuugccagguuaugggcaagacgggaguggucccuacuguccauaagcucaugauguagcaacuaaggagccagauggcaggggcaucccacguggucugggaagcccugucaaauggaaacacagugccaaccacaaugugauuuccauuuugcaggggcagguacaugagaaaaaguaagaagaaauaagugaaucugaaguuuauuuuaauaugcuuuauuuaaccuaguauauccaguguuugaucauuuuagcauauaaucaauacaagaaguuaccuugcgcccuacagaaccuucaaaaucugguguguaguucaccuauauagcaccucucggcugggacuggccucccgucgaguccucaguuggcacauguggcugaggguggcccugugggaugguacagguacagccuccucuuugagcuagggaugauuucagcugaccaggggacagacgcuggcugggguuagggaggcagugugaggugggccuccugggcccgaggucaucgaaggccccgguggggagagcacauggcuaacuacgggucgcuggccaaugcaaggcagcagcaugggagaaagcccuggugugaggcgggacaccugguuugcaggcugaggaugugccaccugugggacaccagguagugaugucugcagcuguggaugagaccuucuaggggaagaguuaacucggaaagaaaggaacucugagcauugaagagucagguggaugaaaaguugccaggaauggaaaagagaaacuagagggaacaagggaagugugucauucaggaacuuucuguauuuaaaaguguguguuggagagaaaggacaaaucuuuuaugcggaggacuuguaaauauuuuccauagauauaaaagucgacuucauagcuugccuggugugcucgguuuugacucuauagaucugacuugaaugcgcaagcgggccguucccacgugauuuaauaaacaguugcuguagcauguguaaucuuugcagugacaacaauuuagggaucauucgcuagaauaaagcaggagcagcagguucugauuguuccuuuuucaggaauuccucccugccauauccaugugccacuguguagucccgugaacucugcauuuucgcagaaugcccccaucaugugaagggguucggcucacucuguggccggccuggaggccugggugugcuuccuaggcaggcaguuggauucuguuuaauuuucuuuagcuaugggagaaauggaguccauuuccagaccaugguaagugcccguugguuuuguuugcgguucuggccuccagggcggucugggugggaggaggaggugggcggccggaaggugguugagcguuuccgcuccacugcgcggccccggagcccccaaacgcaggucagcauggaggggcagccugcagaggugucaccagcagccauuaagugcagauacugucgucccuggugucgucccugaaaaucuugugacagggagagacagagugaaaggaaagaaaaacgaggcgaucaagagauaauauuaacuagaaaaaucaagaggggaucugucaguccuggugggaaaaaaaaacauuuuguuuuucuuaguuuccuuuuccuuuucuuuucuuuccuuuggauggaggagguuugguuuggucuuaguaccccagcauacaguagcuucauuggcuuuuuuucugcccauauucaaaauuccuuugauuagcauuugguucugguugggacuuaauaaugcuagccagaccuaaugugaaccauacaucucgucggcauuacucaucgucaacauggguuuuuaaaagggaaggagagaaacacaacaaacuuuuuauuucuuucccugucauuguucuuggucuuguuauucaguggacgcuguauuaaauuggauucuguguccaucauuauuaaaaugugaagugugucggucacaaagcauacauuucggggcaguuagcugaauaauucuuuucuuuauuaucccaaauuacugcugagcucuggagaggggagcaguuuagccaauuauugccauuugagcuggauuugugggugauuagcuccuggccgaauccagucccggccggcgcuuugaagccugugcugugcgauuuucucagcagugagguaggaauagacgcggcuaaugacaggaaggucgcgcgggugagcugaccuguguguggcgcagccuuggguuccgcaaauagggcacccacaguaacacguguggcgccgaccccgccgugcgcaaucggggcuuuauacgauugcuggagaugcugacagcucaauuaaaguguaacccuuugugcccugcaaccuggcacaacgacagaaauauuacucgccggaaaggggagggggucuuuggggagcugguuaaagauccagaaucggccccucgccccuuugccccucccccaacucccuccacuguacagaaggagcugcagaaaagccuccauuuguaaaauaauaggugcucuggaggaggggcagggcgggaaauauuacuauuuuaaaaagcucaguuaaggggggauuccugcuguuccuauggaaacacuuuaaacuagagagaaaguuaaaaagauuuaguagcggcagagcuugugucugcuggucacauuuucuagucaucuccuuuuaccaaaauuuaccucccagcaucguggaugugaauuugccagaaguuuuccguuuguggaggacuggggaaagccaguuaauugggauguguuuuugcacacaacgaaugauuucuauguuaucgauuuacuucuuucacuuaacggcauuuucugcagcuugaaugaaagcugucucgauccauguaugucuguguaucugcggucuggucauuuuugccacacuugauuuuuuucugcuaaacccuacgucuugcaguauaugggucacucauccagauuuacuugaugcuguuuuaguuaggcagcagcaugcgaugcccugugcgcaucuuuauuuuugguuuuagauuuuugguggacugcuuugauguuuuauuuucugagacuaggaguaucuauaacuuggugugguuauucuugcagguugagccgggugcuagcuacugaugugggaaucugggagcccgagccgacucagacaguccugacuccccagaauucccaccgagggagacaauccgugugugugaucgggguguucuggacuugagguaccugguagauacucgggggaguguguccaguacggaaugggaauugagacuccagcaaguggggaagagacagcggaaguccccagugugacaccagggccuguggggcguauuuggugagacuggugaggucagcauuggaccaccucccaugcugggugccaucagugugcuggagggggaagggggagacagcauuucucuguccuagagcagugcacagccuguucaugcaccugugugugugagucagcucaaacugccauaacagaagaccacagacuuugucuuaaacagcaaacauuuauugucucccaauucuggaggcuggaagucuuggaucaaggccucagugggauuggcuucuccugaagccucucuccuuggcuugcagacagccaucuucucccugugucuucacguggucuuucuccgugagugucuguguccugaucuuuucuaauaaggacaacagucauauuggauuagggcccauccuaacagccuuauuuuaacauaauuugcucuguaaaggcccugacuccaaauagagucacaucgugagugcugggcguuaggaucucaauaucugaauuagggaguggagcacaaugcagcccauaauagucaucgucuaagggaugggcgucggggggugcuugcuuaugcggagccugugacccugcagcucagcaugggaggcuaaaggggcgcucaccaggauggccagaggaaggggcaggaugcaagaaggacauuucaggggaaaagaauugaauuugccaauuuacauuaaaguuucuggccucugauugggucugcaugguuuccuguccuguagcagucuucuauaaaaggcuggagaggagguauguuaggcuucaugggucgugugguuucuccugaacuaccuaccucucccaguucagggcaaaugcagccauuccaaccaaugaacuugacuguguuccgauaaaacuuuauuuacagaaagaggcagaggaucagauuuggccgacaugugggagcuugccggccccagucccguaggauccccaacgcuaauagucuggaugagggugcacaggcugugagaguuccuguuaggcgggaaggcucuggccccucgggaucauacaccuuaugcuggugcugcagugugugugugugugugugugugugugugugugugugugcaagugagggagggugacccccacaccaagcacacagggccauggauuuucacugucuuggguccaggccuauuucuagcuaaguguuaucugcaggguauagcuuagcauaaugagagggcaaaagcaagaugacuaaguguucguuacggaaaagugggaugucaggggagccucagcaggggcaucaccuggauguaccauuuuccgcauggagcuggugccgugggggaagaauaggucacagcuuguaugacccgugugcuucuccaguuuccaaugaugacauuccauccacccaccacccacccagaugcgcuucucuaguuuuauugaggucaguuugguuccugucagccacaguuuuaauacauguuuauagggggaaaaaucuuaauuagaauaauuagaauaaaauuauuaaaugcaaaugugugauugguacucacacucuuuggaucucaguuaaaggugccagcuuuucuuugaccuauuuuagaacuucauagaaaccuuuaacaagaaccuguuccaaaguguaaugaaugcaaaucauaagacacuaaaugagcuauuaacaauauucacuguaaaaccaccgaaguacucaaacaucacuuuuuuuuuuuuuagaaguagaaacauuuuugaacuugcauggauguuuuuaagccagaaaaaacuuuuuuuaaaaaacuugguaauuaggaaacuauuagugcuccugcagcagcaagaggauucauuugaucucauugcgaaaucacacgugcaccguccuuuacauucagucagaugcaugcacggcccccggugucuguuaaagccgaugaggaaugcugcccgcagagcaaaggcgagugguuguggacgugccuguugauaaucugaucuugacauggcgccgccugcguugagacuguugcuccaucaccccguaggagcuuagccaugaaauguucccucuguguaacgaugaucccugugcgagcagaggccggcaccauuuggucccugagacucaaaacaaagacugauuugccugguuaagacccccagucucuaaugcagucaauaaaucuuuguugguaaauaauugcuaucgagcagaguuuuaauauaaauuuaugagugguguuuuaucacagcuuggggcugcagcaaacacugagugauggguuucagauagcacuuacauucaugacauuaacuuuguaaguuauuuaaagcuuguacacuuaacauugcuuuuggcuuucaaugaccucuugggacuagacaaagaauacacaugacgaauaaagggauugcagccaaaagacaauucuacucuuugcuccacuguagaaaagguuccuugggcuuaaagcaagaugugccugccuggaauccugauauuuugguuauaggucauuaaaaucagucuuucugauaugucaguaaauuaggugguaggaauuagaucaacauuugccauuuccaaguaacauaagaagaauaauuugaggugucacaaaacauuugaaauuucuugcuuuacaaacaaguuaaaauuugucuggugggugaaaugguuugcagggaggcagcauagcagcgggguaacaaguauaaacccuugguuuguaccucgaaucuugcgccuguuucuuccccuuacugccguuuggguuaucuauugcuggguaaugagcccaaauuauaguggcuuaaaacaguaccauuuuggccagguaugguggcucacgccuguaaucccagcacuuuggaaggccgaggcagguggaucacaaggucaggagauugagaccauccugaccaacauggugaaacuccaucucuacuaaaaaaaaaaaaaaaaaaaaaaaaaaaaaaauuagccgggcgugacggcaggugccuguaaucccagcuacucaggaggcugaggcaggagaaucacuugaacccaggagguggagguugcagugagccaagaucgcgccacugcacuccagccugagcgacagagcgagacuccgucucaaaaauaaaaaauaaaagugccaccuuauuguuuaucaugauucugugggucaggaguuugggcagggcauauuggggacaguuuguccaugcuccacaagauacuuucuuagggcuacagcguccaagaucauuucuuuacugauguaucugaugccucagcaaaaguggcacagcuggcuggaggcugacgugaaaaggucacuggcagucaucuaucugagaccucaguucuuccucaaauagucucagggugucuccucuuuacuuggucuccccaguaggauagucugaccucuuaacaaggcugcgcaggcuucccagggguguaaagcaggaguuuccaggccuccuucaggcuuuggccaggaguggcacagcauaauuuccaccacauucuguugguucaauugagucagaggacagagugaucacacaggauaugagcaccacgggggaugagggggcugguuuuugugugccaucuucggacacuagcuacuucacucuacccuccuuccugcaaaguacccacagccuguccccagcuacccaaagucucaagccauuauggcauccagcccaggcuugaaguucauggccuugucgucuacaccagguacacguggaugagguuccuugcaugugguccuccccaucggaagaccacgauacgcaggggacaaguuaucucacacaccaugcaguggugacucaggaacaggagaacugcagcagauacccuuauucuaaaaagguggagaggcuguaaucccagcacuuugggaggcugaggcagguggaucaccucaggucaggaguucaagaccagccuagccaacauggcgaaacccugucucuacuaaaaauacaaaauuagccaggcaugguggcacauguguguaaucccaucuacuucggaggcugaggcaggagaaucacuugaaccugagagguggagguuguggugagcugagguugcaccauugcacuccagccugggcaacaagagugaaacuccaucuggaaaaaaaaaaaaaugauggagagggacaagagacauggaauagucacugggccauaacaauucugaaauccagccagcacaugaugcugauucacccugcucugggcauaagaacuguauauucuccccaggaggcauccuccuuggcccuuggcucugcccucugccuuucccauaagaacugacccauguuugcuacuaugcagcuuucucagccugcuuccugcuguacuuaaaguugagggcccagagaccacuuuucuuucugaacuuucucugugcauuuuaauccaagaugguauaauuccuuuaaaaaucuuguggguauccuuugugucaaaucauaaucuguuccauuaaacaaaagcuaaugcacagauuucucucucuaauccauggaucucuaaucagaagggucugugaggcauugccuuaaaauauuugaguucucaaggaaagggucugacugccacaccauugaagggguccucauucugagaucacagcuacuggcauccccaggauuugaucuuaguucugaugccaguucuuacucaaggguuuucugcugucaggagaagcugggaaugagaaacuguuuugugaucaguccagcaagguuuacaguugaaauauuuuuucuaauugugcuggaaaauucccuggaccuccucucucuccucccguauuuaacagagccaggagcacuuccagcaucuggcauggcaaucugguagcuaggugugcaggcucacgaggcacucuugcuaugcuacccaucccccugcgugggguggccgggagggggcagguugcuaauugcccugcugguaccuguucugccggccccauuuccauccuaagguagcauuuuccucacuguccucacaacuuccacucaugcuucuuacaucucugccagccucagccaacugccuaguuccaaagccacugccauguguuuuugauuuuuguuacagcaguacaggaugcuaauucuguuuuucuuaccuguugcugcauaaggauccacccugaaacuucaggguuuaagaaaaugaucauuugacuguuucuuauaacacuguggcugagaccuguggacagagcccagcagggcugacuuaucugucagagcuucccaaggcaccaggugcugcuaggcuuucucgagaauuaaacccaauggagauaguguuauucccacugaugcuguuagcuaaagugagucucgggcagcccagggucagugugggaggauuuauuuauacagggacaccagugccacgaagugugguucaaugggagccgucuuuggagaacagauaccacgcuggcugugcauguugggcaaguuacauaagcagucuguuucaguguccuuauccaugaaaugagaaucgucguggauaucaguugugauugcaguugaugaaauaugcaguugugaauacugagagauugguauucauacucuuuggaacccaguuaaaggugucauaucaauuccuguccaugaaaugaggauaaucaaugaccaucugguugucaugcacuuucaguggguuaacaguugcaaggcacuuagagcagcagcaucugguucagagugagcccaauauugcauagaaauaaaaaaaaaaaguucuaaauaaaugccgaagccacauaggagucaaagaaagcguuaacuguaauugaugucuucacugugacagcuggacagcaagaaagaaucuuaagcagagaugguuuucacauguacaaaaguggcaucugaaagauggacaaaguaugcauggugacaugccaccaugccgcuggcccuggguuaugcagaaucaaaaagacuuaggaucacaggggccauuggcacucacugacaggaacucucuuccugagcaucucaggcagagccuuccggccucugucaucuucuggccaguaggaucacggcuucauguccucuaaaaguuucaaaugaacuauuuuuaggguuuuccauuuucuugguccuuagaguaggaagugugaaaguucggacugauugaacauagaggaggcugucugcgcgcucagcccagaccagugggggccaccuuaguaccacuuccucccuaaggaaagcgacgggcccccugucuuccccgauugguuuccauuuagcugcugcacaugggggaugcugaguguguucagaggggcgucccauggucgaacuggaacuugcuuugggaagaguguggacuaagaaggggcuuggcuuguguugccacaugugagaagaccucucaauggggcuuuugugguggcuccacggucccugaaaguccccacuggcucagugcagcucuggaauuaggaaccagccgugccccaggagggcagaggacccuggcucuuuccaagggagaucauccaggcagcucucacugcugagaccuauggaccccuguccccagggugcuuaugcagagacugcgggaccccagguggggaucaugcaaaacauuuuuguagcagauucagggcugaaugguuuaacuucuggggucgcucuagacugaaauucucugauucccacuugguacaaacacucuucaaaaaucaguguucagaauuaauuuaagccaagaaagaaaaagcauguuuuuaauccacaaaagcuauuucccgagucugcucauuuguaguccaauugaaccucugauuaugacugcuccucuggccuccugcuucugaagccccagccaacgucuucacucaucagagagcuucugucucaucguacuuuugaggaacagccuuuuaaaauuauuuaaggagagacaauagagaguuuuguaguuuuuccuauuguuuuggcaaacuuuuuuuuuuuuaaagguuuacauguauaaaugcagacauggacucucugacgucaaagaucugugggcauuaaauccacagcuggggaguccgggcuuucccaggauuggggcccuucaaggaagagcaagccuguguaauaauuuggaggccuaaguuacccgacugugggaaggccagugccgcuguccaguccauguggaaggaccuugaugucaguccagaaccacauuuucguuuuguuuuugagacgaggucuuacuuugucacccagacuggagugcaguggcacaaucacgacucacugcagccucgaccuccugagcucaggcaguucucucaccucagcuucccggguagcugggacuacaggugcacacccccacacccggcuaauuuguguauuuuuuuguagagacgggguuucaacuuguugcccaggcuggucucaaacuccuggacucacacaguccccucgccuccaucucccaaagugcuggggucacaggcgugagccaucacgcccagcccagaaccgcauucuguuuuuuguuuuguuuuguuuuuguuuuuguuuugagacagggucuugcucugucgccaggcuggagugcaguggcgugaucucagcucacugcaaccucucccuccaaccaauugcccuaccucagccucccaaguagcuaggucuacaggcgcacaccaccaugcccagcuaauuuuuugcauuuuacuagagacgggguuucaccauguuuaccgggauggucucgaucuccugaccuugugaucugccggccucggccucccaaagugcugggguuacagauguaagccacugugcccggcccagaaccacauucuugagcugagcucccgaggguaccuggugauguagaaggaaguuggcuuaacugggggcgcugcagcagcuucucagacauggcugcccucaugccuccuuggggccagggcugugguuauaguugcuguccaucacucuaggugcuuucaccuaggcagagcaaccgaagugcacuuugcagggagcuaagaggcucggcugcuaacagcagacggguuugggugggacuggagugagcucaagauucugugcaggccucacuuggaucagcugcuccuguccuuaggggucaggacaggacuucgucauguuucuggcuuugccuucaucuauucuggaaauuucaagagaaccuggacaugugaaugugaaagagaaggcacucauguauagaacucauuacaaagauagcauuacuccuagaaccaagauaccaugagugugugugugcaugugugugugcgugugcucuugcacacgcucauggaucaaggcagaggaugaguuuaaaaacugguacuaaaauacccucuuaucagagaaauugucaauaucauggccccacauuuccauuagauaggcaguaaccucuugugaagcggaagcaaacuagaaacagcucucccaaacgugggcaaaaaaagaaacuagaacugguugaagacugaguuuugggagaagaacccuggaggccaaaggcaguauuccugggguccugggauggagagagcccugucacccccucucccccaucugcccuugcugcaaggaggaggucagccuuguuuuauaaaugaggucacuuuucaaccuuacugguccauggcccuguccuguuucuguaucugccaaccagagagcaacucccguuguuuguuuucaccuuuuagaauuccugggacuaacaacaauuguaauaaaaucgaugguauuuuaaauuguugggaugaacaagcacuuuggguuccugagaucuuaggauaaaagcccaccgaggugcgagucucaccaucgugcugucugcugagagaucugauucccagcggaccggccuuccucacucgaugauugucagggcugagaacccagcacaggucugugaugcccacgaggcugugcggcucagggccaggucgguuuugagucacgugcuuacugugugucggaacacuugugcuuugaaggcugcgauuggacacgugauucccagcacguuuccugagguuccgccugcagcccgggccugugguggaguagagcuucucuccccagcuuucccgggaguguguggucuccuguuucccaucugcauuugcuuauggggcgccaugacaccaacacauggagccacuuggagacuuguguguuaguugugcacagauaccuacacuucccacugcccgacaguacgugcagugauuuugauggcuguuuauccggacuaaucagacaaaaacaucuuccaaaauacauuauaauugcacuagggacuucuaaauuuuuauucaauggguaaaugucuuuuuauuucauuuuaaaaacucaaugcauuguuuguuuauauuuaacauggauucauuuaaugagaguuaaguuugaccauauaauggaacaaauguuaauuuccucaaaaaguaguuguucuaugucagacccaugaccaagaucuccuugcuauaauuagaugacuuguuuccaggguaaggggcucaccugcagauaauuuucucaucuccaauagaggugugcauugccuucuguaucuuuacuucauuguucucuagcuuccucauuugaaauugcaaauacuuguaucuguuguuuuccuaaggugaacaugaugcuuuuuacuaucaauuuauguacuuuuagaaauauuuaaaauaauuuauuuuuaaaggagaaugaacuagucaaccuauuaaaugauuacgucaugauuuuaaugauucucaggaaaaauugugcugacccuuagaugauaauucuucaaaaugggauucugauucuguguuggccaagcagauuauaacccggcccuugcgugcuaaaccuuaagugucaccauauucaccccuaggcuucuuccucucucauggcuccuccccagccacccuccgucucccggacuuccuccuugaacguggaaccucaacggcuggccuggccgccuugccugccuggggcaccagccccccagugcuguguggcugauaccaaagucuucuuuucccuccuggucaccagcuccuguacucucuggcucagugaaugaccccacugggccacgacaacuaaagccugacuuugugcuggccccgccccaccucacccagcaccuugucccgauuuuaccuccagcguguuucuugcaucugcguucuccuugccugccuuccuucuccucucuugcccccaggcgcaucccugaucguugcugccauucuagaccagucuuucccacauuugagugguguggaaccuuuuuuuuuuuuuuuuuugagacagaguuucacucuuguugcccagucuggagugcaauggcgcaaucuuggcucacugcaaccucugccucccggguucaagcaauucuucugccucagccucccaaguagcugggauuacaggcaugcaccaccaugcucggcuaauuuuuguauuuuuaguagaguuggggcuucaccauuuggucaggcuggucucaaacuccugaccucaugauccacccgccucggccucccaaagugcuggaauuacaggcaugagccaccacgcccugccagagccauuuaaaagaacaaaaaucucaugaauccuucaacauugauuuaacuguuuugauaauaauuaugcaguuagguacaagcagaaaacuaagauucagcuccuugucuuuauagcuuuuaaauagauauaaaaguuauauuuauuaaacauuuaaauuaauaccauuaauuuacugugcauuuaauguuaaggaugaugauguuuugcugaaacaaaaugacggccauccgugccagggguuagggaugacgguugcagggcaggcuccuuuggugucagcugccucgugaccguaucacguggugaccccagucucuuccuuuccugcuuucauacugagaaaucguuucguguacagcaugcggugccuuccccggggguuaacuuguucucagagugagugauuuacauguugcgucucccucagcgcugucccccuuagcaccacucaugaccuaggaagucggagaugccaacucgggcaguggaauccaguggugguuuuggaucacuuuuuagauagugauuaaaauacacucaaaaauuuaaaaauucucuuggagaaauuaugguuccagagaaaaugacagguuucccuugcaucucaaauuugcucagaccgucuggggaucuuguuacauuuggauugaucccucccccucuuggguacacccaaccacuggucuaaagugggccacacuuugagcuggaaagugcuuccgucuuuugccaacuuaaaauuuguccucgccaggggaaucuuuccuaaugcaaaucagauaaccccuuccucccuccacccugcacaccuauggcagggcccagacauucaggcaccuccagggccaggcaggaaguggggcugagggcagcccgcugauuugagagaagggcccacggugcccguggaaacccgagaguguggccucugcacacugcugccccucagggccauauucccaugucagauggagaguaugggugcugcggcugcuggauccuaagauccauaggagggcagggggacuccauccaaccccagugacucuuggccagaagucacaaacaccgcgugcacgugcagcuggccugcagcagguucaguguaaccagcguucaaugcaaaaauguauaccuguggccaguauuuuaacauaagaagccaucacacacaaguccaguguuucuccuucucuuugauaaucaggaaaucuggccacgugggacccuccagcccugcagggucgcuguguugcacaaccccaggggcuuguugguggcagcauguuggcccagucacguucugggcuaaaguacuccucccugccaagcaggucugaucucuaguuuccagcagcccugggcaccccguuccuggaauuugcuagucggguugagauuucuuguccuguucuccuuuccuugaagacacucaggguugaggccuucucaggcugcuccuggauuuagcaaacagaaaccgcuuccucuggagccaugugcacucucaguuaagggaaauauuugcucaucugcucucacuccaagcucacauuauauuucagugggaauuugggagugaagcggagccccuguccgcucauguuccuugacugaaucagaaugucuugggaauuggggauacccucuguaaacuguggggugcagcgggaagauaaaaugcgaguugucaugaagucucacuucucucccugcaagggacucaggugacagaggugccugccagagggauccugagcagccgccccuuggugguugugcuuuggaagggggagcugaaguucaagaccaaaaguguugggcugggcaguggcugggacacccagagguucugcguggggagcaggucaccgcccaucaguaggaacaggagacuuuggcagcccagcagcccaguguccuggcaggagugaagacggcaggagagcuggcccugccacauuccguuagcuaacaagacacuuccccuguguaacucaguccuggcuuucagggagccauggcuuccauaacuucgcugccccugacuuguuccuuuggggagcaggggacaugacugcacagccgggcugagcaugggguagugcuccagccacugaaagaaaagugcaccugccccagcccagcuagaccacagccaugacauggcaagcggggcagccaaguggcucuuggucgccacagcaauucuugggggggucagauaauaaacccaacuggggccaaggcuggaaggcagaaauaugacuccuaagaggccaggguauucuguaguccugccacuuacgcagcauuugaauagugccuauaauccaagauuauccccccuggcaagacguagaguuuaaguuaaguuuacuuauuuaauaagaucuuaaguuuauugagaguuuuccuaggaucaaaagaaaaucagcguaggccuggcacaguggcucacucccugucauccagcacuuucuaaagaccuaagcgaggcaugguggcucacuccccuguuaccccagcacuucugggaagccauggugggaggauugcuugagcccaggaguucgagaccagccugggcaagaugaugagacccugucucuacaaaaaauaaaauaaaaaauuagacagacaugguggcauguguguguaguccuagcuacucggaggaggcuggcgcaggagaauugcuugagcuggaaaguucaagguugcagugagcuguaauugcaucaguacacugcacuccaaccugggcaacagagcgagaccuuaucucuacaaaaaacagaaauaaaaaaauuagccgaacaggauggcacacgccuguagucccaagcuacucaggaggaaggagggaggaucacuugagcccaagaguucaaggccacaaggagcuaugauagcaucacugcacucuggccuuuuuuuuuuuuuuuuuuuaaaguuuuaauucagccuaauuuaguuccucagaaagcuauaaaaugaugucuucacaugccucccgauuagacuguuucccccuuuuuccuuaacaaauaaguccucguagccuucacugggggcaggacaauuuugaggaugugauuuccucacgaaaguaccucccacacgccagccagaagaguggugcaaauccauccgcguggagccccgagggugugcgccguggccagcauuugucugagugggaagggaugaagcuuucugaaugaagccuggagcaucuguaaucuccuggugacaccagagaccguggcccuggcauuguugaaauuccaucugaaaugaaugacggaaaaaugggagcccacuggagaacuugagugagggcgaggcggguggaucaccugaggucagcaguucaagaccagccuggcuaacauggugaaaccccauuucuacuaaaaauacaaaaaaaaaaaaaauuagccaggcaugguggcauuugccuguaaucccagcuacucuggaggcugaggcaggagaaucacuugaaccugggaggcggagcuugcagugagcugagaucgcgccacugcacugcagccugggcgacagagcgagacuccgucucaaaaaaaaaaaaaacaaaaaaagaacuugagugaggcuuuguuaugcuaaguuuuaaaauccacgggaaucccacugaagaggggucucucaugaguugaagcaauugcuuguuuauuaccgcaucgcugauggugacugcccuucucuaauuccugccaugcaaggaagcccuuauugucuugguuugcaacuuaguagcauuuuccugugggcuucauuggguugauuggucucaguuccauauuugguguauagcgauuuagauuccaagaaaucaagguaugccacauuuugccacguuuccguuaauaagaacuugcaaagaaaucaucuucuaaagucguuucaaacucaaauauuuucccuuaagcaacaaugucuaauggugauugcagccccaagcuggcucauacuuuauuaaguuugugaaacuugguuacgaucuaguaaauaaaaaacaguauugucacaguauugguaauuaauuggacuugaacucaauuauaucccauaauaauuauucauucuuauguuguaauucuugaaagauagcagaauuuaggaggucgauggaggcugggaaaaguucugaaggugacucguggggcaucucggcuuucucaaagcgucuucuuguauuucaaaacucauaacuuuccuucugccucaguccaggugaauuaacuagccugagucuuacgcucucucagucauauuaagguuacauaaguuuauaaaaggguaggagaagaggaaguaaagagauuguuccauuuuucuugguuaacaugggccagaguuagaugagaagggaggaagacagagacagagacucccgaugugaacgcugccauugaaagggacugagcuggacaggcauggagcccaggcugagcaggagagaaucccagcucaagguguggggccugcccaagcucaguguuggccgucagcuuccuuaacaaagggaaaccugucaagguagagcaagguuugcugggaauugguguuaaaacaagaagaaauucucaaccaccauuuaagaagacuggauuaaacaugacuucaaaaauguguugguuucaaauucugagugguuuucaaggaggcuuaauaugauuucauuaaaaaugaauuagaguaaauuacaugggauucaucuauuaaauacuguuacugaaauuugccaguggaauuuugguuuuaauaaaaaaucugaaaugaaggaaacuguaaaaaaauucugcuuuacaaauauaaggugagaauacaguuaaugcaguuuggguuuuucugggguuuuuuugugguuuuuguuuuguuuuguuuugguggguuuuuuuguguuugguuguuuuuguuuuuguucuuuuuggcuacaagguguguuuuauuuucauuauucauagaaauaauuuucuauaauguccuggggcaaaccagagaauuuggcaaucugauugggggugguccuucagagacccacaggccaguggcaucggugcagagugcccagguucacaaugcagcuuguggcucguguccaucuugcaggucgcucuuccuccacaucacaacuggggucuuaaggaugacgagggcaggaaauccuccgggcucuuaggaaauuucacuccgcuucugcccaguggucucuuuggucggcaggguguucuucuccugcgucuccguuuucuucagcuuggcccuauugaagcuggcgauuccccccacgucugguuugucugccauuuucuuaaaacaaucgguaccauccguggcgggcucuuagcucacugcaacacucugccuccuggguucaagcaauuccccugcucagccuccccgaguagcugggauuauaggugcccaccacugcguccagcuaauuuuuguauuuuuaguagagacaggguuucaccaauauuggccaugguuggccaggcuggccucaaacuccugaccucaggugaucugcccaccucggccucccaaaguucugggauuacaggcgugagccaccgugcccggccugguuaaugcaguuuuuuuaguuuguucuuucuuuuucucuuugucucuccucucucuuucuuucacucgcuuugucacccaggcuggaguacggugguacaaucauagcucacugccaccucaaccuccugggcucaagagauccucccaccucaaccccccacguaacugggauuacagaagcacaccaccgugcccagcuaauuuuauuuauuuauuuauuuuuuuagagaugggggugucagcaucuuacccaggcuggucucgaacucuugggcucaaacgauccuuacaccgugcccagccugggguuucuuucuuuaaaacauuauaccuuuagguguuuccuguguguuuagcaguuaauuauccaaaagaucuaguguagcacgucucaauguguuugugucguauuuguugaacuaauggcauaucuuuuagcauucgccaguaucacagagugaaguucugcacacacacagaacuugaauguauauguugccuguguaccugccuuuucuuuuuuuuauuuacauuagaauuucuauuuggcucuuuuucccuuguagggcaugcuguugaagcgaaguggcaaaucguugaauaaagaguggaaaaagaaauaugucacccugugugacaauggcgugcugaccuaucaucccaguuuacaugugaguauagcccccucggagcaauuaacagcugcagaccucaacuaaacacuguggggaaggggaaccuaccagcagcccagccucuugucucuguuugaagugaaagucguauuuggucuccugcucaacugugagauaaauaacccuguuccucacacuccacuagaccauaugucuuucucucucuuccccucccuaccagucaaucuguggcuuuccaauucuacaaagaauuacaauaaaaggcacagaugaaguaaaauuuuagaugagaguaaaaagacaggggcaaggagaaaagagaaaggagagaagaguggucuaucugaaaaucgagaaugaaggaaacaauuacauuugaacccaggauuuagcuuugaaaagcugugaacaauaaucagaagucaaaugcaauucaugacucagcuuuuauugucagauaacacauuccagugcauuaggcaaaagaaacucuccucuuuguguuauauguaaguuuauguuacauauaaguuuguuauauccgugguguauaagauagauguauaaacaaaauuaacuuuauucuuggggaagaaaugcagacguucuacccauugauaaaauauaaaaaaaugcagacauucuacccuugauaaaauuuaaaguugggguguucuaguuucauagcaaaccauuccauaacucuuacuugaugcagagaaauguguagauuagaauauaugguggaagucagucauuugauuccauugucccucaguaucuaugggggauggauucugggaucugccuuguauaccaaaauccaugguggucgagucccuuauauuaaauggcauaguaucugcauauaaccugagaguaucauccucuauacuuuuaagucaucucuagauuacuuauaauauguaauagaauguaaauucucuguaaauaguugcuauacuauuguuuuuuauuuguauaauuuuucacuguuguauuagguuauuuuucacuguuuuuuuuuuuuuuuuugagaggagucucacucugucucccaggcuggagugcaguggcgcgauccuggcucacugcaaccucugccuccuggguucaggcaauucuccugccuuggccucccaaauagcuggaauuacaggugccugccaccaugcccagcuaaauuuuuuuguguuuuuaguagagacgugguuucaccauguuggccaggcuggucuugaacuccugaccucaagaaauccgccugccucggccucccaaaaugcugggauuacagguuugagccaccgcgccuggccuucuuuugaauauuuuuaauccauaguugauugaaucugcacauucagaauccacagauaacaaaaggcaacuuuauaucacugugucaggcuaguaguaauagucacagcagcagcagcagcagcagcaguauuuuuugguagagacugggucucccucuguugcccaggcuaguuuugaauuccuggccucaagcaaucugccuaaccucgccuucccaaugugcuaggauuacagucaugagccaugacacccagccaagcuauuaauuuuuaaaauuuugaaaugcuuuguaaaauggcacaguuauugaugagaaguuagaaauagcauauugaagaaaauuaauaucauuccuaaaauaccaccuagggaaccugacuucacauuuuagggugcauacucccggcuauuucuauguauauuucucuuuuccuuccacaagcacauggucacuguguauacacugcccacagccugccuuccucacucauaguagauauuuucaugucaagaaauauacuuguacaccaccauuuuuaaugauuauauaauauuccacuguguggaugugccuucauugaucccacgguaucugaaaaaugaaccuuggcagauaaauuuacuuucaguuuuuucacugucauaaagaacucuaaucaacguuccucuguuuaucucucuguccccuuguccaauuugccuaggauacauuccuagcaauuggcuuccugcguugaagagucgcaugugcuuucaugguuuuugcuguauuuugucaaauucccagaaagguuguaucaguuuaucucaucuggcaguguauaagagagccuuuucucugcccucucaagaacauuuaccuucagaaagaagagcuuuuccuaauaugauagguagcacaugggaaccuugaugcugaguucgcuugcuggcgucuugaguugcccuugucuccuugucuuuuagcguagcuauaccuuucagaaccacgcagcaaagcaggucuuccgucggcaucucucacugguuucuguuguuacugaaagcaccucccaugcguuacuauucagugggauucgagaugcagauauggauagauucuuacauagauauucuuuauugcaguaaggaaauuccuuugugcucaguguccugcuaguuuaguuuuggaauauagucagacugguucuccagggggccuucagaucgaagagauguaauacccauuccaugacgcccaccugggaccagguuggcaucucuccaggacugccccauguaggucuccaguucugcagcccucuccacacccagcuuccauccaucagaacaacagcgaggcaccaggucuucccuggauucucucugcaaaguugcuccaucagcaguggccgggcugcccuguuacuggcuuagcuccuccuauggacccugucagagagcagaggucuaacuauugaaccagucgcuuuauguaaguuagagaagugcaaucaaaauaucauucuugguaagacucacugaccaguaaaaagugagagcugauggaugauacauuuccagucaacauaugcucacugcugagcucaggcucagucgaagggauguuugcugcuucuugccaaggggcagauaugguaacaacgauauguaucagaagauucccuuaggaggccuaaagccuguuugcuuuucauccaaucccuugaguauauaaucacaaccaguucuucaaaaauucuccuauccacaggcuuuuuuuugugaugucccucaguguuugccaauuccauccuuucuccuucauucauaaguaugcaugaaucuuacuggaguacggaagaggggcgcaauggggcuuuguuguauaauuguauagcaagcaagagccaaugucauuuucaaaugcaauccuuuuaaugccagucuccuuggaacugaaauuuuugaugcagguacguaguucccuauggaaggggcuuaauccaggaauggauuugaaucacuagagccugaagagauggcaugaccuuccacguaauccuucauggguuucauuuucacagccaagcauuggauaaaaguguggagaggcagugacuuccagguguauucucugacaggugcauacgaguccguucuguugugacuuguuaggggaagugcugacccacaccagcugaguuagucugguggucuugguucaaaaugggaagaggcauucaaugggacacccacgagccgaauccagauuuuccuucauaagaaacuugagaaugugcaaauguguugcuaguucaggucccaaaauuuuacaccgugagagugacccaguuaucucagucuggaaaauuucaaaagaucguagaaccagaugaucucaguuaaacacggaccaugcugugacacccacauccuuggcuaucuccaggauguauuacggcagaaggaccacugagagucauuggccacaugcagugguggcauaaguggucaaguguugggaaagcugccaggauugcugguguuuggguuucagagucauuauuguugcuccuaacucuauuacugaccacagcgugaaguggggccucucccugguaacacccuauugucugaacaugggaaccugccuccuuuucucuccucugggauucaggcccauguccagccucuguagaccuauaucaagucauuaaaaguagauguuaaccugucaguggaccagaauaacucccuguuuuacacuagaggaaaauguuaucugguuucugagaacacuauucucauccaccuuuucucucaaaggcagauggggcccagguuccaacacaagagcccccggagcaggggccugcauugaucucauauagcauagccuacagcccguucuuuuccacagagcccaggaaaaaaaaucccggccaaaccaucagauauuuuuaguuuucuacaaagauguaaacggguaucaauagugagguugcugcaccgauuccugguguauaccacuaauuuaagaagcccagguaauuaguggacuaaaaaggaaacuagcaugcuuuuggggagacgggauucuaaucagcuaauacuucuauuauggggugcugacuugagagcgccaggcuugcaguuguauuaaacguggaagauucagacagagaugagauagggccgugcggcagcccaucaccggcagcgcuugcucgugguggugaggccucucccuuccggcacagacauuuaucuucuguccacgugugugccgcucacaguccacguaaggcugcgcccuggugccaccaccagccuccuuccauuugcuuaucauguuaaauucagggagcuggggagagggucuugcacacaaggaacauuggagcaagaguaaacaacugagucaaguuuaaacggaauaggccaaugugguuaugggcagggggcgggggagcggguaguucaggaggaucucaggauuauuuguucuuuaggaucaaaccgagaagguggaaucgagggucuuuaccacccuugucuuucucccucugugacacagggauguucaggcauaguagcugaugucagaggauugccugugugggauaggagggucuagaaggcucgacuccccuccuagggcugcuccacacagcuccugcauuagucaaccaaauuaaauucccaggcgagcuccccaaccaguccucccuagacaagacaggcaagcaagggccgaguugauagaccugccugggcaacauggagagaccccaucucuacaacaaauaaaaaagugagccaggugugguggagcacaccuguagucccagcuacucaggaggcugaggcaggaggaucacuugagccaggaggucagggcuucacagugagcuaugaucgugccacugcacuccagcuugggcgaccaugcaagacccugucuuuaaaaaaaaaaaaaaaguugauagaggcagguacagcauuuguugcugucggguagagcggccacccacugccccagccuucccuguggccacuucagcuccugcgugcucccagcagugccagcauccucauaccuuuguuugggaaagacaccccagcaguggggagcucuggcuuucaguuccuuugcacacuguggaagcaggagacugaccauuuccuaaccuugccaaaaacucugggugaggguuuuucaaugucuucauuagaugcccuuaggaaaagaucucccugaagaggucauuucuguuccugagguaucugaacacaguuugcuuauugcacaaguguccacggaaguguuugugugaaagaucgaucaccuuuggacacgaacuucaaguaucagucccagacagauguuuuccacacaucgguguguucgaaaauaaacccagcucuuggccaaacaaacagucgguauguggccgugcugugcaccgagcucguggaaucccagcaggaugaccugcucuuugaaacuguggcuucagaacaaagcagccagucaugaaacuggggaaaccugacauugcaggacaccguggggcuggugugaggcugaaaauguaccuagaaugggucggcugccugggaaccucacgaauacugauccccagggacugcgugucucccucagaacuggggcagcuuucuacuugcagaagaucaugacaagggacuucagcugggugguggcccugggaugucacuuuccuucccacuuaauugcuuuggauuucucuuuccuuucucgucaucccccaaaagugucuuugccuuuuuuuuuuuuuuuuagcccugagccccaagcucaguccuuacauagauuguuuaggagaccaguaaucccuaguuccuuugacuugcagcucagccucacucuguccuuuacuuaggacauaagcuaaaucuacauacccuuccuacaccacagauagaagauauggagggaaaccuuuuucuccaggucuguuucauguuguugaaaaccucaaaccuuuuucuuaggagagaaccucuguuucuaagcaguggaauagaauugcuuauggaauagccaggucauaggaugugauaauuucccuggaaaucagaggggaaaagaagcaaaacauggagccaacucagacuaagaaagcuccaugaaaguuuaugccagugauaaccuccaggccccagaucugcucagcuuggguucugugaagucuugaccccagccaucacccacagccacaucucccagccuccuucagcucuuccccaaaggcuuaggagguguuagcacuggcugccucaggaugauggggucccugcacuuccaugcuguguagguugagagaaggagguaugggcacaggaggaagugaugguagauuuccacuguaguuauucccuuuuuuuuuuuuuuuuuuaagacagucuuacucugucccccaggcuagagugcaguggcacgaucucagcucacugcaaccucuggguucaagugauucuccugccucagccuccuaaguagcugggauuacaggcaugcaccaccacgccuggcuaauuuuuuguuuuaguagagaugggauuucaccauguugcccaagcuggucucaaacuccugaccucaagugauccacccgccucagccucccaaagugcugggauuauaggcaugagccacucugcccagcugugguuauuccuaaaggccagugguggggcaggauaacaaggacagcaccagaguggggaggggugaaugaaccuacagcguccacaucauugcuucccucacagaguauguucagccaccaguugacagugggcgggggcugcccagccuguccaggagcuggagcacaccugcauagcuuucagaucacacagaggugcccugcugcagacgcucaggcuacauccguucuaguggguguguuugaagguagacauugggaaacuggcuggaagguguccguuuuagaaacauggagaacgaauucuuucacuggguaggaaguuugaugacauugucuucuaggucacuucagacucugaagaaugugagcucuaaaacuuucaccaaaaacucucagcaaacucaagcuaauggaguuaguuggauuucuaaggaaaacgcuguccugaaguugaagcuacuggguguaagacuaaaacugaggcucaaaaaaaaaaacaccucaguuaauucaucuuucuuucucaagaugcuauuauuaaaugaaaccaaaacccaguugagauaacagauagaaaacucaaccaaauaaugaaugaaacugccuuaauggaguggccaacugcccugguuuucugcaggacugagggguucccagggugcaggacuuucauagcuaacaucagggaagucccaggcaaucugggaccuggccgcacuugcugcaguacugaccgcccuaacagcuccuuuaucuccacuucgcauuuugcaaugauaacccuaaacauuuaaauaagacugacacggucaaagcaagcacgcuggcugaugcugcugcucugcggucuacauuuuugugucuuugaaaaauuguaugucuccaagaccuuuaaaaagcccuaacugcuuaacuuucuugggggaaauauauaugagugucucaugguuuucagacacuuugcuggaucacaguucagguggaucgagggcagccuguucuaagacccugagagucccuuucuguggacuuaaaugugagccuuagggagcaccuugauagaaaaauggaggcauaaugagaaagaacuuggaccucagggcuucacaguucagcguggccaccuauucaucuuccaugucgcaagcacggccgucgagugcaaggcugcaauucccugcugacaaagaugugugcagugagauuccuaaguggaccuggaaggaugagcugaguggccucacggucaagccaaggacuucaaggugccccugucuaggaaagcucaccaguguuccgguccuggcucucugggcuuccucaggaggucguuuggcagcugugaaacuccuccccuccgggccauaccuggcagacgugcaugaacuggucagacuuuuaaaaaaccuccuucuggccaggugugguggcucacaccuguaaucccagcacuuugggaggcugagguggauggaucaccugaggucaggaguucaagacuagccuggccaauauggugaaaccccaucucuacuaaaaauauaaaaacuaaccaggugugcuggugggugccuguaaucccagcuacuugggaggcugaggcaggagaauugcuugaacccaggagacggagguugcagugagccgacguggugccacugcacuccagccucggcaacagugagacucccaucucaaaaaaaaaaaaaaguccuucuuagauuccuuuccauucugcaugugcccacauuaaaacagcuguggcucugucauuucucccugaccugcaauacuggaauuuuccuucuuaaauuuuccuccuuuaaaauuguuaaagagcuuuucuucuuuucauuacuaggcagguuaauuucuaucugaguggcuuggacucuccugcaacacauaaacccuuugauucugugugucgucaaaguuugguuuuguucuuucaaagccagggcagccaaacuuggacucucuaaaauuaucaucagaaugcagauuucagaaaguuucuaguuucaaaaucagacagaagacccacuucuuuacugauguaaagacaacaaaaagaucugugaugauuccuaaguagguauuuuccucaaaagaaaucauucaagaaaaaaaaaaaaaagauugcuaugagaauagcagcucguggcugugcucagugccuguaacugccuuuguaaauacacgaauuccucacauaggacugcaacauuuuacuugaggauugaagauucacgaagaaucugugauccaucucuucacccaccuucacugucugcuaggauggaccucagacuucuugaggucgugaacauucauuuacacucagagaaacuuuucacugguuuccccagaacauugaaacagucagaauaacuccugugcaggcuacuggacugacaaaugugaaggccagauuuucagaugugaagcugggaagaccaaaaagacagaccucccuuucuuacugagaagagcguagucagacaugucaagucuggcacgcugcugcagaaggcgugauucaucuuaagaucaaaaauuauuucaucuugcuuucuuggucauaagcuaaggugcuuggagcuguccuuuggccuuucaugugcugugucuguggugcgggugugcuguguccucauaagggugcgccaugucuguggcguagugugcaccguguccaucauaagggagcgcugugucuuuggcgcggguguggcgugggugugccauguccaucauaaugaagcaccaugucuguagcgcgggugugccauguccaucauaaggaagcgccgugucuguagcguggguguagcgugucuguggcgcaggugugccgugucuguggcauggguguggcuugucuguggugugggugugccguguccaucauaggggugugcugugucuguggcguggguguagcgugucuuuggugugggugugccguguccaucauaaggaagagcugugucuguggugcgggugcaccauguccaucauaagggugagccauguuuguggcguggguguggcauguccacgagggugcaccaugucuguggugcgggugugccguguccaucaugagggugcgccguguccgucaugcagaugugccuucauggcccucccugauucccaggccccaucuaguguacaucauugccucgggugagaaugucccuuucugccccaucuaguguaugucauugaggaggagggcuguguuccccacagucugcccaggggcugucaugugaguggcacauagguauugcuuaguacacaccggucacagugacuugagugccaccacaaugaaguuuccaaucgugugacuccuucagcaucuuugcuccugaacuuccuggacuccagcccucaacauugacaauccuggcugugcucuacagauugugguaugauugagacuaacaguacucaccaugucuuacaacaugaccucccuaaacugacauaggguugggugaacacacacacacacacguaaucacugccucacguggcauuauuacaaaugcugcaaaaucuaaacacaucacuggaauccaaaaagcaauccauuuagaggcauaugaggagauuguacggauauuaaagaacaaagaucuggaacuauggcaacaaaccaacguugcuguucuagccugagcugccuguuuuaggcaaaugggaaugcuuuuggaaacaauaugaaccgcaacggguauuucugcaaguuucuaagacuggcaggagucagcucgggggaagcaggaagaauccccaguugguuggcuauucuugggaccgaagagauaauccccauugaacagagccuacacucacauccuugaguccgugauguucuucgcuucccugggaacagccagaguccagcuuuccguguggauugcuuucacagggauaucuggcccuucaagccaguggugugaaugucaccccaagaaccuugacguguagauacugccuacuucaagucauacugcagcucugccucuucccaagauaggauuugaagcagcuuccaacagaaaauggaugugaaaauguauugugaacacaugcauaggaccauacauacaucauacacacacacauacacacacacuuaaacauacacaugcacauguacacacacacacacagcuaugggcacaacuucauuucaacuuguagauugugaaguaaaggcauuggaacuuuguggcuugcaaaucuaaauuaccuccuuccaucuuaagaucucuucccuccuuuauucuaaagugugauucggcuccucucuuagcugauccuucuggugugcaggucaaagaacacugagcugggaaucaguugugguuuccgauucugccguugccccacccgcuuccauguugguuccaacguggcuuuguggaguccugggacucaggcacagugugagaaucacugagccucucaaggucaauuaugcagugauugcuugguagcucuucuuccuccacccacagccucggccucggccuccguuuucucuuccuccugggaauucauccagaaugacgccagaagucacacagaggugaucuugcagaccauacuccccugagugugcaggccugcauuuuugcucaguucagcuagcgcaguggccugcucauaaaguuuuccaaaaccuguaggcuguaugaagaauagcgguuacuccuaagcugcuuuuaacuuucaccuugugauucucaucauauuuuuguugauuucccuccuuugaguucuuuuauguauuuccaugauggagaagauccccucucccgcuugguugauguccgugccccugcucuugccccagcuugccuccucagacuggccucucaccugcuuccugcucuaucgcugucuuuguuuucuuuuaguuucucauacuugccauguuaucuggccuccgggucuucacaaaugcaguugccucuguugagaauguucuuuucugccccaucucuuugccucacuaacuccucuuuccaauccuggcuuaaaugcuacuuccucuugggaguuuccccacacucggccuauuugggcacccaugcugugugugcucucacguuacucuauugggccaucucucugauucucccacaagacuggaagcuccuugaggcaaggauguauaugucaccaauguaucucuaacaucuggaacacuggcuuguuggauggauggauggauggauggauggauggauggauggauggauggaugaauggaggcacaauuagcccauaugcuuaaccuuuccuuaaaugugucggacuagaguuccuaaaaccucguggaaggaauccaccaugcaacacuuuuaggaagcagaaauaugucucagccauauucuggcuccauuugcugcaacuuaaagaaggaucuugaugggagaaaagcuucaggauuuuguuuguugcuuuuuucauuuuaauuguaaaauacauacaacauuugccaccuuaaucauuuuaaguauacuguucaguaguaucauauacguucacguuguugggcagucaaccuccagaacuuuuucaucuuacaaaacaaacucuacgcauaaacacaaauuccuauccccccuccacucagccccuggcaaccagcauuccaguuucugucucuaugaauuugucugcucuaggaaccucauauaaaugaagucauaugcuguuugucuuuuuaugacuggcuuguugcauuuaacauuauguccucaagauucuuccaguuguagugugugucagaauuuccuuccuguuugaggcugaguaauauuccgucauauguacacaccacauuuuguuuguccauggauggacacuugcuuucaccucuuggccacuguggacaaugcugcuaggaaugugagcauacagauaacucuucagagcuuggguuuuaaauguaaaaacuguaacaugggaaagcuacagaguauggcugaauauuaaaccugccuaaccuuaccagcacucuggucaugguacauuugcugggcccaguccugaccacagugaacugugcaggcuucauaacaugcaugguggucuggaagccaugugauaagaagaagaaaaccacccagcaaugacauggucacaugggcucuccuggaguuugcuaagcaccugggugaccugggaaagaacuuugucauucaugugaccuguuugaaagaaugugaucaguuguuucucccaugugucaacaguuccaaagccaaggaauuaggccgccauaaaaguagaaauguuuucagggcauagugacaacuuuuguuggaaauggagccuacuaaaaacucacugguguuacaccaacacagaaaaggacucuguaucaaagucuauuucugucuauguaauucuuucuuuguuuuauauacccucaggguuuggaaauguuugggauuuaaaaauaaaagggccgaaagcuauccucacgacauuucauuauugauguuguugacacacagugaauggaagcagggugagacuggacaaaauaaaguccucuuauuucuuuuuuuguuuguuuuuuguuuuauuugguuuuauuuguuuuuuuggagacaaagucuugcucuguugcccaggcuggagugcuguggcgugaucucagcucgcugcaaccucugucuccaggguucaagcaauuccaccaugcccggcuaauuuuuauauuguugguagggacaggguuuugcuauguuggccaggcuggucucaaauuccugaccucaacugauccgcccaccucggccucccaaccugcugggauuacaggcgugaaccaccacgccugaccaaguccucauguuucuaaaaauuauaccacuaaauaguguagauccuaccuaaccuauuuucaacauugaaaaauucugccuucuugcauuucuaguuaaaaugaaaaaauagaauauauguguguuucuauaaauagcagauuuaacaguguggcuggaggguuugagucucuaagcuuccaguggaauccaagggacaucguccuaccaguaugccgcgugauaugucagaucgucucuggccguccuuuguacccaauugauaacauuuuguuuuccauuuuuggccuuuucguguuacucauugaggccaaaaauucuuacacaagguaaauaaaucaaaucccucugguuuccucagcaacaguaagucacagccgaggacucaguaggagaggaugacuguggggggucaugaggaauguucuuuuacuucuacuaagaaauugaauuucauuauuauauuuuauaaauauuuucuucuuuggcuuauaaccugauugcgggcuuguugcugaggucuuggaagguagguagggaggggcagggcuggagaggccuguuucuucucaggugugccuguggccccagauggaaaccaaucaaggugcgauuuauguucauuaagugcuugucaaaacugaaaaauuuucuaaucaacagcaaucuagcugcagcccccucgauggcugggagggccaccucugccgcaucggcuauuugccuguuacaacucuaggcuaaaaauccgcugaugauuacauuaggcuaagcugcgaaguaaaugaaccaugucuuauuuaggugccacuagcuucagaguaguccugccccgcagggcacuugauagcauuuuauggcuuuaaaauuaguguagcuucccauuugcugcagggugcuacauguucugccuuugaacucaauaagcaaagggaacggggccuuuuguuuuucccccuucuuuuuuuccccuugcauuuuagcaauuuuguuuugcaucuuuuccagacggcauuuugcaauaaaaaugucugacuaccauauacaugccucccccauuuaaaaaaaaaaaaggugggggaagagaaggaggaaaaagcagaaaaugucaugcguuugcagaggacagguucccccccccacccccacccccgccugugcuacaaagugaaaaauggcuuugcaggucaacccuaaugacuuaucaugucagaauugcuaccucaagugggaacaacaccuuuagcccaagaaauugccacauaaagucaaagggaaaauaguucaguauuuuuauuggacaagaguggugagagcuaacauuuauggagggcuuuggcgcucuguuaagcacuugaguauuaucucagugaacccucgcaacaguaucaugaagcuagaacuguuuuuaaagauguggacauggggacccugagugacugaaugacaggcccccagugugcaacucggaggagaguggaggcacucugauuucgaggcuuauucccugaccaagagaaagucaacuuuugucuuccaaagacuucuuuaggaaaucagaaaagugugguuaucagugaauuaucugauucauuugaauggaaucuaauacaaggugcugugaacucccuuggcaggcauuauguuuaggaaaacaagaguaguuccuguaaaagcaaugcaugggaaaaauacguauagaagacuucuaaauaggccuagguggaaaguuuaaaaauuagaaguacugacccuuugucaaggggaaaaacugaagugggaguuuguccguguuaccuuaggucucauggcagaagacaugauguagcaaucgauauucaccucagaggacagauguauaugcucugcugucuuaaaacucuacuguuuggccgggcgcgguggcucgcaccuguaauuccagcacuuugggaggcugaggcaggcggaucacuugagaucaggcguucaaggccagccuggccaacauggugaaaugccguuucuacuaaaaauacaaaaauuagccaggcaugguugcaggcgccuguaaucccagcuacuugggaggcugaggcaggagaauugcuugaacccaggaggcggagguugcagugaaccaagaucaugccacugcacuccagccugggcaacaagagcgaaacugugucuuaaaaauauauauauacuguuuguuuuagcgcugcacauuuuagcaaauucguccaaagaaaucugaaguuuuaaagagacccagacaggcaguaucaccauggugaacauuuccuuauaagucaaaauuucuaggaucuaacuauugauccaguuguuucaagccauauucaaauauuaaaauacuaggacagcaaaggaauuguguuggcuccuugaaguucauuguaaugagaggccuacagugacuguguagagacaagcagcuguuuucauauccgaggcaugcaucguacaggcuagguuugagcaggcauggguuacaacugcguaauacucaauuuaaccuagaaugagaaaaaucuuucaggcaguguaaaccucaauacaguaggucagucaagacagauacagucaagaagcaaaagguguauucauaauucgauuuagaauuuucugcuuuuugauuuguaguagaauaacuuaacccuuuggacugguggacuugagcccacgcauguuggacacuggccuccgcagcacaugaagcagagaagucugcuuuugccaucauguagggacucuccacuguacaugaagcugccaccacugguccccaacaaggccucaccagccuucucguuuaccacguguagcauaaugacccagacccaauaaagcauuuacuaagucaagaauauuccacacauacucuuccuuaccuccaugauggaguaguagacugauuucaucuugauagucugggucagucacuccagccaacacuguaacuuccuucuuagccuguugacuuugagguaggaggagcccaaaguggccaggugacaaucuuacaguuuaauggaauuguuguugugucucgguggcagcauuucucccucuggaacuaagaccccuaggccagcagaacguaauguugugggaacaggaagcaaaaauuuugcuagugggucacuaggggugauggugaguggugccacuuccauuucugccccuugauuccuggaccugugaauccuggcaaugggaaaaacaauaccauauauuggacacugauucagagcauacacagccuucuggagaacuuugccucagcccugcaaaguauugucaccuaguuggcauuguaauugugacuucaaaaggccauuccaccauucuauuaauccagcugcuucaggaugauggggaacaugguaagaccagugaauuccauaagcaugagcuguuugccucugugcaugcuacacaucugauuggccaggugccuuccuccugccauggcugcuggucacugucaugcacuuacaagcaugggucagguagucuucaggaacgcaguucugaaagugaaacacuggaaugcuuuuggcugucuugggaaacaaaguuauuucucaugggauuuuucccuuugaagcugccuccuaccuugcuauugugacuaugauccuuuggggagaagaguaauugucuucuugaguucugugaucugaagggauguggccagaagauuuuucauaguuuuacaauauuuucacaguauuuuuaggagcaugacuuuggucugcaccugugacuacguacaaggccauuguuuauuauucauaaaugugggaugugaacguuugcuugaucuuuuugaaugggugguccuauauaugucuuuaugauuaguuuccuuugaauauaauauuaaauggaguuugggaauaguagugaacuuuacaauggcuucucuuacauacuuuuuuuuuuuugagcccagaagugaggcuuuuuaaaaauagaacuucacaaauuacugcuuccuuuugauacuggauauucaugaagugcagugaaaauagggaauaaugagucauucuuuuccuccaggagaaggaggaacaaacaaaugugaaaacauuuacaauaucuuuccacaguccaacccuuugcuccuccccgguuguguacauaaaagcauacacauggagccaauggcugcuuugcagacaugaagcuagacuagugguucucaagacuuugggcucaggaccccuuuaucuuuuuaaaaauuaugggccaggugugguggcucacaccuguaaucccagcacuuugggaggccaaggcgggugggucaccugaagucagaaguuggagacuagucuggccaacauggugaaaccccaucucuacuaaaacuacagaaauuaggugagcauaggaacgugccuguaaucccagcuacucaggaggcugaggcaguagaaucacuugaacccaggagacagaaauugcagugagccgagaucacaccacuguacuccagccugggcgacagagugagacuccgucucggaaaaaaaaaaaaaaauuauggagggaccccaaagagcuuuuguucauauggauuuugucuauugauauucaucauguuagaaauucaaacaaagaaaauauguaauccauuuaaaauaacaauaaaccacccauuacauguuaguauaaauaauauuuuugugaaaaguauaauuuucaaaauaaaaaaucaugagaaggguugcauuguuuuauauuuuuuuaggucucuuugauacccaguuugguguaagacagcuggauucucguaucugcuucagucuguugugauagguuguuuugguuagucuuugaguaucucacguuacacagaugugugguuggaagagggaggaauauuucaacccucauuucagauaauuguggauauuccucuugcacacuucaccaaaacucaacaugugauaguuucuuaaagcuuaguaaugcaaugugaaaucacuauuuuuuuuccuccucuacuaccuuaaaauccauccaacugacuugcccuuugaaugaucuuuuacguguguuuuauccaugcaggcauauccacaugcauccaugcaugugaugucauaccccggucauuucaagaaaaacuauuuuugaaaugaaguaugcagauuucuaaauagugauaguuuucaucauauaacaucaaaaauuuucauuuguaucaccgccaaucuugucagaaaaguugcuaagucuuuggaaggugucaagcucauaguuagagauacaaguuugccacauacauagaacugaaaaccagagucagucaaugucuggcacagucauucuuucagguaaaaaucuugucccaccaaaaaaguggcugguucagcuugcaacuccaacagcugcagaagugcguuucugcaagacaaccaucacccuccgguagccagcaaaaaugcuuuaugcaugcuuuuuccaugucauaccugagaaaaugaagacauggacucaaaggucgaaauguuuaaaaaucgguagcacuucuuuuuuuaaguguauucagagcaucugugagacuuuuuuguuuguacuuaaagagcaugccagugaauaaugugaugaugacuaguacaguuuggggcuacuacuuugauucauguuaaucaccagcauguuugcaccaucaaaacaaauuucaacacagcaauaaaaaggcaaguacuguaucugaauuguuuugaaaaucuuauugauuugucugaaaagugaucuaucuuuucaguauuauauauuaauauaaaauauuauauuucucaacauacauguacaguuauaaacuagaacuuaauggagaaaacgaauuggaacagauugccacuauuuuccauuauuuuuuuccaucauuuaacuauguaaauuuaaagucuuaauacuuuuuugaaguauacguaaaaauggaguaugcugauuacauuuucuauccuugaagaaaguugagcuuaagcacugucagauuuucaaagccauaugguuauuucugaucuaauguugagaugccaaucauauaguguaugcauuucaguuuagcuuuaagaucuuguuaacugcuuuuaguaccccugugaacacaucagcaaaccaucuuuucaccagacagccaaagguaaccuccggaugugaggcagugagaaucaauauaguaaggguauuuuuagggacuguugauggauugcuguauuuugagcuuaacuucaagugccaaaggccccagagcugacuaagaugaacucaccauuuacugaggacgggagaggccaucaggcacauagugggaucugggauugccaagacaagauguacacaccuuucccuuuguaguuuuggggagaauucuuguauauuuuuuaguagccuaauacgguauuuugaugaggacuuuguaccacccuccuugcuggagccaaguguuacucauuugguaaccucccgguccugggaacacauaacugugaaauucuaggacaacgugauacagcagcgaaucaauuaauucucuguaucaggagggaucugguacaccgagauacuaaugacuccgcguccuucuccaaaggcagccccacagaaggcgggcgccacguuaagcugugcugcugucagcaagcugaaagcuaugggucucugacacggcucucaauugcuagcagguuucucucauugcaccucauuugcaucugggacaucaauuagcauguuuguugaggcuaauugaaugaaacucaaucauagcucuuaauugcuugacuaugugaaaagaaaucacauuaaugcagcuaauuaaguguacggcaauagaugcaacauaauuaggagcgaaauguaaaaaacaagggauggcaaaggugccggagcaggguugcagggggacagcgaggcacaguuaccgagcaauuggcggguucggaaacaggucccuuugcucuggcgccugcuuggaaaaaauaagccgcaugaugaucauggacaacuugagaaggaaaaugcaaauagguuugcaauuacuacuuuuucaagcuguugaggggcaggagauggcaccucuggggggccuggcucuugagugggccccagggacuuguuaagugcuguuuaaaaguacuuggcuuugaauuacccucacgccuuguuaaaggguuuuuccucuuuuaucuucgaucagcauuuucaacaaggaacauggagaaggguaguaucuguaacauuugcauaucaaaaucaagcuuccugucuuaauuuuaccgaggucccuaacucagacccgugaagggucugcacagccccuugacuucuacggaggacauuguuuagugguuguagcuuuaauuccucaaguaccaagcuggggagagaugaaaaggaucaguucuuucaaaaccagaaagcucagugucguuucucuugggaggaacuugaagccacagauacaugugucuuuaucucccaccugugugugaagcgcugagucggagggcuuuuauugaguaggaaaugcauuuuguaaaauuuuuaaaaaugugcagugccuugaaauauaagaauuggcuauuuuaaauaccgauuuuauuuauuuuuuuuuuuuagagcuaguucuucugagguuguaacgccuaacucaggcaagaaaacagaucccuuagcccaugcugagcuaaagauaaauggguucccuugccgcuuucgaaucuggagagcagacacuugguacauuucuauaauaauuuuaaauaaaauaucgugguuauuguauguuaaaacaugccuauuaaaagagcccaugcugaggcuuagucacuaucugauuagccucauuuuagagcccauaagcaauaaaugcucaauuacacuccuguuauuguauuuuaauuuguuaagaauuggcauuaaggaagaaaguuauagcaaguugauauuuuuaaaggaguaacugugcaagaaggaauucauuauuuacaagcauuaacuuugguuuggaaaguuggguuugcauauuuucaguggauauuaauggaaguaaacuaaagaugcuugagaaaaaccuuuuuuaggaagugaccaacacucaccacucuacggugugcuuuuccuuucuuuucucuuuucuuuucuuuuugagacagaguuucccucuugucgcuuaggcuggagugcaauggcaugaucucugcucccugcaaucucugucucccagguucaagcgauucuccugccuuagccucccaaguagcugggauuacaagcacacgccaccacaccuggcuaauuuuguauuuuuaguagagcaggcauuucaccguguuggcuaggcuggucuugaacuccugaccucaagugauccacucuccucggccucccagagugcugggauuacaggcgugagccaccgcgccccgccugaugugcuuuucauuugucacccucaacacagcgcaguccugagaauuccugugccgcuuccagcucuagcuuuccuuccaucuaguuuaacagaguuaauucaauaguaacuuucuuucugucuuuggucuacauccucucaaaguugauuauguuuuguggaguccagcaucucaacuuccaaguggaaucccuuucgggggcuggugaagucagauuuguuguucccagcccagauaccacccucccguuacccgaacccaccaugacagcuuuccuccaagggggcuguggcugacuccagccagccugcccugagagucaggccauccucccugagccacccuguaaaaugaaauggccagucaccagccucggguggccgggcaccucugcucccggccucugggcugaugugagaugcacgcgugccaggguuuucugccuggauagccugucuguccuuugccggggaaugcccggccuugccccugccucugaauuugccccacuguagcacaguuucugauccuuucuccaguggucuucagcccauuguucuuccuccugguucugacccugguguuuugagcuuucugucugcaccaagacuuccguccucaggggucaccagggacccugaaacaucuugucccucuggggcugauguaggggagccugcugggguucuguauuuaucugccagagugucccccgccaguguggcugugcccucauguaaagagguucuccucccgcccguccugccguugagaauuccugcacccuuuucccuugagucugguuugacuccauguggcagccuguaagucauguugguugcgggaaggucuacauugucacaccccaggcucacccaccugaccaugguugggcagggagaaaacagcucuucucauccucugcccugaggacccacaguuucauuccuuuccccugaacuggaauuguguacuuuguggcuuuuguugugccuuuucuucuaucagcaaacaucuacuuguugauaaacccgugacuccuucacaaguguggguguugcccugcaauuaaaagguggacugcuugccugucaucccagcuacucgggagacugaggcaggagaaucucuugaauccggaaggcagagguuacagugagcugaguucaugccacuccacuccagccugggcaacagagugagacucuugucucaaaaaacaaaacaaaacaaaaagguagacagcccguuuccuggaagccacugggaucucgcuuuggccucucugcuacccuacccugugucccagcagcuuccucaauacacuuggccaaguuuccuugucccugagacagaggcuuccgacccuugcauagugauucuagaacuugauccaacuaucucucugcaucggguaacugccauugggcaguuaaaagacagcagcccacuucuccacccugccucggucccuugcauccagcaugugaguuuauuuggcaguucuucuaaaauuacguuggcugagcacgguggcuugugccuguaaccccagugcuuugggaggcugaggugggagggugacuugagacuaggaguuggauaccagccugggcaaccuagcaagaccucaucucuaaaaaaauuaauaaaugaaauggaauuauggucaccugaacuuaauuacuuuuaacaaagacaaauuuauugguuuucacaucuaaagggaauucaccaagaugcugccaaagaaagagcauauuuauucccacuuccugcauagucuuaaaacacuugaaauguuguuuuuccaagaguaauuuucaaauacagucauuucucuguauucaugggggauuggcuccaggacccuccagaauaccaagauccucagaugcucaaguuccuuauauaauacagcauaguauuuauauauaaccugcacacauucucccguauaccuuaaaucaucccuagauuacuuauaccucaugcaauguaaaugcaauauuuucuuauuuguauuuuuuuuaauuguuauauuguuacagagggcugaguguauauucuuucuuaacgugugauaucaaguaauauguguccagaaugcuuaagauacuguguuugcagacagggagucucauuaccagaaauaauaauaauaacaauaauaauaaugagugaugaugaugcugcacuaaaggaucaguaacucacuggccagcaggcccaucccccggcucucaguugcuuguucaccuuccccguucccugcccaucagccaguuuccagguaguguuugacuccacagugaguuaagugagcugccagagagcagucacuguccaccgaggcuucccuguaguucucugauugcugcuggucauuugcuuccaaggccuagaaagccagauaccccuuggacaucuuccugguucuuagcacaacaguugaccuuuuuacuuccaguuuucaccugauuuuucaccagagagcuucagucuuaucuagauuuuaaugauauucccaucugagacagaaagguuauuacaaaaugguuuccuacuccauggaauuuuacuuggaauuuauaggaggagccuaauguacccucugauaagcaagaguucaaaaaaucagauuuuguguguagacuuacuuccuaaugacccuugaaggaggcaccugcugugucucuccuuacaucucuagguccuggauuaguucaggacacagaagcaaaacucugauuuaaauauaauaaugauguuaccaguacucuauagauaaaaaucucaugauuuuuaaaguacuuuccacaguggaagggucauaggguuuuaacucaugacgucugauagacccuuuuguucuagguuguaaaaggucuuuuuuuuuuuuuuaucucucuuggauguuuaacauuuucaacaggauuacaugcagaauguucaugguaaggagauugaccuucugagaaccacugugaaagucccagggaagaggccaccccgagccacgucagccugcgcacccaucuccagcccuaaaaccaauggccuauccaaggacaugagcaguuuacacaucucacccaauucagguaagcuuacagcaaaugcacuaacaaaucaaguucaacagcaacaggugguccaggcucgaggauaauguuggacuccuagguuaaguggagacaguaacuaucacauuacagauuaagguuuagaaaccugaucacuucuguggcugaucauuuccuuuaaacuuucaguuccgcaaaugccagcgagcaaauggugcuuugagucacagcugcaaaaaccaugcaucuaggccuuuccagggcugcauaguggaaagugaaguuaacaugugaacuggguuuuuaagauccuucugaaaaacgugaauuaacguuaaagugucaaagauuaacucauuucugauaacuguauguaugaaaguggaaaaaccauucggagcaagauucagaggaaaccauuugaccuauauaaaauguaaauucuguguuguuauauuuuaauuaucugccauucuuuaaugcaacuuuaguucucuguauucucuuuuaaaggagauuuuuuuucauucaggaucagagaaagcuguauuuucucaaauguugauguguuuagaaauuccuggccucugugcccaguugcaagccauccaaaaugacauuguucauuuuauuuacguuuuugcaaauaauugcccugugucaugaaccuucccaugucugcucaucagagauaaggagaagauccucuugagcccucccauaaacacacacacagagucaggcuccuucaacauggggacaucccuucaagaauuugcauuuucuccugcagaaaguccagaacuuucuucucucccaccuacauccagucuucuuaaaacagauuucuggcuaggcgcaguggcucacaccuauaaucccagcacuuugggaggcugaggcggguggaucgccugaggucaggaguucgagaccagccuggccaaccuggugaaaccccgucucuacuaaaaauacaaaaauuagccgggcgugguagcaggugccuguaaucucagcuacuugggaggcugaggcaggagaaucgcuugaacccaggaggcagagguugcagugagccaugauugcgccacugcacuccagccugggugacagcgagacucuaucucaaaaaaaaaaacagauuucucuccuaugagaguuucuggucuuugaugcugcacuuuccucuucugaaacaucaagugcuuuuaaagagggauggugcugacugccugguucugaggcaugaacgacacugguaggugagagcaagaugguacagaggaguucaaauuuggguccaccauccugggcuccgcugcauaguguuaggcagucacugagcugguuccuucccaccacauuggggugcucuugccuggccugccuguguugcaggggggcggugucagaggagacaacaugaaagugcugggaaagcuggauacaaacacaagcuguuguuucuaaucaaaguuaaaacuggcuuuaugcuaaaggagucuuuagugccucccaaaaaagugagaacaguauuuuuccaggggcuucuaugaccugcugaccuuucuuccaagacauccgugagauuuuucuuauuagagcggugugcuaacuauggggugggaagagagaaaagaagggcacaagaaagaaaaaacaauccguagugaguaaaaugcugaaggcuuuauuacauuaguacguuacauaaacucaugcauuuauucaaaaaauaucuauaggccaggugcaguggcucacgccuguaaccccagcacuuugggaggccaaaaugggugaaucaccugaggucagaaguucaagaccagccuguccaacauggugaaaccccaucucuacuaaaaauacaaaauuagcuggguguggagaugugcgccuguaauuccagcuacucaggaggcuaaggcaggggaaucgcuuaaacccaggagguggagugcagugagccgagaucgcaccacugcacuccagccugcgcgacagagugagacuccgucucaaaaaaaaaaaaaucuaucaagcaccuauuuugugccagaaguugugcgcacugcagauacggagucccuaaccucuagaauucuuccauuuccaccucccuucugaccaucacaucuagucaucuaguuacauaaguaaaagcauuuauugaguuucauuuuuauaauuuuaaauugauaaaaauguauuaaauagaauuaauuuaacuuaaauaaaaauuuauugaucuuuguaacaugguguuuugaauuauguauacauuguggaauggcuaaaucaugccauuuguggaguuucuaacgugugccugagucacaguucccgccuucaggaaucuccccuguuguuggggagaaagacaaguagauggaggccacacggagccacaggccccaggagggcuguguaaagggcagggcuuggagacccagugaugcugcggucggcuccccaggagguaggccaggcuucaagggaugggggcuaccugcugaguuugaauaaaggauaggaauuugccaggcacacagauaugaaggaagggcaccaauucugugaagaagcguucacuauguaaaaguaggauuuugaacuuccuaaucuugagauuuauguuccuuggagccaaaugccacuguuguccuaagggaaacacuaaugugugauuuuaaguagauaauacaaaggcccuauaaaccguaccauaucugauggagucggcuguggcaugggccuuucucuuugagggagugaguuguguguccuuggaaggcauuucccauugcccaguuucauucucuuuaagagccccuguugggcaaaugggaggguugcgacaagauugaaaucccuuuuccauggucacagcccucaguguguaacaggacaucuccgcaacccucaaacagguuaaucccacacaggggccuggcugacuuucccucuucucuggauuccaacuagggauagagaaguggagguaugaccuuagcacagaggcguugccacuuugggaagaagaaagugccucacggccacagcagugcuaagggaaguggcacccugaccaagcaugcgggugaagucaucagcuggugugcggcaggagggcgcagaucucagauagcagcucccuguuuauugcucagcuucauucuuggguucugagaauaagccaugggcggaggcacuucuguaagaggaagcagcuucauuaaaaucuugggaaauuuuaauuugcauucaccuucucuaaacaugaacaugaaucuguaaagugauacguucuuucuugcuuaagaaauuaaagcauuuggggauuugaguuuuuauacucuuugaaaauugaguuucuugugcuaaaaucaucauucacaaaauguccucucaccugaggaauuccaacacagcaaauucaaucugaaauaaauugaggcuacauuuaagagacgggacuuccagcuaaaaauagguauuagagagcuguuuuugccaaaaaauugaauacuuaaccuuauucuucacucuugacucauuuguuuugucucaguucugggugaacuggaggguuuucuuucuuuguauuuucauuuuuguauucauuuucuuaaugcgauugaauuagaucaacauuuuaugccuucucuucccguaacuugcauucacauagaccugauauauguaugagccuaaaucuuugugguuaacacuuauuauugcuuuggaauaacuguccauauauggaaugauucauucgguugguauaaccauuuacaggguucuugauacacauuuccaaauuaacuucuaaaagguuuuacaugaaaacucuucccauccauagccaucaccaguuucaccucacacacuugcuaaugcuauuaauauuauuguuagaauuuaugcuaaucugaugagcgauaaaaaugccucauguuuuguuuauuuggauuucuuuaaucgguaaugaaguugaacagcucacauguauuagguguauguguuucuuacguuguaauuaauuguuuagguguauccuuugcccauuuuugcacuagguucuuuuucuuauugauaucugagaacuccuuguauauuuaggauaugaauauauuuugcagguauuuccccaguuuauuauuugccuuuuaaauuuuauggucuucuuuacauaaaaagguuuucccucuuuuuuauuuauaaucagauuaucuuuuacuguugugauuucuacuuuaagcuauuuagaaaaccuuucauaaucuugaaaccagaucacaguuuacauauauauacuucuaaguuuuaauuuuauuguuuuuuucccuuaaaaaauauauguauguguuuaugugugugaauauauguauaugcauauauaucuguguguauguguguguauacauguauaugcauguauuuagccccuaauccaccuuuaauuuguuugugucuauugugugugauagaaaucuaauugaauuuuuuauucaaauaaauaaucaacugucguuuuucucuuuguugaauuuuuuuucuuucccuauuaauuccauauguugccuuuguuguagaacucaaucacuucaucaaaugggcuguguuucuggccucucagauguguuccgagaccuggugucccugcauugucuuaccuuauguagauuuaccacagugucuuagauguaugacuccguuuguaucugguaguauaacacaguugaauauuucucuuuuaucuuccaguuuuucuuggcuacugcugccugcuuauuuuuccucaaaugaacuaaagaguaacuugaaaccuucuccuccuugauaaaaauaauccccucauuggugcacaugacaucaggaccucccgaggcugugauacgggcacguaaauaaaauaauaaaaauaauucuaucauggcuuuuaacuggcauugcuuuuaagcuaugaauuguggaggaaguggcaucuuuacuguguggaguuccuuaucguggaacacuguucuuucccaguuuauucaaauuuguauuauagccuccagcaaaguucagcauuuuuuuuuuuuauuuagcugcuggacaugucuuguuaaucuauucuguuuauaauuuuuggugcauugugaagcuaauccuuuuuagagaggcggggucuauuaugucaucuaauuggucagaaauaaaacuccuaauuuuuguguuuucuauuauucagccaucuugcugaacucuuguuaguuggaauagcuacuggauguuucuguugauucucuagcacacagucauaaugcauuccauauuucaaauacuauaaugccuaacugugugccaccaguuuacugauacagagacuggauuguguugccuccugugccauucgucuccauuguuacugagucugcuguaugcccacccuugauuaaugcucuggauauugggguggggggaggacaagacgucucuccaggagccuuacacucaaguggggguggaggaguccaaagauaaacacacaaguaagaucauuguaaggaaugauaagugcugaagggccauauggggcaauugaauagaaaauaccuggaggggcucgggggugggguauuccuagcauuugggaagugauuugccuguauugaaauagugacuacauuucacacuuuaaaaugcuggaaauguggucaucuucaugucaguuuuugccaugggcuugggagagaggaagaaacacgcacugucagagcagcugccuugugcacugcugaugacugggcucaggccacccucuggggcucaugcauugaggagagcagaggagcugcaauggugaugggguggcucuggguuccuuguggcggucguggaguucaggagugggcuggggcacagcagcaggcugugcgacgaaagcaaggagagcuggccaguguugucccugccaccaacacccccaggagagcaugcaucggaacaggcagcaugccuagggagagcagaaccuuuugauguggaugcuggugcucaaaaaagggaaacagagaugauugugaaacucaaacauccucagucucagaagaagagaaagaaauggagaggcaaggcagcccugaccguaggugguaugaagugcaccggccagcucacagccccccacacgguaggucuaaaugaaacccgccagucauuaugggccauacaccugcucagagcccacaaccagccuucugguuggccaaggcugcagagaaaaccccuucaucugccucaucaacccacaugcucuuauucauagauaauggacaacgaagguguuugugggaaccaacaguaaaaugugaaggauaacugaucuuaguaagagugacauuuuagugaaagggaauuuaaaaggaaauuauaacuccuaucaacagaaggauuuaauacguuaguuauuaaugauacucauaaaaugaggcaaacagagagcacguguuuggcccagcgcaguggcucaugccuguaaucccagcacuuugagaggcugaggcaggcagauccccugagcccaagaguucaagaccgauuaaucuaggcaacauggugaaacccugucuuuacaaaaaaugcaaaaauuuagcugggcauaguggcgagugccuguggucccaggggagacugaggugggagaauagcuugagcccaagaggucaaggcugcagugagccaugaucaugccacuguacuccagccugggcaacagagugaggccugugucaaaaaaauaaagaguaugugaaaauacuauaggagaaaaaguuuuaugaauaaagauugugaaaauaaaaaauucauuagauaaauacuguaaagaacguggcuaaagacauguugguagucaaagauguaacagaagaauauaugcuagaagcaaguaaggauaucugaagagucaaguaucaaguuggaugggagaggaggcucugcaaaaauacaaauaaaaucuuaaaacacaccaaaaauaggagaacaacaagguuaccuacaaaagaagagaaaucugacuguagacuucucaagagcaacaugcauucuuaaauauaauggaaauauucccuccuaaggacaaauaauucugaaccuagaagccuaugcaaagacgacuacuaaucaaaugaagauagaaaaaaaagacaucuuuagacaaccuacaggguuauacaacaucucugucuuaaaggguuuugaaaaaauuacugaagggucuacuccagaaaaaaaaagaagaauccaaaagauauucaggccugguuaaaccuucccuuccucauucaaggucacuggcuucucaagaugugcauggccauuauccacuuccauucuuuuggccuggaacuuacauagucuuaaguugccauucuaaugaggauccaccagaagccacauuuuggagaaucuucccaacuugaauuucagguauagguccagagaaggagguaaaacgucaagguauuuucugacaugaauguuuggccagccuaguuuggugaagcuguauccacauguaacaaugcagaguuguauuagcuuccacaguuauuuucacauuuaaguagagagcaggaaaacauaauguccaagagcaaggguuucggaguccaaaucacugaauagaaucccauuucuccugucucagacccuucugaaguugucucacuaaaccccagcuuccuuguuuuuaaaauggggaaaugauguccaccucuguucuauggagaagaacacacggcauuccuuugaaaagcuuggccgaugcugacuucacagaauuacaucauuaauucaucaucaugguuaugccaaaagcaaggaagaggggaaagaaauuauguucuugaauuaauuuuucaaauacaauaaagcauugacauagccuuugaguggacauaauggacauagggcuuagacuucacaaacccaugcuccccaacagacagcaucccacuaucauggcagcaagggggcagacagaagaaaugcucuucuggacuuucauggauguccauggagcugucugcuccaguucuguguccuguggucacuuuauucuguaacuccugguugugacauuuuuguucuaggaugacagauaccuucuugucucuaaagugugucuuuguuggguuuuugcaacuauggauauguuuuuauccuaaccagauugaugcuuagaccuuugucaaaggaauccuuuccccuucuccucuacaucccccccuucccuacuugaggcccccagcgguuucgaaauauuaaagccuucaggaggguugaagcugauuuuccaggggaggugggggaggcggggacagcaaauguguuuugaguauugaacugccguugacaucuaaagucucaaccaugcuguuuucuccacacuucagcaaucaggacauccagcaaacccauaaaaaaccaaacuaauagcaugaauauucagugaccuagaauacuaauuauugucaugaauauuaaugugaucggacuugcucuuuccucuccucuuucucucucguccucuuucucccucucucccucucuuuuuuuccacuuagccggcucuaaagaugggucauaaugagagcauuuaagagggagcgcucuccgccgugacagggaccgggguaauaaggagagcuugauuaacguggugcacuugggggagagaugagaggcuucacgugguccuguucgggggaggcaaugaggcaccggcggcucuguugcugcucccggagauuaaugaggccuaagagugcauuaggaacagugacaaagguuugaucuaaugggcucagucauuuuuccuuugagugacagacgcacagaaguaauuggcugugcagaauggcagcucauuggcgguacuuaaggauacauuauccccguuguguggcccgcagaggcuguuuaucaaaacugcucacacugcagacgcggagucgcgaagcugcuguuucagugguaauagcuauuaaaaaaaaauaacgugacaucaaaacuagacccguuguugucucauggaaagaaaguuuuucuuuguuuaguuucaaacggucuagaaaacauuauaauaacucuggaguccggagucuguugugggcccuggaugagcagugucaguccacaccuguccccugccggcaugcgguguggccaaggcuugguggaacacagauccuugcuucccacucaugucgaccaaggucacucgggaguuuuccacacauuggaucuugguuacaacauauaaauuggaagcuucugcuaaguacccuucuagcaccuugguagaccauuugcaaauggaagccuuacuggucgagaauuauuuuucugaaauaaaaccucaauaucaguagcaugugauaucugcuuucauaaaccagguuuuguuggaauugguuuuaaugucuauuugacaauuuuuagggaaaauguuaauguuuugugaggcuucucagacaucagaaaguuagcuaaaucugacauuagaggacacuaaaguucaucuuaguucuuuuuaagaauugcagcaucuucagcuuuuaugagcaaugcguucucacuauuaguuguuuccguguuuauacauugcucccacugagguuuaggcaaauucgugugguauuguuuccaucauuaaauuguaaacucuuugaggcauacacuguuacuucucuuucuuuguuauccucucuuaguuuugugaccuagcaauuauuuucucauuagguauauauuccugcauguuacccaucauguuaaauguaagugauggauguugaggagauuaguugcuuuccugcagauaauguuccccuguaguagcucucugugguccugagcauugguguguaauucagaaguaaguauuguacuuccuaaauuaaggauagcuucaauuauuugaacucuaaguggaguguucuuuucugaaagaaccaacuaaagcaacuugauuccugaugauuucagcugagacauaucaggggauggccaggaccuugaguuggaugugguaacaggugugccuacaaguaaauaaaaggugcuucaaacacuuuuuuucucucaaaaaugugugugggcagggaggaauaguguuucagcugcugaacugaugcuuccgagaccagcgaaguggucugcagggucagcugugggaaagaggaggugcccggaagagccucugugaauuacccgcgcccccuccaccagggagccagcugccagccccgggggccagugagaaccgaggccuugggaaagggcuucugguucuuccaggcuagaguugaguccguggcuucccugcuuccugcaguccuuucccacacuggcagaggagaguuuuucgaaguaaucgugacauuuuuccaucucgaaaccuuguggcccauuguuuugaguuaccacucauauagugaacguuugcguuucuggaguauuucuagggaguggucaaaccccguaacaucccaaccagcaaaccuguaaaacccgccucauguuaucagacuugugagcccgggguacuccuuggugcuuugucuucccugugucauugcuggauucaguugugagaucauuuuguaagaacuggaaagcagagaaagaaguaguagugaauacuucucaggauagagcuguggggccaccugcuccuggaaggggacuguaaaauucagagaugaccggggaacgcuccccucaaaacaguguugucaaaugaaaaugaauuucauguuaaaaacacacacacacacaccuguugcauuuaucauauaaaggagaaagaauauuguaaagauggaaccguuauucauggcaaaggaagacaccaaacaaagaaaaauucuuuucuucuccgucuucacaaugcuuacaccccucauccucgcuguugcaucagcuuguccauauaacccauaccaggagauggauuguggccaagacaagccguacgauggcgcucuccauaaacacugucggaaucuggagcagcacguguuccuucagcagauaaaaauggcaaaaugagaauggcacacauuguuuugcaaaggucggaauaagacuccacguuuuaggaagugacgacgaaccgucuaauucuaggauguugaauucugcuuggccacguugauguauuuaguagucguuaaauuugucauugcaacugggucuggauucuguauauucuuuuuucuguuauguagaacuguguggcuggagaaagcaacuuugucuuuagaauaaauacuuacacuuauuucuaaauauaauuacuuaaaugagaacuuagcgucugacaugguaaauauuuugucuuaaauuguaccaauugccacaugauauccacucccaacauggagcaguaacccagggaugggagggaagggaugacucuggcgcuccagcucacugucaccugcugucaggccauguccuucauccgcugcaugcgcauggugccccaagcgcaggguuguuguuuuuuuucucuccuuccuuucuuuuguaaacuguaccucugacaacauuggcaucgcucugaucaucagaccuuugggaugcuggaagauggggggugccguggaguucuccacagcaccaagcacuucacuaguugaugguggguguucaguaaguacucacagagggaaugaaugagcucaagcaaagugaugccaacuacagcacuaaagcaaacaggaggcagauggcaugcacaguucauacaugaagagacaccauuacaagggaaacauaaggaaaauauucagacauuuuagauuuuaaagacaaacaagauuagcaacaucaccauuuuaagcuuuugcuaaaaaacuguagagauaggaaaacccacuguugaugagauuaauaacugauaucugcagagguuuuacaguuuacagagugcuuuacauaauuugaucauuauauuaaccacauggggcauacuguuaucauuaucaccauuucuucauuauuauuauuauccacuuagaaauuauggacuaaauugcuuuaaagaugcccagguuccaucuucuuuuaguuacuggucauuaagaaaauuaauuagcaacauauaucaugaaucagaaagauauauuaugcuguuuguuccaguaauaacgcugcugagaauuucuucuaaggaaaauucaaaaguagaagauguccuuugcaguguuguuuauagccagaaauuggaaacaaccaaaacuauccagaaguagaaaaauggugauauaaauuaucuacauuaaaucaauaauguuacauaucuaaaauuaugaagauuacauaacaacauggggaaaaugguuaggaaaucauauuaaagaaguguauaaaguuauaucuuuucuguggccauaaccaagaacaauguaugcauauguucaauaaaaaauugaucuguuagacgagauuuugguggauuuaguuuacauuauuuguauaucuguacuuuugccaaguauauuuuaacaguacaacaaaauaggcccccauuauuuuuuuccuugacaucauaauuuagaacagggagaaagcagcauacaaugagcuguuucuacguuguaggaaagagcuguguaauuccaggauguggaauccuaagccuggccacguugcuguauuuaguaguaauuacaucugucauugugacuaggucugaacucuguacucugucuugauaaacauaacauggaaaaucucuuaacuaaacaaaagguaucaagaaacaccagauuugugucuuccuaguagauauguugaauuguacucuuuuacaaaacaaguaucacaggaugcagagucccgaaugccuacaucuuauaagauacugaauguguccuuggaaaaaaaauccucucagccugaaauuccacuugccaaaagcaaggcagaucuccaaugcaaauacaggagcgaaugggccccauucacaggccuuaaaucgugugucucacuuuuuaugguaguguugugaauucuguucuuuuuggguuuguaauuagaggacagaacagauggcgaaggccuaguuugaagugaugugacuguuaacgucgccuccuucauccaguugugauuccagggaacccgguuuucccacacaugcgcacaacgggcguggugcagcuguaggguuugcaagguagccgcucacgcugaguuuuuacagcauuugaagcugccugugaaugagauuggaccgaagaaagccgucccuggauguuucuaagggugaaggcuccauaggggaagggugaauucuugucaaucauauuccuguaauuaggauuuguuaaaauagaagguauacaauucugcagugggaauaaacgucuguuuuacacucaagugcucauagaauccuuuuuggcuuuuuccccgcccucuuucuauguacaugaaaguuccuaucgccaucaccaagaguugcuccucuuuucaggcuuacuuaaccaauaagucaaaugccagcuauuauuuuccuaguuaaaugcuuuggugaaguuaaguccuauuuguaaagacagaccaaaauuggaaggcgcagggaaugaacuuuuguauuuuguuauuguuauuguaaagauuuguugaugaaucuuuauuugaaugcuaugaaaagccaucauuucagaguauauuuuuaaaaaucagaacaggcuauuuuuaauguaauaagcuaauagcuuaaaagagggauucugucuuugaugucauuugguggaugaaaacauucuuguucaauagaaaaccagcaucuuuuucaugcucauuugagaucaguucaggcaacauacugauauucauucagauauaaaugccauauucacuuugaaaugcaaauuguguaaagaaaaauagcauaugguggagguaaguaccuuuucaaaucaacucuuccacuuuagggauauaaguacagcuaaaauuauucuuuggaaagaaucuggcgcuuuugacacauggaagcuugcacuaaucaaggcagcucaguaagcacacacacauauccauaucaaggaaguggcgcagcgaggacauggauuagcaugguaaugcagucacccccugcuaaucggggcgaguaccagcugauccguagaugggguauuugaggaaacacucuuucugaguucagaaugggccaugucgucagucauguauuucaugguaacgcaaauaauauuugggggacgaugccgaaaagguccuuuuaugacugccuuccuguggaagccagcauccuauacuguuuggggcugggccacuuuuuaaggacuuauugcugguacagcuguuuccuuguacaacccuguucugucucuuacacuuccugaccugaccucugcauucacaagccauuccaaugacauuuucuagguuuuuggauaaguguuacugguacaacauacacauaagacgcacagaaucauaagucauagccacguuuacaggggccgccacucacauccagaagcagcagguagccagcccucauggaccccuuccugucccgugcacccccaccccaccccaccccacucacaagggugaccaccaucugauuucucacuccguagauggguuucgccuguccuuggacgggauccuaacaguuggcacucucgugcuugucuccggcucuguguucugugugugaugucaccgcaguuguggcccgugucaguaguuccuuguugucauuggguaauguuccguugugccgugauguaccuacagugauggacagugccgucauucccagcguggggcuguuaugagcagugcugcucugaacauucuagcaccuacuuuuugguggccauguuuaugugcaucuguaugauuuaaaucugaaagaugugaaaggagaagagaaaucuuaaaggaggaaaaaaaaagaaguggacuugaaauguuuuaugaaagcuuugcauccaguaagucaauuagaagagugguguagguuguccugggacagccccgagcuuaggaaacccccguguuuaauaagagcacguaagcaagccuguccaaaguuugccguggagagugacauuuacugucccagacagcaaacagaugugccccccucgcugggaguagacacuaccccugucucaccagucuguucauucugucaacaucccuugcaagauacuaccuuaagucuaagguaguaucuuaagguaguaucuuagguagacuuaaggcaguaucuccccuuuccaucuauucuuuaucuagaugggccuaauuccaaagucuaaaagcugcaguguccccuggagccucuccuguaccuuccagcagcggugggcucccugacccucauacuuucuggcugcucuuguguuacucugccuugcguuugggccacauguggaucugcuguauaccuucuacuagacuagauuguagguucccuaagacagggacuccuuccuucauugugcccaaugcaguaggggcucaguuccaugcggcugcucggcccgcuagaaggucaauguuagaauaggcggcagcuucugcauaccgggucccaucuuccccuacucgcgaguuagcagguuagccugcccuagguuccugggugaugagacuccuggaucaaaaugaaugacagucucuugcagcaauagcaauagugagaguaucagcauugucaugcacuggcuucccaagccucaguucccacagggugacaccagcacacacaguaacucauguuguaagaggaaccccaagcuuaggaaaccccauguguuuaauaagagcacguaagcaagccuguccaaaguuugcuguggagagcgacauuuacugucccagacagcaaacagaugugcucccucuuaaaguagacauuaccccuguuguaccagucuguuuacucuguccacauccccugcaaaauaacacagagcagagagcaccugcccguguccacacccagaggaagaagaaacugaggcccguggagagcuggcugccagcaacaguggggugggaugugcugguagcagcagggagaguggaagucagggaaggauggaagggaagggaagaauggagaguacucaccccccaaaguaggccacauccuuguacuuauccccgaguauaaguguacccucggcuuccgggguagaagcuuccuuuaagacccuuguauuugcgcgugacuugagguuggugaauuaggaccacuuguuagacucaccucgucuacuccaggaaggagggcauucuaaucuggcuuuuacaaucuccuccuucuagggaaauacagacaugccugcaaagaacauuuccaacgauggugcgcagaguuuucccacaucuaaacgaccccagcuucauaucuuacuccuuagacacgggaaugaaauucuguagcaaaacggcuguguguugagguggucccugauggagacaauccagaggcucucuuuccugggcauuacuggggcugaggguuggggcguggcuuccugcagaccccacgcaccuugcaauccucauggcauuucugaauguagcucuauuucuauuagccuuccugaacuggcaacuuuaaugccuggguagcaagcacuugggcguuuccuuaaacucaccgucuuagcuaucaggucuaggugugaaaaugugauuuaacuaaucaacacaguagcagcagagcuuggugucuuuguugacugucggcggccacguggguuuagguccccugcccuucagccugguugcuggguaugaggccuccaccucggcaggacugcuucgagcugaccuggacuguguuuagaacaguguuuggugcacuuguauccuagcuugucuugaugucaggauccuuaccccucaagcaaucaaaaaaguuauccagcuuguuucacaaaugagaacuucagaccuucagccuuaauuaauaacucauuaacgugaaaugaauuccagugagugaaaacaguugcccucgaguacuuugagugagaauacagugauuuuaaacagaggcuuuuuuuaugcuuaaagauauuuccaaaaguguucaaaacuccugugugguaacacauagggcagguauugcuugaugcuuacauaacaaaacuggaugccaggacagcauuaguaggucaauuaguuaaugacauucauucaagaacagaaaugagauuacauauuagacucuguaugcauaucuguaucaaaaaaugcaugagaaaguaugacacuauaauuggauauggaaugugcaugauuauuaaaaagauucacuccacauuugggggugguucguuucuuugacggguggauuuacugaaaguaaguggaaaugccucaaaacuguggccacuggccugggacugcugacacauggcacgagaugcuccaugggcguguuaacccagcauggcagcuuccacagugucguggcucaggucguggaccacugguuugccucagaguuuaagcagaugucuucaugcauuuacguugaaaggcagguacuguguuuggaucccagaaacaauauuucugacccuguguaauuuuuuuuagucaaauauguuucugcauuaucacacaaaauacuuuuguuuucuuuuguugguuuuucugaaagaaaauuuaagugaucucaaauauagugaauggguauauuuugaaacagagauuuacucccuuaagagaaaaucggaaauguuuugcuuauggaaugagccuccuccuccgcauauuuuuggaagguccugaccagaggucaagagugagguggguugagugcagugggguguggggaggcaggugugagccugggcaaccccggaacccacucagauccuucagacagauccagagagagaggcugucagcucuuuguucauaaacacaggcccacagcucccagaugcuuucauuuucuaagugaugccagaaaccaccaauuuuuaaaugaaaucucccaauuuaauucuacuuugaaaaaaaugaucaacuaaguaaaaaugucucuaugagcucagccuggacgucaggcgauagucuguggaucugauugaaaguuucaccuuuaucacgguuuguccauguauacaccuugauguggcccaaauucagucaugcuguuucaguguagucccgcagugggaaguggguguggcuggggcuggggggccuucacgagcuauagggcucuaagagucugccgucagaaggauuguggauagcuggucuggugucuuccaucuggacaccaggagcauguggucuugccaggagguucgucaccccagagguuccagguugguuccuuggggacucucucaggaggcagaaggugggcucugagccacacccucagagcugcugcaccagcaucucaguggauuggacuuguccuuguauuuugauggacagacagaaguuugaaaaccaguacauucacagcagcauucacagcagaguccuguuguuuccuaguguguaggcuugaaggaaucucucccuuccuuuuuggcagugugauguuuggccaugagaugaagaacucauaaaccuaagaugaguucuugaucagcaaccuccauuggaacauuucguggucccuugucugggguugagauugacuuggcucuccuuacuguguguugauacuuacuucuggagcuuuauugcaaguagucagugauggaugcacugaaauacuguccucugccuuuuaaaggaaauuguucuggaagguuucuaggccugguugucaucggagaaccacucuccagggagaaggagcaagagaagcggugcucuauugagugccauguugucaucguugucccaaagauggagggacagacagacacagugaaauuccuuuuuguuuuucagguauuuggaccuugugugccuaaagcugguauaaaaugaggucuguggacagauggcaugcuuaauaaugacuugacaggggucugauugggcauugcaguguggaaggaauuaccuccuuaucaucuuaccuacacagcaggugucccugcagguagagcaggcccagaagugccuggcacagcagucagggucccagcaagggaggugcccccccaaucgcacccccagcugcuugcaggcaucuugucauuguccuuuuccaccuuugcggaguccuuucgcccaccauaacagugucagcagugucuggaagccuuuugucugcucagaauucacgugaugaaagcggaaccaggccagggaagccccggcagccacucuugggaggcgccuccuccccaaacgcaccuucgauggguggaugugugggauugagagagagaaggggaagagaagcacacaggacagugcaggcaccagggcuggcagaaaugcaccaggacaacccaugggccccaagggccaaggagagagggggucacccagcaagacaacugcucggggaacgagcccuggagucagcacccacccucacccuccucucuccuuuagauuccugccaugcucaccauugguugagcccagugagaagcuagaaggugcuggagccaacaggugcagcccauaugggugccuucccaggaggagagcagggcggagaagggaugugaagggauguagcaggaacauggugggcacgggcuccaggagggggucccgagaugggaguaucuccucugcuccucagggaugcugccuucuguggggucugaaugcccuauuguaauagggaucuggcuaaggcacacaauacccagaggacagccacaggguggcuucgaugguggcacguggaaaauacagggaggagcaugagugcuccccuuagugccaugucgccagcucugggcugcuccuccacgucucuuaagaugccacaugccuggcccaccucccccggcugcugugaggccuggugcaagagcaagcaugggagcaccacauggcacugucauucaagaugugggcuccaaaugacgcuguguguuucuagggcguuagggcacgcccaugcccugagauggagcucucagaacaucagggcuugggggcaugagaaacggccucaagacccuacauguaagcaggggagcccagacccgaggcuuccgagccacugcccucgcuccucccaccugagccccuuggaugccaguggucugccgugguggaguuuugauugugauuuuuuguuuuaugguggugacuuucuggcuggagugguuuuuuuaauuaaugugcacacagauugccugggaucuuacuaagaggcagguggcagguggggccugggauucugcauuucucgaaugccucuuggcgaugcugcuucuguagguccgaagaccacaaccucuguggcuuuccgauccuuccuucccuggggcaucacugugggcuuuuuucuggaaucaagcagaccugccuaugaauaauuucccuuaugacguucagaauguacucaguucagacaacagcauaaaauagguaucuuuucuuuuuuuuuaaggcagaacucuauucuucaaagccaaacgccucgucguuuguuaaucgcugauuggguguagggcucguacacuacgcuucagcucgugguuccguggcuucccagugcugcacgggaucgcagugaggccgcuuguuugaggggagaccugguuccugccucuggcuucucauccauaucaccggagugcuuuugaaaaugcaucuuuucccaagccccauucccagagcuucugaaucaaaaucuguauuuuuugaagccacuaguucuaaaaagcuccacaggaaauucugguaauuggccagauuuaagaacugcuaauaugggcugcguauuuauuauaaaauccugcacugugaaaaacuuauguugagacagcuuagaacuuagcugguucugaacuaaaacaauuggaagaaaauuuuuuuuaaaaaagccccaguaccuccgaagaucugcaaauagaccuaacagacuaauucgcuggcagcaggguaugauuggcugagcuuuagagaaaggcacuuaauuauguuuuugagucuaaaauugguaugaccagauaauaauucauuuugauguugagcaacugauucaaaucauuaaguauacaauggaaucauuuuucaucacagccccugugcucuaugaagucacgcagguuguuuuuccucugcuuagucuuuucaagguuaagaguaaacuuaucugguugaagagccugcauuuccuccgugucgugucuagggacuuugauuuguguugaucauaaaguauggcuuccccaugaaaauaauccucuggcaccagacaguugacucucaaugggugaucauuuucuguuccauugguagggugacauggccgggcuccuggagcccccaucuugccggccugccggaucgcggugucucugcuaagacucgcugggucuuuugucuucacuuccacucgauguugcgguugcgguuggguugcgucuuuguauaggguuguucggugcgagccaucuguggcaucgggucccuucacauugcuuugucaggcaccaucaagauuggcgucccccuuuuauuccucccgaauaguuucugucuggcgcuuccguuugccaugcaggcaggacaggggcugcucucggugguaaggugcacuaugugccagcgugugggucccauagacuaacucgcgcugguuucuguggucugcaguccgcggugguguucaccugacuuguuuauuccuagggaaugucacuagugcaucugggucucagauggcaagcggcaucagccuggucuccuucaacagccgacccgacggcaugcaccagcgcuccuacucagucuccagugccgaccaguggagugaggcuacggucauugcaaacucggccaucagcagugguaagagggggcucagccccacggacccgcagccaccucaagguccuucguuguaagccaggggcuggacaggacgcccuaagcucucaugcuccucugggagcgcagcacccuguggggcggcugcaucagagacucacaucuugccuuucaucuguggaacguuuuguccuugcuaggcugucuugccccugucaucucaucuguuccucuuuggcacagggaggagguagucaucccauuuggucaguuuggaaacugaggcggcagacagggcaacuggcuuacccagggucacgugacagaaguggcagcgcugagaaauaagaucugauuuuaucuccccaaucacacugcccuacguggcguggcccacacucuuccaccacuagugcacauuuuauaucauuagggugaauucagucuccuugucuguuuuccagaauuccugguguacccucuaaauucuggaguccccuuuguaauccuucaguuuucaaauuccuuuggcauuauuauuauuauuauuauuuugacaaguguauccagcuuuuuggggaauaagcaugcacguuggaaacgaucucgccgucuguguggagcgugaaugacgcagcaccgagggcacccugguggcugcagcaggguuugccuguggcguuuugucucuggccuguucaccgguauuuaaaggaauucccacuguuguauguaaucuaucagacgggguuuuagaguaaucuuagcauaauuuguucuaauuaaaagauucagcaucaggucuucccuguagacccaccagcugcugcagcaggacguuugcuuuggguaaacaucauccuuauuucuaguggcuccgcagacgccaccaagcagaagccuuaaaggaagacaucuccaaaccaagccgggagacgcggagucagcgagguagcuccacaccauagcggugcgggucuggaagagccuugugacuuggagcagacacacacagcgucacgcggcugccccggcuggcccauucccaucccagcgccagggcuugcuccuucccucaaaagaaggugcuuuguuagauagcaaagaucugccugcagcuucuucaagggcucucuaaggcucucugccucaucuggaaucacgaugauaacccugaaaaccccaaacaaggagguuugaaguuaugauaaauuaaccgucuacaguuuacucucuuuguaaccacugcaugccccagcgggccugguagucagccuuucaucagcccugugugugcugcagcugaagccccgccaccugccagccaggcagccuaggaugagccuccguaccuccaugagccuccguuuucuuaucuguucaauggacacguucuccccucccuuacguagaaguuaggcaugugccacaacacaggacaguaggcucuucgugacugaagaaccacuguuaaucaugguuccuuuaggaggagcagagaguucacauacucguuucauuaucaaauacuuuaaaauauguauuaucaauuaguauuacuauuugauaagguuucauucuguggccgccaucucgugaagguguucuugcauagggccacguuugagggcguggggagaugcacgcugggccuucuggagccaggugcacaggugacacggacaaggccuugccuuaccaagcagccucugcugagugagaguagucuaggugccaauaauacagguguuuaaguauucaucuaaaauucauccuauacagauuuuccuuuugcacacuuaccuguuugauaaaaacucacuagguaacuuucccucuacugaauagcucuuucuguugagcuguacguaugugcagugggcguuuccacaccgccacaucgugagacacugcuuuccagagccuccguuugguuggaagucucuuuccauggaagugggcugcauugucugcacgcaugcauuuguacaguacccaugugagacuaaagucgccuacguuugaaugccaguuuuuuauucacaaagcaauuucuauaauauuaacacacguggguguccauuaaagaccaguaugcucccugaccucguaaaucuugaacccugaacauagaagauaagaaacaagcaagcggaugccccaggugucagccugcugagggacauggaaggagagcuguagggagagcccagggcugaaauugugcaggucguuuaaggauugauagaguugaucaaggaaagcuucccaaagaaaaucaaacuugagaaaugcuuaaagaaccagauggauuuuuuugugcaaaacagcaggaggaaguuauuauaagcauuggggcacuucggacaaagacccagagaggaggaaaagggaagauggaauagccacgagccgcagugaagugaaaggugauaguuggggugcagaaaaaugaggagagaccagaagagaugaguguugagagcccagcacugccaaauuagcaucugauuuucagacuugggagcugacauuuuacagagcaaagauccagaaagacagcagaauggugcacagaagucugauuccuacagcuuuaugggggucuugguugauuccuguauuuucuaaggauuuuuuuuuuuuuuugagauggagucuugcucuauuggcaggcuggagugcaguggcgcgaccccggcucacugcaaccuccgccucccggacucaagcaguucuccugccucaggcucccgaguagcugggacugcaggcacgcgccaccgugcccggcuaauuuuuguauuuuuaguagagacgggguuucaccauguuggccgggauggucucaaucucuugaccucaugaucugcccgccuuggccucccaaagugcugggauuacaggcaugagccaccgcgcccggccuuucuaaggauuaauaguaugucauaccggaaauauuuugaaaagggagacaauaaucguaauaauaagagcuacaguuuauugagggcuuuauguagauaaucucauuugauccucacagaguagauccuguuguuaccugccuucuacaggggcugccuuugguacagaaggauuaaaugucacuugcucaaagucacauccugugaggggccaggauucaaacucagguggcccgauucagcucuccaucacugcaugucaaggugugccuccaggagcagcagcagcagcagccccugggaacugcuuagaaauguugaucucaggcccugucucagucccacugaauccaguccucaggggaugggaccaggcaaccuguguauagcaagcccucugggaucacauggcaugcugaagcuugggaaccacugcuguaaguccucacuucccaaagccugguccacggaccaaguggcauuugacagcuccggggauuuggcuggugaugcagaauucaggcuccacccaggccugcuggacgcauccuugucugucugcgccgaggguaccaucccggcgucccucugguucgcgucauuccccccuuuagugugcugcuucgucaaguggccagaccccagcaauguuuagugaacaccagggcacaggaucugauggacaacuuccagaaaacguguuuaugaauggauuucaagacucagccuuggcauaaacauucccugcagggcuuagaaaauaaucacagaagaaacaaacaugauuaagagcuuucugucaugcucuuucuucuuaaguugccggugauauaaguccccccugcccccacuuccuuuucgaauguaucugcccccaucccuagucuuugguuuggauuucagagucgcuuacucugugcuggcagcaggaaugaauggggagagccuaagcagcuuuggaauacagacgcccguguuggcaagugugccuucccauuguugugcacucuuacucuaaaacauaauaaucacggcaacauugggauucacuguuucuccgccccccguccacccuaaauuaagacuuuggcucuggagaacuuuucaaagucuccucucuagacacaccgguccccccgggguuucuuccuuuaaagcagcugugagaaacuccuaauuagauagauuccuuuguaggggcaaccuacaaaacaggaggugcugcuuaaauuaagggaagaagaaaagaauccauuucgugaaauggaaugcccacugcuuuaugacuauuacuguuguaagguuucacauuuaaguaccugagguuuaaaauuaaaugucuaauauaauuuggcguugcuaacaugagaccugcaucugcccuuagagaaaaugcagacagcucgguugaggguuucaaauugccgucugccggcuugcaagccgcacggaggauuggaucccuccucugcugaguaccacaugcugcugagcguaauuuuuuaaaugcagaaacauauucaucuugagccucugcauugaaaaaggccguuccaggaguacaugaaaaauuaauuuuuuuacauuuuuucccacucuucuaaguguuugacagaaguaauuuuugcagcaagagagaauaaaaacugguggcuguaaauuccuguccugcaaccucuuguguagauucuuuauggacccagaauugaucuacaugucagauccuguugugguuuaaacuguuuaucacuguaauggcaguagugagcccgugaccaccaacuuauaauccugggugaaagaaauugguguuugcagucaaugaagaggcagcuuugcuuuauugauagauucagaacaauuaucucugcaacaacuauuggcugaggguucucuugaaucuuauuggaagccuguaauuuuuuuugauuaaucauuuccuccauagguaauuuccucuagaagcguuagccacgagucagcaucacuguggguagcaggggcccuggggggucguauguggcauacuuggccguccugucuuacuucaagacaagaugcacguugagaugcgucacaccuguccucagggccagagugcucaccugccugccugccuccugaguaccugggugagccuggcccggcccuccccgcuggcuccugccugggccagccucgucggguggucucagcuaaugcuguugccauggcagccucgcucccccagcccuggacugucagguucuucugauagcuccaccccauccccgauugcuucaguccaacaguuuaucuucugccacgcugacuggccaucacuguuaauacugcauuucuucacgugacucuuccauguggcucuugagccucacuucccucggccucccccaggccaccacgcagccucgucaccaucgagcacaaacaccauguccaucuuccacauggaaggaguguaucacauguguguguguacggguguaugcucuggucccuguuuccuucuggccacguaaucauuauaucuuuccaguagacucugugguuauaaagcagccgauccucaauggaaagcauuugaguuuuugccagcuuuuaaaugucuuuucucauuauaaaaauguuuugcacgucgauuuugaugauggggguucgaaacaugaguuucagcuucggaagcugucugucccacacuuacuuucggagccaaugcauuugaaccacacuuuccagcaagcauguccacaccauucaucaauuuuaaucauuauaguuggagcauuuuuuuucucuucuuggauauuauacugacaauuuuaguguaugaccagcaggcggcgguaaugugauacugccggucucugaccuggaagcuucuuugaugggaggguaucagugaagcgugguggggaggaaauacauguguugacagccuccgcuguugugaccuucaugccuaacacucguuucccuggggaucaucaucucugauaacugagcuuccaaaaggcugagaaaccaagaccauacuuaucauuauuagccaaaauucaaacccagaucuuucugauuucaaagcuuguaaucauuccccucugcuuuuuuuuuuuuaaggagaaacgcaugcuuaguacuaaaacauuguaucauaaaaauuguuugucuuuugauagcgcuugcuuuucaaggaaauauguucuaagauggauagacauuuugucuucucucacugaugcugaaguuuccuuuaucaauucuucccaaaucuuggcuggcauucaaaagcguucccuggggguugucaucaaccuucagcuuagcucaguguuaaaggccccugggcucucaucucucaaagcugggcacucccugccucaccgccgggagggcugcucggcucgccaggcuggccggccuaauuaaaaggcugaccccgcucccuucugugcucggagccugcuuuccugucucugcauguggccgaggagcaggcagaagcguccugggguaacuggacacagggggugaaagguggauuuuuuuuccucccaaucagaauguuguaacuuuguacuuugucuccuuaguuccuuccuaucagcuauuuucagcaguagcugcugaccaggggaaacagaggacagugaaaugcugccccaugaucaaaaccgaacaggggcagcacauuucauucccgaagaccagaaaucuucauguuguugcaaggcaaaaaaaaucuagaaaugcuuguaaacagggaguagagaaggauauuguugcuaguugcuguagugcccggaccagaccucuuggcccucuggcccucggcgugucuucaccuauuccaggggcucgcagccaggggugauuuugucuccuugggacaguucgugauguccggaggcauuuuugguugucacauaggggagggugaugcuacuggaagcuaguggguagaagccaccagggugcugcugagugugccacggggcagagaccagccccccacagccaagaguuauucagcccaaaacaccagcggugccacggucaggaagccccgaucuggacaaugaaaguuucgcuuccuuggccccuuccagcugcgguugcugcguugcacaguaauucaguaagaauccuucccaaagaaaggaaagccgguuucugguuugcaagagggucacugcagccaacccagagcagugccugauccucagggugcuuuccacacagcuucucagagcauccgccuggcggcacggccgguucagcggcaguccugcugccaccagcguagaugugauguaacauucauggaacucacugcuugccaggcacaggcccccaggagaugagugccagagccuucccugcuucagaugaggagaugagugccagagccuuacccgcuucagaugaggaagcaggggcagaaggcaguugggccuaucgcagcagcaggucgguggucaaggcuagauucaaacagccugugucauaauugucacuaagcuguucuccugcccacccgaccgccuccaagaacgcugggugcgcagcgugucccccugcugcgcguaugaagacagggagggugaggccaucagauguguggaugccacaagcugagacauaaucuacauugaaaucuccagauuuagagacuacaaaauggguugaaacuaacaaauugaaacagagauaaaaucuugaauucaggcucaacaaaccaacaguacagauaauggaacaggaguaccggaccugguggggaaggcuugggugugguuugucugcagaaacgcugucaagacuuacauucugcacuaagaggacgagagagguucugaaugucucacugggcuccgaggauccuuucgggggccacauuuugagaaagacaucggcacacugggaagcacaugaagcggagggccgagauggggagaggggccugaaacccacaacaccuagcguggcugaaaaccugggagggccggaggacccucucaggaaggcgucguccaauggcugcccauuauauucuugggggcgauuuuuaaaaauacuuguuccuggggccagccgcuagagaucuaguccauuuggccugggauggaacccaagcaguggaaugucccccagggguuucagaugcgcagccaggguugagaagcucuuucagagggaccugaaugaugugugugaauggugguuauaggacaaaaucugauccugauucuguauaaacccagagaauugaacugggagcaauggguaggauuugcaggaaagacaacuuugacaccaaguaguaugaugcagugagacaggucccagcgacuguuuccagccuucuccucuggcaucucugccuuccucucccuugccugaaggcccucugcauccuuucccgaugaaacuggggaacguccccacuucucucccaugccaaaacccaugccucuccagccucuggagcuuccauguaugaucuguuccugcuuggacaugggguagggcaucccuuccaccucugaacucaucaccucucaucuuccaagggacucugcuuccgcggacacccucucuccugucccagcgguuucucccagguauuggaucacucccuucagcuuacauaccugcucggccaucgcucagcccaacaccauggcccucugcaguuuccaccucuccuucuauucuccuucucaccacacguuccaggacacucgucuguccucagcuaccacccacauucucuucaacccucucccaugugucaucagcccagcacccuccaacacugcucucauccacuucagucccaggagcaccccuugguucccgugguaaucuucauagugggagaccugcugacuccacaucuugcuugaaacccucucuccucugggcuucucugaagacacacacagguuuuuccugcugcucucuggcugcccccugugucauccuccuuuaccagcagaccucagacgauagauguggcccagaacucagcucucuccuguccucccugcacuccucuugaaauaggccugaccauuccucuagacucagaagauacccaaauucacauccccagccaugacuccucucuccucauugaacgcagguaagcagcuaccugcucggaggggaguugggcggcucaugcucagcauauuugaagaacuccagcuuucauccagagcgucuguuucucacccaccuuuucaccaucuauccucccaguaguucaaaacacacccaaagcaucacuugcacacccucccucggccucaccucacagucuguucauuugcuugguucccuccacuugaccuccaagaauaccagcuggguuuguccuguaccuccaccuccucuguguuccccugguccuucugcugcgucgguccuaacucaucucuggccugucauucuuacuucccaaaaguccucucucucugcagccaaauucaccuuuuaaaaaaacaaaacaugagccagauugccacuccccacacccacuccaguggcuucccacugccaguggaauagauucccaauucuugauuucuggcugacaaggccccagcuggucugaccccuguuuuuugaccgccucuccauggcuccagccggcggcuuugcugagaucugggaugagucauccaccagauaguucaggcuuccgcccagacgucagcuccagcguguguacaucacugcagacagccacucuccaucccauucuuugcgguuacccagacuucuuguuuuucucagcauguauuguggccugacuuacucuggacacauucuuguucgacuccuacccagucacaaguggucauccugccccuggcaucuugaauuguuuuccuagcaucugucacuaucugaaaugauccuguuugcuuaugugucuucugcaguaauucuaacuccaccacagagaggggcuucagggucuugucugucuccacuuucuugacuaccuggagcuguguccaucccaucaucacaaugucauugcacgguaauaugcugaguuagugaaugagcacacuuggauagcauccccaaauaggaauaguccaagugguggcaggggugggguggcuugguguauuucguucgauuugcaaaaugagcuccaaggauucugccaguuuuauaugauauaaucuucugaauuuuuaaguaucuuaaugcuuugcauauugcuuuagaaacugguucuuaacagagaaccagugcuggugccccuuaagacagagcauguuggucacaguguauacaguuuauggcagaaaacacuggcagcagucucagcaacagguucuuaaauuaguauaaguaguuagaguugaaacugguuuuccucccucggaucaucuuagccuguuccugaaucauaaguaaagucagugguguaaauuaauagggauuauguagauuagauacauuucacaacaauuuaauuucuuauguaacuucauuuaguccacaaguauuuauugaccacuuacuguggccacccacugcccuggcccugggaguggagcaggaauccaaacggaguucccaggucucucuagguacaaaagaagaaucgacggauaaucacuaaggaaacaaauugaaaugugcuuugucagguggugaaaaguaaaaugagggugagcaggugcaaggcauacguucgcauucugaagucaagucgugcaugcaugagugugcgaauuccuaagcauguuuucaacugagaccaucacagcaauguaucuguucaucauucauuccauucacuugacaaauauauaacuagcgcuuuaucguaugcaguggugucccaggguacauugggaagugaccccagagaagauggacacaucaguugauccaauccaaucaaaugcugccaagaacucaguaggcuaaagggagugugggauccaugcgaagggaagggugugugcggcuauggagcuuuguuguuggggggguaagaagggcggacacugaaggcgaagcacagaggaaggaaggagcguuccagcccgguauggaagagugaggaaaagcauucuaaaaagguuugcccgugauccugagccagcagaaugcccugauggauguggcccagaacucagcucucucccauccucccugcacuccucuugaaauaggccugagcauuccucuagacucaagauacccaagcucauauccccagccaugacugcucucaucauuuccuagggaagagaggaaugugauuugaaaagaucccucuugagucagccuggguuaucaucugcuguguagacagcucaugccaggcugcguuaaucgagagcagagugggcucacugcagacaacccgcgauuccccugguuccaggaguccaguagccacggguagagccgucacugaaauuugcaucucguucuuugguuccuuucucauuugcuuggcccaguuuuuaaucaggucacuucucaugggccucaaggcaacaaugugucauuaacuuacauuuuaggcugggcgugguggcucacaccuguaaucccagcacuuugggaggccgagacgggcggaucaccugagguugggaguuugagaucagccugaccaacauggagauaccccgucucugcuaaaaauacaaaaguagccaggcaugguggaacaugccuguaaucccagcuacucaggaggcugaggcaggagaaucgcuugaacccacagagguugcagugagccgagaucaugccauugcacuccagccuggguaacaagagcgaaacucugucuaaaaaaaaaaaaaauuacauuuuaaaaauuuccuagcauacagaagucuaaaauuuuguaaaauuauuuagcauuuuauuaauuuuuuaguccccauguuugcagcugcaaauuuucaauuucagggggacuuuuuuaaagauagaaagcaucuugacuauccuagcuucaaauuaggaauagguaguacaguauaaaaagauuugucaauuugagaccaaccugggcaacauggagagacccuaucucuacuaaaaaaaaaauucauuuaauuagcugggccuaguggugugcgucuauagucccagcuacccaagaggcacauauauuugaagauuugucaaauauaugugcugcuucuccaacuggaaauaaaacuuugugauguuuuguguucucaacauuagaacgucugauuuuauaauguacauuuugaagcaauacaggacuuuuuuuccacaugacuuuauacaacucuugggacaggaaaauauucacuuuguauuucugugguuugcucaguuccacaaccuaggaacccaacagguuaagaaccgucaaucauacugccucccuggugacuuugucaacuguuagaauaacauuggucaaaucuuuuucauuuccucccucacuuccuuuuguagauuuuauaaacacaugcaaaaaggcaaagaccuaaaggacuuaauuuuuuuuuuuuuuuuuuugacacagaguuucacucgucacccaggcuggagugcaguggcacgaucuuggcucacucugagguucaaguaauucuccugccucagccucccuaguagcugggauuacagccgcaugccacuaugccuggcuaauuuuuguauuuuuaguagagacgggguuucgccauguuggccaggcuggucccgaacuccugaccuaaggugauccaccugccucggccucccaaagugcugggauuacaggcaugagucaccaugccuggccacuuaaaauuuugggggguaucgagaagaaagaaaggcauggaagaaaugaguguuggagaagagugguguuuaaaaugaacaaguuguuacaagaugguuauaacauggcuaggucgagagacagccagagaugggugacagagggugggguguggcugagcaagcccacuguccagcuucuccguuaggauuuguauguuacuuugguuuugcauucuuaaacuucuuucaaugaauauaucauguuacaucuuggcuuuauuaugugacagauaagguuauuaacagaaagugauauuaauauuaauuauacaaugauacuaaaaauuuuauaucacacagaagcagaugguuauuuuuaaugacuuaaaauuuuacucuuuuauaugagaagaaacauuuuaaacauauuuaguuauaaaugcuauuuuaauugcuacauuauuucugcagcgggauuuuuaaaaucuuacuauaguugcagggaaauauuucuauguauauuucagauccucuuaaauuauauacuuauuuacaggaaacaauuauaauuacauugagaaaacagaauggggggcuucaaauuaucgauaaauacaucacacuauucucacacaugaucauuccaucuggucauaguucaagaauucagcucuaguaggaggcuuacucucugagcauucaucaaguuaacaaccuuaccaguuaucuuuuuagguacucuauuuuuguaauguuuguagauaaauaguccuuugcuggauuuuuaaaucauaacuggguaagcauacgacuuaagaauuauuuccuaugcaaaauagaaucagaaaauuccaucuacuuacaaauucuuuauguacuuccacauuuuaagcuuuccaaguugggaaacucaacuucaaaccagcuguugacccauccuuuguucuauaucaagcuuugcauuaaugcagaaacugaaauaaguaucuccacuccccaaagugauacaucugaagucaucuggcugacuguguguccagaggcaccacgucagugucucuuugccagagccuuuaugggggugguacgaggggaacuggagucugggggcacgucaggccuucaucaaucagaaggcaguggcagcgacagcaagacaggcgggucaggcccccagaugagauuugugaggcugcggcaucgauucugaccacacauucuggaaaaauuaucauccuacaccaccuucugaagcagucaagguuuggguuauuaccuggaccagcacccggcuuuuacauaggaccuucuccugggggacggugguaucguuguaaaccaaaagguuauugaucaaaucuugcuaauccaaguuccugacaauuaauuuuuuaaaaaagaaauuauuuguccuuuuaaagaacuuuucucuuuuccuaaaauuaugugaagcuuuucauuuuuaaaauucuuuuuuguuuuuuugagacggagucucgcucuuuugcccaggcuggagugcaguggcgcgaucucggcucaaugcaagcuccgucucccagguucccgccauucuccugccucagccuccugaguaucuggggcuacaggugcccgccaccgcgcccggcuaauuuuuuguauuuuuaguagaguuggggggggguucaccguguuagccaggauggucucgaucuccugaccucgugauccacccaccuuggccucccaauaaaauuauuucauuacagaagcaugguuaacgcgugcgcuagcagaaaagucccaccauuaaauggaggccacagugcauggcuggagaacagcaggauguugguaucuguugcacauguuucagccuguuucuacaaaucugccuuuuucuucuaacauauggguuaacuaccauuucucuuugcuaauuuuacaauaauaucuuugcauuuuccccuaauaaaaaaauuaaauuuuagaaacauuuaaaaugcaguuaagcuuuuugguuucuaaaaaacucaguccuacacaaagcucuuagauucgggaguggguaccuguaugaauccguucucacacugcuauaaauaaacaccugagacuggguaauuuauaaagaaaagagguuuuguugucucacuguuccacaagcuguacaggaaaugugaugcuggcgucugcuuggcuuccgggggggugccucgggaaacuuaccaucauggcagaaggcagagggggagccggcacuucacauggcuggcggugguggugggggcgauauggggggacuugccgcacacuuuuaagugaccagaucucaugagaccaacaccaagagggagcucugcccccaugauccagucaccucccaccaagccccaccgccagcauuggggaugacaauucaacaugagaccuggguggagacacagauccaggcggagacacagauccaaauuaugcauuuuuccccuaauuaaaaaaaaaaauacauuguagaaacauuuaaaaugcagauaagcucuuugguuucuaaaaaacucaguccuacacaaagcuguuaauuuuggggguguauacccuuccaguuugugugugugugguuauguguuuauucccccaaaguggauuggaucauaauaggcuuuuuuuccuuuuuuuuuuuuuuuuuuugagacagagucuuguucugucagccacgcuggggugcaguggugugaucucagcucacugcagccucuuccucccagguucaagcaauacuccugaccucaggugauccaccugccucggccucccaaagagcuggggauuccaggcuugagccacugugcccggccaggccuuuuccacuuaaacauguaauauguccacuaaaauuuuccaugucuuagaauauuuucauguacuuaacagcauuuaaaagaaaauaaguauaaauagauaaaauuucgacacucucaguguggaaacuagaaacaaucucaguucagaaacuagaaacaaucucuguguccagaaguaggggacugggggccccuccaaggagaggcugggcagccauucaagugcugcuuucuauguaguagcuuggaaagcuggccauugaaaucgccaggcgucauuguucuaagaaccagcagggaggcagcacuguguggucccgccccucugcccagccaggcauaucccugccaccccagugccuuuucaccugcugugccugggaaccccuccccacccuuguguccaccaaauaccaccuucaccgugaggccuuucugaccccaguuuaaacgugcccauguccuucuuccccaccuuacuucugcgugccaccagucaccuucugacagccuuugucaucuacuccuuccuuuccuuuuuuaaaaauuauauauagauauuuuacuuaacugguugaaaugugauuccuuuuuucugguuuuuauuuugauuucaguaguuuuuuggggaacaagugguuuuugguuacauggaucaguucuuuagcgcugauuucugagguuuuggugcacccaucacccgagcaguguacacuguacccaacguguagucuuuuaucccucgccaccgcccacccuuucaccugagucccaaaguccauuguaucacucuuacgccuuugcauccucauagcuuagcucccacuuaugagucagagcauaccauguuugguuuuccauuccugaguuacuucacuuagaauaauggucuccaaaucugcccagguugcuguaaaugccauuauuuuguuccuuuuuauggcugacuaguauuccauaauuauauauacauauauaacauuuucuucguccacucguugauugaugggcauuugggcugguuccguauuuuugcaauugcaaauuaugcugcuauaaacaugcaugugcaagugucuuuuuguauaaugacuuauuuuccucuggguagauacccaguagugggacugcuggaucaauguucugaucugucaucuccccccgaccagaauuuaagcuuccuaaagggagggacugucuuguuugccucuauucucaaagccuagaacagugucuccaucaguaggggcacagucagccucuguugagugaauuuuccagguaucaggugguagaaugagcaguugaacguuacuguuugccagugucuaagcccuggauuaaaugcuuuauagguacuauuuguuaagucuacgcugaaguucucugaggugguacuauuauccucauuuuuaaaugauuaaacugaguccuaaauaauuugaauaacuugugcaagagugugcaggugaugaggauccagcgugcaauguacggaucaaagccugagcguugggcuaggccggcuaggccaggcucccugugugcccaccugaaugcagguguccgcaugaaggccgugugaaugaagagggcaggggacucaugggaagguuuaccuguuuuaccuguuccauuucagcuuuuaguaaugaggacauacucaucuaaaagugugccagguuuucugggguuuuuuuuguuuguuuguuuguuuugucuuagagacagggucucacugugucauccaggcuggagugcaguggcacgaucucagcucacugcagacucugccuccugggcucaagggauccucccaccucagccuccggagaaccugggaccacaggcaugcgccaccaugcccagcuaauuuuuuguauguuugguagaaauggggguuucaccaucgugcccuggcuggucuugaacuccugagcuucuguguuccccccaccuccaucucccaaagucuccuggcauuauagacgugagccacugcgccuggccuaaaaauguuuuaaauaaaguuauuuuaaaauacgaauuucauaacgagaacacaaauugagaggugaacauuugagaauuuccauggccgcuuuggcaguagggauguuuaguuugaaacuuuaauuuaaaaagugagugcagugagucugucuuuguagcgcuagagauggguccucagcuggccaugauagagaaggaugggcagaggcggguguuugagacuuggaggggacagugggggcacagcagccaggcagaggcaugugucagggcagagugagaaugcuaggauccuggcccccauccucccacuugccacacagucaagaaaaugacagguguacgggaagacccaauucaauacagagcagccagguaucaaaucacagugcugcucugcagagccuaucccguguccaguaaagcagacagcauuccaguguuaucuggaauuauuuacaaacgcaguguccacaauacgaugaaucacaacuuacaguuuaguuagauuaagcgaauuauaauuuuuaauagucagugaauauuuucaccugccuagauggggagcaaggcucugaauccucucuugccccagccccuucucccugggugaggcaagcauggcaugagcagauugguuuuuguaaagugccugaugugcagucaaauacaggaaggccccuucuuucauacaugcacguugaguucccuaaacccaaaauccaaaauccgaagggcuccauugagcauugccuuuuagcgucaugucggcacucaaaaauuuucagauuucagaacauuucggauuuuuggauuagggauacucaaccuguaauuuccaugauaauuuuuuuucuggaaacaccuaugaaguugaauugguaagaagugcugccauaccacuucaaaagagggcgguggccagggggugcucuucccaaggagcugaaaaauaccaugaaauuccugauuaugccaccucuccgccuguucuucugcaccgugucuccggaucaucaucuuagucucuuucuucacaacugaacagaucugcuuaaaucccucgaacacccaaggcuguguagauuugccgcuuugggcaugccuagcgaauuccauuuuugugcucuuuugugccucuuuugcauaguaagcuuaugagcgccaugcucuuuuugcuaauaucaguuaaaaucuuuccauuuuccacuuauccucguaaaacaaaagcaaaacaugaguugguccagcugcauaaacagccuuggggcugagcuaccccagccacgccgcacccccgagcacguggacccugugcucgucucugaucaccacaguaccaaaggccagagucacagcucaugcagaauggaaaguucugccaggaaaaauagacucccucgccuaggcaaaaguaucauggaucuagaacuagaaaacuaacuggaauuucguggaagaaacugcaccuguuucuuccuuuucuguagccagcgcugggaagucugggaagacaccaaaaauagcaaugaagcagcucccuggaggguugcugggagaugcuugggcacagagagugagguguuugcugggaaaagccauuugggaugggugaagguccaugcuggaguuggagagcgcagaaaauggggugaguguaaaagucuagccuggguuacggccccagugauccuggacaaauuuggaguaagaaacucccgccagucucauggccagagugcccagggaaagucuucucucccaguggugacuccggguuucccuagcccagcacaaggacuugggcuggugagcuacagaauugcaaagaagagcaggagccagccagccagaccuggccauggcugugccauaggauaucacagggugugugggcaggagcaaaugccgggaguauaugcaagagaaaauuauggcuggugggaaccugcaggaguugcaggaggagcaaagggauguacuccugagguuugggggcuggcagcgcugggaagggagggagggacccugauucuggaugagagguggguggauagucacugacgauuuuaaccucaccccaggggaugaaggcugcuguagggaagaaugaccagagcuuucucugcugaauagccagccagccaggauucugcuuccugccgcauccaccccugacccuuccagcagccacaggaggucaggguuuugcuuaaagaaagagaggaaaaugucaauuauuacauuuuggagcacaaucuuaccuuucaguuuauuuuaaagcaauuuucccuaaagaucaaccacaguaugugacugaacuguauuaacgaaauuuuagcuugauaaaggaaaugcuuuaaacucacagcaaauguaacucgggaucuccaagcacuuuuuuuuuuuuuuuuuuuuuuuuuuuuuuuuggcuggacagcccaaauuccaagacacuaguaaaaauaauaugauaaaacuuugguggugcaaacaaagucaguucuuuuuuacaaaaagaauauucuaauaguaucuaauaguaauggugaauuacucauaguuuucugcuggaaguaaauuuaauucuaguuuuuaaauaucauuaauucuggagguugcacucugaaugauuucuuauuuuguggaaaauacgaaauaaagaagacacauuuggccacugugauggagcugcuuugaaaggcugugcuuuagaagacacuuccgacuuugaucugcaguugcggaugaagaugcucacgaguggagguguugguggagauaguuaucccaaguagaauacucgaucgauguccacagcacauucaaauuaucuuucauguuacaaacuuuuccagcaguuaccagccccagguacgauuauggacaaugcugucagucaucgugagacagaguagcauggaacugaaaaauguguagcagguuuucaaaccucuuacuugcccaaagcuuagucaaaauuaugagauuuccucugaacuuuguucuucucguuauuuuuggaaugauugcaggguugguuuaagauugccaugaccacauauuaauaguugcacugagaaacaggcguaaacagagguugucccgggaaaggcagaaugaaugucacccacccuggggaagguggcucgugucacuacccuuugcuacagcuguuguuucucacugauucauucucgggaaucgcuuguugucuguugguacaaaauaaacauuuccuccuauccuggaugacuggagccuugggcugcagaugaguuacaccacaccagucucccagucccaucacacacaggcaguuuuuacaccagccaaacuuagagcuucauaaaugcaggaaacugucagguuccuuucaagaggaagucuuagcuacagauuuuugguggaaacaaaugguccacccugaucuacucauuuaccaucugguuuggggaaccuucugucauccuaccugcuauguauuugugaccugauauauuauuuuuaaauacaguuguuuaauaguguagucaaaaaugaaaggucauaagccucaucuucucauuaacaccacaccagauugauuccaguauucagugcacagauaaccucauguuucagcuuccuuauugacgugaaugugcugagcagagcucaccugccucuugucagagacaugaaugggcugauaauaucuaguuuucaagcagaggaaguuagaggugaaccgcagccucagaaucuacauaaaauaugcagcacagucauuagucauuugcaguggcccagcaaaauccuaaaacagcaggagagaaaaauauuuucuuuucagugucugucaaagaaguuauaacauagguuuuaaaaaaaaaaauuucaucagccaaauccuuaaaauuuaaauaugcagacuuuuuuccuguauuuuuaucaaaaauguuuauacuguuaaaagguuauccagguaccagauaggugccccaggcagcucaugaugcaaauguagacaaauauauguugagugccccugugucuguaagucagucuguaucaguauagaauuaggauuggauuagugugaaguguuugcacuguaaauuuuaucuguguuuuuuuuuaaaaaaaacuggaaauauucuguuuuguuccacuacuauuuccccagggccuuaaacagugccucccccugaguggcccuggguaguuguugaucauaucuguaaauaucuggaguuuccgcacacacagacuucgagugugccaucaagauggugucccucggugcugagccucaccauccuggugguccugagcaguugcauccccuccuucagcucagccccagggccuucuguucagggucacuguggauaaauuaccaguggaacccaagcccucaaagcugcccuaugggcugggcggcuccaagagccagaguauugcucugugaccuccagccgguugacuggggcaauuguuagagccagguguggcggaaggacccauacagccucuuucaaguggcugggccuucuguacgaggcaccugacaccacgaugcuaucaccauccucgcugacugggacaugccacccaccuccaauaaaggcuugggagucgcaaggaucccuuuucauaaugaaacuuccuguccacaguuuaggagagagucuugaaaucaccuggaacaagaaguuuuucaaauauuuuagguguuuacaaaauauuucuaugaggacagauaagggggaaugaauuuugcaaauuagcauuugauuuaacccccaaaaaaguaccccgaugguucccacaguugccuucuaacauaacaaaagguuacaugugauggccaagggaaaagaaaacguaauuuaucguuauaagauguuaauuuuuuauucuccaaaauguucagacugcaaggauauuucauacagauuuguuagcugguauuuaaauaauauucaacacuccuaagccuuaaauaggcaauuagaaguauacugcauuuuuuucccuccagcauuucaaagacauuacucaaauuuuguuuguucuuugugcugcaguggucuuacuuggcaacucccugucuugacagacuugauuacggagcaccuauuuugugcauggugcuugcuggccacugagcaucuguaaagaaaauuuuuuccacgccuguaaucucagugcuuugggaggccaaagcagaaggaucacucaagcuaggaguuugagaccagccugggagguauagugagaccccaucucuacaaagaaauuaucagggcauggugggucauaccugugguccacgcuccuugggaggcugaggcaggaggaucgcuggagccccaggaguucaaggcugcagugagcuuugaucaugccacugcacuccagccuggugagggugagacauugucugaaaaagaaaauguacuuuuaaaaaucaggccaggcacaguggcuuaugccuguaaugccaacauuuugggaggcugaggcaggcagaucaccugaggucaggaguuugagaccagccugaccaacauggagaaaccuuguuucuucuauucucuacuaaaaauacaaaauuagccaggcgugguggcacaugccuguaaucccagcuacucgggaggcugaggcaggagaaucgcuugaacccgggaggcagaaguugcggugagccgaggucacgccauugcacccagugugugugauaagagugaaacucugccuccaaaaaaaaaaaaaaaaaucagagggacacagccacauaaaggagacauccacagaagcaaucauagcacacuaagggccaugaaaggggugcaguguccaagggagcugggaagagaggcugccuccugugccacugaagggcaggcuucagcccuccaagcgcugcucauaggcacggugguuugugcagcuuucauuguggcaggucuaacuguauuucccaacauccucucucaucguucucuaacuuucuccuuacaaugccucaucuuuuggcggaagugacuugcaucucguauguuacgguucuguguugagguccugcguuuuaacugugugaaugauaauugucuggaaaagcugggggcccucgacagccauguuugcacguucuuuaggaacaaggggagcuucagcacaccagcagccuccacaccccgccucuaccugccaaccccuugugaguccuucagguuuguccacagcccuugucaucccuccucguggucaauaugcacacauauauaugcuuauuaacucucuccguuugcuggaaccuaagcucuuuagggcaggagcuuuguuuauuuacugcuauuaucgcagcuccuaggagacagccugaccagggcaugggucucucugucccuccaugugucuggauguugucuagccccacaccaagcacaugguagaugggccacauggcacugccuccccuugguuuggcguggaggguagaguugccuuagucagucuuuaacuggcucuuggccaucuuaguugaccaagauggagaagagagcaagaguagggugaggccgguugaggguagagguucaggggugcuauuuuguucauuuccugugugaagaaauugaggcuaaaagaaaugacaugcccagggucacguggccagguggcuaggcuggggcuggagcugccuucgagucugugcgguuccaguucauggagcacugugcaguuuucucccugaccuccaucugcuuccuucuuguacccugggugcgggccauccugaggagcggggaccucuccaucagcacgugggcagggugggagcugaaguguaacaggcaugucggcuccagcgacacacagcuuggacauccuuacacaccguuggugggagcagcacagaacuucggcucagcagcauguauccagagccccacgaaugcucauguucaugagccugugucucaaaagcugccccaaagucauaauccuaauuacugaaaacacacagaaguacugauuuauggucauaaauuuggaauccuucuaagcagcugggaacugacuaagcaaaccaaagcauauucugcucuuuaugauguuaaagaagaaaagaauccuauuacuuaucuucuaugacauauaacacucaacccaugggaugauaucucacaaccaaauugccucuuuuuuaaggcugggcuucugcauaucagguuuucccauagcugaggacaccaacacacuuuuucuaaccacauaaugucaguagauaagagcagggauguacuucgaagcagcggccugaguuugguguauugcuguaccuugagcggagugaaguggccaggugcauucaggacccuggacaaagccccucgcuguacuggccuaaggagcccaccuuccccacucagauaggacacuuuccugugcagcagugggucauuugacugcaugugacuuuucauagaaacagcuaaguuucuaaagaugagaaauguaugugaucaaagagggcuccuacaucuaauuaccuuccugauuuaauugaguuuucugcaagacgcauucagucucuccccagccugcucacccucacacgugaaacagaaucucuuuucaauuuagcagaucugagcacccaacuugagaaaugguaguggcugauuauguaaaaagggaagaggcuggggagaagcgggaaucucucaaaaugauuucauuuccaccuaacagcgcugcgcaucgugccuucccauuuaucggaguucaccguauuaauuuaaacuuugugcugcuugcauucagcuaaaaaucagcuagagaacaauuugauuuuugagccuuaacuauaaauuccugauaugcauugcauucccaagcaugcucccuucugucacacuccccacggcuuccccaggcuuucugccucacuuggccacucuguguuccuucugucaucccuucaaacuggaugaugccauucggcaccagcuggcccucuggcaugaaaaaaaaaaacuguuguaguggacaagaaaggagagauaccaggaaacggauggggugcaaagaaagugacaggaaccaagaggagagagcagaggaguaugaccugggaggcgagaacacagagaagcuugagaagcccagggcugucccaccuguggucaggaggaggcugggggacaccccuucaggguagggccccaugagcagcucaagacugggaccuccugugggucagcuguguagagccagauccugguagguggcuggaggccagacagccacguccauuuguucauccagacucagcucauggcccaagucucaugauggccuuuagcuucaguuucugggggaacccagccacccuccuguccccucugacccucucccccgucucacuagaccguauaguggacguuuuaaaaucuuccuuauuuaauugcuuuguagcauuuaauacaacgaccucucccauuuuuuuuaaacagcuuuauucagauaaaaaucacauaacacacuucucccauuuaacaggugcaaugcaguaguuuuuaguaucucacagauaccugcaaccaucaccacagucaaucucagaacauuuucaucgucucaaaaaggaaacucuguucuugaauugguggucagaauauguacuuuuuucuuuguaaggcuuuauaaacauauuucaguaaucaagguccucaucucaauggaagaucaaauuuccuaaauuccuacugacuaggcuuaauuuagagagaucucugggcguaauugaaaauggcccaaguaggcaauucuucucuccuguguguucucuugguucuggcuccuccuauuguauuccuuuccuccccguuuuuauaacucagucuaacacuguguugucuuuuccuuucgccaacaccugucaucuuccugggcccccugccguguccccgcugccccucugacauuguguaccucugugugagcggcaaagggaaagggacaauaaugccagucucugaaacaucuucagagauggggaauucaagucaaccuccucccgcugaaagcucccgucaaaaggacuaugcgaaggggugagguuuugaaccucacuucacacucaccuuuuaacagagacccaggauguugugauuuccuuggauggcaaagguggccuguucuuuauuuaccggccuacacaucucuguaagcuucagaaagaacagagcccuuauuaaagauccaaauuagcuuuauaucguuggccguguaucaaaggaagugcguuuuaauuuacgaguuccuacaacgacuucaucuugaguucacagggggcuucagcccucaacugauuuccucuccuggcaccuacaaaugggccugucuuugauaauuuuaaauuauuuuaauaccaagcaaaaaaggauuuuuagucauguaccugacacugccaaauagguaaauuaagguguggguggaagucagcaggggcagggggccgauacauacgugcuuagcauuuuccucucucuuuucuuuugucuuucuuuuccuuuuuuuccauauagaugcaugcuucuuaugaacauguuuuaaagcauuuuguaucuuuaaucaacauguagaaaaugaacagccaacccuucgggaaccauugcagcucucccagagugaguguugccugcuccuagcaaauucguggcgugccccucaucaaacuacguccccugagggagagugguuggagguguuucuggagggcccuguacucccugaaauccaggcuccagggucagggaagaucugacccgggagaggauuagggcccugcuaacggcagcaguaacagcgggaguccuugcagcagggaggcuugcagagaucaagugcaccuacgcccagcaccucccccagcggacacauuuagagacccucgggagcgcgagggauaugagaaucacaagcacagagacucaucucuugaauaucacccgggauaucaaaaaccuaucagcacaccuggcgaggacccucaccaaggcgagcucccugcaaugguucaucaaaaauugcccagcuaaugaucggcugggcagauaaucggaggagaguuaauuguaagguucgauauggcaucuugucagcagagauaaguugucacguuuuccacuugagcugaaacuaaaugauuguaaaauaaguuaugaguguccuugggccugucugccggaaugauagcuaagaauacauuccuggcccaucagucucaagcaggcugcuugauauuuaugcggacggaauguuauuuuauucccccucuagucaugcuugucagcucuccgagugaaaagugaaacugcuucuuugacucauacuucacguuccgaagcucggagagacugcagauugugaucauuauugcucguauuauauauuuuuuggggugugcguugaacauugaugcccgauugggaagaacuaauggcugacauugaaugugcgggauggugccggcccaucccggcucagcgccgcgcagcucgggaccccagucccuccgucagagccgguuuagauguggaguaaugaggcgcucgcuuuuuuaauuuggcauggcuuuuuucucuuagccucuccccucccauacuuaacgccgucgacaguagucgucugucccggugcccgguaauugauacaaaauaaaaugcauucuuuguaugcagccaggaggagcggauggcgcuccgugggccggcuggagcucauuuacagugucucaggcggggcuuucggggccucuucaauuugaggaauaccuugucaggcgaggggaguaguuggaauggaaaagcacagcguggaagccuagugcguugugauugcucauauuuuaaaccaggggaauguuaaacaacuccuugaaagcgagcucucgacaccuagaagccaggggcauucauauucccguggccgagcucagcgcccaguggacgggaacccgguccuucuugccaugagaacacccagcccaggagaggucagggccuggccuccagguggguccucucuggucgcuccucacuggucuugagucccaggugacacuuccugcccgacuucugucuccugccacggccccccucaauucacauccuaauucaccccgccaucaccuucucagcaccaugauggccacucccucguguagccgguuccccugcugcugcagccgggcccucccacaggcaagcaucuggaacuagcaccagagcuuccuccugucaaagcugugccacuuuccccacuggcugccuguccgcuccugccaaaccugcucccacccgccccagcccagagcauguggcuucucuaagggcuugagugccucccuuuugggccaccguagacaccccaccucugaguggucaggcgccacugguugucuccuuccagcaagaaaguuggaguaaaauguccagggccugggcuauggaguguuggagcauugccguggcaggagaacgcagugggcagagacgcacccugcccugccugcagcauggccuggaaagucacugccucaacuccaugccuccaaaugggggcggggagggugcuugcggacccacccuggaggaccucggcccuguaagcagcagaucagagcgugggcuggugcugcuuccaggaucacaggugcuuugcacacgucaguuacucgagucauagccuccugaggacgacugcaaggagcucaugaaugcuggccuggcuuucuguuuccauucuugagauugcaguuguuuuuaucccaugacaacccuguguccucugaaaagcuugccuccuucuccccgcaguggccaggacaaggcucacauuuuucuguucucugucuccccagcccucuccugggcuuucucccggugcaaugacaccuucaucucccuguuggucccauucucugggguggcuggagguggccuggguaugcucgguccagugcaggugggcgugcggacucuuccguaccucacuucucccugcaccuguggccccugcuaucggcgugcuuacuggagaugcgauuccccucuuccuucuuuguucagguagcagggcccaagaaaaaucgucuuuuauggaaggcaucaagcaagaaauuugauaggcauucucuucacucuagaaaucagccccgugggacaggggucuugcccuuuauucucugacagcggccagcuccuagggcacgcuuggugcguggggacacucaacagggagaugcuuucucugugucaauagacuucacucauggacucagucguucgccuaaaaauagauuccaaaugguuggaaacucauaggacagugguuuggcacaaaagcgugcuuguggcugguuuuaaaacuaagucgcgaaauugauacacugcugugugauacaccagaaagugguccguuccauccacccgcgcaagugucugucacacagagguuaguucuuucauaaaacuuuauuacguaucgaaccccauuacucauccugaaucuguuucaggaaggaugugugcuggugaagaggaugagcgaaggccugccuuccugaagcucgagcgcucauagggaagauguuccguaaacaaagaaacacgcauggagcaugucauguccccauguggagagagccacggagcacagggggccgggaggggcuggaugcgccaguggccagcuuggggaaggccucucuuggggcuuccuccuuuggcuccuggagucuaaaacuuccuggugucccuucugccugccuagcagaaccccuccacacggcuccccgucuaaggcggcagggaugagcuguguggaugcugcugagacuggugugacugcuuugagccuuguccacugaugcagcaccugcagggugccgccggccccagcaaggacacaccagugguuggugggaugugagcgggacuggagugaggccagccguggacagcagugcagagggacaggcccuagggaguugugcuuuaaagaagggcaggagucaaauguccaggguggaggugugcggccaagggagaguuguguuaaaaaugugagaugacagggccgggcgugguggcucaugccuauaaucccagcacuuugggaggccaaggcggauggaucaugaggucaagagaucgagaccauccuggccaacauguugaaacccgucucuacuaaaaauacgaaaauuagcugggcguggugcaggagaaucucuugaacccaggaggcagagguggcagugagccgagaucacgccacugcacuacagccuggugacagagcaagacuucgucacacacacgcacaaaaaagugagaugacagcucauguuuagugccgggugcugggugagcgagggugggugagcauccauuucccaggggaggggccccgcgcccauggagacugcuggggacaggcuggggcagggcgggguggaggguguccucuucugauggaugcuuuugguuuuugguuuuguuuuguuuuguuuuguuuuguuuuguuuuguuucagugaagugaaaagugaggucaucgugaggaugguguggggcgugggguguuugaagcgggaggagaagcuuugaaauagccccuuggagagugggaaguggguuacuacagaagugagguaggauugaagggcaggccagaggccacugagggguacacugaccacacagaggaggccggugugcauggcaccacccucucccagcccuggcccaugacggugcugagcagguggagggcuggaagucagugaaguuggggcuuccuacucaggagagauggugggagaagggaaacuuacaagggugaguuucaagucgugugcgaugcugcccggcuguauaagaaaaaccgugggaugugagcggguuggacgucagauggcauggaacucagggcauagaggagccacgggagugaaggccuagugagcuggggaggcagggguggggguggcaguuagacccuagaaacugugguucuugcugguagcaagccugggugagaccaugagagagggugucugagguccagggcagaagagauucaugaggguggaguggcacagaggccagggugcuggagaggacacccaggaggcugagaugcagacagaccaaaauuccaaaggaggugugugcgagagguugaaaacuagaagcucugguugaaauuccaugggguuucucgcuauugauauuuuagguauuugagacuguucuuuguggcaggggcuguccugugcauuguagggcauuuuucagcaccucuggcuucuaccaucugaugccuguagcaccuccacuccacccaguuugauacccagaaacgucuccagccauugccagagguccuggguggggguuccuggagaaccgguggaucugugggaauccagagucccauggggcuagaagugcucguguggaaggacacaaaaggaaaacguggauguggaggaaaugcugauggguuggcugugguggucucuuagaggaagguggguggugguauuuccaagugcugucuccuucccaagacugccacuuagcugcuuccuccaggugaguccgggauuucucggacucaccaagagaauuauaaauauugcaagauauggagaaagcuuagaaaugagagggcccugucccugucaacuguuuugcaaaaaguuuucuacagcuaaaagugggaaggggccuagaaacagacgugccauuuugauuuccagaaacgugaauucugagcuagaugccagugagucaggucacaaccaggugggauucugaauucaguuguuaaagggcugcuuugugugcacauagaaaaggaaacagauguauuugaacagagguaguuuauuaaagagaaugaauagacaucaaauagauggcccuuuaucguuuucaguugucaaaaauacgugugaguuggguaccauauagcccucagcagaguauuugacaagauuuuuccuugguuuccucauaggcaaguugaaagauaugugagcugaacacaaagacaguguaauuuaucuaggcucaguggucacucuuagaaucuuccaggagcggauggugcauguuaaggugggaagcucuaucuugacuccacccuguucaccaucuuuuucauugauguggauggauauaugggaguauaugcucagaacggucaagcauaacuaaggcgauagugaagaguaacaacacauaggcuuagaacacagagacauagagugguggccuggaauagagagccuagcgguagaccuaccacgccccuguggaagccugucguguggacggcauagcuaauguguguguucugagugucuucgaaauagcgguguacacucauaaaaacaaccgcuggauaacggaagagaguuuaugauauaaugcaccuacuguaggcucagcauugcacaagucaccacaggggaggcgagcacuggugguugcccugggcacaggcaugcuaguuagauugagauaagcgacuggcagccucgugcagaagguccuaacugugggcuccgugggaguguagagaugagaaauguuaguuugggagagaguguuacaaacacagagugacagagggaaggacgcacaguuggggaugaacauggccugucgaaaugagaggacacccaagggacagaguaaaauaauaugauuuuaauauaauaauauuacuuaauagcggccccuggcagccgaggagaguugcguuugccuguucugcuuaucucccugcaggacuaggguugagcucucugagggcaaagacagucacagugaccauuguuucccauggccuggcaccauaccuggcaaagugggcuccuaacacugaauagagaggaugggaugguaaagacuugggaacccugggcagaaaauauuuaaaaugagcaaaaagauugccugccugguuugagcauugaauaacacagagaaggguugcuuuagaaucagguaaugaucuuggggucucuggaugccccacccccugaacguuaugaggcuucugaacacuguuaaaucauaaauaaaaauuaauuaggcucgcccuuuuuuuuccaagauaucuauagcuuuuaucugauauucaguggaaucuaguauuucagaaauacauauaagaaccacuacuuuagaaauaucaguauuguaaaaucaugggacagcuuaaaaggugaaagucugggaggagaaggaccucguggagcuggccgcacagucuaggcuuggggguaagguaagaacuggaccagggguacguggugcuuaaauggagagcaggcagucauggagcggcuuugugaaaacaggcugagcucgaggucccaggcugcucaaggcaagggaagugucuuauuuaaaccugcccgcucccaccucugcaguuccaccacaaccaaacugucauagugcaggcucagggggucucaggacugcuggcuacaccucggguacaguuaaccaaggagguuuaccagauguccaccguggaaagcaaguguugggcagaaguggcagggaaguggcaguuucaagggugaagcccaaggugauagcagagaaagcugcccggaaugcaaaggucagagugagugcuguuucuugggagccggcugccgggaagagagggucagguagagccaagccuggaacugguguuggugucaugcacauggagaaugccccuguggacguagggaggagaggcaggaaaacauggcaucuugggccagcacaguuagcaugauaagggaaaggaagucuuacgggggcgaaggaaggcacagugaaacagugugccguuuugaagaagcaauggugaaggaagccagacuucaaggagucaggaagaaacacaguggauuuaaacccucuaucuggauaggaaccuugucuggagaggucugcagcgguuuugagcagaccugaccgagcucugugacuucagcaaguuacuuaaccuuccccugugccuugguuuucuaaucuguaaaguggaggugguagggauaccacgugccucagcggauugcuuaagaguccugaacgcauugcugaagguagagccuggaauagccccuguuggguaguaacuuuggaugaguguuugcuguugagacuguggcuucaaggguuaaggaaauaacccuuuaaggaauaaugggguuuaggaaagugggcaugaaagaucuugggaccucugaggacagaagugacgcaguggagagggaggaaugaguggaagugaccuggccaagacaccugaggaugaaagaugggaccaggacaagcuaggaauguucauuuagcaagagaggggagcccauuccucuagggauggagagaggggaguccguuccucuggggauggagagagggagcccuuuccucuggggauggaggagaggggagccuuuuccucuggggauggaggagaggggagcccguuccucuggggauggaggagaggggagcccguuccucuggggauggaggagaggggagcccuuuccucuggggauggaggagaggggagcucguuccucuggggauggaggagaggggagucuguuccucuaaggauggaggagaggggagcccauuucucuagggauggagagaggggaguccguuccucuggggauggaggagaggggggccuguuccucuggggauggagaagaggggggccuguuccucuggggauggagagaggggagccuguuccucuaaggauggaggagagggcgagaaggccaguagaggagccgugaugguggagucacaacagaggcaccccaggaagcugacagccagauuucugccauugauguuaccucucaccuaccaccaggggacagugaccuguccgugugccucugcaucuaaggaugugcguccauaggaagcaccuccugccugguagagggaaaguugcugagacaccgaauugccacauuucucgcaacuccuuaaaguggugaagggaacuuccgccuuuugugagugagugaccacccacaaggagugcacaugguugacacagucucaggugucucaugguguccagugcugccugggcugcccugcaggagcccugggguggcccuucacccucuucgcaggaggagcuccccacagcccucuucuuccauguguaaagggugcaugcaaugaagggugacgcuuccgacugugcagagaggggcgaggggucucugccuuagggcggccaggaacguacaucaggguguucuugggaccguauguauuucucagauaccuuaaauuguguguuuguacauuucucaacauaugauaaaauuuccuagaacuucacaaaauaaaaauauuuucaauucauuuugauuuccauuaucuuuguauuugaaaucaugucacuguucugcucagaacccugcauggcuccccauuccccccaaagcacaggcgaggguccucacgguggcccgcaagcccccuccucuccagugccaccuuccgcaggccucucccacccacaccggccaccgccacucgggcccccucuccguuucuggaacacaccaggcucccuccuuggagccaggcucugacuguuucucugcucucauuaccuucucacuccucugccauuuucaagucuugauucagugucccgugcucagcgagaccuaccccagcuacccuauuuuaaaugacaccccccaucacugccgccucuccccagccucccagccuugaugccccgcguuccuauucggucuuucccauaacucuuaccagcuucugauggacuccagguucuggcccggcugccaugucacugccacuccacuuuacagaguccccauuggggcaggaauguuuaucuguuucuccucgaucaaugauggcugccaagcaucuugaaaagccgcuggcucacagucagugcucaaaaaauaccagcugaaugagugcggugugcuguacagaacucugacuuuggacuuaaagaugcugaaucgugaaauaaaaacuuuucaagacgccguaggcaugcaccaccuguuuuuccugcacguuuucagugggcuuuuuuccacccggcuugaauuauaugcgcguucuggucauguaguaccgcuuuggccuucucuuugauaaagauacaaauggacauaauacauugagaguuucacuuauagugaauaaucacgugugcacugguuuugaaacuguucuaaguagcuucaaugaaucaaaaauuggcaggccuacuauaucgacuuccaaacacugucacuggacauuggugagagagagaaaaaaauggcauagaauuuuucacugauaauaaaacaagaugaaguuauagucaucuguaauauugaggccggaagaaaggaucaggaaucccuuauccugugcacccacaggagucaaacccacuuaagaugauauuuccaaauguauucuuaaaugcaucguuuucauuucuaauauaucaagguaauuuuaagaagagaaagauaacuaaaaagcauaaacucaccccuuuccuuuugcagagcuccagucaugcagaggagagaaggagaaugcauccauagcaugcugcugauagaaaaagaaaugcuuguguuuuaauagcgggaggcacaguagagcaagggggacugagcccaucucauaccagaggcucuaggccuccaacucagcaauacaguaaugggauguuauuugcagggccugugugguaugagaggagcguggcugugcuguuucugcgcauucugcuuuguaagugcucacucugcauuuuuuuuuuuuuuuuugccuuuuccgguccaauggcagacacagggcugggugacuccguaugcuccagccccaguaucuccagcaccaccagccccaagcucgacccgccccccuccccucacgccaacagaaagaagcaccgaaggaagaaaagcacuagcaacuucaaagccgacggccuguccggcacugcugaagguaaggguuccgcggugccccgggagagagucuccacugcggaaaauucucuguuauuuuucaaaugcgugaaauuagacacccuuagcacaacaaaugcacaguaaugcuggucaccguaugugcuuucuguuugcaagguggcacgagagggcccuugggaccuuuucaucacugucugauucucauauuacgcaaccaaaucugcugucaucacucuuggccgccgucgcugguagcggguaggagugcuggucucccagccaccagccugauccaguucugaggucucgccccacccuggcagccugggcgaguguccucuccagccaaggugggccaugcugcgugacucugcuggggacagugcccacuucuaguuuaggaaucaucucugauauugguuacucuuaacuaaccagacaccugccuugauuucagcuuuuagcaacguguuaugauaaacacuucuucuguuaauguccaucagcucuuucugguaugugggcucuauuaauauuccaguugucacagcucauugugagucuccuuucaccugagugcuuccuuaguuuuuauugccacugauggcuggaugucagcuuccugaaguggcuccuucaaaugaauucccuuuuuuuuuuuaauucauagaugcaaguagagauagguaagcgcaugcguacacacacacauacacacacaccccccacauuaugagagguaaaauuaaugcaguuguaacaaaggaauacuuaaaaggaaaaauuaaaguuugagaaccuuguuguuagaacaugaauuauuaccugugagaccgacaauggugagagagugugguuaccugugagaccgacaugguaaaagcgugucuucagugagggucucaugcccaggggcaacauuuauggcuuccauccuuucucuuucucuauggcugccaugcuuuuuccagauacucuacuugaucgaggguucaaaccugcgagcugucagacaguggcuacauuagagggaguggcccaucccguccacauauccagagcggagcacgcaaacccacggugcguguguuagcagggaaggggcagaguguggggugugcuguguguuuccauaacaccggaggcagggagcaucauuucuuucaucaucaggaagcugaaguucggagcucugaguagcccgccagccuccgcagaaggguuagaagccuuucuccuucaccacguuucuuccuguuuugccuccuguaagcuuccugcuaacauauuuagccaauaaaaacugauuuuucgucgggcacgguggcucacgccuguaaucccagcacuuugggaggccaaggcaggaagaucaccugacgucaggaguuugagaccagccuggccaacaugaugaaacucugucucuacuaaaaauacaaaaauuagcuggaugugguggcacaugccuguaaucccagcuaccugagaggcugaggcaggagcauugauugaacccaggagguggagguugcagugaaccgagaccaugccacugcacuccagccugggcgggcgacagagugagacucugucuuuaaaaaaaaaaaaaaaaaaaaaagacgauuuuucucauguuguggggagugaggauaaucccauuaagucagcgaugguggaaaauaaugguuaugggucagagcagccacagaugccacugaccuucccacugaaaacaguaucagccgcaggcgcucuguguugguaagacuccuucagacaaccguugggcaaaaaucacccugccaagcacgugcagccaccccucccugauugggaagaagguuagccucccccagggugggcagccuguacccuccacgccccuaaggugcacacacaggggcgggcgccagauucccuuuaaggacaggccuuguucucacuuucacaggcacgcgucuucuugcauuuguuguguguuuccaaccgaggucugugguuuuuucuuaugcacaaccuggugggaacugaccguugccacuuagauacacguucauuaucccacccacguguugaccgcuguguaaaugagugaauaaaucaguagcguuucugcacauuugauggagcagcuggcaccacccaguguuccauucagcaccggugaguuugaaggaaguuugacaagugaccgugaccacguuggacgccugauguuucagguccacuugcugagugagugggaugguaugugugugcgaggcaauaguggauacccaggcugagacacgggcucuguccaagcagcaaaugggggccccuuuccuuaaagggucuuacugcugaggugguaacaccagcagaaagauuucaggcaccauggaaacuccaauauuaggaaaucacaggugucucaaacauggauguguaagcgggugacguguguuuggaaguccaaggcagagguuccaagggagccaccucacucucuaauuaggagagucuggucucuacgucagcggcuaugacaucuuuccaauagcaaauaagucauaaguuauuuauaaaaagaaaauguaucauuuuucccuaggaaaaguuacuuaucagacuacaaaugagucacuuuugugaaaaagucuauauuucauuuuuucaaagccacauuuuccccccaaauuguaacauaucugaagucagaacauaucauuguagauucagugauauaugauauuuuugauaguuuuauuuacuguuaauuccuugaaaguacauuguguaaaacacccaaauuaaacauucuguucuggccgggcacaguggcucacgccuguuaucccagcacuuugggaggcugaggcgggcggaucacgaggucaggagaucgagaccauccuggcuaacacaaugaaaccccgucucuacuaaaaauacaaaaauuagcugggcaugguggcaggucccagcuacuugggaggcugaggcaggagaauggcgugaacccaggagguggagcuugcagugagccgggauggcgccacugcgcuccagccugggcgacagagugagacuccgucucaaaaaaaaaaaaaaucuguucuugaaacuaaagcuaguuauauauguuuuauuuuauuuauuuauuuauuuauuuauuuauuuauuuauuuauuuauuguauuuuuugagacagguccucgcucugucacccaggcugggguguaguggugcagucacggcucacugcagccucgaacucccagguucaagugaucuucccaccucagccucccaaguagcugggaccacaggcaggcaccacgacaccuggcuaauuuuuuguauuuuuguagaaauggaguuucacucuuuugcccaggcuggucuugaacuccugggcucaagcaauccucccaccucagccucccagugcugggacuacaggcgugagccaccacacccggccuauauuuuauguuuugagaauacuauucuauuauaaaaaaccauuucugccucucuuuccugcaaggcucugugacugguuacuacuaguguauucucuaucgccugaccaagugcugaaaagauggaauuacagauauaaaacuucuauagaagauuuguguaaaguaguugaauuuuaugguuuuuaauauacccuauuggaacaaauaacuagguucaaaucucuuuagaguauaagaaaaauagaauuccauugaaguaagcaaauuuaucaggguccuuugaauccauuggucaguagaauccauuaaacucagcugaugaaucuggaaugggauggggcuccccggcugguucgccgaggagucuuccugggccugucugcagagaugcggggagaaaguggguuugguguagaacccgggguguaacggggugaggagagggcaacuauuugggaaagcuuccagcuaggagcuguggccuucaagaaagagaccuguccggcuguggugaccgggaaggugaggguguccucacucuucucccucccacuggucuccaguggccccuccuuggccaaauccaaccagaggccaaaagcccugagagcccacgaugccagucacacaguuggcucccaggaccaagacaaaaccaacagaagccguagaguguucgugccuuucacagcaccuccuacaagccccugaagcccgugccaugccacucuguuggugguccacaaacacaggaaacgaagcucuagagggcagggguaugugcuccccuccaucaucccccagggucuggcuuuagccuggcccagggagcccucgcggcuuccugaacagaccucagugcccuuccccagcugugugcgacaaggacccugcgagaaggucuuccuagacucccagcuaagcacagagguucucacucuggccguuucuuaccucuguggcgcacuuauucagaaaguaaaggcuaauaguaggaaucaucaguaccugcugcugcaaacccagaaacacugugucuacacggggcugucagggugaccgauggaaauugggccguuccugcccuggaguuucucccugcgcaggugcucgcugugcucuuuuugcugaagaacagccacuuuguucugcaccagauggcagagggugucagaccccagcccagggagagcauuuauuuucuuagguuuaccauuuaaaaugaaucggaggaaucuggaaaguuacagaagcagggacggugacuggagaaucccuuaucuuuuuguguauauuuuggguucugaggauuaccaggagauguguggaugacagagcccgucgcuaggcucuuaugucacagaugggcugcugugcugcguggucauugagaccaauggaaggaaauugagaugugacugggcaggauggugacagggccugaagccuaugcauggagggaacgugcagugaccagagagaaggguggugaugaggaugagggccaugaggcauggugacugugaccagcugauggaagguuugcaaagaagggcgucccaacuuguccuggauggcccaggugguaaccaugggaccugauggguggaagccucaaggagguggauuuugauucugauauuaaaagcucuagaaaaagcucuacgaaccagggccaccugagagggagugaccccgacccugcauggggucggcauggguuggaccagggcagaggaaccugggcucuagaaggugauugcaccacggcccuggauucccaaccagguccaaguucaaggguaugugccagggaaaagcgccugggcagugggauuuugcagaucuuuaauggcuugucagcucuuggcauugucuuugaauuacaguacuuucugggcaucuucauaucucggguccaguagugagguugucauugcuaaaaugaacggucucugcagucccauucuguggccccgaaccuggugguucucguuaguuuuauaacauucaugcaaguuugcauuaagugcuaauuucccuguuuccccagugaaaaggcugaaguagagagagguuaaguggcuuucuuguccagggucagguugcugguaggugacagaacugucucuugauucucugccucaaacucuuuccaccaggcaaaaagcaagucuuugagguauguggagcugcuuuugaaucugggaguggggcacacugaauagcuuccuugauauuucucagauuccauguaaagacacugacuuuuauauggcucauaacaucuagaaguuguguagcaaagaucuuucuuuaaaaaugcaggaccagacuggauuuacccaaucuuauuauacaagaggguaugcagaaauccugguguuaucccccccuuggguucacagcgcuuuguucugaaggucucagaagggaauuuauuuuauccuucucaucuuguuccuuugguuguucauucuggucuuuaucgcaccauugugugguugauccuggauggauauugaaagauucuccuguagaggguaagucacaaacgggccucucacuguuaugguagaaaaugaauugcucaucacagcugcacucacugagcaaugaaauguugacaaauuucauuaacuccagaguugcagaggucacccaggacuuaguuucccuucacucuuucaaaggagaaccugaaauuguagaucauuuuauucuuucaucaaauaugaagcaaccaccacagggaaagcacugugugcuugccuccaugggagacguugagaaauaaaacucgguuccucucucucuccaaggaguuuagagccugauuauggagauaagacaugcaagaaacuguaacgaggaugucaggcagaauauucgagaaaggcaugggaauucagaagaagcacaaauacacacugaguuguaaaaguuagggaaggcuaaccuguuguagagcuuaauuuuuauugugcagauuuagcacauaaugguuaucuuauuuaauaaaacugcagaaaucauuacuuuuucauuaaauguugccuacuuacaacuuuaaacaccagugguggugauuuaauuagucacaaaauggaguuuuguuuuuacuuagaugcuaagaaacagauguugcuauugaucaguuaccuuuuaccugaggacuuuuuuuuauuauuauuaauuaguugaugucuuggaaggcacuuuggagagaaauuaaagaaucgugcaugcauaucguacaguguuguuuuuuuucuugcaggaaagcaauacgugggugcguggaagcucucaguuaaucuguaaccauccgguuagauggacuaucaugcagcuugagccauugcuggguaguuuggggauuuugcaugccgugauugggagggcagugugcuuguuuuguuauuuagaauauaacaagguuguaagagucuuauuagcacaaggcucucaucuuuucucacuccuggggugcaauuagugugcacaugacggugagcacaugacuggcaaggagucagggcccagaaacuguuaccuuccagguuuauauccagucuacaggggcuuucacauugaauucuguguuauuuggagguggcuggaggggagauccaguugcacaaguguuacugucauucuucccucagguuuucuccuuuucuucuccaugaacauuccaccggcaccucccgugucugcuccuuguuuaacauuggcagcuacccaggaaagggaacgagaagucuccacaaucagcucccuaaaaacugcauaaucaacaguaauuuuugauacaauaaggacuuauuaauuaaacuuccuuauuagcaaaccacugguuagugcaucugaacaguugaguugaacaguucauuauagcaaauguggaaaaccaagaaugagaacaucuuccugggagauacacuggaaaugcaguagcgaauguggaaaaccaagaaucagaacaucuuccugggagauacgcuggaaaugcagucacuucacucugcuaaggauaucaggagacuggcuggguuucaucacccuugggcugucagugaugggagccaccaugcaucccgacggacuugccuccuccccacaaacuagaugacuuuuccaaagacaguuugcucucagguuguaacuccagcuuccaagagaaugaacuugcugaaauugaguagaucaucuggguuuacucuagacauugacauuguagauugggcacaguugacucaaaagccauccugcaggguacaguccggccgccacaaacacacacaagcaguaagcgcucucagauccuuuguggaagccagcaggucggaaauaaacaaagaugagucgaucacagcaggggcagccagaacggaagauucccaucgugaugaaccgacgcacagaaggauguuuguagugugguuuuuguuuguuuguuuguuuuaauuuuuuuaaccacacacaaacuuaaagggguuagauucagguccaaaaauguucauugagcaccuacugcacgcaagaguuuugucugaugcuggaugggacaucaacugaagcggcccagccaucaggacacacauagaccaguggagaaagcagaaacacgccggggaacuugguuaugcaggagcacagggcacccccagcugccuggaggaccucagggagguuccccaaaggggaguagacacucacacacguuguauagacaacgaaauaucugcuauuccaaggaggaaaaaaggaaaaaaucugaaaagucaaaacaaacuaaaucuuguaaagagguggcuuggagcuccuggggguaccuaggcaacuccugacgccacagacaagcauuugagcuccuuagccugcuacacagaagcauaaacucaccuuugaaaaaugcugacuacucacaaggucccuuucuaagauacagaaaugugacggaccucaacuccuuuuuuuuagcuagacuuagagauucucuucugcgaguggggcucgguuagcacaagcugcucacaggcuccggcguccaucagcagagaacucggggcaccguguuuuccugugugcacccugggauuggaauucgggcuagcuugggagacccugcauuggucgacuuucauuagaaucuaggaucugucuugaagucauuuucuugauggucucaaaauguuugagcucugaggcuuuucggaugucauuuaagucucggugaaauuaugguccacuuggaccaagguccugaagccagaagaggggcugguucuagcggccagugcuguucaacuugugucuuccuuacuauucuaaauccucaucuacucuuucuacuuuccucagcugcauguauuuuacacacaaaguacagggauacagauugaaauguucagcagcaagguaugagagguccgcaucucaugcacgaggguguuuuucucggccucugcagcccucagauguucccacgcucuguuagacacaugcggccugggcuucaggaaguagagaugcccggggguuauauuuucagauguucuagcugagcucgcuuugucuuuccucccaggccuggcaauaaugaaacuaggcaguguuuuaucucacaggcaguggcgacuucauuccucuuucuaaagauguaaaacaaaaggggauauugacuaaugcaaaacuuagucuguguggaagcaacuuggcaaauggggaggaugaaauaaaauugcaccuaccguuugucuuagcucagccugccauaucaaaaugccacagacugggggcuuaaccagcagaaacucauuuaucaugguucugaaggcugcaaaguccaagaucacggcaccagcugauucucuuccuagggagagcucucuuccuggcuugcagguggcccuuuucuugcuguguccucauguggcccuucuguggugugcacacacacacagagagagaagcucuucuuuuucuuauaagaacaccccucccaucaugaaggcccagcccucauggccucaucuaacccucaucaccucccaaaggcccagucuccaaauaccagcacauugguggggugaggaauuagagcuacaacaugugaauuuuggagggagacaaacauucagucuguaggaccauucuacuuucuauuccuggcugugggauuaaugucccuguggcccccacccacccacucacccacgcaccauaugccauuuaaggauuucauggacugucucaggucagaaacugcuuggacagaucacagcuguccuuuccccuucacucuucccucccaagucuuggauuuguugucaggagacaucauccagugcaaaggaagaacaccauggauuuacugccugcuugugcgcuaccucauugcauccuuaaaacaacccugugugguguuggcaggugggugguggcauuucuguugucacaaaugaggaagaggguugaauaaaguugaguaauuugcccaaggccaguagaugaguggccucugggacuuggaagucuguauuuugcuuugcauuucaucuguuaaccuggaaaaggcuucaggggguuggagugggaggagagccuucugcaggccucuuacucucaauccuguggcucucagaguugcuucucccucugugcauguccauuucugcagcacagcagggccaugcccacggcuccccaccacugcccuugagaacugggaagcagucauuccuuugcugguuuucucaggaggccuguuguguugugguauggcuuccuugcaaacaagugcaugcacacucugauacguuuuuaaaaaaaaaagaugcaaaucacugcuucagcugcuuugcagacaguuagaaccuacaggauuagaugggcucuguuauaaggggacaucucucuugaaauuuuuuuggacuuacggacauuuaauucagaugcagugaacccaguuuuucuguucauuuuaagauugauaugcuuuuucuuuuuuuggaugacagaaguguauuugugggguuuuuuuguuguuguuuuuguuuuuuuuuuuuugggauaugaucucacuguguuguccgggcuagucucaaaucccuggucucaagagauccucccaugucagcuuccugaguugcugggauuuacaagcauguaucaccacagccagcuagagugcacauuuuuaagggcaguuugagguuggagggaggaggguggugauugauuaagccccccugucguucauuugaauccugcaucgcugauuuaaguguuaaucaaaugccugucucgccuggcugcgggguccgaucauaguuacugacucgcgcucauuuuaucaagauguauuaaugcuuuggagaagguguaguugagauaaacuuuguguguuuauuuaguaaucuuugcuaauacccuccuggcuuuccacuccaccccuuucucaucucagacauaccauaggcaccaagguguggagccagugaaagaacaggcgcagcgaacguuccggcaggcauugccgugcacggacacacaacuucacaagggccucuugugcacgugggacauggagaaaauuggccauuugucugugggguaaugggcuuugcugcaauaugaaaaucuaucaaauggguaaaaucaaugacauuguaucagaguucaugaaaagugccuacugcacacaguuuaauucuauuuaauuuuuuuaaguggaaaaaagcaaaggaaaaauguuuuaguuuucucuuaagcugauuucgcucugcuuuuucuuaaaagugccuuucuaguugccacacagugaugugaucauuaucugccaccucgucgccuugcugccucugcaugcaguaaaauacaaaaaaaagagagauagagaaagcaggggagcuugugaaguaugacucccuaucccaagacucauugccugcgauucguaccgcuugacaguaaugaucuuauuacaguacuguggaccuugaagagauuucaugaggagagugaaaggacgacccuccguguaaucaaguggcgcugaauauuccacgcguuuuugaucacacacugauugggcacaguuuuagcccaucuucuagucaauuaugcauggccccugugcuccucgaauagucggaaacauugauggcuguugucuggguuuuggcaggcagccagggguuugaagugccuuguacaucgucaucccaggauaagugcuuuuuaguuggaauugauuaccuuucuuuggguuuugcuuaauagcaaaacugcauuuggagagggcuucaggugaaaaauggacauauuagccauugagagcauccgaacuccuagucaauuuuuaggcuucccuuguuuccgucuaauuucuguuuaaugauacaguguuugauaauauuuaagauaucucaccgcauuugccgcugagcacacauguugagcgucgaggacagguucaauuauguggccacuguguucagguucccggauugauccgggggaggcucuaagcuuugaggagaucuggcgguuaguuuccaucuuggcauaaaagcauuaauuaucuaaagaucuuuucaucugcaggaaaauaggcagagaauucuuccuacuguugaguggucgcuccgugugaccguggagcucaugucagcauugcuagguuugggcucagccugcuacccugugcccaaaagacuuucucccauuguuuccucccuccccucgcuauugagcuugaagucuggggacauuugaaaggaugggauuguuucuuaccaaaaugaggcaugauguugccucuuaagaaaaucagacaauuaaaccaauguuacuauguagaagugaaaacugguauaaaccaagauuuuuugccuccuccuguuaugcucuuaauucugauucuugucuuacggauugucuuagaaugauuaggaaaacuucuaagguguuuuauuuuuuuguuuuaacauuuugugcaaggcuaaggaauuagacaccccagaguaugugaucacugugagauguuucucaaagucugucuugaacuugccaacacaugcugccucggggccuguggucacuaagcuuauaugagggacgagagccguagcauugcuccagcagguauuucaauaacuugauuugacucuucuuaauuaaauaaauagguagcuuuguucuuuggcuugauuauucauuugggucuuucuugcuuucuucagguaggaaugauuuuccccuucaguugguuuucugcagaagccaugauauacuguaggcaugguuaccagaacaccccuaagagagcugaccagaauuucuaaguucauguuccaugcguacacacacacacacacacacacacgguguuauuuuuuuucuuucugaauuucaugaaaauaaaauauuuucuaccagaauacacauuuagugaugccucuuucaaagaggaaaucaaucacgaaacagaaacucagaguugacaaucuauuagcaauaauaucacuaucaauuauugaccacugccaugugucaggcacugggcuuaagugcuuuacacgcagcgucucauaacccucacaagaaccugggaggugggugccguuauccgcauuuuuauaacugaggaaaccgagggucauaaaguuuaaguaacuugcucaaggccauagacguagaaagcagcgauagggccaccgauccaggcgagggcagcagugcucgccgccucuaacacaucuccacggugaccuucccuucccuuggaagggggcgcuugucuuuucagcggucuugccuccgaaucuuggcuugucuaggauucuuccuacagaagaaguucauauaaaauaagggguuuuauuauggguuaucugaagaguguuucuuaauuuuaauaaguuaauauuccaaccauaaaaacuucugacauuuuacccgaggcugugcuucagcagauugacagaaugcauuuuuacagcacuuagaaaauaccagauccacgaagaacaaaugaucaaaguuucaaaggcuguaauuuuggaaagcuggcauauauaaugaugaucucuucgcagccugguaauuuuaccuggacaaguaaauccauuucucacauuuaaagagaaucaaagagucaguaaacaugcagaaacacuuuuagcugugaaugcagaguaacucuuacaauuaacauauaauuaccucaacgggccaauuaauuaagcaauuuaagaucuauaacuauuuucaugauuuucccccaaaauauuacuuuauucugcacaccguggggacaucagcugggagggucauagcuaggaggucagaaggaaggggggacgauucaugcaaugaggcacugcuguugugggguguugguuugaagaacucauaaaugguaaaaguaaccuguauuaucauugguucuaggggacuacugaagauaagaauuuucaaccuuccucuucguugucugcucucccaggcucauugaaggaacauagagaagguuuaggcccuguuucuuuucgagcagcacagaaauacuugcccaguccguucguggaaggaaagaaccgaagccagcccuuggcugccauucuuuccagacuuccaccauugugcccugagugguuccagaaugucauugaugggaaauugguuuucuuuccuucuggacauucaaagauuaauauguuacugucaucagugacuuguuaccuucuguuucugauugccagcucaucagcuuaguuugcccaggagagccacuuuuucccacguucuuuuacuugaguucugagacaagauuugauacccauucauuuauaggccaaauccaguucuuauuuuaauuuuuuuucccaaccccuaaaaagcauuugcaaacacuccuccacacuguucagaugagcgaugugugagcaugaggagacauuccuuaagccagccuggucuguggaggugugcucacugcugcagggccauuugcugagcaggaagcuggccucaggggucucccaggaugcuggggcugguggacgaccccagagaagggacaggaugggggguuauggaagugcccagcaaggggagcugcaggagggucucuuuacaggugugcaaaggaccagcgcugcugcagggaacauggcugggagggcauccaccggggcaggggucugggcaaggggcuucuccccuugcuaggcccccuccuuuuguucagcuccuccucuccagcaccaaccucccaucacuuucuacauucuggccccuuuuucuccuuuccuucuuucucuuccauucuccuuuuuccuguaagacuguccuugcuucucuuguuuaauuucuuuuuucuucuuuucccauccauaaccucaucauugucuuuuucucccuuucuuauucucuuuuuucuuugaacuuuuuuuuauuguggcaaaauacagucaugcaucacauuacaacauuuuguucaaugauggaccaaguaaugugaugguggucccaugagauuauaauaccguguccuuacugugccuuuucuaugguuagauguuuaaauacacacuucccauuguguugccacugccuacaguuuuugauacagucacauacuguauggguuuaugcccugggagcaauaggcucugcacauagccugagugugugguagccacaccaucuaggcuuauguauggacucugugauggucacacaaugacaaaaucgccuaacgacacauuucucagaaugcaucacuuaacgauggggauacauggcuguauguaacauaaaauuugccauuuuaauuguuuuuaaguguucaauucagugccguugaauuauauuuucacauucacagugcuggacaaccaugaccgccauucccaaaacauuuucuucacuccaaacagaaaucugcuaaccauuaagcaacaacuccccagccccuacuucucccagccccugugaccuccagccugcuuucugucugugaauuugccucaucuggauauuucauaucaaaagaaucauaugauaguugaauauggauccuuuugugucuggcaucuuauauuuggcauaauguuccauguuguagcaugugucuguacaccauucuuuuuaaaggauggauaauauuccauaguguggauuuacaacauuuuguuuguugacagacacuuggauuguuuccgccuuuuggcuguuaugaaggaugcugcgugaacauugucacacaaguaucuguuugagucccuguuuucaguuuuuccuaggguauaaaccuaggaguggaauugcugggucauaugguaacucuguucaacuuuucaaggaaccaccaaauucuuuuuuuuuuuccuuuauuucuuaaaaaaaaaaaaaaauagaugcgcagauugugcagguuuguuacauagguauacauaugccauggugguuugcggcaccuauugacccauuucuaaguuccuuccccucacccccgacccccaaacaggcccugguguguauuguuccccgcucuguguccauguguucucgauguucaauucccacuuaugagugagaaccuaugguguuugacuuucuguuccuguguuaguucgccgaggaagauggcuuccagcuucauccauguccuugcaaaggacaugaucucauuccuuuuuauggcugcauaguauuccaugguguauauuuagcacauuuuauuuaucuagucugucauuguuggacauuuggguuuguuccaugucuuugcuauuguaaauagugcugcaauaaacauaugugugaauguguuuuuauagcagaaugauuuauauuccuuuggguauauaccuaguaauaggauugcugggucaaaugguauuucuggcucuagauccuugaggaaucgccauacugucuuccgcaaugguugaacuaauuuacauucccaccaacaguguaaaagcauuccuauuucuccguagccucaccagcaucuuuuguuuccugacuuuuuaauaaucaccauucuaacuggcaugagaugguaucucacugugguuuugauuugcauuucucugaugaucagugaguugagcuucuuuuucauauguuuauuggcugcauaaaugucuucuuuugagaaaugucuguucauauccuuugcccacuuuuugaugggguuguuuguuucuuguaaauuuguuuaaguucuuuguggauucuggguauuagcccuuugucagauggauagacugcaaaauuuuucucccauucuguagguugccuguucacucugaugauaguuucuuuugcuuugcagaagcucuuuaguuuaauuagaucccauuugucaauuuuggcuuuuguugcaauugcuuuuggcauuuuugucaugaagucuuugcccaugucuauguccugaaugguauuggcuagguuuucuucuagaguuuuuaugguuuggguuuucauuuaacucuuuaauuaaucuuggguuaauuuuuguaaaagguguaaggaagggguccaguuucaguuuucugcauauggcuagccaguuuuccgcauaugacuagccaguuuucccagcaccauuuacugaauaggaaauccuuuccccauugcuuguuuuugucagguuugucaaagaucaguugguuauauauguguggugguauuucugaggucucuguucugcuccauuggucuauaugccuguuuugguaccaguaccaugcuguuuugguuacuguagccuuguauauaguuugaagucauguagugugaugccuccagauuuguucuuuuugcuuaggauuguuuuggcuauacagggucuucuuugauuccauaugaaauuuaaaauaguuuuuuccaauucugugaugacugucaaugguaguuucauaggaauagcauugaaucuauaaauuacuuugggcaguauggccauuuucaugauauugauucuuccuauccaugaggauggaguuuuuuuccauauuuuuguguccucucuuauuuccuugagcagugguuugucguucuccuugcacacguccuucacaucccuuguuaguuguauucccagguauuuuauugucuuuguagagauugugaaugagaguugauucaugauuuggcucucugcuugcuuauuguugguguaaaggaaugcuugugauuuuugcacauuuauuuuguauauccugagacuuugcugaaguugcuuaucaguucaaggaguuuuuaggcugagaugaugggguuuucucaauauaaaaucauguugucugcaaacagagacaauuugauuuccucucuuccuaucugcauacccuuuauuuucuucucuugccugaucguccugaccagaaauuccauuacuauguugaaugggaguggugagagagagcauccuugucuuguaccaguuuucagaaggaaugcuuccagcuuuugcacauuaaauaugauauugccuguggguuugucauaaauagcucuuacuguuuugagauacauuccaugaauaccuaguuuauugaaaguuuuuaauaugaagagauguugaauuuuauugaaggccuuuucugcaucuauugauauaaugaugugguuuuuaucuuugguucuguuuaugugaugauuuauguuuauugauuuguguauguugaaccagccuugcaucccagggaugaagccgacuugaucaugguggauaaguguuuugaugugcugcuggacucuuuuugccaguauuuuguugaggauuuuugcauugauguucaucagggauauuugccugaaguuuucuuuuuuuguugugucucuuccugguuuugguaucaggaugauacuggcuucauaaaaugaguuagggaggaaugucuccuuuucaauuguuuggaauaguuucaaaaggaaugauaccagcccuuuguauuucugguagaauucagcugugaaucugguccugggcuuuuuauuguuauuuauuuauuuauuuauuuauuuauuuauugguugguaggcuauuaauuacugccucaguuucagaauuuguuauuugucuauucagggauuugacuucuuccugguuuagucuugguaggauguaugugucuagaaauuuauccauuucuucuagauuuucuaguuuauuugcauagagguauuuauaguauucucugaugguaguuuguauuucuguggggucaguggugauaucccuuuuaucauuuuuuauuaugucuguuugauuuuucucucuucuucuuuauuaguuuagcuaauggucuaucuauuuuguuaauuuuuuucaaaaaaacagcuacuggauucauugauuuuuuucccccccaaaaaaccagcuacuggauucauugauuuuuuuuuuuuuuuuuuggaggguuuuccugucucuacucuaucaauucuucucugaucuuaguuauuucuugucuucugcuagcuuuuggauuaguucguuguugccucucuagcucuuuccaaugugggcauuuagugcuauaaauuucccucugaacacuguuuuagcgguaucccagagauucugguaaguuaucucuuuguucucauugguuucaaauaacuucuugauuucugucuuaauuucaguauuuacccaagagucauuuaggagcagguuguucaauuuccauguaacugugugagaaccgccaaauucuucucuuacaucauucugugacuucaccuuguccucauccguucaugcguaauacggaauuaaagaagcuccuguaauuaggcucccuccuaauuacaaaaauaggugauauaaacauguuaaaaauauuguugcuuuuuccagaaaaucaaaccgaaaguaugcagaauguugguaguuaaaacuccuuuuguuauuuuguguuuguucguuuguucuguuuuguuuuuugaaacaagagucucacucuguugcccaggcuggagugugguggcaugaucucggcucacugaagccuccaccuccaaaguucaagugauucuccugcuucagccucccgaguagaugggguuaaaggugcccaccaccacgcccagcuaauuuuuguguuuuuaguagagacagggcuucacccuguuggccaggcuggucuugaacuccugacuucaggugauccaccugccucggccucccaaagugguaggauuacaggcgugagccaccgugccuggccuaaaacuccuuuugauuggugcgugggugacaauggauucccugucccugcugccaugaaucagucgcaccugcuucagauacuacucagaauuucuuguccuuaaaugccacccccaacccccgccccgaagucaggaagugauuucugaacuuuagcguaaguguucucuggcagguauggcuguuuuucugagcaguagguacuuagucaaggcaugcaggcguuucuccuuguuuuaguucaucugcagaggucagcuuuuuccauugucucugaaacacuugcauuuuuccuguaacuuuccaguaaugagggggcccaguggguaaauggaaucuuaaagacgagaaaugauuauuuuuuucccgccgacuccacucuggccaagacgagcucucagauugcacuucagaaucggugaugcgcacucauuccccugcacccacccuuuuuucuguggucagcauguguuucccagacugggcgucacugucgccuccuugacucucaucacucacauggucccccagcagguaacuugcuucagcgccacuuugccugggugcuggugauccuccaguucucacacaccugcaccuuggggucguugaguuuuaguuuaggucuuccgaggaaugcacagaccacacguugucaggcuucccuuggccaauaauguggagucuuuugguuuuucuguucuucagaguuugcauccccugagaauuccucuccuguguccuucaaauaauaaugugagaugaagaugaugaugaugguuguuguuauuuaaaacugcaagacguaggcaauaccaggucuuaacagcuuguugucuguggugucuuccuucuucccuggaauuagauauuuuucguucaagcugcugacagguauuuauugaccagguacuguguagaggucgcugcugcguguggcuucacccagcuccucugcccaucuggugacuuugcaagcucacaauguccugaaugaaaaccuaguuccuaagcccuucccccaacuggaaccauggagggaggaagaacagaccaggugaaaacaucaggaggaggguccgcagcucgauggugaugaguguaggggagaggugggugcugggacaggaugagcugggcuggaggaggguuugcccuagggaggcagccccaggcagggccugggcacacugguggcguagcugaggggcugccugcgugcaaggaggacaugaggccacauacaaagcuuagggccacccaggaagaugugggagaaacuagaggggauuaggagaguucgggcugcaccagcuccuggguguugguuggagaaagagucaugaaucaaggagcccaggaggacggggaaucccuggaggaggugggucagugggaggaggacugaagacauuggcaagcaucaguccgugcgggagacgugcauggaguggaacggucacagcagcagcucacagggagggacagccucggaagaggaaauccaugcgucuuccuuuugcccacaggagaagagaugaaagagaggggaggggcuggccagucagcaaucuggacaguuuagaucauucaaaugcguagccgggguugggaaccagugguuuagguuaagaucagcuagaucugugugaaggaccagugucucacggagauucagacucauaaaaaugugggccacaccccaggacccacagccacacaagccguucuuauguugucccaagugcucuaccguuaggauuccuguuaaaaccuuuuuuaauguuuuuccuacccugucuuauugguuuaaaucaaauugcagaaaaauaaaagcucaaauauuaucuguuaugucaaaguuacuauuugagcuguagaugcuguuuucaaaacagaucauccuccuuaaagcacccaucucucuccacugacaugugccccuguguccagccgcaccuuccagcagaguucccugcaaagacgcuucccugcagccucugugggucaggaauuagaaugggugcagcuaggaaggccugugucugccucgugauguuuggggccucaccuggaagacucagaagccaggacuggcaacaucccgaaucccagucacucguguguuugaugguugaugcugccuguugggugggaccuaagcuggggcugucagccagaacaccuacacaugaccucugcaaguggccugggcuuccuuccaacaugguggcuggguuccaagggcaggcaucacaugagagagguacauggcugggcagaagucuuguuuccucugugaccuugccucagaggacacagagugucaauuuuacuccaucuguagucaacacagucagagucccacuuagggucuaggguagcagaaauagacucugccucuggauagagaguggcaagguucuagaagagcauguggacuaaaauaugaccauggccauuuuuggaaaauguaauuugcaacaguaaauaagugaauguguauuaugucagauugugaucaacacaauggaacaagauagaguaagaggaauugggaccaccagggguggggcaagguucuuuucugcaaaggcagccaagcagggcucaccgaggagaccacauagcacagcccagcaaaggugaggcugucgccagguggcccucuguggucggcaucuuccuggccagggaauuguguuugcacuguugugguggccaccuuaaacugaguacuuguuuguaguuaacaucacgugcuauaugcuuauguucuacuguauuguguaaaacaagcugaauuuuaccuagauuuuuguguuguacuuauucucugguaauaugacuggagaaguauuuuaugucucaagaauuauuaugcauuucuuauuucucuguccuuuaauuuugaagggucaguauaaaaauacuuuauucaguauauucuagcucauucuccacauacaauuauauuccaauauuuguaggguuuauucucuccaagcagcaugaucaaucagaaaauuggacaguuuuaaaaagugguccagagaaccagcaaauaugaaggcaggcuaauaaaaaugcauaucacucuaacaguuucaaggcaguuuccucgggagacugaggugggaaggucgcuugagcccaggaguucaaguccugccugggcaucccagugagaccccaccucuuaaaaaaggaaagaaaaugguuuuuuaaaucauuucauuucguauaagauuauuuugcgagguuggugcaugacauuggaguugcccagcaauuggaaaaagacaugagcguuuaauacugggcguucuuucuaaggcucuuaaagugaaggcaaucacauaaggcuaucuugcuucauggguaauuaaggcauuuccuucugcaguucccaaaucuaaugaagaagaaggaauuucucuuuugcugaaauauuucuuguaagguuuucauuucuucucauugcuccgacuuuggaaaaauguucuuuuuaccucugauuuucucuuguaaugucuucuugaauugugagucggggaaaaaaguaaaagauucgcuacagauucagacuugcaaaaaaacgcuuagaaucuugcuguccguaaaacugaaacauccagccucacaaauguccacauuucucucucaucugugaaggcccguugagacugcucaguuggugucuccucuguccacaggacauggccguagccguguguggagaaggguugugaugguggccaucacgagacccagauaacaggagugguuagaagcgcagcggaggagccugucuuccuggguccgaguugcgugguuaggagcgcagcggaggagccggucuuccuggguccauguugcgugguuaggagcgcagcggaggagccggucuuccuggguuugaguugcagcuccaccucuuccuggcggguggccugggcgagugccucacgcucccgucagugcucucagcuguaaaaugggaacgaucagguugucuaccuccaagacuguugucaggauucacucaaugaacuccugugcuuugagugucuggcguucaguggcaggggacccuccauguggggacagagacugccacccauuccuuucugaggauucaguucuuauagacuacaguauuacucgugggagccaaauuaugugcaguguauuuucagauuuuauugacucaccuaagaaaggcucggggacacuguuguguucugauguaagagaucacuuguuauauuaugcuuuuuaaauguugaaggcaauacucaucagaguaugcauuaaguagcauugaaccacauuuuuaaggugacucuucaacucaccaagaauaucguggccgcugagguccugcacaccuggggaugcgucgugggcgccgaggagagcguagccuccuguuaacguagccuccugcugcucuuugggguagaccagccguuuccacgcacaggcugcacauuguuucauggccuuugcaguugagcuuguguuggccucuuuccgucgugaaccauggacgucucuccuugaccuccucccuaccugggagaaccuggcuggccacauaguggaacuggaaaugccuccaugcugacgugucugccuuucaugaaagauaguagcaaaaguuauuguuauacguuacaaaaaaccaguuuaagacauggacuuuuuucauauguacaucugaaaaugacuuuagcagagauucuagcuaauacauggaguugugcuuccuaaguauugauagcggcguauauauaggauucccacaauuugcaguuguacaguucaaacaccaaacuguuuguggggaggagggugauuugcagugaucuuuuccucaacucaggccagucuauacaauacuauugauauuuacugccuuggagcagccuuggcagccuuguauucugagcugcugucagugguuuaaacauuucacuuggguuagccuugucccuucgacuaggcuggaagcccaagaaggcaggagacucgucucagauauuuccuggugucccugaaaguccagcacagugugugcacgugguaugucccugauggaaacugcuucucaaaguggaagacagggagcaccucugcaggccuauagggagguaguaauuggauuugcgauguauuucuuuucugcaaguaugguuuugugugauagaaaccaaugcuucccaaaguucacauuguggaaacugaagccagcaagauacugugaaggaaaaugcuuggagaauguugcagccugugucccuguuggaguuuuugcugcccaauaccaaauuaagggcucugaggaacgcuuccuuugaaaauacccuaguuuaacuuaaacucuuucuuaccaaaccagcuaugccacgcccuucugcuuuggcuguguagaugcuguuccaguccuggggagcacagguguguccucacgugcgcuuggagaaaguggaguuuuaauuacuuacccagcaacauucaggacguccugagaccucgucacuucugauuugggaaaagucugugagcaaaugggauuuuacuaauaugaaaacccagaacauuccagauguccuaggaacacagguccuagguguuuuuuuuuagcuugggaaaguuacgaugacccauaagccugcuccacaggauggcuguagcacagacaccuuccccugggacccccauuggcugugugucccccagcuucuaauuccucuagaauaucaugcccagguuaggcacucuuucuguauuccccaaagcuucauaacaugguuccauauguguccuuuuuaagagucuugucguuucauacucucauuuuggcaagacaccuucgucuuagagugccuacauccauuucuguugaaacuggucauaguuagcauuucuccaugucugugcuuuuaugcccuccugaaagcugguuccauuuagggguguucccugucauuuucgugcugugcaauaguugaugaagauaacauaguuuauaacgcacaccucaaaauucauuucuucucacguaacaacuuucuuagugcuuguacuugugugccucuuggaguuacuuguugauaggacagcguuaagggggucguuucuuucugguuugaaaguugagaaguaggucaucacugucaucgucauaguggggacacacugagagguuacuuucuaccaaacuguuuccuaauugcacucccugcauugucuuauucagucccgacuuucccaacgccucgcagcccgaugauacagagacggggcagcaguggagagcucggcucaaagugcgaaguuguuuagauuuccacguuacacaaacacacaagcuucucaggggaagagcaugaugaauuucuuucuuuuuuuuuuuuuaaacuaaaauuagaauaggccgggcccaauggcucacaccuguaauccuagcacuuugggaggccgaggcgggcggaucacgaggucaggaguuugagaccagccuggacaaaauagugaaaccccaucuguacuaaaaauacaaaaacauuagccaagcguggugguaggcgccuguaaucgcagcuacuugggaggcugaggcaagagaauugcuugaacccgggaggcagagguugcagugagccgagaucgcgccuugcacuccaaccagggagacaguacaagacucugucucaaaaaaaaaaaaaaaaaaaaaaaaaaaaacagaauaagauacaacaguaucuuauucuguaccacaguaguaaauauguuauuuggaauauagcuuauaaauaaaauauuuaauuuacuuaaagcugucaugcccaccacccucccauagugaaaaaccaaagaaaaggcuaggcccaguggcucaugccuguaaucccaacacuuuggggagccgaggugggcagaucacuugagaucaggaguuugagaccagccuggccaacauggugaaaccuguuucuacuaaaaauacaaaaauuagcuaagcuugguggugcgcaccuauaauccuagcuccucgggaggcugaagcaggaggauugcuugaaccugagaggcagaguuugcagugagccgagauagugccacugcacuuaagccuuggugacagggcaagacugugacucaaaaaaacaaacaaaagaaagaaaaaauucuacuuaaagaagaaagacccucugugcaucauagauggcaggcacauucaccgugcacggcagccccacaacaauguguggcagacaaccuuagcagggcagcuugacacugcggguccgauucugccaucaagaaagcugcacagaccucaucagaagccacugaugcuuugguccuauugaggauuccaucucucugucucggagccauacucuagaugcaucacugcaagcuguggccugaguguggugauggugaggaugacccuguggugguauuccuuucuuucuugccucuggcucuucucucccucacuuucccucacccauugccaaaaauggguuuggaggucauugugcaguggguuuggaggucacugugcaguaggucuggaggucagccucaauaaaagaccaguuuucagcccucacagccucccugcaguguuauuagcuguuccugauuuggauguguaagcccaagccgccacgugggcucggagggguacagagauuaacuggaggcuugccaaccguuugucacacaaauagcagugccaguuaacugagauacgauaaaucauuuuucucaagauugaaaccuuuuaucaguugugucaguuucauuauucgauaagcaauuaguagcagccauugucauuuaguuaucuguaguuaacaacucaaagcugcugccagcagggcacccgcuugacaccugcacccagguggaaacccguccacugcccaccucuccagcagaaauuaggccaaacucgccuccuacugccccuuggccgauuggagauucguaucugacaggugucuucuaauuuuuuuaacuuacgcucugacacauaguuaaguugugcuguaguuaagagaauaguaaacaggugagcauuauucuauuaccaccuacugauccuuuuaugaaaauauucuugccuuuuaauuuaaaugccaaccaucuugauuagagaaauaguguuauuccuuccugcacccaagcccugacgucagcaugaccuggcgguagagccagccccugccagcuggcugcccccggggaccuucuguucaccaucaagcggcaguucaucuggaguaaggagagaggcuggagcacagcucccagccugcaggaacagaccucuggagaugccaagggccugaaaucuguguguagguuuauguagacagaaguaaccauauauugaaauugugguuaauggaaagcaaagucguuuuagaauguugccaaauugugcucaucaaaagacgccugcauacuuuuuaaaaauugggaaccacugaaagagauuaauccuugccaauuuuuucacuuuuucacucaagucuaauuuaucagaaaaaauaauuccaccacuagcuaaguguaggagaagaaaaaaaucacugaauguauguaucauugagaccuauuuaauuauucuaccaguguucuggcuuuacccauaaugaagacaggagugugugugcaugcauagguacauagauacaugcauauugccuuuaaugaagaucuuuuuuguuguuguuguuacggaguuucacucuuguugcccagacuguagugccacggcgcaaucucggcucacugcaacuucugccucccagguucaagugauucuccugacucagccucccgagcaacugggauuacaggcgugcaccaccacgccuagcuaauuuuguauuuuuaguagagaugggguuucuccauguuggucaggcuggucucgaacuccugaccucaggugauccgcccaccucggccucccaaaguggggauuacaggcaugagccaccgugcccagccuaaugaagaucuuuuaaaauauaacucauaauuuaagacgucauucuaaauugcauuucuaaugcuuuccagcaccuuucucuacuaccuuaagguuaguguuugguauuuuuguagcgcggccauacauuuuugugaggccuggagcccugucuugugccuuccacgcccgcagcaucuacacugacugugugguaacugcccacuguauguggggacugcauauguugauccuugugaaagcuuuugguuuauuguuuaagaagaagcgguuuugagagcuucucagccacuccagcuccccagcgcaguccgucuccagaaucaccaauaaaaacuuuuuuuuuuccuaacuaaaaaaucugaagaccauucaaauggaagguucuggucugcccucuuaauuguauaguagcucagucccuucuguagggauuguauuuuuaagaggacuucccaguacauuuguuuaugggguauucuuugaaaccacgagccacagucgucuuccacguagcauuucggggucucggaggcugguguuacacaugaagggcccacaguuuggaugcaguuaggucacuguuaucugcuguuuuacucugaaaguggaccccaggcauuuuuaauuucagugauuaacaaaaucaugucaguaaacugagagacuaacaaaggauugaccaacuuugaguuuugccaagcaaggauauuuaaaacaauaaccaccguggacugccaccaucauuucauagaagaagacugcauaagugcccacaggagagagcaagcguuaagcucuggccgagguacaauuaacugacuuacccugaugcugcucagagccucuuuuucuaauuuuauugcagaugggagaaaaacauuuuguauuaguguuuaggaagcucugcucaguuaccaccuaguggagaaaucuaggagaaagggcuaaagaugaccugagacauaugucagguuuccuugacuccaggaacaggagugagaagauggaugccuuggaggugagccagcaggcuccagggucccucuaacugagccccuaucuuaccccugaaagcuguggggcuucaaccuaguucuuacaccucuggaauggagauagauuaguacuucacucauggaaaggcugggaaaauggaaugagauaauacuuuaaggccaacuuucuaaauauaagucuaugguaagugcucagcaugguaccuggcucagcaaaaguuagggauggugacggugaugauggugagaggugguggugguggugguggugacgauggugguggugguagcagugaugaugauaguggugaugaugauggugaugguaugaugauuaauaugguacaguggugaugauggugagagguuaugaaggggguugugacaguggugguaaugauugugaccuuggugagaguuggugaugguggugguugugaguguggugaccauggugagaguuggugguggugguggugguggugguaguggugacggcaaugacgaugauaguaugaugaucaauaugguaugguggugaugauggugagagguuauagggcugguggugacgggguagugguggugauuguggugacaguggugagaguuaauggugguggugguacuggugauggcaagaaugauaaugaugguauggugaccaauaugguaugguggugaugauggugagaggugguggugguggugacaaugauagugauuguggugacgauggugagagguggugguggugaugaugaugauaauggugauggugaugauggcagugugaugaccaauaugguaugguggugaugauggugagagguuauagugguggugacaaugauaguagugauuguggugacgaugcugagagguggugguggugauggugauggugguggugguggugguggugaugaugauaguggugauggugaugaugguagcaugaugaccaauaugguaugguggugaugauggugagaggugguggugguggugaugauggugagagguggugguaguuauagugguggugacaaugguaguagugauuguggugacgauggugagaggugguggugguaguggugauggugguggugguggugaugaugaugauaguggugauggugauguugguagcaugaugaccaauaugauaugguggugaugauggugagaggugguggugguggugaugauggugguagugauuguggugacgauggugagagguggugguggugaugauggugguggugguggucgugguggugaugauagugguaauggcgacgauggcaguuugaugaccaauaugguaugguggugaugaugcugauuaugauguuguugggagcaggagaugaggaaccuguaucuugaugcuucccugaauguugggggucaggucugagaugugucaagcggggcaguguucugacuuccauucauuaaacuuguaagucacgauuugugggugcuccugaugugugcccauaacaaaccugcuacaccaagaacguaguuuuauagucaugaguuccgaauagucucauagaccauugauccugcuucuaaugacugucagaaagaauacgugaaggccagcuucuagaccaguguccucacgugcaggcguccucgaagguuuguuuguuaguagccauaaccgugcagcauccaucgggaggacacacaccccugcaggccagcuuuugucucaacaucacuggagagcugcauauuacguuguuauuuuugucuuuccaauuacacuaacuccucacucaaugucauucaucaauagguucuuaaaacuucgacuugaagcgaaaggacuuauaaugaagccaguuuuuuuccuuaucagcaucauaaugaaacaacgugggaggaaacaaaguuauuugaggaccugcuguacacaguuuugcuuaaagucacacauuuccaagaaccugucaauggcauugaggacuuucuguacaaaaaucacuacgcgugacagcucaaauaauaaacaguuguucagagacagugguacugcgucccccuccuccaguccagucccccacccugagcguugaugguggggugugcaucccccaccccccaagccuguuccuagaaggccauggcgcaccugcucugugcagaggcugggcgaacaccagcccgagccugacuuaagcaggaugggcauggacaucguuggcacucacuucccugcagggaggugcacagugaagaauaaaacacaggugauuucagauaguggcacaugccugaggcaaucagccccgaugguguggcggggcagguacuagagauuguguuugcagugagggccacuaaggggggcggagaagaccccugacagcaagaaggagccccacuugugcuguucuguaaggagggucuuccaggcacagagaguggcugaugagaaagggccuguguggaaggaaccagggccaagcgagggaggcagaugccgcguggcgugaggagggugagaguccaugccauaaaggacugucauccaucugucauuggcugaauugugaccuccagaaagagaugaguuguccuaacccccacuaccucagaauguggccucauauggaacuagggucauggcagaugucauuagcuauacaggaggggaggggauggacccucagaggcgagacggacguacaggaaacaccacauggagacucuggcgguggcuggggcagcgcggcuguggggcagagaaugcugagauaaacgccaccaucagaaaccaagagaaaggaaagggacagguccuccggggagccuucauggggagcccuggcauggccuucaggccuccgaggaacccagaggaggaaacgcauuuuugugguuucacgccacccagcgugcggugcauuguggcaggugcaggccgcuagugccccccacccagucucuguguccucugcacaguagggagcuggggaagguguguggcuacuaacgugagccuguuaacguugaaaauuucccucuggcggcugggcagagugggcugcaggggcugaaguaggcaguggugacaguggcuuccccaggcaucagcgccacaggaggagagacacagacuguggcuugcaagcagagcuggcaggacuugcugaaagaguuaauaugggaagugagaggacacagaggccagggccgggagaccaggaggccgagagcgguagaacgucacauccuggaggggcggggauuuccccuuuuguuuuguuucuguauaagaucauaccauguauauucuggaauuuuacuuuucuaauuuaacaccccgugggucuccaguucuuccacaagcuguuugaaaggccacagggcacugcguggaaugcguggucucuaauagguuaugccagccccucucguugggcauugaaauugccucagcaguuuuuuuaacaauuaccaguaauacuucccugaacaucauugcacauacauucugaagcgcucacgcuuuguuccuguggacaucucugccugauuggaagcuugcguugcacauucagcccacgccuccauggcugguccuggacugggugaggacaccaugagaaacagcuagacuugggaugucuguguugacagggccaugggugagaacagagaguuucucaagcgacaugccaggaagagcuggcuuccccgcacaagcagugcuaccaaggguccauuuguuacugagucauucauucagcagacucguugagaacaugugugguaggcacgugcugggcacugaaaauaaacagacaaacacaacaugacccacgcacccagccugagcccaggaggcuccuggucccguccuggaacagccggugacucaaagcucaaauaucauccccaccuggacagucugcaaaugacuuuccuucuucccucauccccuuucccauccucacucucuuccaaguaucugauugcacgcaugugcacaugugugaguaggggagaggcuguguguuuucauaagcgaauccugauuuucugacaaaagagacaugaaacaaauauguuaacaaguaauguugcucccucucaugagggggucacuggcugcccuuauagaaggccuuggaaagaauuacuucaugcauuccuguucauuggcggucuuuggccuuugagaguggaacucugcaucuucuugucccuccuggaugaauacaggacacuuaaacauuuaaaggggggacacagagaugggcaggacugugagagucccccugaaaagcgagauuucauagaaguauugaauuuuaccaaaaguuucagaaguccaauucauuauuagauuucuauaaauauaaauauuuauaugauauuucuugcguugaauucaguaugugcucaaguuaagugugauuugaaaaaugaccaagucuccuaaggugaaguuugugugugaacaggagggccggggucgcuggguuccaggcgcagccaugagacaccugcucugcacccagcucuucuuuuguuuugcucaccgagaaaaagaagacucgggaaccacagaacuaacacagaaguaaguuagaaaauuacucacguauucgcccacugugugccaacagagucuugaucuauugcccaggcuggagugcaguggcacggucucagcucuuacugcagccucugccucccagguucaagcaguucuugugccucaaccccccaaguagcugggacuacaggcacaugccgccacgcccagcuaauuuuuguauuuuuaguagagacgggguuuugccauguugcccaggcuggucucgaacuccuggccucaggugaucugccugccucagccucccagagugccaggauuacaagagugagccaccacgcccagcccaggaugcuuucuuuucaugggucuuuguccuuuggagggccuugaccucacgcagcaggggaggaugcuggcccacaccaaggcaccaagauuuuacccaccucuguguguggucgcacguccuccucauggccacgcugggauggagguggacucugagcacagacaagggacccauggcccagagcccagagucacccgcagccccccugcgcugcugcugcccgcaugggguacccuuaagucccacauccaagcucccuccaccccacacucucccuuggauuugcgccuguucuuucucuggcugugcaccuggcagugcugagaggagagccuggugggcacuuccacccugaucaaauucagucauuaaccccacugaaaccugacaaggccugugugcagcucacuguggaggggucacugcuguccuaccacuuuuuuuuuuuucuggaaguuugcauguccuacacuaucuauaaauauguaacuuuuuuuccaaagaacuuaaaaugaaagaauaugagaaaaccccuaaauaauacauacaugguauagauugaugcauaaaacagucagccccuggacuccauggcucuguggaaugggcgguuuaguauuccuuuuucuggcaacucacuuagggcuuuuacaggugcaaugagcuuuggugaaaauagccaaugggcaccucguaucuugugccccaaauauuccuauuuagcacaguguauucuggaugccugagugacugcaaacccuccuccuguguaacuuuguuacuguuuuuccugucucaggaaagaugcucauuuugucuccugacuguggcaguugggggucuugagaccauuccugaguuuagaccuucccaggggagaucagugaccacagaugugccucggugaauuucacaaacccagcuuagcgugacccaaguuuccagcuuuaccgaacuuugucauuguuauuaaaaagaugauuuuagugugcugauuagaaacugggauccacauucaacauaagcacaaacuuuuuuucccagugggccaaagcucauuucugaucauuaaaagcuaauccugaaaauuagcuggagcaugguucaagcauacguuguaaucuguuaaaagcaaaaauaauaauuucaagcaguguucugcgucuguguggaaacagcuggucuaccccaaagagcaucaggaggcuauacccuccucccacaauuccaaauaaaauauauggagacagcacagcauccggaagaacuggcauugguaaauuauugccuccaaagaauauuaguuagcaaacauacuuugaaagccaucuucacaaucauaaauucaauaguacuucuuucagucacaacugaaugccaguuggggcagccuuucgaguuguuaagcaguuuaguagcaaaugugacauauagugugugugccacaguaagauuucaaauugucauuaauuuguaaaauuuaggagaagaaaugauauauugugacgagauaauaguuuucucuguauguacuccaagcuaucaaauacuucuagccuuuaacuuggcaguguuacucuuggcauuuuauucuauggaaacaacugaaaugaauggaagaaaaaauaauauuccuguucaagaugcuuauuagaguguauuugauagacuuuguuuucuaggaaagcuuuagacuuuuagaaaaauugaggagauauuauagguuauucccauaggcuucccaccacuucccccugacaaguuucccauguuuuuuguguguguguguguuuugguuuuuguuuguuuguuuuugugacagggucucacucugucacccaggcuggagugcaauggugcaaucuuggcucuugcaaccuccgccucccagacucaagcgauucuugccccucagccucccaaauagcugggacuacaggagugugccaccggcuaauuuuuuuuauuuuugguagaaacguuguuucaccauguugcccaggcuggucucaaacuccugaccucaaaugauccacccaccucagccucccaaagugcugggauuacaggugugagccaccaugcccacccucuccccuguuaauuuaccucuuucauuaguaugguacauuucuuagaguucaugagucaauauugauauguuuuuauuaaaguccacacuuuauuugcaucucuuuagcuuuaaccucaugccgugucucuguuccaggauccaaauccuauuccauugucaugccuccuuagccuucucuuggcugggacauuuucucagacuuuuccugucuuugaugaccuugaaggucuugaggcaugcugggccagguguaugauaggaaucccucuacuggaauuugugcaaugcuuuucucagguuucaucuugaguuacaaguuuuguggagaaggaccacagggugaagugcuauuuccauccuauccugucaaggguauauaccaucaacuuuauuuauggcugcugauguugaccuugauccuuugacuugagguagugucugucaaguuauucugcuguaaagucauugugccccuccacagcccauacugaacuuuuggaaggaagucacugugcacuuaaggaguugggcguuagacccccuguccuugaggguggggugucuauguaaauuuuuuagaauucuuuugcaggggagaucuguuucucucccccauuuaugacuauauucaguugucuauuuguauucauguggacuugugaauauuuauuuuguauucuaggcugcuauccaauacugcuguggcccagauuauuccacccguggcuccugggggcuccucuggcugcucccacacccuuugcccuacaccccaucucugugggguuucuuuuguuugagcacuuuccuuccuuucugucaguacaaggugcauuuuguaucuuuccugccacaaucuuagaaucggcuguuucccaaagagcucugguuccuuuuacuggagaaugguauuagaaaccagugucuuggagcuaggcgugcucguugcuucuggggugccauuucuugguucucuuggccaacagaguaaagaacgaaauguguguauacuaaccugcauaugcauauauaucuacaaauauuucuauauguaaccaucuguaucuauauuuaacagauuucauauucuuacuggcauaaaauuggaaauaacuaaguguuuuaacaugaggaauggcuacaacuauguuaauacuaccuccaugaugcaacuguuauaagggacagguuggaaaacuguggaaacauaauacuuuacauuaaaaaguaguauuuuuuauuguagagucuccaacaaaggucucuguuggaguuacgcuuacaaugugauaguuguguguguguacggauaugaacuuuaaaggaaaaauggaaaagguagauaagccauggcuuauucauauuaaacuaacauaaaauuaacuuugcuucugccauaauguuagucuuccagugaguucuugcugaaaccugaaugaaguugauguauuuaauuuuaaaugaaagaaaugagacacuuuuuauuccguuguuguguuagcccugcagugcuuuuucaggcccucccagauuaauaaugaccuuguuuacucauugacaguaaccaaagagccugcuaaaaaaguugugaaguuaaggucaaagcaguuuuaugggaggaaaucugugaguguuuaaaggaaggauuuccauaauagcaagaagagcccaaaguugggaauucuucuuuugcuuuuccacucugaucuuuguauuaaugcuugauugacugaauaaaugccauguaucuuaugguuuucaugaugauuucucaagccacacgucaggauacuuuugggaauuuccagagaaguccuuaaauggaaaagcuaaaauuaucucuaguagauauuuucaccagucuucaguucagauggcuuacauauaagaggagcaugauugacuggauaacccugaaguguaucauuucacccgcuguaguugucagaacucaacuacaaagauggcagaucaaauacuucaagaagggugguuguuugccauuguggaggcuggugguccagcgaucacagccccucaauuacggcccugcgugagagcacaagcagcagucauuacauaauuauaccucugauuaguugguugaacuggccauugccuuugaaauaugauaacacaauuuggaguuuuauuaaaaaacaauuuuuuuggaauuuuugaaaaagauuuuguguuuaagaaaaaagaaccaaagggccugcaauauauucuguuagaggagauuaaaaagaagaaagggaugagggaaaaaaagagaugaauguuucccauuaucacucauuucugucucaggagggcuaagguggccccugcucaccagccuuccccucucggcaucaccagcccccagccugcuauccgcuucacagagcagcgagccaguccuuggagaggggacgugagaaggggcagaagucaggggaccugaggcugcuccccggcaccagugcugcucaacacacacaauugugugaccaccacugaacaaaucucacaagaaagaggugcauuuuacuccacacgucauuugguuuugaaaaacuaauuugaaccucauuuuuuucuaagugagaauuugguuugcuguguguguguuuucaauuuggauugccaaguauucaguccuaacauauguuaugguuggagugcauauaacacugugcagccgaauaacuagaccuagaaaauaaaacugaucacgguaaaguuauuuuccaggcaggggaugccucaugauacuggcuggggcccaaccacacccaaggccucgucgguuucuguucucaugcuguugucauauacccagaaguaggggaagcccaggagccauggagccucagugucaguucccugacaagccauccuccaaaaaagccuuuccuuugcaaaaugaacagguacuccgugaaaacagggagagaaauuucuguuuuucaccgaugcauuucucacguucaucugacaaugugcaaaacaaaaagucuacauuagaaauuuaucaugaaguuauacucuacuucaacucacuucuuuucagucccugugaaaacuuaauacucuugguguuguacugaaauacccaguggauuuggggugcaccuguacccuugaucuccacuucugcguguuucuaggccaaagggaaaaccaacucucuaccuaauuggaacuucugguuuuauugcauauccuggaggucuugcuucguuuuuauuuucccggguugauggucuuucccaugugcaccuacguuagcccacuauguagaacgccuuggcaguuuucacagaguaagagguugaaggaagccaccaaugugaaaaucauauuugcuguaaagaaagaaccauugugaguuguuggaaaccagauuaaaauuccauaauuggagauugaugacuuuuauuucaugaguuuuacuuaguuagguguuuuaucuucuguguuuuguggcuccaaauuacgaagacuguuggccuugcaagaaacugaucacggcaaaguuauuuuccuuacugaacacguguccuauauauuugcuuggccucggguuuuguuuaaucccuucaaaggcccuuugaacugauguuucaacaugacuccuucucugugagcucuccgcuaggaagcggccaucaugucaagccccuucacagcuaaaguagugaguucacauagucgaagaaucuucuggguugcaucuuaugaaaaaaagaaauccacugccuuuuuauaagagaacagaacauuuacaccgucuuguugagcaaaugaacguucaaauggccagcacaaaagaaauccccaaucucuaaccucacaaugaaaucgccacggacaaaagaucacgggauaccgggagcacuaaacuggaagugacacaaaaccacagcagaauccgcucacaccugccgagguuccugggggaugaucuuuguguaaaggauccuggugccgcagucagccugaaacacuccaaggagcagagacgcuccccucugcaacagugacauuuauacugauggcgucuuuuuaaauaaauuaauacaugucugauguggacagaguagugcugucugacaaggugaucauuugacuuuucuuagagguacaaauuuacgcucccuucuaugaauagagagggcuauuuguuucauucaaagacaagacauuguuagaaaugaguggcacaccucuucaacccauccccuuccuccauggagguaaaaagauccuauuaguucucauaauugauucugagggcugcagcgugccucauuuagccgucccugcucgguucacgccaaggauguaauucaugcacacuuggacguccaacauggcugacgcgccuuggacacacagccucggcgcugcaucauuuuuuaaucagcuaucugaggaauauuuaucugaucaacaaagaguguugucaggaggagaccagaggugacauuaauaagccugugguuuccugguacaaugauggaggaagaguuuggaauaaaacccugcucguuugagcaugccagcagacuaaagaauauuuuuauucugcuuacaaagagccagucaaaagagucucaguuugaaguguucaguuaaguuuaagucucagugauaaguuuucaggcauucacauguguuaguaaaaaaaaaaaaaacaaaaaacuuuuagagaaacaaauuaacaaauuuuauuucaaaauaaaaauuuaaguuccucaugucgcaggaacccagaugaaaagcuguagcuucuaaaaauagggagagguguaauaauugggagcuguuaacgcuaaaugauuccagcuacucuaacuuaguagaaagacguaguaagcugcacacuuuccccuucugucugucuuugaaaagaucgugacugucuguuaguaauuacaaggagcugaguauauuaugccaggccucguuuggucauccagacacaagauuugcuguuuauaacgaucagaugccuuaagaaauguucugugaauuaaaguuucuaucacacuuucuuuucuaagugcaucacuguuugugcaccacaugagacccucaugaguggagugacacccaucccaucugccaaccugaagacgcagaaaguccauacauagccaguguagacaucagcacacuuuguccacguuaggaucgugguaccagaaggugccacagugaucucucuuuguaauucaaagacugccucaugaauucaguuugcuaacgccuucgguguuccucaacaggagggcucuguguguguuuuccggaaaauuaauaccauuguuauauuacacaaggauaaauaaacauuuugucuuagaguuugggagugagucucucugcauugucuuaaccugaguuuuucaaaguuuugauccuuuuaauccuuagaaaauacacuaaaaaaguacaaaaaauuagucgggcgugguggcgggcacucguggucccagcuacucgggcggcugaggcaggagaauggcuugaaccugggagguggagcuugcagugagcugagauggcgccacugcacuccagccugggcuaacagugcaagacuccaucucaaaaaaaugaaaaaagaaaauacauuccagccagcaugaugaugaguuuuccauguguguuuuaaauucccagcagucgguggugauucccuuguuugaccucuugcugugauacccgcauguagcacccuuguguuucaccugaguucacgguucacguuuuggcaccauuguggggacagugcuguccucccacgaguggcauucucucccaggcccacugacuguucugccuacccagauuagagcucagaaaguuccauuuaauuugcagacuaaagugagaagagaucagucucguugucuacacuggagcugacagucaguuuguaccacaucugaaauuauacuugugggauuucauguccauugagauucgcguauguguuuuuaaacauguaagacagugcugagacauccugccgcauacauagcuaugggaggcauugugaaacucuguuuaccaaagagacuuuugcuuacgcagcaagcaaaauagcagaauggaaaacacuaacggaaugcucacacccugcugccuuuuuguuuaauaacaggugaaauuuugauacuagaauaauagauuuugugagaaauaacauuaguaacaaaaucaaaauaaguuagccuguguuuaagaggaagaaacuguauuccugaaaguagaacaggaauuuuacuaaaaauuuuaauuaaaauaaagacccggaaaguuuuagucuauugcuagucccccugaaguccccgagaaucgccuuuuauuccaaaggccugagaccagagggaggcugccaguggugggcaguggcuggguggcaccaaacaucagcucggagccuccugguuccauuuggcacagugucuccguagccccucaaagugauuccaggcagcagcauccgacauaacccaagguguuauugaugauaauaggauuguauuuucuuguugagaagcuucuaaacaagggaacuuagagcaaucaaugcccccggagaccgaugcacauaucaggaccuugguaucagcuagaaaacauccauuuguuuaaggggaagaaacaggcacgacauuuugcacauuaaaauggauuauuucaucaauagguuaauagaaagccgggcugcaaguucacuuccugcuuauacauccugugguaaugggagagcagagugugaaaaauggaaggcauaaagcgggcgaggaaagaggcuuucugcacucgggcaccccuccccucccgaggggugcccagccuccauucugccuauuuauauguaaauauugcugcaagagguaaguuguacucuugaggagugcagccuucucauggcuaccucuuucuggaacuugcgaaauacugucccagacaccagagcugcagcaguuaaaaauuaagcccaugccuaauucugcaucaucaugccuggggccccugguacauacccaucaagcauuucuaaagcaaacauuugagacccgggacagauuugguuuccuucguuccucaugcaugguauuuguaccgguggguaccugaagauccuuuucccagguuuggaguuaccugagacagauacuuagguaggaccuuauagauagugaagaaaccugaagguauagacauaaagaagucuucacuugugaaaaauuaaauguagacccguauccuuuaacaccgcagaugccugcuaguuuagagguuguuucuuacuaaauuauuauuauuauuauuauuauuauucucuugagauggaaucucucacugucgcccaggcuggagugcagugguacgaucucagcucacugcaaccuccgccuccagaguagcugggauuauaggcgugccccaccaugcacagcuaauuuuuguauuuuuaguagagacgguguuuugccauguuggccaggcugguuucgaacuucuguccucaagugauccgcccaccucagccucccaaagugcugggauuacagacgugaggaccuggccuauuuguugauuuucacacugcaaaggaauuguuagauguguuuaguuauaacaaguuaauaucacuuuaaaucaagaagcaacuaaaucacagcuaguuuuuacuugugaauaauguaaaauuugcauccuaaauauacagugcuuuaucgcagaauuguauuugcuuccuuaaaggcucagguuucucgcguauguuuuguguugucucuacaaagaaauccaguguaguuagaagcacuugagauucauuucugcaacauaacucaucccaggcgccuagucaucacccugggucauuuucuggccaccagaacuuggugcacacgccgaaccuacaaccacagccucagcuguaguguucgaaauggagaauuuuggcucaaacacuacagcaggcaagaagaguuaaccugucguaagucaggaacacguugggguugauuagggagcugaccguuggccagcucaugcuuugggaaccagagggccagccuggcugccugcuuugcgggcuuaagaccugccucuggaaggguaagggccugcccguccagauaagugcugcucaccugcauuaaacaaacggccacacagagcccagugggagccugcacugguuucucuuccugccuguggcaguugagagagacagacgguccugugagaccccuucuucagaaggugaaugacagugaccgccacuaaacauuccauuccaccugccugcacggcaguccaagcccucuagcccugugaccuggggcugugccuuugcuugcauuugccugaagaguugagccacccuguuuaacucuuggguuuuuauaaaaugucuccugaagggcggagagaaugccucaagucgaugucuucccugccacagaugucagcauuucugaguugauaguugggaggguaagggccuggugggguggagaaugugucucuggagggugggggccccaucucagugagccagccaggcacugcacacagccugaguggugggccugcugcgcccuuguuaaauugguucucuuccgaacccagcgucccacugucggugacuuggcguuuuguccuuucuccugagaaccugagguggcauuugcucuucugguuccuaggagcuccauuuagagccguaacucccccgagugucaaagagaauagacuccucccuccaggacagcagaauggcacuaggggguuuugcugcuguagguauugccugaaucaaaaucugucucgggaagacaacuucacuuuuaacagcucuugguuuuaaaaccuaccuucuccaacacauaggcaugaacugcucauaaccagggucucuugauuugacaugcuccuaauauuuggccgaaucaaagggcuuguggcgacuggcaucauagcuccuucaaagggugucaucauuucccaaggcagaggccaguuuuugugcuguuuugaguagccacgugugaaacccagcagggcgaagcagacuucugcgcguggguaguucuuugacguuagaugcaauccugaugacccugcuccaccucugcccuuccugaguuccucuguucaccgcaggggaguuggagggcucagcccagggagcuccauggcacccacccgcuucgcgcagacagcucggaggcaacgucacgugcuacuuugaccuuuuuuuuucuccccuuuucauuuguuuucuuuuccuuuuuguuuucucucuuuuuccccucuccccuuucugcucucgggaugcagccaaacgcaaagcauggaaacuaaaccguguugguagccugcgaaauauauacagcagcagcaccaacacugaagguaacgccuccgcaccuccacccgcccacaccuccaccugccucuuccccucucauccccugcccgccccuuccuuuccaacacaggcauggaaaugcaauuugcccaaagccgcaugcucccuuauuguguuugcagagucauuccuguggucuuuucaucuuuuuguuuguguguuuuauuuuaccauucguguuccuuucagcuuacuuaaauuuugaccuuucccuucagucguagaguagugauguuuaaauuacuucagaaaccuauuuucuccucuuuuuucuuuuccuuuauacaugugggcacucaguguaauauuucccaaguuauuacaguuuuuaaaaguguuaguaucagguguaaugaucuguagccaaauacaauagugugccgugacauuuaaguaacagucuuaauuuguuuuguggaagcauucuccauaaugcucucugcagcucuaauccacaggcaggcaggcccgggccauuugcaugggcugcuauuugcuuguaaagucaguauuuuguuguguuucuaaaggucgucuggugccaaaguucacaaauugacuugcguugcuuuuuucaccgaagacagccgucauugcuuuuguauaauagcagauugaauuuuucccccaccuucauuugaacaacauaauuauaaauugccuuuuuuuuuaugauuacaaaugucaagggucggaauuacuuugaugccaggcaagggaaaaccaccaccaucagcccaagcgcacauaagggaggcgggggcaucgggcgugugaugcaaagcaggucacaauccagcgaucuugguauaauagggggacauuuuuuuucacuuaagugcaagccaaaugggucaaguaaucgcaagcucgugcccuaacacuaauugacuuauuuggggauuauuauaacuguaauauuuuucuuaaugucacuguuuucugggcuguugauuuuagcgauugccaagcaauggcauuaaaucucuuguaaauuuuaaauugcacguuauuucuguaaacaagucccucucuucacauccuggucauuaaccuuugccgauuuauaucaccauccucuuuuuuucuuucuuucacaauuacuccugucuugccgcugaacgcccugcucucagccaggaaaaaaaagaaaaagaaaucuggaaaacaaaucuacauuuucacuauggcuuguuaaagagccauuuuuuaaucauaauuuuuuuuuucauuucucaagggaaaauuguugucuguuaagauaccaguggagcuuggccucauugguaucuucuuucaaagcacucaagaaauaaccaaaugaaagagggaaaagaauagaaguuaagaaacggucauucauuaucauuuuuguugcauuuuaaaggguauuaguauacucuuuucaccguuuuuuaaauguuuuucaacuuagcgugcauaucauuucuccucccuguguccuuaucaaauauguuggguuugcuuuuuuuuuuuuuuuuuuuguaugcauguggguuugucgcaacaaauuuguuuauugacuuccagccuuuaaaaaaaaauugugaggucugguuucaaaugcaguguauagaaaauugggggacagcaaggggacauaccuccuuagccuugagggcaaaugguucccugagacuugcugaugggccuuccuggagacacuggugggugacacgggacccaguagaaccaggagugaggauuugcagcagugcgaacuucucagccuuagcuucucagguaauacacagcaucugcucugcccagcaccucggagggguggagagcgugaauuccucucugaaaucugucaguacuggauagcacugcaaacauggggucccucugucaguagcuaugaaaggcauuccuggggauacuaaauagugacugcauauccaauugucccucacaauuucuuucauuuuucucaguuauaguaaguuucuguuugguguucaaggucauguaugaauuuucaauuaaaagacagcauucuucauuuacuuuggguuuauuuuaagauuaacauguguacacauacaaucucauuucauacgguuuuuaauaauguauuacagaauucaggccagacgcaguggcucauaccuguaaucccagcacuuugagaggcugagacgggugggucaccugaggucaggaguuugagaccagccuggccaacacggugaaaccccaucucuacuaaaaauaaaaaaaaaaauuacccgagcauaguggcgagcaccuguaaucccagcuacucaggaggcugaggcaggagaaucgcuugaacccaggaggcggagguugcagugagccaagaucacuccacugcacugcagccuggacgacagagcgagacuccaucucaaaaaaaaaaaaaaaauacauuacagaauuuauaaaauuauauaaaauaauugucaaauuccuuucugauuuacagccuuuugauguaugaaguuaucacauauucacugucuauaaagugacccuucaugaaaauuuguauccugaacauuuuaacuuuuguuuuaaccucacgucguguuacacuaaauauauccauccccaaguggaguaucuuuuaaagugguccacuugagugauuuacucaaaggcacccaaaaaacaccacccaaguaagguggacacuggaguuuccugugucuagagggagaacuugagcuucaggaauaagaggagaccacccacuaggagcugggaguggacucagcuguucugggacuuuccucaggauccugguuuaggagagacagacagagccaagguuugagucuaaggaucucucugaagcccuuuuucuuuuauguccucucucuuccggccucuggaccacauuaucucauuuaaucuucacacucccccugccagguagguaucauguuauggauggaaaauugggauucugauaacucaagugauuuucugcagaacaagcuagcauguuccagaggcaggacgugugcccagaucucuugacugugggaccugcucacagauccacguggaaggaguuuguggauggaagucaggaguggauaaaaacaaacaaaacuuacaagggaaacgcacagacaagauuaaaaaacaaaaauauuuuaucuuuugucuguccauuguggcuaacacugaaacugagauagaaacuuuggauauauaugauugcacuaauguacaaacuuuuguugcuuuuuaacaauuaacuuucucaagaugggugaaauugaguuuucuucagccagaaugcagcuguaacuuuaacaucucaggaaccugugaauggaagggugucuuaaugguaugauccuccaauuaacagcugucucccaacccaagggagaauaagaucuaaauaccagaugacugaggcuagacucaccaauguucaacugaaaguaaauguauuggagaaagaacaaagaggaccaaguggcagaagaguggacguugugcaggaggaaacucgggagggaggccucuucgcugcaccgcagggcagaauugcacaacaccuggacccaucuccaggccucaccugccccaugcagcuaaacagaugacauuaucauccgcugugaguugggugaacacaugggcucuuucaagagcauuuaagcucucuguuuuugcagaagaaaaguacuuccaguaccuaaauagauaaaggagagagguguuaggaaacaagggggcauuucuugggaugccaagcccauucccuggcagcagaaugaauacuuaagauaggccucuucaaauaggugaugacacuugcauccagguguuagccagauucaguacuggccuaaagucccaauucgagcccgucuaugagggcccguuucuguggauuuagagcucgccccagcaacaggccugggaaaccucugcuuuggguacuuccguucaccacagugggccagaucgcuggaacccagucuccccgacacugcgauuccaagcauaggcauugccauggggaaacagcaaaccuccucuuggaaauuucaucacagauacagcuucgcgccucaggccugcagucagacccgcaccugccuucuccacugaacagcccagauggucacuguuccucugagcagaugugagcaggccuaacuuguuggccauucccuccaacacucguuuucuuggucacaguucugagacuuccaacucauucacaguuaaacaaauuacaggcccacaucugagaaugauggucuugcugagugugagguaggccugccuccuuguucccgacucucaggucccugcugggaugcgccauugccugcgcugggugcuggggcaauggagaggguaagggugcacccgcccacugcccucagggagcuuacugucagucuaggaggcugcacaaaggaucucaugcagaaggagggaagaggcccuggaugcucugggggcuuuguggagagcagaacuacauuugauuuaggggucaggacagguaucauggccugcgggaugugacaggaaccacagugaccgcauccucagugcugagaaauuuccaacauccugucgugcaccccuagcagagggagaucuuuuccuccuuguuuuauaaaagaagaaaccgagccugggagaagggcaggcaucagccccaggagcucucaggaagacggggcuggaauuccagguggaggcagcagccugcaccuggacggggcuuaguacagagccugcagcgcccuuaggcuugagugugaggugugugccgaggauucuuuugggaccaguaccaguggaggggacuagaugauccacagaucugcagacagcugucaucaucaucuccagcagaggaagaaggcagcccugccugacaaucugugacccauuguguuguguguuuccugaaggacucacugcagugucugaucaaggcccccgccaaaugccccggcagucuccccagugccccguguggguccccacugugagaggcugccuuccagaaccugcucucugcagugagcauucuccaggcucagauggguucucuuucacacugaaucacugcucuuguuuguaugaggcaggcaugggcgccagacucaagcccagaucuuaacucagguggucuugguucagucccacauccccacuucauagcucuaaccuuggguucuugaugugucuucucuguaccucaguuuccccaccuauaaacuggggugaugacacccacugcacaggguuguggggaggagucagcaagcuaacauaccuagagauguggaacauggccccugcauugcuccuugccuaggaccaguaagccccaguacucaagcacccagauucucucuguuuucaaagaaaauugcaguguuugaacguuguuuauguagccaggaacagagauuugaaaagacguguugcccaugaagcauaggggggaauuuagaaaugaaacuuaaccuguuaucuagacuuuuaaaccuacccuccugcuuccauuugcugucaucugagaagaaucgucaguuguagaaauuuggcuaaaagcgugagcuguggagucacacacgccugggucucauccccucucugccacuucccagcuguguggcuugggaugcuuuccugggucuguccuuccucucuguucuuuucuuccucgcaugcagacaauaaaaccuaccuugaaggguaauugaagaagaaaugaagugaagccugugaagugcuucccacagagcugggcacauagggaagcuggccgccguggcugcuauuaaauugcuauacagacuuauuuaauagaaaaaugacccaaagacuccauggagaauaucuguggacuauucaguaggccuuuuuaauguaucgguacagagcagagcuggccaaagccaccccuccucagugaugagcagcaccaacuaagaacuaaugcagguaggccgggcacaguggcucacaccuauaaucccagcacuuugggaggucaagguggguggaucacuugaggucagacauucgagaccagccuggucaacguggugaaaccccaucucuacuaaaaauacaaaaauuagcugggcaugguggugcgugccuguaaucccagcuacuucagaggcugacacacaagaaucucuugaaccagggaggcagagguugcagugagccaagaucgugccacuacacuccaaccugggcgacagagcaagauucugucucaaaaaaaaaaaaaaaaaaacuaauacagauaacuucagauuuaggaaacccuugcauggggaauaacuagaauugacguuuugggaagagaagauugcucauuuuucuagcccccuccuuuugaaaggaugacagucuuggguaucaaucaccucagcgcugagcagcaccuaggagaggaagcccucaccguggacaguggagggugccgcugaagauuccugguaagcccgggucuccugauggccaugcuggacucuugcagaggaacccgcccuaggccugcccaacauggccgugcucacuuauuccuauaauuaggaguccgaggggaccucugcaaaguggggagugugucaggaugaguaacaaacaguuaccgcuuaguaacaagauaaaucaccgcacgugccuaucguugcuuugucuuucuaaacugaauguuugggccuggagcuuucacaggguaucugggacagagaaaguacaagggagauagcaacacucaccccugcuguaucgcaagauguuuucaauuugcggucagauaacuauuuuuuuuuccccaagagcuuuguuuuggagucuuuucuuaauuuaagacaggcacgggccagacauggugacucacaccucuaaucccaucacuuugggaggcugaggugggcagguugcgugaguuaaggaguucgagaccagccugggcaauauggugaaaccccuucucuacaaaaaauacaaaaauuagccaggugugguggcgcaugccuguagucccagcuacucgggaggcugaggugggagaagcgcuugagcccaggagguggagguugcagugagccgagaugaagccacugcacuccagucugggcgacagagacccugucucaaaaaaaaaaaaaaaaaaaaaaaaggcacauauggcacccuacagcucuggaagccaaagcuuucaaauggaguuucuuuacacgugguccuugaacugcuaucccagcucuuuauaauguguuugaaaaauaaaaauguccuuuguaugucaugagaaccuucccgugguaauauuuaguaguuaaacauuccuaagcucguaauugaccuguggggauuugcuucuucacagaauuaaucacacuguucuaaauuaagccacaggacaacaccucuguuggacucucuuggcuagacaaagauguugaccaaauucagaguuuccaaaaauaauuagcugagaaccgugaacugcguguguuuauaaugaucuuuuguuuuuguuuaaaauuaauaacuucucaaguauacuaaguauauccauagguuucuugguucuguacaacccugguccauauucuccaggcuugccuacagucuuugucuuuuauuuuuggacagagagucucacucuguugcccaggcuggagugcaguggcacagucuccgcucacugcagccuccaccuccaggguucaagugauuuucaugccucggccuccugaguagcugggauuauaggcacccgccaccacgcccaacugcuuuuuguauuuuugguagagauggaauuuugccauguugcgcaggcugcucccgaacuccucaccucaagggauccgcccccaccccaggccucugaaacuguuaggauuacaggcuugagcuaccgcacccggucagcaggcuuucuuucacaucagucuuuuccuacaaaaaugggagaaaauuugaaaauaaaaacugacuuucuaauacuguguuuuggcugacaucuuagugugugagcuuuuugucauaauuggguaaaauaucuaagccacacgccuauuuaauagaugguuuuaaaacagaaauauuggaggauuuuacaaaguguaugaggaaaaauagcauuaaagcccgggugugugcgugacauugccacacauugccucuuagggucaugguagagggagaaagaccacaagguagcgaguauauuccgucugaguuuccgaccccguugcauugacaguggcuaccuggagaacugugugaagaggaauucuggggcugcaccagccucuucaggaacaguuaggaaugucuguuuuuaaaagaaaaggagagagagcuucccuuugucaucccggguccagccuggcaccucccuugcagauaaagcugagaucagaaagaugaagugggcugcucaugggcaccaguccgucgauggcaggaugggaaguagguuccaggagagagaaccccaaaguuggagcuccaguucagacagaaacugggagaacccauagcgaaaacucacuuguuaauaggggaaaaagaaaaagggcuuggcggaagguaagcaucggugguaauguguucaccacggcuuugugguguguccuaaaacagaagucccaacucuuucaccaaggucaggaguggagaagaugguuauuuucugcccaggccuuggcuguuguauugucccgucuuuucgguggugcugucuggaggccucugggcuugguagauccugcacucuuuguacagcaaacaugcccgucccccaggcugagcaugucaucucugcaccguugcgauaucccauuucauuuucaucacagguugcucauuaaaugugucacaaaggaugcuuagccuuguggacagaacacuggaugggccucaggagccuggauuucaggcuauagggcacccugggagaaccuccucucuccccaggacccagauucucauccggucauugaagaacuuggaguaagugacuucugcauccuccuugagcccuuuucuauucagaagagaaacaucucggcauugcaccugcacccaucaguaguuugugguugguuguuuuuuuuuuuuguuuuuuuuuuuuuuuggagacagucucacuuugucacccaggcuggagugcaguggugugaucuuggcucacuacaaccuccgccucccggguucaagcaguucuccugccucagccucccaaguagcugggacuacaggcacacaccaccacgcccagcuaauuuuuuuaauuuauauuuuaguagagaugggguuucaccauguugcccaggcuggucucaaacucuugagcucaggcaauccacccaccuuggccucccaaaguguuaggauuauaggcauuagccacugcgcccggccccaucaacagcuuugagccauuucucaucguagcucggggcacagauccagguccucuuggccuuugcaagagcacagugcaguuguccuuuuccccagacccuuucccugagaccugugugugccucugugccucccuccuucccuccccucgcacccacuucucccccaugcauccuugucagaugccuccuguugaaagcaacuuccaaaugugaaacgguuuucagcugcuuuuagcccuuuaacccuuugucugcuagaauuccgcaaaaaaauaauugaugacggauuggcccauuaaccuuuaagaaaaaaaaaguuugacagcccggauucauguaaugaggagggauuccuugugaaaucagucugauggcugaguuucuugccccuaaggaggcaaaauuagccccauggggccuugucugcauagaaacuggacacaauuaguguaauauccgguguuauuaaugucguuuggaauaauugggcagguugauuucgacagguucauggugcuaaaauacuauuauaguggaccuuuccacagcuaacuguuaaacacagaaaacuguuuaaaucccugugagcccaaucacaaaacuuuauuaaacagcuaagcccuggaaugucacacugggaaacaguacaccgucuguuacuucaggcuuuggggugugguggcaucuugauuuuucaggaacagggggauuaauuuugcugucuguguguguaucugaaacuucaacaugcuuuuaauagauauaccaucaggagcuucuacaaccugaaaucuguuuuuacagugaaugaaauagaagccacugcaauugucacaaauagguaguuuguauuagugaaaugacaccacuaaaagugaaagcuccgaacagggcauccucacaggcacaugcucguucugcacguuugaagugaggguggcaguggagaguaaugcucggcucugucucugacugaugggccucacgcugccaauuacuguuuugaucauuuuuaaucuaguugcucauaaguaaaaugucaucaccgugucacuucguaaugugcugcagcccuucggggccaucggugauuugaauaaggcucuaucaucugcuaaaaauucuucuuugaaccuuaggaggagcauguuccuguucucuccacacagaagaagggaaauuggguccaaaaaucuauucacuguuuacauaaugagcguaaauggucacugcaaugccaccgaaguguaaacacggauuaaacacggauuaaaucuugagauuugcuagguguugaccuaauaaagucaccagagcagcacauaggagaucaccaccaggauagaucuucucuacuggauuagucagaacuagguuuaguaacaccagaaauccaguuuuaaaaaaaggagacgcugggcgugguggcucacaccuguaaucccagcuacucaggaggcugaggcaggagaaucacuugaaccccggaggcagagguugcagugagcugagauggugccacugcacuccagccugagcgacagagggagacuccuucucggguggguggauggauggauggauggauggauggauggauggaugucuuauguaacgaacuguaggacaggcaggagcuucagggaccucagaggcaccaggcucccugccaccucccaucccuggcuucacucugcugggcagcagcauucauaccuguccacagggaguggccugauaacagaaguuuuccuucccauggagagggcagaggcaccugcaccugcaccugugggccauguccugacaggucccagauaagaggggaaggcacucuauggacacaacucagaugugaaacccuggaagacacuugaucaugugcccccaccaggacugaucagaguggccagggacaucacgugcuccaguuggccaacauagauggggccaucccugcucccugugcuggccagggagccagacacccggcagguggcacguggaaggcccagaggaccaccaccucuguguaccaugucccccagcauuuaccagacugaccugauugugugacuggacaucaguuagaaagaaguaugacacgccgggcacgguugcucaugccuguaauccccgcacuuugggaggcugaggcaggcacaucaccugaggccagaaguucgagaccagccuggccaacauggcgaaaccucagcucuacuaaaaauacaaaaauuagcugggcgugguggcaggcgccugcaaucccagcuacucuggaggcugaggcaggagaaucacuugaaccugggagggggagguugcagugagcugagaucaugccauugcacuccagccugggcaacagagcgagacuccaucucagaaaaaaauaaaaauuaaaagaaggacaguaagacaaacuguugagggauuucuggggaagcuaguuucaaaaggcccaaccaucuuguucucuuggcaugaggaauaggagaagauaacggaaagccacuaggagacccuuccagccccuaugccgucuuugauucccaaggagagcuccuuuuuuuaaauguuaauuuguuuuuaggaaauggaggaagaguacugccacuuuaagagaggaaaaugauuacaagcaaaaauggcuguaaaguccuggcguugugccugacagaauuuggagcccagugguauuauuuucuauguuuauuacuccaugcaguagauuuguuauggauaaacagauuucuuccuggaaguuguaacaugacuaugcaguugcucuauaauccuuguacuuauuuuuuuuaaucuugggaggcagagaaaagucauauggcagauauaaauuagaucugaaacucuacguguggguauucaccuauuacccucccucaaaauaaaaaaugaagccaccuaaagacaggauccugggaaacacaugggccuagcauagcuggauuccacucggcaguguugguguagaguggccuuaauuaggcucugugcucagauguuaauccuuccucaggaagcaagguccagcugcucggacccuugucguaaauuucagggccugaaaauccaaaagaagacacaggguaguccucccgccggugcccaccucugcgcugagcauguaggguuccaucucccgccucugcccugccucccccagggcagacugagccucuccccuccaggugucccagauguuugcaucacaguucagcccugguccccaucagcacagccugccugggagaggccagcccagggucagcagcgccauugccucuugauuugggagcugaugcuggaccccgcauugacgagacagagggggccaucuugugcuucuccagggcuaggaugaaccaucuggucaaaacagaacagaaaccccaaagagcuguucaucggcgucucacuacauggugaacugcuacucacagggaaaagcguggcguuuagaccugcccugugaucacagggccuuugugcaugcuacauacacgucagagacagaccauacccaaggaucacagagauggcacagcuuccugcccaccacacuaucacagagcuguuggucccggggauugcgauucgugucuuuauuucuucauuauuuguauaguccugugcuuuuccagguuuagaguuauugcacgggacucccccucaagaaaagaauaucuuaagugagucugggguugcaguugguccuuaggaugugaagcuuagcugugcuuuccacggucagcagggucugucauggggcugaccuucccaauccaugccuuuaccugaagcuggugcccaucagccugggucacagggugucuugcaucuguuuccucuuuacucuguugggccuuguugguguuucaugguaauuagccaauuagccuggguuucauucuccgggagaggagaccugaaccugagcaggccacccucaggcucugguuaauccgucaccuccaggcaaaguguaaagccuucucuuugccaccucuucugaguggcugcggauaccaagugguccuuuauguucuuacuuuuagggaaguauuuagcucauucacaagucuuuguaucucuacuuugcuaccucagagauagaaauauaugucuauuauuugugaaggcaugcuuaaauacgauuuuuguuugcuaguguacauuuugcaauuaauauuuuuguauucaucuuauaucuugcccauuugccaacugcuguuaugauuuuuaauaauuuguaggugauuugggguuuucuaugaagacagucauauaccaugugaaugucuuuaucuuccuuuccaaucucucggucuuucauucccuuauuuuugacuuaauacacuggguagcagggauggaaaaaagcaguuacaguggguguccuugucuugagcauccuguaacugaguguucaaagguauguuucugacaucucacccuuaggauuagugacauugugggguuuagggauagauuaucucuguccaagguaauggaguccucuucuauuccucguuggcuaaggaguuuuaaucaugcuucuuucucuuauugauuuuuuuucuuucuucugguugagaaauuggacauucuacuuauuuucuugcagagguuuaccacauggacuuaauuuacuuaccaacaugugaagugaguccuuaccucucccaguagagcaguacaaggcccuaugacaucguaacucccauguccucaccgcuacucucacguucuccagcauuuugaccuuucccaugguagacauugucauuagcagucauagucgguauuguuuuuauuuaguuuuuuuuuuuuguuuacauauuuaucaguucauuugcucaccaaccugucuuucacaaaccugccuucuaggaucuuccugaaauacauccuuuuuucuuuuuuuuuuugagaugaagucuuuccuugucacccaggcuggagugcaguggcgugaucucggcucacugcaaccuccgccucccagguucaagugauucuccugccucagccuccugaguagcugguauuacaggugcgugccaccacacccagccauuuuuuuuuuuuuuucgguauuuuaguagagaugggguuuugccauguuggccaggcaggucuugaacuccugaccucagaugauccaccugccucggccucccaaaguguugggaucacaggugugagccacugugccuggcccugaaguauaucauuuaguaauuucccuaguggacgucuauugguaauaagcacuuuuggguguuuuugcagaaaaauauauuuuguucuuuccuucuuuuucuuuuucuuuucucuuucccuuucuuuucucuuccuuucuuuucuucucugcucuuuucuguuuuuucuuucauagggucucacucuuucacccaggcuagaguacauugguguggucacagcucacugcagccuccaucucccaggcucaagugagccucccaccucagccucccaaguagcugggacuacaggugcaagccaccaugccuggcuaauuuucaaauuuuuuguagagaugaggucucacuguguugcccagaccagucuugaacuccugggcucaagugauucugccaccucacaucccaaagugcugaguuggcagacaugaucccuugcaccuggccuguguuucacucuuguucuugagagagaguuuaucugaaucucaagucuacacuguuauuuucucuugaggauaucauuccacuaucuggcgacucucacuguuacucuuaagaagucugugaucgucuugauauuuguuuaagagcaaucugucucuagagacggggucucaccauguugaccaggcuggucuugaacuccugacaccuuaggugacccaccagccucagccucccaaagugcugggauuacaggcgugagccaccaugcccagccuguaucaguaauacuuuggaucuaaaucugcugucuuguuugcaguguguugggugaucucugguuuugaguucagauguaguuggucuccguccaugggaagcuuuccuguagagaagauaccagaagccaagggagcucugagaccuggggccucccggcuccuuuccuugcaggauugccaggugcuggacccuggguuuauguuuccuaucuuaggaccuuaucuguugugcuaccaaagguguuugccccucaggguagccuucacuuuugcagguuuuuagcacuuuaggcucacaauucuaguuucaccucguguauuugauuuggggaaggagaaggaggguccucuugagaucaugccucacuguggacugcuguguugugaugcagucagcuuggaggggaagccaggccccaggaacaagggagaaaugcuuaaguguuggagaggagagcgacagcacaaacuucuuacacaguaaacucagcgaaguguuaaaggugggccagaaccaauuucacagucaggcaagggcugaaaguagaaggaaguggaaggguacagauuggcagauauugcuaagcagggcugugacugaugagaugaaagugggaagagggagagggaggaauccaggugauuuugagauuuuaugauuagaauagcauuguaaucauuaacagaaauacagaaccccaagaggagcauuugaaaaugcuagcaaaucuaugugaugcauguuaaauuugauaugaggacaaaguuuuugagaaacauccacaggcauuuuaaaauccaaaacugauuagauauaugaauuggagauauauguaugagaacuguacaugucuguaggaagugacucucuaagcuucggaaggaaaggaaccccuaagaaggagggaggaggaaggaggaacauuaacuaaacuugaaguuugccuucacuaaaggccacaugcagaggaaccagggaggagaaagagaagcagugaucagaaagcucgaaagagaacuauaguugcacagugagaagauggcaggcacgccacgggcaccccuccuugcccugggguagacauugcuagcugaucgcagauccuucuccaggagccuggagccagccuuggagaucucaacacaggauucucugcagcugcucaaagcugccuucauugagaacacaaaugcaagauaguucucagcuaucuugcaucacucccauaggaucucagaguugcaagggcccucccaaucaugugugagacgcugaauucccaccagucuccucugaaagggccacauucaagggccugaaacccccagggagcagaacccacaagccccaucucuggauaguugugagggggacagaaucuuccacuugcagggucuccaucauuuuuuucuguccuggguugacuccagggcacccagaacaggugucaucccucuuccaucagacagaaguucccugugcucagaguccccagugagcagucccuggcauugggcucucucuguggugccugcuggccaccacccugagugauagagacaggaccaccuccccaccauugugggugacacacucacagccuucacuuucacugggagccucguucugggccugccguucacugcaguccuucagccuuuucauauuuguaguugggaagcaaaaucuucucccaaaccucaccugcuguugggguccaagagaaggaauucuagucaugcauuugaccauuugaguugucaguucagcuaagagauccuccucuuuuuagaccuuggggauggggauaaaacccuaguuuaucugcuaucccccaaaacucuuugcuuucacaauuugguaagcagacuuuauaugucuuuauccaagucauugauaaaacauugaauauugaaugaggcaagacagagguaauaguuccaugguugaccacugcagaccuucugcuaguuuaugcugcuuaguaccccuuagcugugaauccauauaacucuauucacaucucuuucauucacccugauaaaagccuugcucacaucugggugagucuucagggugaucaagcaucucagaagacuaagggggaaaauauugcaagaugguggugcccaucagcaacgucaggugcuccagaaagaggggggucagugagaaagaagacuaagcacagcccauggccccuggcuguuccuugaucuguaaucuuacagagugagguuucaaucagguggaugauggggaagcauuauuagaaaagagagggugguaaagagcuggaugcacgcgugcacgugucugcuuugcagauugugugagugaaggaugaagaaaagaggugaugaucucucucaaggauggagugagaucaggaagugagugcaggaggucuguagaagggggacaugaaguuugcaagagagugaggaaaccaugccaaauccagguccgcaagaagguaugaggggaccagguaaaggaugcagagagacgggaggaaaggaccaggagcugaaaggagagacagaaauguugagugacauagaagauacuagacaagggaacuuucuucuguccaguauacggagaagacagguggugggauagauuuuuaaagugagugaucggccaggugcagugacuuaugccuguaaucccagcauuuggggaggccaacgugggcggaucaccugaggucaggaguucaagaccagccuggccaacauggugaaacccugucuccacuaaaaauacaaaauuagccggauaugguggcacauaccuguaaucccaucuucucgggaggcugaggcaggagaaucgcuugaacuugggaggcggagguugcagugagcugagaucaugccauugcacuccagccuggacgacaggagcgaaacucugucucaaaaaauaaauaaauagagugagugaugaagccauagaacagccacuguagggagcacauuuagaaauuagcucgaaauggguucugauguuccugugaacacuuacauguauuuguuccccuaaguagaguuugcaugcauagguaaaauuuguuuacauaauuaaucgggcagagccaaacugcgcuuuagcaauuuaauuugcaaguuuugucuuugcaugagauacugagaguauuacagugcaagauaccagauagcagcuacugcguugggaugaggcaaaaaauagagacguucccuuggagcuucauucagauuuccauuguuuuuaucacuuuguguucagucaucugccugagugugugcccguccucaccacguagacacguuuagagggcacaggcuucuccugcaugcuggaaucccuuccacccagcccagugccuagcacguuggggagggcagcugaggaccacagugaccgagcccugcacccauacaguguaauacaagcucagcucuuagccuuaguuccagugacuguagcucaugacuggcuagagccagacauuugagcaggaaagcuuuacaggggaccaguugugcagaaauuuaaccgggaagcuaaugguuguaauuuuuuucacuagaagauccaauaaaugcugaucagagggagcuuugauacaugcauuugaauuucacagauuaaacaaagugugagccugucgaguugaucucauaaugaaaaauugucacaucccaccuaugaauuaccaaguuuuccuuaugaucuaacugugaguuauguaguuuuuucauaccuuaccuaucuguucacuaggagaguuuugcauaaaauacaugaauuggggcacuauccuaugagaaucuguauggaaaagguuguaaaucauaguacuaggacuuaaaagcccauggaucaagaagcuggaccaagacccacagaugcaauggcucagccaguacuugcacgauaucauuguaagucagccauggugaaaccuaugugaaaguuacaguuacaaugauuuuuuuuuuuuuuaaugaaaucuccaagucccugaguguuuaaggucguuguugaaggcaugaccugcagacacccugacccccaccuuccucccccaccccucuuuccacagcagguggaguguuucauucugcauaaauacacagguggcgggggugggguggucauuuguucuccaaauucaagagcccaguagauugggauaaaauuccugagcaaccagacccucccauccugaccucuugucaccagcucuccagaaaucgggaaccagggugacugagagcacaaaggacacccccauaccgugugggccagcugagggcuuccuccaaagacucuucucuccccucccacuccagcccguaucggucccuuucaaggacagggugggucucagugccgacaccccaagcggggcuaaccagccagggccucaggcccgaccuccacucagcacgugcaucacagcacuuuccugcagcccccagaauaugcccagggcacaguggcugucagcaccuagggagucacagaccacugaggggcugguggaggccaugggcccucucuggcugggugcuguccccacaccccugggaguggggcuugggagcaucacugggcugcucagguggaagggaucucucagccacaaagagggcugcauauccacccagccagaaaggaguggggaaagggugagugggguggcacguccucacgucccaggcugcaggcgcauugugaggaagggccugggagagccagucuaggugaggucaguaagccgugcuuggaagcugggcuagagggaccaagagucuggaagaucagagguccgugcaguagacaugagccagcccaauggccacgggcuggugacagagauaaguaaagugguuggcaggcagguaggugaaagucaguacuaauaauaguugcucgccaggggauuauaaugcagcuaguucacaggccagggcccggaaacauugagucaaaugagauguugugucugaaaaccuaguugaagauuucuuaaugagggucuggugcaguggcucacacuugucacucagcacuuugggaggccaaggagugaggaucacuugagaucaggaguuugagaccagccuagggagacaccaucucuacaaaaaaugucuaacaauuggccaggugugaugguacacaccuguaguccgagcuacucaggaggcgaaggcaggcucgcuugagccugggagguggaagauauaaugagcugugauugcaccauggcacuccagcuuggacaacaaagugggacuccaucucaaaaacaguucuucgugguuguaugcaauuaguuaugcuuuuugccaguggugccuccuccuuuggcggggacuugggggccgggaguagggacaggaauaaugaacagaggccgacguggaucuguggagugucuccuauggaccaggucccaaguccgcaugggucuguacacuucauggaacuagcagaaaagcauuagacagucggugcccuuuuccuucauuuuauggguuagaaaaaaugaaccucaggggaguccaggaacuugcccaaagacuuagauguggcagguggggucgcaggguauacccccaaguuccucucuucccauugcagacauggccccagaguagcuaccaagucuggggccugucucagcugagauccuccuaaggcacgcgggaucccaugcacucucccugucugaaaacgugggaauugaugccucucccacgguaacagguccucugccauaaaagaacagaaccuucccgcguuccucuauccauggagugucuguggaucuacgcgagugcuuagauagaaauuaacccugcagccggagauuagcggcccuaacuuaauuuucgucccacagauaaggauggucagccaugaguuacaugguuauucuccuaaguugcuuugugugugcaccacacagagacgcugacaucacucguugauuucaucuggccuugugcccugagccuugauugaaaccuggcuaagucaugcuggccuuaggaaccacaucuggacuguugggaggugcauggauucaaaucuccgccgccgugguuguccagugccgugcgccucaccgguccaugcaggggcagcugaacccagaggcgcuucugugacagagggcccgcagggggacugcugucucauaaaagcuaaacucuucaucccacacucuguguuucagaacaagaagaaaauuuugaguuuaucauugugucccucacuggccaaacauggcacuuugaagccacgacguaugaggagcgggacgccuggguccaagccaucgagagccagauccuggccagccugcagucgugcgagagcagcaagaacaaggugaggccccuggcugcccaaaaccaaggcuggggcugcucagggggagugcgggccccaaguaaugccccagggaggagaaaauagaggaccagugugaaugacaggaccuagcuauucuuuaugagcagaaagcucaauaacuaaaacgaucagaagcacuuugugucuauaccaucauacaugaguauuccagccugaccgugcuucccuggcaggagagccaagguuaaaucuucagucugucagccaaucccagagggaaucuuuuggacucuuguggcuucuggguccacauuuauuuuuguuuuggacagaauacacucagaaaaaaagagagacggacuuaaaagaugcacuguucaaguaaaugcccagaauucaaaucgacaucaaguuggaaaaccgucucuuguuagggacauaaaugaaaaguagaugggucuguaugagcgugcagggaguuugggaagauaaaguuucuauuaucuaaacugauaaagccugguauguguuuuauucaauaauuagaggugguggugcagcucuuuuagaauuuguccagcagguuuucugguucucaccagaaaacgccacccccaaauguuucuauauuaaaaaaauaaugagaggcaauuuguuuuuuguaguuacuuagcuagaaaaggaaaaauauuuuaaccuguauuuuuuuuuccuuuggagagagucuaucucugucaccuaggcuggaguacaguggcacaaucuuagcucacugcaaccuccaagcucaagcaauccucccaccucagccuccugaguugcugggacuacaggccuggcuugcuugcuuauuuauuuguauauuuauuuauguaauauauauuauuuguggaggugggguuucaucacguugcccaggcuggucucaaacucuugggcucaagcgauccaccugccucagacacccagaguccugggauuacaggcaugagcuaccacgccuggcuuaaccuguguucucuaggcuacugcccagugauguuccuucuacaaaaguccuuuuucccaucaaggauugcuucaguuucauuauuuuaauguuuguuugucuuuaaccucuuugcugggacgucuuagacuuuuggagagcauuuugauauuucagacuaugaucaacuagaaacuaagagaaaggauguuacccaccgaccugcaguuucauuuguaaccauuuaaagaaauuucugccuaugauuuaugugcagcuuugucacuaaaaagagagucugucuuucagaaagaugaagugucuuauuuuauuacccucuuuaaccaggguaaaccagaccacagucauuauuauuauaauguaauuugcuucccuuuuuaaaagauguuuuauacucaagguggggagaaccacugccuuucauuccauacacccuggcuuuacugggucacguccacaugcauccaugaugugccuccugaaacgagcacagggugcuuuggggccaccucaaugggaagcaacagcacacagcauccuccaagcgugggcagcucauucugagaaggaaggcagggaggcaggcuguguuaccgaacagagaggcacagguuccugccuucauggagaaaucacagucuuucacggcagacucugagccccugccaccucgaccuaauucaggaagaucugggaugguggcagccuuucccauuccacaccuugccaggcuccuccugacucgugucucagcucaugcacacaccagccuuagaaugcugcccucggcccucacuaggcgccuguucuccagggaauugcucccuugggaggaggacgcguugagcaaccaaagguggccgacucagagcuggucaucgugggcauugguugaacaggugugagggcauaaaacauggaaauacuguccacaaggaguagcgggaggcaaaaauacaggcccaguugaccaccagcuuuauaguauuuuaccugccaguggauaauugagagcugauacagguauaggcauagcuagacagacagacaaaccaaccaaccacagaaaugauacagguacacagagagacagaggcacaucccuuuguaugugugugugugugugugugugugugugugaucacacacuugcauuccagaugccaguguaaacuguuuaaacauauuuugaauacuuggguaucuaaccaaagggaauuaaaauucaauaacgcaugaugcuaauuagacaguagugauuaauacauuauaauuuauuauguagcaaguaauauauuauuucacaucaauuugaugagauguuucaauuuaugaagaauucuuacgcaaaaaucaagcuuauuguaacuguccucugaaauugaucaauuuuugcuuuaaccauaauauuaaaugcauacuuaauaaauaagccucaaaaacacuacauaucagccagacacgaugguucacgccuguacuccuagugcuuugggaggcuaaggugggaggaucacuugaggcaaggaguucgagaccagccuggccaacauagggagaccauugucucuacaaaaaaauuuuuaaauagccaggugcaugguucacaccuguaguuccagcuacucaggaggcugaggugggaggaccacuugagcccaggagauggaggcugcagugagcuaugauugcacuacuccagccugggcaacagagcaagacccucucucuagguggggaaaaagguacauauccaguacauauccuuucacuuagaacuucuacuuccaggaaucuauucuuaguaaauaaucaugaguguguaccaagacuuagcaaucauauguucuuacagcaucguuuaugauagagaaaaauuggaagcaacuuaaauguccaucaaagagaacuugauaaguaggucuucacuaaguggaaugcuaugcagccauuuaaaaugaugaugucagagaguaugugacagcagugagcaaugaacaaguuucguuaggcuggaaagggcagguuucuaugcagcaauauguauuacgcuggcuuuuuaaaguacauauguguauguagaugugcuuaaacaacaggcuaaaagaacagacaucaaaauguuaauaaugcuuaacuauggauggccguaugauuguuuauuaauuuuauguucuuuuuccccucucuguauuuucuaaacuugcuucaaugagcauguauguuuuuaaauccuuuuuaaagaagaccauagagccaggugugguggcucacaccuguaaucucaacacuauaggaggcuaaggcaggaggaucacuugagcccacgaguucaaggcugcagugagcuaugaucacaccacugcaccccagccucagccacagagcgagacacuggcucaaaaaauaauaauaauaaauaaauaaauaaaaauaaagcaagccaucaaguguaagguuaagaaucagcacucccagcuauacucguguuucucccugcccccacccuggcgaguggcuuugucacuguggcaaccgagggucuucagaugacaugugcaucucccagggugacgugugguaugaaugggguuuucugacaaggaaccaugagauaugucuuacauugcugaugaagcccuaacccugggcuuauaaacggauuauuucuuucucauucuucuuaccaaguagacauguggcuacugcccagaagguuacccauuuaccuucuccagguuaccaugguccaugcguauucacagaugauccagaacucuccucuuugcucauuucuggcagaguccgucucagcugaugaguuaaaaugugacauuuccucccuccccccgccccaugcaugaugauuucuucuucaguuaugcucuuucccaaagacaucaaaacaagagugauuguuuagaaauuacccucguccuacauuugcucccaaucuguuugaucuuucccugauguuaucagugaugugcguuucucccggggugcuuacgccuuguauuugugucuuccuccgugcccagucccggcugacgagccagagcgaggccauggcccugcagucgauccggaacaugcgcgggaacucccacuguguggacugcgagacccagaguaagugugugcggugguagcaggggcuggcgcuguguagcuggagaccacauggucccacuaggcccggguugcaggggacucacaucuguccuguuuggcagauaagaguuaacugcuuuuaggaaauugagauauuuuguuuggauuuuaccuuaacagagugccuuccacacaagccucaccccuggcugcagggugcguuucugugagucuuuccuugccuuaggcauccgaugagcagcagucauaccugaggugcaaaggauucaaccccacacccacagccugugccaaaucuaggaagcccaggaauucaagacgagccugggcaacacagggagaacccgucucuacagaaaauuaaaaauuaacuaggcguggcagcuggcuuacuuuuugcuuaaucagugaucacuuguugauuuuuuuuuuuuuucauaaaaauagaauauaauugguucauuccugccuagagauucuuggguauuguuuuuuuaaauucacaaucauauguucuggguuuugccaucaaaugaugucuuguuuuuuuuuggucuuaaauccauuacccacuaaagccucugauugaacugauagaaguuguaauuacugcuuugugccaucgaguaccccaguuuuauuucaugauuuccguugucuaauccauacuauuacuuucccuuugaaaaagucauuuuguuguucauaaucuugagaguagggacuuauuuucaugguugcagucccagcccagagacaguauuggagacauucaguaaauuucuucccuucagauuuuuuuuguuaaguaguguuuugaagagaaggaaguucaguucaaacaagguaagaggugcugguaccaggcugggugcugcccaggagucaaacgugcauggcgugguggguccugccauccugaagccugaaaugcacuggacaaggcaccaaccugcugaccauggagcuaagcgcuggggagagccaucgggggcaugcggcggucuugccacccaugcaggagcugucgugucagcagggcucuggagaugggcaggguuuguacagggaaggggccgaaggaaucacugugagcaaagggaguggcuugaggagagcuucucugggugguuguaggauuagagaugcuuuuugggcuggaaaaccaguagaagcuaguuggagugugagugccaagugaaacuuuuuccagcuuuguucuucauuuguaagcagagagacaucauuggaguuuuagagcaggaaggagauggacccugagcuccacuuggggagauggaucuggccagaccauuuugaacauacuggaauagaggcaaagcagggaggaggccagccagggucggcuuggccgggaagggagacaggagcccaggacugcuccagacaaaagggaaaggaagcgcccccuccaagaguccacucagcagcauagcaggcaggggagagaucaaaagucugucugcggccucucuggaagccuguccugcgggugagggaagggguucuucuccagguaucuugagguucuucuuuaaaguaccuccuuauguuugaauguuuaaguuuuacuuucaaauguguggugaaaugaaguucgaagagagaagcaguuauuugaaguguguuucuaucaaaaaguuuuaaaaguaagagcuuuuuuaaaagcacgaaucugagaaauauuagaacauccauuaaggaaaaugccugcaguuguuuccaccgugcgucugaaggucgcuuuaaaaggaaagccauccguggcuugcggggaccaugauaccuggcaaaucggaggucgcagguccugucugagaugagcuugugcaugugagugcggauggggggugggaaagggaggccagugcaggggaggugugggccaguuuguucugagcaagaccaccugagcagauggacagggacaaagggaaaaggcagaguuugacaauucaggagaaagaggcgauaccaagcacgcauuugcuaaauguguggucugugucagcccggugccaaacccucccaugcgcugucuuuucauucugcaacccuaguaguuggugccccugugggccccacuuaaaggggaggaauugaggagccugaagggucaagucauuugucugaggucacagaaauagcaagucccaaagcaggauucaaacccaucuguuguccagccugcuguauuuucucaagaauggaaaggcucagaagauguagcacauuggcaaggauuuguuaaguaaaaauacccaauuuugguuaaaguaccgggauagguacagugcccacacugaugaugaacuguaaacaccuccauggggccuuucgacaauguauauaaaaagcuuuugaagaguggaugcccuugacuccagcuguauacuccaggaacuaaaccaaugggauugaguaaggcgggugcagagaucugucuuuccagauguucaucacagugcuuuacauggcaaaaaaucagaagcaucccaaaugucuaacaauugaagagcaguucauggugaugucuugucuuugcuaccuuuaaaaaucauggaaaaagacuuaauugagccugggcacgguggcucacgccuguaaucccagcacuuugggaggccaaggugggcggaucaccugaggucaggaguucgagaccagccuggccagcguggugaaaccccaucucuacuaaaaauacaaaaauuagccgggcaugguggcauaugccuguaaucccggcuacuugggaggcugaggcaggacuugaacucgagaggcggaguuugcagugagccaagaucacgucauugcacuccauccugggcgacagagugagauuucgucucaagggaaaaaaaaaaaguggggggggugcuuaauugagauaaagaaacuucauaauguguuguaaaaugaaaaagggguaugacaaugagucuagaugaaccuaacgaguauuuacagguauuuagaggggaaagaucuguaaggcugcacucuggaagguuagcaccaguugugucugagugguagggucuuuugaggcuuggggauuuucaugcagcguggaauuuggaauugugguaacagcucccugacccccaguucuugcagagaaugcucuagaccgccaggagcccccucugucugcucacugggcacaucccagagcacuguuuccagaguggacgcugagccucuggagcuuugggggugccugucuauaaagggauucugagagccagugaauuugggaaacucuuaacaacguccgacucccaggaaguugcagccuucggacaccugugcuuccggggaguacugcucugaagcuaccuguucagcauggcccaacccagcaugucccaggcccaucggacaguggggccuuuguuuagggugccuguugccugccuucugccaggaacaugccaaggaaaguccacaccugagggccccugagaauccuagggcuugggacccucaguggcucucaccagcaggucugaccuucauggacaggcccugagaggcagcucaccguuucugcugcuuucucucugcccauccaugucgcccaugaagcccugguuggagcugaccgugcgcuggucccucccacccugcugcguggaccucacaggugccccucucuccugggccuuucucaugucuagaauccugccuuauuucccuuugugaaccccaggccugcacacaagaggggacuggcacccaccacuaccaccagauagcucaccacaaccuacaguaggagcacauccaggcucucaucuuuagcuuggcccacaaauagaaccuccggucccgcaacgucgggucuccuucccauugucgccucuuaguccuucccugaccuccagguuugaaaucacacacacacacacacacacaucccuacucccugcuguucugcccugggggcuuccuggcucugguguauccuagaauuuucuuagcucuuuucugguuugggcgggggcaggggcggguugagauggggucucgcccuauagcccaggauggagugcagcagaaaggguaggcugccucucggggccuguccaugauugcagcagugcaaucauggcucacugcagccuugaacucuuaggcuccagcaauccucccaccucagacuccugagcagcugugacuacaugugcgugccaccacgccgaccugauuuuuuaaauuuuuuguagagagguagucucacuaugcugcccaggcuggucuuaaacuccuggccuucggcgauccucccccauugaccucccaaagugcugggauuauaggcaggagccacugugcugggccuaguuuuuuuuauuuuuuccugcuuggucuguccucauagaaucuacguccugcauuucugugggcagggauuuuucuccguuuuguucacugcuguauccccagaagccaguguguuaauauugguugaauacgugaaggaacagauguaauuacagccaacaccuaacacuguacuucccguggggcagucacugcucuaagugccucguagcuuuuaauccuucugacagccccuugaggaugggaauuauuagccucauuucucuggaggggagcugaggcccggagagcaagaggcuugcagaggacaaagguggaaaggcagugcuagcagguggcacgcacacaggugugagggccuggagagcaggcagggccgcccuggggcugugggaccagcggggccugaagccagguggaggggcaggagacagugcagaggucugaguccgugccaggaggcugggaucagccacaggccgagguucuccacccaggccgagacacagcgaagugucccaguugggccuuaaggcaucuuucaaggaaauugcaguggugaugcuuagauaccaacccuugccgaugagucauucucugcuggagcggaggcaagguucuccccucagucagccccagccuuaccugucucuaagcagaggguggugagcauggggcccuggaacacugugcccccgcccccugcaacauuuuggguuucagagaauucggaguccggcacaggaaugugucccacgcaugaaugucguccuucagaucuggaccugacagccugggagcugcuggggggagguaggagggggugcaccacggucugaacgaggggccagcaugaguggcuucuguaucugcaacccacagcggcauggagggcgguggggugggcauaggaaccaaaucggagguucugguaagagcuuaggcaaguggcuauggggauccagaugugaguggagacagugugucagagcacuccccacagcacucggugaugggcuggaugcugggacauaagggagcaggagaggugcuagguuuugagcgguggugugacaugaucagagaugccguguucaguggggcccuggcugcugugugaagaggucugcagggaagugacgggcaaggccgcagacaggagccccuugcaccccaguugcgaugcuggugaggacgcccaugggagcauaaguucgagaagaaagcguuggacuuaugagagguugagaaccuugugauuggcugugggaaugauggaagaauuaagguggaccccuggggucccagcuugaauagcugggacaggagggaccuggcagaagaaugcauuugcagaguggauguugacuaggagauucucccaacugaaauguacguggucguugcguauauaauaauucaggagccaggaagagguguuagugccugaguggugauugaaguguggguuggguuggccugaauaagacuacacagucagaagagaugaccccacaggagcccugaggucagggaggaagagcugggaaagagaucacaacggagcaaccaggaaaguggggaaaaaauccagagaggucguugaccaaaaagguaucagaaguuagcacuggcccagcacaguggcucaugccuguaaucccaacacuuugggaggcccaggcaggaggauugcuugagcccagugguugaagccugggcaacauagcaagaccccaucugugcaaaaaauguaagaaguuagccaggcauggugaugugcaccuguagucccagcuacucgagaagcugaggcaggaggaucacuggagccuaggaguuugaggcugcagugagcagugauugugccaccacaagagacccuaucucaaaaaaagaguaguacucaguguugugaggagggguggggcaguggccagcccacaagaggccgagugaaacguuggccacaggggucuuuuggguuucgcccuggaacaggcuagugacuuugguugugcugcguccauggucaggagguagaggccugguugucagugauccggaggugcagaagcagagggagccaguggggaggugggcugugcagacacaaagggagaggcacaggcgaggagggguccacgccagcugugugccaugccuccacccuccacagccccaggccagggccuccucuguguccccgcugcccucuuccuucucgugccaccugugcauugguucugacugcgcuuuucagcguugagucucugcauuucucuguucucuucugcuuggguuuuuuucauuugaugcauagguuuccccuucccagucagaaccucucugaggucacagaccucucuucucacauuucuuuuuuuuuuuuuuuuuuuuuugaggagucucguucugucacccaggcuggagugcaguggcaggaucuccacucacugcaaccucugccuccugaguucaagcgauucuccagccucagccucucaaggagcugggauuacaggugcccuccaccauacccaacuaauuuuuuuguaauguuaguagagacaggguuucaccauguuggucaugcuggucucgaacuccugaccucaggugauccucccaucucggccucccaaagugcugggauuacaggcaugagccaccaccgcacccagccucuucucacauuucuugugguaucuaucacugccuucuugcauauguaguagauguuaaauaaaggacuggcuuucugauuucugaucaacuggcguaaggcuauugcugguuacuugccauuuauaaaacaaaggaugucuccccagugagucaaaugugaccuaagcuacuuggucuuuuguugacucuucagguguguccagaguaagcauugccuauucccaggugaguaagccguauuuacuuaacaguggugaaagccagugacuaucaaggucaacccuaucucugcacaucagcuguagauucuagcgugaagucaacccgggccugaguucuuggucuucugaugaugccagccaguuucacgcagugagugcuccaguucuggggucccagugcugcugucugaauccauuucuuguccugcacaauccuugcacuaguccuuggucuaguuucacagcccaaagccugucaccauucauucugcaagucagcguugguugcgcugcgugauaaccucaccaaagggcccugcccaccaacuugccugcagugcaguugcuucaguagcuauaguuaaauaagaucacugaaaacgauauuucuucacuguaguguaccucucucucaucuuugaaauuugcaagcaugcccguuguguaccuacuggaaacuuugaugugccaguggcugcagagguagcaaugaaggaaugaccagagucacggugucacccagcugccccucagcaccacuucuccuucccucucagcagcagcuguccacaguggaugccgagucacacgugcuuuuucccacacaggucagcccucucaaggugaaugcugcugugacauaugggaaagugcaucuuuucuauccaaaccaacgcugucaauuauuuauugugcgggaaauuccaaggcuuuggcuucagccaaauguguucugaagcuacuaccaacggccagucauuugggacaccugaaacaggacugagcacuggcuagggagcauuuuuucucgccauggaugugguucugucguugugaaguuugacugauucgucgccuuguguuucuaagaacgguuggaaugaugcaugauggucugauugcguuuagcguucuguuccucuucccguagaucccaacugggccaguuugaacuugggagcccucaugugcaucgaaugcucagggauccaccggaaucuuggcacccaccuuucccgaguccgaucucuggaccuggaugacuggccagucgagcucaucaaggugaugucauccaucgggaacgagcuagccaacagcgucugggaagagagcagccaggggcggacgaaaccaucgguagacuccacaagguaggaacuuuggaagaugccuggcucccgacacguuugccaacaguuaggcaacuggaagugaucauaaugacagccacgguugggaaggcccugauaaccuguaggaauucgggaauuccgauucauccggcauaggaaugucuguguuuaaaguuggucuugagcagacguggauaauucacacuccuuaauuuuuuauguuuguuuuuaggccuggggauuucucuccccccucuuagaaauguauuaagcuucuaaccuuaugaauauauuacuuuaauuaauacauuucuaauaggcauaagcugugccguuaacacuaauuaugaauuuuugauccuuuaauuuuguuauucuuauagcuuggauaagcaucugcucugucgaucccccccccgcaccaucacacaaaaguuauuuuuaugguaacaaaaucuauuuuauuuucuaaaauauaucucaacacauuuagucaaccaaguucagcauaauguaugauguaacuccucauuaauguuaauuguuauccaguguaaaaaacgcauuuauuuugaggccauuuaguuucucauuuuucauuuacagcuauuauaaacuguuuuugaguacacaugcauauuuaauguuccuaaggggugauaaaauggagugucuucugagaaggcguauggcauggaggcagaauagagcauuucaucuccguacuugucuaaagcaaguggcuuccaggguugcucauuuucacccacaauaggaagugggagguugagguuugcuguccguguuugccucucaggugucugaagagaugaagggagaggagaggucucccaucacugguacuuuuuagguuccucugauuuguuuugcugcugaucagauaaaaugaaaguucaagugguaaucugugguuacgccacagaaaccgguuucuacugcagagcaguaagaacgugagaagcguucguggacuucaguucauuaacacugaaaaaugaauuuguggugccaccuuuggcucacuggagagaaugaagcugguguguuacucaucuggcucuccguaugagggauucuuugguaguggggaggacaggaaaggugcaaagaacauauuuguuuaaaauugcaugguuuugauacgcgaccucuuuaugaguuaugcucuauaguguagacagggguaaguuucuuacaaaccgaagaaauuaugcacuuuaaaaaguauuuaucuugauuuguuuaaugcuaccauagaaaucagcugggucaucaacugugaacaagcuuaaaagaugaauucauguuuuaauaucuauuuuuucacagauaaugauaacauuggaggaaacuugggucugaaaaugaaaaaugauuggaaauuagauugagcuuaauauaugaaugcagaaaacauugaaauaagcuggaaaaaucuaugcaucuuacuguuuauauguaaaagaagcacauucacuauuuuuaauaucaugaauuauuagaaaaguuuguuuauccauccauuaaaauuuagaaaccauuuggaauuauucgaagcaaagauacggguucauguuuuaccugauaaauguuuuauaauuucaucuucauucauaaaugaagauugugugugcacagguauuuuguaguucuaauuugcauccuugaauuaaguucuugagugcagagcccugucuuuuuuccaguguuacauacaucacaucauuauauuuuagagaccuauugcagagacuugcuuacucccaagugcagugguugcaguuaagucccaucuuuucuuuagucacacuggcuuuccuaaagagcaggccgaguuguaauuccucuccaagacugugguguuggugaugugguucugugcuguugcugaagguaacuguggaauuucuaaguucccuuugcaccuaagaagauaaacacauacgagaacugaauauuucuuugugccuguaguaauuuuccuggggaguuuuguuuucagugaaaaucagcaaauaaucauugcacacuuucucguagaaaagcaacggugagugaugauugcaguucccuggugauuggugaaggcucucagggcugccugaggaugccagggcucgggagggugcauucugggaggugucacuggagaaauggcaucugagcuggacucugaaauagggggugauucccagggccagggccaggggaccaggugggaaggcgggcuggagggugggaguggccucgguggaugcaggcucggccgggccuguggggaggugugccugucggcgaguacagcaccguggacgggagccucccaugaaugaggaggagcaggaaugggggaggcccaaagagcagaagcaggaagggccucugagccagggcuggcaccuuaaaagcgacccugggggcaggggagaggggaaggguuugucuauucauggguucugucugucccaccuguucccaagaggacuaaaggcagccagcaaggucugugucccuucccgcuggaaggccaggguccugguggagcaugcgggaagccuuaacuacacuguccaaagcaaaacacacccagcccgauaacagaguagaaauucagacucccaccaccuucaccaccuccugcacguccccucaauagaaaauggaaaagugaaagucggggcuggaaucuccgcaagccggucuguccaugacgugagaagauucugccuuucgaagccacccccgcucccucugccccacuccgccccuccuggucucucugcagaaccuacgauuguuaguagaaacagcuggaagguucuuuuaauguggcccugagguaauaccaaaaagaaauauuuuaauaaauuuuucucucuaucaaaggaaaagccaagugcaauauauuugguguaauucuuugaaaaagggcccagcuguuuucccaaggagcucugguccauuccaucuugugcagaagauucauucugacaguggaauauaauuagaaaugcgucguucagccugcccccacccccaaacacacaaacacacacagauucaagaccauggggaaguagaacacagcagaucuuccuccaaagagaccgccgcacacuggagucaccuauucgugcggccaguuaggacagcaggcgcccuggacagccggccucugcugugucccugcaccccugauuagggcagcuucggacggcuuauaauugguuccaguuaaucucugccgcccugagaacugccguucaaacuugagcagcaucaugaucaauggaagcugacggcggcugaagcaguauugacuucccauuccuaaacaggggaaucauuagucaagaaaagcaucuuuuaauuacucccaggaagaaaaaaaaaaucuuuuuggauggauucugcaacaacugccauuuuuucccagugcauucgauauuaaauuuauugucgcaggaggggagaggaugcccuuugucccccucuguaauggggguuuaauuuggaaaaagaagcacguuagaaaacagagcaaugcuacaacaauuaacuacaucugggguagcaucagaauuccccucucuaauugcuauugauaccauuuaagcacacacuuaaaauaucgauuuuaaguggggauguugaagugguggugaaguaguaacaguggacagaacuaacuagguuuuagggguuuaagaagggagccgucagcuguguguaggacaggacuucguaacacccggcuugugcgugugugcgguaccauaacguagcguguuguagggcgucgagcagcugggccgggggccaccagccaggcggggcucuggguuccaguguuagagguacaugguguuacuguaaggagaaguugccaagcuccuuggugacccuuucaaaggcaagaguaauaagcucagaggugaagauguuaaaacagucgugcgaacgucuccugcaugaaugaaugauugaacgaguaaaugagugaaagcgggaacucgucaucauggaacacaugucaggugcucuugcuacuucggggccuuggaauuccucaugugagugaaaccggggcuuugacguuugcagcaccagcaaagccgucucaguaaacccguccacgcacauccucucucccucgcgguacagcaguguuuccggggcugcacggcagcgcccuggcccguuguucuuuauuguuguccccauugcacuuaaaaacauuugggauuggcugcagugcaagugauuuccuagcaggacggagcagagcccucuggcgccacauuccucuuggcagaagccucgcucugcguggcacugcaucuccccaucuuuguguccuggugucaaagcauuuggcccccaaggcccugcagggacucgcugcuauuugcauuucagugcagguagccuguuuacuuggcggcuuaggagccugcugauuugggccaggaaaucaaaggaaccuggaaguggagaauaguguuuucaauuccgugaaagagcucuugagaggcgcuuuaagcgcaacugaaaucacccauuaccucuuugaugccacuuggaagggaaccgaguuugcugauuuaguacguauucuuuucccuuuuuuagcauccuuuuucuuuuucuuccccccauuauuuguaaguucaccucugugccuaaacucccuucuugucuuuaaccuauaaaaagaugucgccuucgauaggaagauuuggggccagacaucagaaauccacgugggagagacuggccguacacuuccagauggaacaagucugcccagugaugugaguuccaucucuuuuugauucuggaacuccacuuucaucuuauuuaugcacauggagauauugauaaaggggaaauguauccaaacugaaaauaauuggaucccuacagcuaacucugagauauuaaaagcaguaccacuuggcugugucuuugucuuguuagguuugaucauaagaucacaauguaguaaucucgggcucaaauuucuggcauaaagaugcacuguuccaaauguggccucagggaacacgacugcccacacagccccaggauugucucaucuuauuauuuuucaacaguucuuggccugcugaggucaauguuuugucucuuuugaguguuccucuaugcuugacaccuuuuccuauuuucuuucuuaaaaaaaaaaaaaaaaaaagggagggggagaaaggagaaaaaaaauaaaaaaaggacuuugccgcgaugaccagaguccaucugcaguuggguggcaucugcuccccacaugucacuuuccucauuaacaagcaauugaauuaauuaaaugcuacucagaacacgcauaacaagcuaccggcaguguccaaauuagcacugauaaucaaggaugauuuccuuuauuauccugcuaaguggugugcagacucugaucucccugucugcccucaucuauuuacauacccccagcuccugccuuuggaagcggagguuaucuuaccuaguuaauuugccacgaucaccgagcauggcggauugaugcccugccccugccgccacugccgggcccgggcccccuccccggcugcccucccccagccccagccuuuguaucucaagcucacugauaaauuaaaggccaccccuguggucucucaagugaguaauagaggcagaaauuucauuuugcaacuggcugauuuaaugauccaaaggguaauuaauggccugauuaucuuaauguuaaauauguccggcagcaauuacugugaccucccgcuugucaagguccgggcugugcucuucuuucaauuaaguucucuggggcuuaaugguaugaauaaacuccucugauucuaucaucccggaugcagaggguucagggagcugggggcucguuuggaguuuuaaucagccugucuucuacuccggcgaucagaguuaacaauuauagcaaggacaguuuaacuuucuucuucgccgugcagaccccccuacauguacacacaugcacacuuuuguguguggcuuuaugugccuuguuuucauguguuucuuucagugcucucagggagaauucuguuuguggaggaagcugcugugcucugugagccucgucucuuccaauauaaauuaucaugugaacgcugugguuuuucuauuugacaggcuuaauuaauuggcaggagcccccgaaaaugacaguaccacuaauugcaacucaaagugaauuucugucaccgcggcgugcuugucagugggccugcccuggccccagccgcagagcggguccacccucccaguuuccccguccaggcagggacugugcccugcucaagccacgacaguggcagccuucuccgaggagccguggguuugcaggcacaccgucugcuggcaggagugacauuuacuaccaauaaaguuuauacauccucggcuaugcaaacgcaacagcugcucagggaccucagcccuuacuuaagauauuuuagcaacuucucuuagcaagccaacuuggaaucagacugagagaaccauaacucacuuagccacccuucaugacuggaugguccucauuagcacacugcuaaauaugcuucaguuuacuagagcucagggcccggaucagaaauauucugcuauaaauauuaagccaauuaggaaaauguacaaaugagaaguacguuaacacugccuuuaaaauaauaccuacagauuacaguugacaacagauagagcaaugcaucuagugaaccuccaccagggagcuuggugggaauccaggcaagcucuccauaaagacuggcucuaauuauaagaaaggugauucuaagaagauucuccaugagguuaaguauaaugggaucugcuuuuucaaggauaacuauacuugcauuugccuuugaaccagacagacagaauggugcucucgguuuaucaugccgccugccacacaggaaccccaguuauuuguuugauccugcaagaaaccagugugugcuuggagccggcuuugcuaccgcagagcugucuaggguugaaaauccuuaucauuuacguucugaaauacggccgucgugacaauuaaggaguuucugaugcuuaagaauuuuuacugccccuggcagaugagaaggcaagucaucagcaggcagcaacuggcuuccaggugcccugaccacguucaagccugugucuacuugugggaguguaugaaggaauggaaugggaagauuaaccuuuuuaggcuugaauuauauaacaugggccaauaaauauggccucuauuuugauuccuccagcagucaagcauuuuccaaagggcccugucuuucagucguguuuugcuuauuuugcaccagagacucucugucuucuagugaacuuuucucuuucuucuucuuaaugaagaggagggagacaaaaacauggccggagcacacagcgcccugugugcuuggauuauccccauucccagacgugugccagggucacaugggagcgcaggucagacugcaggcaccaagaucugacuccagaugccgcucugcaguccugcugcugcuccuguuccuuuucugccaaauccacgucaguagcggcauugggagaaccgccauguuuagcagcaccacucccacucgccccuggucaguuucuaucucaguagccaucgugugucaaacuuacuaaaugaguagugcaaacauauuauguaacuacagugucuuuccacuucacagcagcuucacuuauaguaauauaaguaaucauaaagccucuuccauuuuaguuuacauucauuuagcugaccugacuuuuuugguggcgucucucucugucgcccaggcuagagugcaguggugcaaucucggcucacugcaaccucugucuccuagguucaagugauucuccuaccucaaccucccagguaucugggauuacaggcacgugccaacacacccaauuaauuuuuguauuuuuaguagagacaggguuucaacguguuagccaggcuggucucaaacuccugaccucaggugauuugccugccuuggccccccaaagugcugggauuacaggcaugagccacugugccuggccaaaacucgaccuuacaagucacacagccaugauucuaaagucuuaauucucuuccaucagugcuaauccuaagagcuuccacagaaaacagcacugagaacuguaaaauguugagauccacccacacaagugcaggguuagagccccccccucaacccccguguuucacguaaccacauccugcucaugucccugacccaacacugcguuuugggaauauaaagccuguauugcagagaccucacaaucauauuuauuaucugcaugguacaauauggagccaugucucaggccauagaguuccugguucugguuucauggccagcaucuucugccauuuuaauuuuaaaaacaggguaauuccucauuucuaagaagagacuagucauuuuuccacccacuuaauuauguagaguuagugcuaaaagaaaauaauauuuaugaaguuuccugggcuuccuuuuuauccagaagauacaaucagcuuugaggccugggucaugcauacuagcagugagagggacaggugguccaugcccuccccggggguuguggagggccugcugauauagaagauguggcccauguuuauuuugcuuuguauguauauaaugguuuauugcagcaucaguaucacauggaaagguauauucuugagccccacccaagccuacccagucagcaucccuaggggguaggguccagugguguguuuuaacucucuagguaauucuuaugcacauuaaaguuugagacacucuggucugcacuaaguaguaaaaauaaaaguccacaaucuugccugugaacucacuguguuaauccaagucccuggacuucauuccucacuucuuuagacccaggucuucuguuuucuuccuuuaccagacuguugucuggcuuagcauauccaguauaucccagcagauguuacagccagagagcaucuacaagaggauuagacucugugaucagguggcacugaaugcaaggaaggcaagguugguucgacacgcaaaaaucaaucaaugugauauaccacauuaauacaguaaagagagaagaaaacauaaucuuuucaagggauacagaaaauacauuugacaaaaccacgugcccuuucaugguaacaaacacucagcaaacuagaaauaaaaggaaacuugcugaaccugauaaaggacaucucuaaaaaacccacagcuaacauuguacuuuauggugaaauacugcaggcuuuuccccuaagaucacaaacaagacaagaaugucaccagaucuguucagcauuauacuggagguucaagccagggaauuaggcaagaagaagaaaccaaaagcauccagauuugaaaagaaguaaaacuaccuccauuuccagaugacauaaucuuuuauguggaaaauccuaaggaacccauaagaaacauguuaagcaaaauugaaggauacaagaucaaugugcaaaacucuuagcuggccaugguggcacaguucuguagucccagcuacucaagaggcucaggcaggaggauugcuugagcccaggauuucaaggcugcagugggccacaaucgcaccaccacuuuccagccuggggaacagagcaagacucugacucuuaaaaaaucaaaaaggccaggugcaguggcucauaccuuaaaucccaauguuuugggaggcugaggcuggaggauuacuugaagcuaggaguucaagaccagccugggcaaaauaacaagaccguaucuuuaaaaaaaaaaaaaauucuauuguauuucuuucuguacacuagcaguggacaaucaaaauaaaauuaaggacaguuccauuuacaaauagcaucaaaaagaguaauauacuuagaaauaaauuaccuguacacugaaaacuacaaagcaucaucgaaagaaauuaaagaagaccuaaguaaaugaaaagacaucauguucacggauuggaauauggcaguacucuucaaaucgauguacagagucggcaaaaucacuuucagaaucucagcugccuguuuuuuucccagaaauuugacagcuaauccuaaaauucauauggcacaguaagagaccgucaaauaucaaaacggucuugaaaaaagaaugaagaaguuggagaucucacacuuucugauuucagaauuuacugcaaaagcauggugauccaagccugugugauauugguguaaaaauagacacacacgucaaugaagcggaaucgagaguccagaaaugagccccuucaucggugggcaguugauuuccaaaaaagaugccaagacaucuuccccaucaauggggaaggaauagucuuuuuaggaaguggugcugggacaacuggauauccacuugugaaagaaugaaguuagacucuuaucuaaugcuauauauaaaaauuaacuccaacaccuguaauccuagcacuuugggaggcugaggcggguggacacuugaggucaggaguucaagaccagccuggccaacauggugaaaccccgucucuccuaaaaauagaaaaauuagcugggcaugguggcaugcaccuguaacgccagcuacuugggaggcugagguagaauaaucacuugaacccaagaguuggagguugcagugagccgagaucgcaccacugcacuccagccugggugacagagcaagacuucgucucaaaacacacacacacacacaaauuaauuccagauugaucaaagccuugagugcaaaaacugaaacuauaaaacuuuuagaagaaaauacgggguaaaucuuugugacuuuagauuaggcagugguuucuuagauaugauaccuaaagugcaagcaauaaaagaaaaaauagauaaauugaauauuagccaaauuaaaaauuuuagugcuucaaagggcagugucagaaaaguaaaaaugcacagaaugggugaaaacauuugaaaauuaaauauccaguagggaucugguauccagaauauauaaagaacgguuacaggugggcaugauggcucaugccuguaacccuagcacuuugggaggccaaggugggaggaucacuggagcccaggaguuugacaccagucuggacagcauagggauaccccaucucuauaaaaaauaaaaaacauuagccagguauggugacgugcaccuguggucauagguaagcuacucaggcggcugaggcaggaggauugcuugagccuaggaggucaaggcugcagugagccgugaucgcaccacugcacuccagccugggccgcagagugagaccccaucucaaaaaaauaaaaauuuaaauuaaaaaaaagaauacuuaaaacucaacaauagaagguagauuguccaauuuaaacaugggcaaagagcugggcauggaggcucaugcccguaaucccagcauguggggaggcugaggcaggaggaucacuugaggccagcaucucaagaccugccugaucaacauagugagaccccaccucuacaaaaacuuuuaaaaauuagcugggcacaguggggcacaccuguagucccagcuaccugggaggcugaggugggaggaccucuugagcccaggaguuugagguugcagugagccguuaucacgucacuccacucuagccuggauaacagaacaagaccucgucugaaaaauaaaauaaguaaaaaauaaaaaugggcuaagacucuaaauagacauuucuccagaaaauauaaaaauggccaguaaauacaugaaaagaugccuaaugucauuacuuuuuagggaaaugcagaucacccuugagcccccaccgcacgugcucuuggacggucguggcaaguguuggugaggaacguggagacacuggugcagccacuugggaagauagucuggcacuuccucgaaaaguuaaaccuagaguuaccguaugacccagccauuccucccccaggucuauaccuaagauaaaugaaaacacuuguccacacaaaaauguacaccugaguguucacagcaacaucauucauaauagccaaaaagugaaaguaacccaggugucccucuguggaugaaugggugaacaaaacauggucuguccguacaccagaacgugauucugccaugggaaggagugaaguguggauacagguuguaacgugggugaaccucgaagacaugaugcuaaaggaaaggaagcaggcacagaaggccacaccguguaccauuccaucugucugauggcgaaaacaggcaccuccauaguaaugcaaaguagauuccugcuugccaggugcaggggagggaggggcaguggcguauacggagugauugccuaaugaguacgaaacuucuuuuggagacaacgaaaaugaucuggauuuacauaguagugaugguuguacauccuugcaaauauacuaaaaaccacugaguuguacacuuuuaaagugugaauuuuaugguauauaaauuaugucaauuuugaaaaaaaaaaaaaaggaauuuccaaaggaaaacagaugagccagggcguuccacaaagagcagcuggagcaaaggugcaggcguacaggaacgcaugcuggguggcgggggccugggugcgggccgagggcuggcguggcugccccuccucaggccuggggaguagagcucugagcaggaugugcacugcagccaaauuccugcccugcggacggcccacaggggagcgagagcagguggaagguggugccuauguccaggggagcaagugagccugaaucagcgaucaucaccaccagauacugggagucccugggagagaucaggcacuugacaagcccugccucuuggaauccgcacagcaaaccaaugccauucuuuccuuuuccugggcuaggaaacucaggccugugucucccugagccugugaaugcaggacgggccagaacccaccccagaucugaccucccuagaggaagccauggccagaggggaggggagggaggcagagccaggcugguaugggauucuaggagcauacucaggacucguauuuuguuguuguuguuguuguuguuguuacuuuucauuuauuuucauguauuuuuuuuagaaacagaaucucacucuaucacacaggcuugaaugcaguggcaugaucauagcuuacugcaaccccagacucccaggcucaagcaauccuaccuagucagccucccaaguagcugggacuacagccacaugccuccacacucagcuauuuuguuuguuuguuuguuuguuuuuguuuguuuguuugagauggaaucucacucugucacccaggcuggagugcaguggagcaaucuuggcucacugcaaccuccaccuccuggguucaagcaaauucucugccucagccucccaaguagcugggauuacaggcucccgccaccuuacccagcuaauguuuguauuuuuaguagagaugggguuucaccaucuuggccaggcuggucuugaacuccugaccucaugauccacccaccuuggccucccagagugcugggauuacaaguaugagccaccgugccuggccaucagcuauuuuuuuaagagaugggggucucacuauguugcccaggcagggauccuggccuccagugauccuccugccuuggccucccaaagcgcugggauuacaggggugaggcacugcgccccgcuguacucaggacuuuuauuuuuuuugagccagagucuugcucuuuugcccaggcuacagugcaguggcacaaucucagcucacugcaaccuccaccucccagguucaagugauucuccugccucagccucccaccugggauuacagguacccgccaccauuaauggcuaauuuuuguauauuuaguagagacgggguuucaccauguuggccaagcuggucuugaacuucugacccccaagugauccacuggccucgaccucccaaagugcugggauuacaggcaugagccaccaggaaugguggcucuuaaccaaagugaauguggggugugggaaagacaagcauccauguugauguuuaguuuucuuucuugggccauugggaggaugaugaggccuuuaaacaacaagcaaaacacacaaaagguaauuccaguuguaaaaucuugacgagauuauuuucauguuaagaaagguaaaaguugcacacauuugugcuggugauuucgacaagauuaauugauugauuucuaggcuggccacccaguguagcagaggcccagccucaccuuugcagucuuggcuuugugacugggucacugggcuuuagaggcaaacuguccgaggccagugggacaaagcaagccacuccuggcugcagagaucugacuucacagaauuacuugaggcccagaaagggagaacagcagugacaauaccauuaaagcuucaaauaauuaaaugucauuuauaacugauacaaaauuucaucaaccaggggucuggaagaugaacauuaucuggagcacacaucacucaauuuuagggacccacucauauaaaaagcaucucugauguacgugaucuaauacaaaugacccuggaggauacauacauaaucaugaugacuuaccuauaagucucuccucaaggaccucgaagagcugccacaaugucuucaugcugauccuugccaucuuaaugaaauuaggagauaacuguuuaaaaucagagaagaugacacccagacaggaaaagugacuugccuauaauuaacccagugacuuggaccaagccagaauuagccugugaaccugucacccagagacuccugagagaagccaacagcguggcuuaggagcauggaguuauggcugcaaaugccucuaguagcuuucagccucaaaugcuaaagcccaggacacuccuacacgugaaaauuugcucugccguggcucgcgccuguaaucccagcacuuuggggaggccgagguggguggaucacuugagguugggaguuugagaccugccuggccaacauguugaaauccugucuguacuaaaaaaaaaauacaaaaauuggccaggcauaguggcacacaucuguaaucccagcuacucaggaggcugaggcaggagacucacuugaacucgggaggcggagguugcagugagcugagaucgugccacugcacugcauucuggacaacagagcgggacuccgucuuaaaacuaaauaaauaacaaaaugccaguagcacuccugcugaggagcauggaaagagcccuccaaaaauuaaacccacacugcugcagagggacccaggaucagcucccaccagcugauugcugguauccuuuaaacagcacgugaaaagaccuggaagagccucgcacccuuccucggagaauucuuuggggguguggaaggaaugaacugagaaagaggaauauguuuucauucuaaauugccaaacuauaccuuucuaaacacauaaaaugaaaacaagaauaaucaccuguucuguaauauuccagaggagccauaguagauacucaauaaauauuugagagauuguguuacuuuuucauuguuuucuuuccaaaaacuaaaguuagggucaugauauaugacugauaaaaaaaggaaguggaaguaaguggccaggcaaaggcuccauggagcaucagccugacugauacugcuggagaggugaggcagauacagacagacagcagcuuaucggaggccggaaggcuuacgugcugccuucaucacgggcuucgucaaaaccucuggguuucaacacagcauuggaaaaggcucuguuccugacguucccacuugugguuuugaaauugccaagccaagggaaguucaauaacuuauucgcacacaggggcacguccauuggcuuugaguuaggagugucggugguggugucuucagcuccucgggccccuauuguugcugccugcuugugacucugcauucgacuggaugcauuuuauuucugaaauacacucgccccgugggcgguuuucaucuggcugugaagcagccaucaaagaaagcuccccuaaauguucuguucgcaggcagccuagaaaccuuuucugacauguugcuaacacuccaucaggcucucucuggaauaggaacaguguucggccagccuguggacaguugggugauuaucgaaagggaggcccacaggggcugcagagcuuagaaaaaggaacgcuuuuaaaugugcauauuuacaacaaaauccugcuuccuaaggcaagcgaguggggucccauuguugccggaacacaucaucuccaucauccuuuuaaaaauggggcucuucugacagcugccuccugcuggguuguggagcucuguggcacccaguugggcuucagggcaaaugaagccuuaggacccaccaucuagcacugcuuucagcaaagccuuccagaguccuuccuucuguccagcagcuuccuuaucagaugggaaaauccuugcaucauuaaacgugacaagucacugugcuuguccccagcuguugugcugagauucuagggaguagcugucugauggccaggguggcacuguggucggcaugugucagcaacaucagagucacuacucguggcccucagugggaugugcccucaguaauggcuugcccauguguccugaaaacccuucuuccauugcuugucccacuagggccacccugcccaagcucuggaggggacacucacugugcaaauccguuuacugacacaugggccucaggaagcccugauuugcaggcugcagugaaugcacaaauuacuagaauuuugguuuuuguuuuuuauuguuuuuguuuuuguuuuuugagacagagucucacucugucgcccuagcuggugcaguggcacaaucucaguucacugcaaccucugccuccuggacucaagugauucuccugccucagccuccugaguaguugggacuacagacaccugccaccacgcccaguucauuuucguauuuuuaguagagaugggguuucgccauguuggccagacuggugucaaauuccugagcucaauugauccacccgcgucggccucccaaagugcugggauuacaggcgcgggacacugugcccagccaaauuacuagaauuuugaauaccucauucuuaaggucccaguaucaugccauucuuuugagauuguugagauaaaucaugaacucuuaaaaugguuggauuauccagagcaagugguauauuauucuuuuagcuuuuuaaaaaauuuauauugggguauaauuugcauacugcauuacacacauuuugaguauacaaucaauucaguugguuuugauaacugcauaggucuaucaauaauauuccuaucaccccaggaacuuccccuguccccccuccuguuuauucucccuguucagaagcagccaugaaucugacaucugucaggauagguuaguuuugccucuuagaaaauucauggaaauggaauuauaugguauauacguuuuugugccuggcuacuaucacucaaaaauguaauugaaaagaauuguuuaucuaccaaugauacauuuuccccauguaagggaauaucugaaaaugucuucuucaccaaccaauuuuuuuuuuuuuuaucacugagaccuaagaguuuacuguaagucagauguacucuguguagaucugcuucuggaguugggguucagaguuccaacucaggucagacuggcagcauccaaccuggucuuuaccacuggcuugcugugugacccgggcuggauguucacccucacugugccucaguuucccauucugccaagugagggguaaguguaguaccugccucaucaggaugauuucaagaauuaaaugaacaauauauauaacacaaugcugaacaccuaaucuucucaauagagggcuaaguucuaaauagaagucaucuauuaguuuuuuuaaggaaaaaucacuacgcuuuuaaaggagaaaaacuuguaagagugagacacucugagcaaguucagaaacaucguuaaaaauuauaaugaaaaauacuaugucuaccugucauauuugcuauaaugcuaaaucaggugggcaggacaagucuucaguaucuacagaaaugccuaguauugagcuagcccauuugagaaaguaaagauguuucuggaaagacaaucugauuauuuucuuaggaaguagugugaaauaaucuauguuacuaugcgcuagaugauguggccaagacugggaguaacacguauuggaagaagagaaugggguccugucuuuucucuguucuggggaagaaaccucaucucuuaacagacguuccgcacauccuuuccaguaugccguguucacgugaggugagacgaggaagagcgaguguuuuucacaagagucucauggaauccaaagaguaaugaccguuccuggauguuuugcaucauguuccaaaucauagccaccgggcugucagggucagccauccguccugugcuaucucaucuggcaaagagaaggacauguuguguauguuccuguaagacagaguggcucuuacuaaaaucaaauaauuggcugggugugguggcucacaccuguaaucccagcacuuugggaagccaaggcaggcagauugccugaagucagaaguuugagaccagcccggccaacauggugaaaccccaucucugcuaaaaauacgaaauuuagcugggcguuguggcaugugccuguaaucccagcuacucggaggcugaggcaggagaauugcuugaauccaggaggcagagguuguagugagccaagaucacgccacuacacuccagccugggcaacagagcaagacuccaucucaaaaaaacaaaaaaucaaauagcuagcgcagaucacugugaaacaucugaugguaaaaaacaaaggucguuuuguuccauaauauaauaacccuuccuguuggccaacucccucuccucuccucuggcacugcugguaagagugaaaguuggggaaaccuuccuggaaggaacuuggcaauaugugucaauagccuuuaaaaugauaugcuuuuugaccuagcaguucuucucuuaacauuuauccuaggccgggcgcgguggcucacgccuguaaucccagcacuuucggaggccgaggcgggcggaucacgaggucaggagaucgagaccauccuggcuaacacggugaaaccccgucucuacuaaaaauacaaaaaauuagccgggcgugguggcgggcgccuguagucccagcuacucaggaggcugaggcaggagaauggcgugaacccgagaggcagagcuugcagugagccaagaucgcgccacugcacuccagccugggcgacagcgagacuccgucucaaaaaaaaaaaaaaaaaaaaaaaauuuauccuaaaaacugaaggauguaggcuaggcauggugguucacgccuguaauccuagcacuuugggaggccaaggcaggcggaucaugaggucaggagaucgagaccauccuggucaacauggugaaaccccgucucuacuaaaaauacaaaaauuagcugggcaugguggugcaugccuguaauccaaacugcucgggaggcugaggcagaagaaucacuugaacccgcgaggugaagguugcagugagccgagaucacgcuagugcgcuccagccugggcaacagcgugagacuccaucuuaaaaaaaaaaaaagaaagaaauuuuaaauaaagcaaaaauucaaaauaggcaauuaaauaaauuauuacuuuaguaugcaaguaaugcauauaguuacauuauauaaaauacaugauuuugucguguacacgugacaaugcaauguaaauauacauacguuaugauguauaauugaauauauaucauaaaaucuuacauuucauauaauguaaugaauuauauauaauguauaaauuuuacaugguaaguauaugcauuauuuauacauaugagcauagcacaugauauaaacagugcaacuuuguuuuucuuucgauacagaggcucccucugucacccagucuggagugcaguggcacaaccucggcucacugcaaccucugccucccagguucaagugauucuccugccucagccucccaaauagcugggauuacaggcacacgccaccacgccuggcuaacuuuuguauuuuuaguagagacgggguuucaccauguuggccaggcuggucuugaacgccugaccucaagugaucugcccaccucagccucccaaagugcugggauuaccggagugagccacugcaccuggaaaugugaugaugcaggugaaaaugugauuacauggggagauaguuaugguauucuguuaaaauauuguguaccccaaauuguuaauugugacacuuucucuaggggauaggguucugauuuauucuuauuuauugcuuaucuuuauuuucuaauuuucugccauuuuaaaaauuugguuagauuuuuaauaagcuaucuaugacaucagagccguagagggccgggaaugugucauugacaugaauggcauggcuugccuuucacccagugugacagugguggcugacgccacccaagggcacacugguccacugucaguggcgccuagagcccuggcaucugcuggcuguggcgcuguaugagagcauucguguuaggaguaccacuggggugugacccccacauugcucccgaaagcugugcagccaugacccgcacccuccccagacucaguuuccuccucuggaaguggaccugcuaguucuccuuuuguucccaguuugcucuugguuuggauuuggcaucagggcgagugguuaggggcagcguccggacaccaugcucaccuacccagaugaaugagaaagagcagcauugaaauccucaggcuaauucugaaggacucuuagcagcugaggagcaucuauaaaguuaugaguuccucugaaguuuuagugaaauuacggggcuacucuguggccuaccacuuccaccccuaggcguauccacaagagaaaugaaaccugcguucacacagaaacuugcacauaaauguucauggcagcaucguuccuauuagcuacacaguggaaacaaacuaaaaugucuauccaccaaugaaugcauaaacaaaauaugguguauccacacaauggaauauuguucagccacagaaaagacuaaagcauugauguauacuacaacguaaaugcaccuucaacauuaugaagccagucacaaaagacuucauaccguguaauuacaugaaauggccagaauaggccaauccauacggacagaaaguggauugggguggcccugggccggggcaggggcggggaggcaucagggggaugggcagugcuugcucaugggagugggacuucuuuuuggggugaucaaaauguccccaaauugguugucauggugguuccaugacucugaaaaaugcuaaaaccauugaauggugcauuuggagaugagugaaucguaggguaugugaauuacaucucagcaaagcuguuagaaaaaagaaaagauaugccacauuuuaaguggugggaaaaaucaaagagagcauguucugaguuuuaaacaaagcuagaggagaucauguuucugagaccguuaaggaagcccacggcuuugccggcauggagugagaagaugggaaccaccugcccagucgggcuuggagggcagcgcugguucauuucuuugacaucaguggccuuagccccgaauaauccuuuuuagaaaaucaaagaagcacucaggcuaaauaugcaggauuuuugaaguguccaacagauuuuauuugagaccauaaaagggguuugugaacugucugggacagucauggaccaagucugagcccaccuggccugcagauggcuuccugcugagcaccucgguggucccagccacuccuggaaggauugguucuagcacagagaacagagcccacccaagggacugugaggaccuggcuugggguggcagggccugaccccaaggauacauacaaucuggaacauuuauuuguucaacagccacucucccagaaccacacuggggccaugcgaucuacagacccuuaugugugcugugugugcagaggggacucacgguaaacaguucagccaguguuugugaaucugcagugcgaugcaggaagaccugccugaucugcgguggacuggccaggaccagccuaggaaagccauuugggcugaucugucugaaagagcugaauuaaaagugagaguuuuaauaacagaaaugaagaaggaaaaaaauggccagcagcauaggagugcuccccaguguugcuggggaguuucgcugcugcucagccccuguucagggucuucuggaagcucccagcagccuccugagacagacagguuggagcaccacagcugccugcggcuggcacacagagucguaauuuuucuugguuuuaaaaaccaauccagaucuuggaauuauccaccguugugguaaacuuaaaauuguccaaagacaccggaugacucuccuucaaauggugucccuggcccaucucuaggagagaacuaaacuuuuuuuaaaaaaacucacauauccugugguuuuucaauucucaaaaaaagcuuuugucucuccugucuguucucuccaaaaguagucuucguuguggguuuuuuuuuuuuuuuuuuuuuuuagagauaaggucaccgggcacaguggcucacgccuauaaucccaggacuuugggaggccaaggcagacagaucacaaggccaagagaucgagaccaucuuggccaacauggugaaacuccaucucuacuaaaaauacaaaaaauuagcugggcgcgguggugcgcgccuguagucccagcuacucuggaggcugaggcaggagaaucgcuugaacccgggaggcagagcuugcagugagugagccaagaucgcaccgcugcacuccagcccggcgacagagcaagacucugucucaaaaaaaaaaaaagagauagggucucacccucuugcccagaguggaguacaguggugugaucauggcucacugcagccuuaaacuccugggcucaagggcuccuccugccucagcugccugaguagucaggacuacagguaugagcuaccaugcccagcuaaauuuaauuuaauuuauuuauuuauguagguaggugaguauagacaggaucucacuuuguuagccagguuggcucaaauuccugacuucaagugauccugccgccuuggccucccaaagugcuaggauuacaggagugaggcacugcaucuagcccaaaaauagucuuuucuuacauuuuccccucuaaugucuuaccugccauaccacugucugcuguccagcugaacuauaccaggagccauauguguuguuuuaaauuuucuaguagcugcauguuaaaaagucaaaagaaccugauggaaguaauuuuaauaauguaguuaacccaguguauguaacaugucaauucagcauagcaagcaauguaaaaaagcauucaggagauauuuauauucuuuuuuuuuuuuuccuagacagucucgcugugucuccaggcuggagugcaguggugcaaucucagcucacugcaacuuccgccucccagauucgagcgauucuccugccuuggucccccgaguagcugggauuacaggcgcacgccaccacgccuggcuaauuuuuguauuuuuuaguagagacgggguuucuccauauuggccaggcuggucucgaacuccugaccucgugaaccacccgccucggccucccaaagugcugggauuacagaugugagccaccgugccuggccuauauucuucuuuuauucugagccuuugacacaucaguagguuauuucacacagcacaucuccauuaggacuagccacguuucaagcaucugauggccacauguggcccauguuuggcaaucaugggucuagauagcuuaucaggacaggaguuacauuugcccuaucagcuugcaaaacaugcugcaaaacagcuugcaaaacagcuggggacuggagauauuggauuauaccaucuugguguugcgccagucaggaguaauuguuguaaguuaggcuuugacaaggaccuuguaaugaugcucacauagaagauaauuuauaaauaccuauaacauaaccugagaauggcgauuaaguaaccuggucuuaacuccagggcccaccacagcaacuuugagcuuagaugccacuuaaccuuuuguaacuuguaacuucauuggugguggggguacaggcaggucagcuuguucacaugggcugcaaacauggcuuuaccccaccgucucccguggccuucucaacacacuuuagaaucugcaggagaccugcagccccccaccagacccccagaaucacacuaugcugguuggccugggcaugccccuccccccaagcauuuccgcugcacaucccagcucaagaaccacccucugggugccaaggucuccuccaggagcacagguucucaccuggggcugaucugcccccuggggacauuuggaaaugccuggagacauccuggauugucccagcgugguggggggcuggggagccccugcuagcuguagagauccagugacaguuugcaugagagguuucuccauugcauaccagcugacucugaggagcagcuugacgcgguaggggcccuagugagaaaccuugccuuccuggaccauuugggccacaagucagcauaagugacuucuccuaacaucaguacccucugcaagggagaggcuaaacaagaagacccccggggagccccugcuagcuugggaagugugugauucucuccacucccuccccauagaaucaacuguaaaagcuuuagccauuucuuugggacgacuuuggaucagcauauaaagauacuggguguucugugcacacucugcacucugggaaguuaaugagcaguuuuuaucuggcauggcacaggcuguucuuaauuuuuacaagcuuaagcucagcaauuucaaguucauucuaaacauugaaagaguccauuugcucuuacgagauaauagucuccauaaaaccuaacaucuacauacaguagguauuucugaaccacacucaaccaaaauaaauguguaaaaauguuacgaaacauuuauugaauuagacaaugaccaaaaauuucuucagugcaaagcacacucagauuugguuuuuauuuccauuuccuguuuucuuuuacuuaaaagucuauagaauuaacauaaagguugaguucucagugaaagaaaccaggcugggcaugguggcucaugccuguaauuccagcaauuugagaggcugaagcaugcgcaucaguugagcucaugaguucaagaccagccuggaccgcauggcaaaaccccaucucuacaaaaaauacagaaauuagccaggcaugguugcacgcguguaguccuagcuacucaggaggcugagguggaagggugguuugagcccgagagguggagguugcagugagccaagaucacuccacugcacuccagcuuagacgauagagacagaccuucucucaaaaagaaaaaagcgagacacaaaagaucuauaagugauugauucgguuuacauggcgucucagaaaaggccagucuguagagauagaaggagaagcgguugcgucgguguggaaaggaaaauuucaggugggcaugaggaaucuuucagggguggcagaaacguucuaaaccagauucuggugaugguugcgcgcuggguuuuuuuuacuagaaaucacugaaguguaucccuaaaaacagguagauuuuaugauauguaaauuauaccuuaauacagcuguuggggaaaaaagaagacuugguacugcccauccccacccccaagggcucccaguuuauuaagaaaacuaaggaaaacauaagacagaugaaugggggaugaagccgcaaaggguccccgcugcugcccccuuggacaucguaauagugaacuguguucuggccuugggugaggaucaaggaagcugggcccagaucuuuuuccuugguuuucaaagccuuccagguaaauaugggaccugccagggucuuucagcacuggaaauagccgacaugccccucaguggccuccaggggaagccccccaggagcuuugaggagcugcuuucuccuccgcugcuuugaggagcuuauagccccuucaagcucuucccaaaccucacaggccuuucugcgucccugacagaggucucaagaggagccuuugacaaacagcagugagagcugauugcugcccagugucaucaagaugccgccauugauucuagcuuuggaaucuguggccaaauaggugacucaaucugaaauuuauuuggagaaggcagacaaacauucagaggaagcagcagaaguuccauuagagcaaaccuccgcagggagugagagcaggggccaugcugcagaggaggccggggcagcgugggucacccaggcggaggcggugccgcccccucacauggaccaggggucugggggcagcucugcuccucaccaaggcccaagacccgugcugucauaacaguccuccuucagagacaccccucaaucagaucuaggaauugaaagucagauugguuucacaagagaauauuguggaguuuuuuaaagucuugaggcggggcgccguggcucaugccuguaaucccagcacuuugagaggccaaaguggguggaucacuugaggucaggaguucgagaccagccuggccaacauggugaacccccaucuacuacaaauacaaaaauuagccaggcaugguggcaugagcccauaaucccagcuacuugggaggcugaggcagaauugcuugaacccuggaggcagagguuacagugagucgagaccacaccauuguacuccagccugggugacagagugagacuccaucucaaaaaaaaauaaagucuugagaauguucacuuccugacggcuuugcacauggcccauaacaagcuguccugaccuucucagugugugacccaggacaccguggaaucugggaaagccaugauuuccacaguauacuccuagaaauuuuaaucucagagaaugaugauagauguuucuggaaaaugaguuguguuugagaacuggauuaaacaaaauuacagaggcuucuuuguggcacuuaauaauuucccaaaccacuaaagagggaagccccagcgcuaugagcauaccuggcaacagaccacuuccuagagaaaugccuccagugagccagggcuacauuuugggaagugacuguauccuacagaguagaaaaauagucccagcacagggucucaugccuguaaucccagcacuuugggaggccaaggugggcagauugcuugagccuaggaguucaagaccagccagggcaacauggcaaaacccugucacuacagaaaauacccaaaaaaaaaaagccaggcaugguggugcaugucugugucccagcuacuccagaggcugaggcgggaggaucgcuugagucugggaggaggagguugcaguaagcuaugauugugccccugcacuccagccugggcaacauagugagacccugucucaaagaaaaaaagaguagaaaaaaaaaaaaaaaaauauauauauauauauauucauauuccaacccccgagagauaaucaguuaauguuugacauauuacauguagucuuccucugcaacauuugugaaaagaaacagugcuuuaaagaauuuaagagccuuuuuugggcuaaaacuauaucaugaacaucuucucauguccuuauguaugucucuuuuuuuuuuuuuuugagacaguuucgcucuguugcccaggcuggagugcaguggcgcgaucucagcucacugcaaccuccgccucccauguucaagugauuguccugccucagccucccgaguagcugggauuacaggugcgugccaccacggccagcuaauuuuuguauuuuuaguagagacgggguuucaucauauuggucaggcuugucucaaauuccuaaccucaggugauccacccaccuuggccucccaaagugcugggauuacaggcaugagccaccacccccagccauguaugucuuuuaaagcguuauuuuuaguggugucacaauaauccguccaugguugagccgucauuacauagucaucccccuuggacauggguuugcaaugaaauauugaaauaccgcuggguugagcacauuugugaauacagcuuauggggcuuaugauuaauucauuucuaaggaugaguuucuagaaggagccaaaugaggucaaaggcuguggacuuuuucagguauugauccaacaucacugugcugcucuccagaaggguggugcccucuguguacaucuguucuuucucaccuugcgucuccccugggucacugccagccucacagcgauagggcucugcuucaauugggucuuugcucugcucacagccaugcuguauccaucaggguucuccagagaaacaaccaauuuguguguguguguguguguguguguguguguguguguaaucugaaguguguagggcaggccagcuggugugugugugcauguguguaaucugaaguguguagggcaggccagccggggguguguguguguguguguguauauguaugugugugugucacaucugaaguguguagugcaggccggcguucuggaaacucgggcagaaguuaaugcugcaugcuugauguaggauuucaucaucacgaaaccuguuuuuugcucuuugggcucucaccugaugggaugaggcccaccugcuuucucaaggauaauugccuuuguuuggaguccauggacuauaagugacaucuacaaaaggccuucacagcaaugcauagguugugugugaugaaaucacuggccgccguggccuggccagguugacaugugaaacugaucaugagucauccugcuaugacuuuaauugccuggagaauuccuucccagcaaaagccgcacgcugcuucucccagagggguggggugcauuuuauugggcacuuuugccuuugaaaacguaaucucccuagauaaguauuaccacugaaccaccugcugagcagcgugcuagcauuucuugacuccagauggguuucacacacgucuguccccuaccuggcuccuguggcugggugcuagaugggaccaugggacccaaguccacccucuggccccuucucccuguaggauuccuaagcuugagccagacuggucguucugccagguugguugcccacccuccuaccccugcagcggccccaucccacgugguuaaguggguggccacacccacugccuuuccuuucucacuuccagcucuguucuucauuccagcagaagguccagccucacacagugacccagugggcuugaacagugagguuccagucccgucccuuuagccucaucccucaugggggaagauaccugaugccggggcugggguguaggaggugguugaaacagccugaucuacaccccugccugguggguuagggcuccgaugccacaccaggccuggcaucuagacagagaguuccacagaguccccucugccugcuaugugccaggcacuguacuagcaccacaccugcccucaggaaacucacagcaugaaggagagagagacaccaaaaauugcuugauacugugacccaugcuggccaggcacgguggcuuacaccuguaaucccagcacuuugggaggccaagcgggagaguuucuugaggccaggaguucgagaccagccuaggcagcauagugagacucugucucuacaaaaaaagaaaauuuaaaaaaaaaaaaaaaaaaacaggcaugguggcaugugccuguggucccagcuacucagaaggcugaguugggaggaucgcuugagcccaggaauuuaaggcugcagugagcugugaucgugccacugcauuccagccugggugacagagaccucgucucaaaaaaaaaaaauuauauauauauacacacacacacacacauacauacacacacacauauacauauacauacauacauauauauauagugauccaugcaaaaucugcagcagggguaggcagacaggaggaaguggguugcagggucaaggcaagccucagagaaaaaaaccugagacugaguggcccugacaggcaguuggugggacagggaagggggugguacagacggagggaacccccaugcaaagguauaaaagaggaccccccaauaugcuaacauguauuccacuguugcugaagacuaacacucaaggcacugguuaccagggaaugagaacuuguguugaguuugagauuuuacuuaccuggcaaguuggccuuccaguuucacggagcuggucuaagauaugagacuucagggucagagacaaagaaaaauccguuauucacagcaauagcaguagccagaguauuagcauuugggucauuucccaggucccagugcccauagcugugauguagucagggccccauggcauccgcacacaucaagggcugcauugcaggagaggaacccuaagcuuaggaaccaaaucuucuacagugggcacaaagcacauuugcccugugcucuggagggagaugcuaucuccaucauccaaggcuguuuccugugcauguucuuggaaagauaguugggaaaaaaggcaggcagagccucugcuggaaagacacagggaaaggagagagaagaauuguuacccggcaaagaucagacugccuccuccaccaagucucuggucuagauucugugaguccagaaaccuccaucucagucuaggagggacagcuaggaggaaauaaggacgucaguuugcaaccagacaaguuuagaggccuguggaauucccaggccaagggaagaguuguuacggagacucuauggccaagagggacagaucacacuagacaucaagcucaauggaugccaccaagggcagccaccugcuguaucuuguacacguuucauccauccagcuuuuagccucucaauccuucucuuccuaauaggguagguauaagauucccauugcugcuguaacaaauuaccacccacuuagugguuuaaaguaacacggaaguauuccauuacaguucuggaggucagaaguccaagcugggucugcaugguuucauuccuucuagaggcugugagagaguccaugccccugucuguuccagcuucuagaagcugcuacucaucuugguggccuugcauccccucugaccuguuucuguccucacaucuucugacucugauucuccuauuuauaugacccucuuauaaggacccuuguauauugggcccaccuggauaauccaagauacucuccccucucaagggccuugucuuaaccguaucugcaguuagguugccauguaaggucacauagucacagguccuggggauuaggacguugacaucuuugggagccauuucccuucuaccacauuauucugaccucuguagauacuguggcccaugucaucaaacccccaugacagucacagcccugccuauuucuuuccauccagacagguggugccuguggguacaucucagcguagggugcagacagaguugucuguuggaaggaaaaccacaucgaaucgggaagggaggguccuggcuagaguaaggacagugggcaggaggccgggguccuguccugccacaacacugaccaccuagaaccucaacuuucuucuuuaaaaauaaaaagagaguaacuacacuugccauacugaccccccagguuguauggaagcucaguggagaaaauggccggggugcgugucugaaccgcgcugcauuuggacggacacuuugugugucacauguuaguagcugcaguguguccuccacccgacugagagucuguguaucaagauagggguaaauccuuucugaccacuugcagacagaagucacgccucgugguccaaagccaccaagucauuacuuuucaaagcuuuuccaguagagacacaugacuccuuccuuaaaacaacuuacagugaaaauauguggaugguugaaaaaguaauguuuccagucugcugaaaguucuguggguuuuuuuuuuuuuuuugcagggcaauuaucuguauaaaauacuuuuuuucuuuuaaguagaauccuauugcuaaugaaaccauauuuugaacaugaaaauuguuacaaagaagaaaaaaugucauuauccagaaaagcugcaauagcucaugcauuugauggucuaaauagaacauuuuucuucucagggggaugaaagcgguccccuccuauuagccuaugaaauuauuuuagaauuggguuuuaaucccuggaacgagaaagggggauggaacccuaacauagguuccaugcaugggaagucaaaccugaaauuuagagacaggaaauauagcacgccuagucacuaauccaaaaggaaugugaaaaaagaguuguuuuaauguuggaaaaaggcagcaugaaagguaaggcuuccuuccugccguuuccucuggugcccuuuucuuucccccgaucacauuugcuagauguccauuucuguaaguuuucccucuagaacaaaccuaucauuuuucaccacgggauauuuacagcuucaaucagugccaaauucaauuggcuucugaucucaucgcuggaaguuauagaugcagauauuauuugcacugcgguuaauuauggagcaaucaaaccuuggcuuuuccacuguaauuuccucugccagcuaauuuaauuaaucacccccagcucagcucuuccagcugcgaccagcagggucauuaauuaggcauguggugggagcucacccaccagguccugcuacggggccgcugcccauuugaucucucagggagggagagcuuuuccuaagcaucgauccccuccagaaaggaagaugguucccaaaaggccuaucaggggcaaacagcucaccugcaguggugauugguuuacaaaauucaccuaguuaaagaaaagagggccaggugcaacggcucacgccuguaaucccaacacuuugggaggccaagacggguggaucaccugaggccaggaguuugagaccagccuggccaacauggcgaaacccugucucuacuaaaaauacaaaaauuagccuggcgcgguggcaggcaccuaugaucccagcuacuugggaggcugaggcaggagaauugcuugaaaccuggagguggagguugcagugagccgagauugcacccauugcacuccagccuggaggacaagagcaaaacuccaucagccgggcacaauggcucacgccuguaaucccagcacucugggaggccgagguggccggaucaccugaggucaggaauucaagaccagccugaccaacauggagaaacccugucucuacuaaaaauacaaaauuaggcaggcgugguggugcacgccuguaaucccagcuacuuaggaggcugaggcaggagaaucacuugaaccugggaggcauagguugcagugagccgagaucacgccauugcacuccagccuaggcaacgagcgaaauuccaucucaaaaaaaaagaaaaagaaaagaggccucgccuuccauuuagacuggcucaugaacuugccaaagaaagggcuguugucagucgccgaggcuucggucucagguuuuucaggucagugugugccuaauaaugcagaugucaugugaugagcucgguuuguugcaaggaagcgucguccuccucacgggcucuuuacguugacauuguggcuuuggaggcugauauuuucucuaaaggaaagauuaaaggauuguuuucauuuuauuauaaggaagagacauuuuugguauaagcccaucaaaguuggugccuaaaugcugcaacugauucuucuauuauuuugaagagccuguuuauuuuccagcaguuaccagcuuaacuaagacauugucacuggaauuccguauaaaugugugcaugcucacacccaugccuacauuagaaagagaaguaccccaaauuugggaggcuuucuuaugaucauucuuaaauaguuuauugucuuauaauaaugugggcuuuuuuguuuuacuuaauauauaggaagauuuuuuuuuaauaccuuaaaaauacugcacauuaagucuguuuuuuuacagaaggauaaauggaugaacagguguuuuaggagccacaauaaaccaucgcagagcaaggagugccucuucugagaucccauucgaugcucugcccucaauuaaaugaauccgagauaaaugggcaugugcguguguaugcacacacacgugcacacauacacacacaggcacacauaugcacacaccaagguucuagaugagaaggaacagagggauccagcucaguaauuaaaggaauaauaaggacucauuguguggcagguggaagaaaaggugcaggaggaagacucacaaagucuggaggauuggcgcucucuguucagccgggcaggaaggcaggaagcaccccugucauaaaaccccuacagccuguaaacaccaaaguucccuccugucuuggaguggggcugggaggccccgguggggaacagcuguaaugaugguucgcuuuaguugugccuuccugaagggcgggggggggucucugcggccaccuuaaacuuaaacaaguguauucagucuugacggccagccccgugaccugccagcauauuaacauuuaaaugcacaguacauucauucauuucaugcuguaaggaucauucuggaacgaaugauaaguagugguuuuucccugacauucguacucuacuuuuggaagugugggagauuguugagcauuuuuaaauagccauaaugcaaggggcuucuguguauuucuaguucuuaaagaaaaugcaggaugcaaacaaaaaauuaauuuucagacauuuucuuucaggaaaaccucuguuuggauauaaaucauugaaaccuugaaacaaaucugucauucuauucacaacucaaauaucaauuuuaagaauuuuugccgggcacgguagcucaugccuguaaucccaggacuuugggaggcugaagcaggcagaucauuugaggucaggaguucaaaaccagccuggccaacauggugaaaccacgucucugcuaauaauacaaaaaauuagccaggcaugguggugggcgccuguagucccagcuauucgggaggcugaggugggagaaucacuugaacccgggaggcagagguugcguugagccaagaucaugccauugcacuguaaucugggcaaaagagcgagacuccaucucaaaaaaauaaaauaaaauaagauuuuuuaggccgggcacgguggcucacgccuguaaucccagcacuuugggaggccaagguggauggaucacaagcucaggaguucaagaccagccuggccaacauagugaaacccugucucuacuaaaaauacacaaaaaauuagccgggugugguggugugcgccuguaaucccagcuacucaggaggcugaggcaggagaaucacgugaacccgggaggcggaggucgcagugagccaagauugugccacugcacuccagccugggcgacagaacgagacuccgucucaaaaaaaaaaaaaaaaaaaaaaaaauuuuuauuuacccaauucugugacugccugaacuggccaggacaaauagagaaggggugguaggggggcaguguuagauucuuucuggagcacuagggugcaaaucagaagcguccuuuguugcugcagcucuccccagccgccuggaggaucuguuugggaggggagcacucucuaaggcuaguuuuguucuugcucagaugaucaaaucucuaaugcaucucuaguaccaaccucacuucccagccugaguuuccauuuguccccaguuuccccacacaaagagcaacaaacacuguuccagcugguaggaccagcccauggaucccagaggcccagcaugcucagggcuccuucuuuuuucucauuucucuccuccccaucuccagacagccuuuaccguucauaaaaagaaaugcaggccuaaagaggacugggggcuggaagaggguuaggcugagucccauugcccagggcaugaccagggaccaugugguggcccccaggggcaucaugugguuuuccaggccaaggagcugccuggcuccaugggccgccucaggauguggcccagccggcuuccuuugugaaggcaagccccacacaaggagcaggacuccuggaggggacaauggcuguccaucagugauagcaaauuccagcguccaggccguggguucaucuggcugccaggcugggcugauggcagcaacgcugaccacacucgucauuucucugcuguuaucacagccugggagcgggacaggaucuguuccauugacugcauuuuuaaagcugcccugaucuuccuuuuugcccuaaucuuccuuuuccuacugcccuuuuccccccuccuccugcuuagagauaccagcucugacaguccgaauguaagaaauaauuggauucuaaauucuaauucaucuguaaaguauucggugauuaaauuagccuaauagauauuauuucuuacaugacugcguaauuuuauccugauuggaucucagugguacuaacgugccccccaauuuacuauugacuugaaauucucagaaggcgagacauaacucucugucuucuucagucuguuuucccagguuaaaaguuaaacugauuuaugcuaaaggaagaucaccuuacugcucaaguguaguugcacaguguauauuguucuuuaagaagagcaguacaaggaaaauauuauuuuauguaauuuuaaauccucuuuuuccucuuuuucuauucagaaacuaaaagaaauacugcccauuuaaagucuuuggacagcaauuugauugcagguaacauaguuucucuuuuaaauagcuggaagucucauccaaacaaaacuaaccgucacucagcauagagcugauaaguguuguggauacauuccaaaaaauuuucaacauucuuaggauaaaauuuuagcugggcgucuuuagccauuuuuaauagagccgcuuaaauucuuggucaggaaugagauagaaagggaacgaagucauggaccccagagauacacaggagggcacuggccagcacuuauucaucggccuuauuucuuucuuucuuugcauaaauuuaauuucuucaaguaugugccucuccccucccccaccccccugcccuaccucccucccuccaaaaaucugcaaauaaaauuccccgcucccucccugguugaguagcuggaagcagcugguggguuuuguguggcuacugaacagugggggaaaaaaguuuuggcaaacacucgggaaacccaggacagaggagguagguaaacucaggaaacuguuuucaugaguaaaugaaggaaacaaaggccucgcagcaggagcagaagggacacacacucccucugaauagcucccuaaaaacagagcugaaaaggaagaaggcccauuugcuucugggaauccaauaaauuguuucaggaagugaaagucuguccaggcuaauggagcugugauugacaggccuucucauuauggagcccaucaggggacagggcauuccaguguuauuuaggggucgaggugggaaugagaggaagccagagcccggggugggggcgggagcgggggcuagcuguggguguucauugaaagaguccagguccccgacagcccugcuccaaggacagacaaccucgucuugcaggaucauuuaccuuuuauauuaugaccuagccacuucucauggcucuaccacaccaucuucccgagagagccugugcccgccccacagucccggcugaaauggcaaaugcgguguaggacuguggugcacacugcccaugacgggcuacuuggacggcucaugcccaccucugacuaguuugauguucugaaucaggccccuugguuaagcgugauaacaugaucaccugguguuuuaaagcuuuucucuguuuccauguggugccgugaauagucucauaagccauguaaguggccuuauugguuaagugacaaccggggacauacccauuuucuuuguccaugaagcaccaaauaagaaguuggcguccauuaaacuagauugauuauuuaauaucacaaggcuuuugaaugggcuauggggaggaauagaccagaggucuuugccaggaggagacguuacagcagguccucucugguugggaccugcuuaaagauguguaaagaccuugaacaucagcaucuggcacagccaggggagggacagggaggacgagagaccugcuugguauccuuggccccgggguccagguuauucaguuuguugauggcuaucuggcaggacucccuccugagcaagaaagacccucagucuccacgaugguuauuuccagaaaaguggggaccuucaccaaugugccuuucauugugaaccuuacccagcugggcuccaggacaccuaggcacauccccgucucuggguccccagccuuaucaugugucugaguguccucagacaguggaauccuuccuucaccuuacugagagaggccagcgcuguuuucauuuuggaauuggcaaaaggcaaguuuucuccuacaaugcuuugaaaggguuuaaugcacacugaagaaacagccagauagcuccagcucugcuggaaagggcaaagacccauuaagcaucuggaguuuggguccuggguugucacacucuguaaugaccaucuuggaggguaagacacuuggcagugggcaugugaauuggcuggcauuuccagagucauccuuacuguugggcuauugggugauagcuagugggugauagcuauuacaugaagaagaugccucugugaacuuaaauguugguucagugacucacaggcuccaggcagauucauagaugcuuucauguuuacugaugcauuuuguauucuuaagcuucaggaaguaguguuaauuauuuaucuggguuuaacuacacuuuaauuuuuguaaacuaaguccagagcggucuacauaguaaaaccauagauucucuuuuguuugauuucugugaauugcagcaguuuaugccacaauuguagcccuguccccauugucacgaaucuauguauccuucugcuucuauucacuguguuccagaaccuaucacggugcacugcaauaccucauuccucacgagugcucaguugguauuucuugaaagaauaguugcuuaacagggcauucgaucaugauggugaucgucauaaagacacacggggcugaaaucaaauucaaagaacucacuucuaccaaaagagaaagaacugguuuguauaauauguuucaaaguacagaagguagaagguacaucaccaccguccaucacgugaaggaguagaaaaagugggaugccacaguugcggcagagaauauccaaaaggaaaggguccaagucagaccgcucacguggguggcagcguccaaguccaguuuguacauuucugcauggaugaggucuuuucaaagcacauacaguugugugauuuuuauuuccccaagaaaaaauaaaaaguuaaagucagucuagucaauugcuuuaacacaaagagcaaacugacacacaguuucccugggcauugcuacauauuccuugcucuuccguaaaggacacaugugucucugugccucucagucucccaguugcaaagaugccaucccaggucaagcugagguccuugcaaaugaacugcaugcuggagauaaagcgccuacuaggcugccggguacuggcagaagagagugagcguagcaacugggagguggccugauggccugcgccuguugccguugaugagacccaaagucuggaacgaaucugguuccauauagaguucaugcucaccccgaaguccuucuuuggcacuggagaacaaagaagaguuugcacagaagaaaagggagguuguuuaaccagaaaggcccucugcaaauuucugauuccuguacagucagcauuaauaugcugcuuuucagacauccaaaugggggauugaacugugagagugcaggcaauaaagagugcauuuguggaaugauaaccugacuggcaucccugccucuugaauggcugacgaggucuaauuggcauguaacgcccuauaaauuuauuagcaugccucauuucucauugguggacuuucuacuguuaaccaccaagaaaugaccaauuuucaggaguuagucacucaagucguacuuauaacuagguuggaaaaaaaaaaacucacacugcuccuauuauaaaucaaccuuaugccuguacagcagcucccuggcugcaaaugaauccaucggauacagaaguuuugaggugaguggaguugcagggaggagcacguguuuaccaggaaacccacugcucuccucaccuugcccugcgcgccugagcccuucacagagaccggccguguccucaccccucugucaccauugugggcuccagcugcacaggcuggggaugggcuggguagaaauggcaguuuuguggucguucgcacccaggacuuugauguuccuacugauauauucaacccucaggcguaccaugcaaagaggacauagccacccucuuauuucaagagcaugauagaaauauucagaagcagacauaauuauuucaauuacuucucucugguuuuugagacgcacacucaagagucacaaauuagaaaauaauauucacauguuucuucuaauugguaacagauuagaggcauuuuaucuuuuuaaauaauuuccaaaugugccccaaagagacugugaagggagggaacagaggcauggaaaagcaaacgggcuuugccaagcgagugagaggcgggggucggagggaggccuuccuccugcagcguguuuccaguuguucggauuuuuguguuauuuucaucacuuuuggauauugaaagcuagcagggagggggucuuccugguuauacggcccagcuugcaaacauaauccuuccuuguuuuucuuuuguugguggugguuguguuuguuuuguuuuuuguuuuguuuuguuuuuuugagacagaguuugguucuuguugcccagccuggagugcaguggcacgaucuuggcucacugcaacccccgccucccagguucaagcgauucucaugccucagccuccugaguagcugggauuacaggcaugcgccaccauacccggcuaauuuugcauuuuuaguagggaugagguuucaccauguuggccaggcuggugucgaccuccugaccucaggugaucugcccaccucggccucccgaagugcuggguugacaggcgugugccaccgcaccggccguaaucguuccugguaagcacauuucugaacacaucaauccgcugccugcaugcccuguccuuggccacguguuuucuacacacgugcaugcguguuugcauaucugcacgcauuuuuauguccaguguacuuccaaaaacagauuugagucaucuaugccugucucucugugcagcaacuuuggaggggugaagacggaggucgcugcuaguccaggucgccuggggcccugcccucugacacaggguauuucaaguuccucuaaauccugagggucucaacuguuccuuuuucauaauggaauuugguuuuaucaaauacuguuuuuaacauuuaguugccucugcucuggaaaacaguuuuacaguuucuuauaaaacuaaacgugcaccuuccuuaugacccagcaggugcacuauuaggcacuuauccuagagaaagaaaaaccuaggccgggcgcgguggcucacuccuguaaucccagcacuuugggaggcugaggcaggcagauagcuugagccacgagaguucaagaccugccugggcaacauagcaagauuccgucucuacaaaaaaauacaaaaauuagccgagugugguggcgugcaccuuagucccagcuacucaggagacugaggcaggaggauggcuugagccugggaggcagagguuacaguaagcugggaucaugccacugaacuccagccugggcaacagagcaaggcucugcauaaauaaguaaauaauaaaacuuagguuuacacaaaaaccuguaugugaauguucuuaguggcguuguucguaagagcccaaaaccagaaacaacccagaugcccuucagugggugaaaaaguaaacaagcuguagaccauccacacuguggaaaacuacuuggcagugaaaaggaaugaauucuuaauacacaacaacaacuuaggcgaaucuacagggaauuacauugagugaaaaaaagccugucccaaaagauuacgugcuguaggauuccauuuauguaucacuguugauauuacagaauuacggagcuagagaacagguuagugguuguccaggguuagggauggagagggugggugagguuuuagaaaggcaacaagagagacccuugacuggugcuagauacaggaacguacaugugaccaaauugcauugaaccaauuccauggacacauaaauacaaaugaccacaaggaaaaucggaaauguggacaagccagguggguuguauccauauccuauggugauaacauacuacaguuuuucaagauacugccuuugaggggaaaccagguaagggguacaugagaucucucuguauuauuucuuuuucuuuuuuguuuguuuuguuuuguuugugacagagucucgcucugucacccaggcuggaguguaguggugcagucucgucucacugcaaccuccgccucccggguucaagcaauucuccugccucagccucccgaguaagcugggauuacagguguccgccaccgugcccagcuaauuuuuguauuuuuauuagagacgggguuucaccguguuagccaggauggucucgaucuccugaccucaugauccacccgccuuggccucccaaagugcugggauuacaggcgugagccaccgcgcccggccguauuauuucuuuaaacuccaugugaauacacaauuauuucaaaaaagcuuacuaaaaaguuuaaaacaaucaagcaaaauaaaagguggcuucccuuaaaagaaucagggcuccuuggagaaauggcucauuccagaucugguugagaaguagggaauggcccuggagcauccugcugugccagaaagaaagcacagagcuaccagggaccagggcagaugccgcagacagaaacaggagcggcuccaggccucccacuggccaaaucuggaacaauugaagcaucuaaaagaauaguguugguggcaguuuaugugacacauuuaauuuuuaaacauggguccacgacgauacuccagaaaggcagugggggagaagcucuucuuuauaaaaaaugccaaccaguaaacagagaggaugagggaacuggaaaaucucuaucccgcaaccaaaaacgugauauuuuaauugguucagucaaggaucaucaacugaagcugcaccccugggggagaggaacaaaauauuccgccucaaggugucagcccagggaaacugaagcugcaccccugggaggggaggaacaagauauuccaccucaaggugucagcccagggaucacuuggucauuguaaagggggaagggaccuggacagagaccugguggcuccugcuuuagccacagacucagacagacucgguaguggaacaacucacagucugugccuccugcuggugaugcaagggagacguggcaccucuguaguaauauuuugacccaaauggaaucggacaaacacaauugggggcauuuuccaauagaaauagcuugaaauccucaaaauaccaauguaaagaaagaccaaaaagaagaguaggguuuggaagggacucucacaugggaggagguauaagaggaugaccaaaggcaacauauauccuggauugggagagaaauucagcccuagaacguauuuuuggauaauuuggugaaaacugaauauggaccacauaucaguggcugccugccagucauaaucaugaaaaacacaaucccaaacaccauaaucccaaguauugaaaucucucaagucugaaauccccaaaaucacaaucccaaaaaaucaaaaucccaaaaauauaauccuggaaaagaucauuugaaaaauuacuuaaaagguauuuuuugacauuuuuaaaggggguuucucugagaaacauauaaaaacacaacagaacacuuuuuagagcacuuuucacaaauaggcaaugauaaccuauauuuuugcaagcauaaaccccagguguacuaacaacagucauauggcuguaacagguacaagcagacuguauucauaggucagaaauauauaaaugcaugucacugugguugcuaauuaugggcacucagcuguauaacaccugaaauacagugacgaacaacuucagucuuuugacaagacugaucaaaagcugugauggagccaguguguggcacacaaccauagucccagcuacucagaaggccacgucaggaggauugcucgagcccaggauuuccaggucagccugggcaacauaaugagacucuauaucuuuaaaaaaaaaaaaaaauugcaaauacgaugggucaccauggccuaugaaguugccaaaagagcugagaauuuuuuuuuuuuuuuuagacagggucucuguggcucaggcuggagugcauggcucaaucacggcccacugcaaccuccaccucccgggaucaagcgauccucccacuucagccuccugaguagcugcaaauacaggcacagacuaccacgaccaucuaguuuuuguauuuuuuguagagaccaggcuucaccguguuguucaggcuggucuugaucuccuggauucaagcgauccucccaucuugaccucccaaagcgcuggaauuacaggcaugagcacugcgcccagugagagcuggagaaauuuuaucuuucacaaacgcagauguucauuuauugaagaaauuucaugaaauuuguggacuguauguaagugcauacagaaugaauuuccacauacccaaaacaaugaaaaagccuggcacagaagaugggaaaauugaucugggcaacaguggcucaugccuguaauccuaaaacuuucagaggccaaggcagguggaucacuugaguccaggaguucgagaccagccuaggcaucacagcaagagaccccaucucuacaaaaaaaaaaaaaaaaaaaaaaaaaauuagccuggugcagcggcgcaugccuguggucccagcuacucuugaggaugagaugggaggaucacuugagcccgggagguccaggcugcagugagcccugaucaagccauuguacuuuagccuuggugagagugagacacugucucaaaaaaguugugggggcagggcaggcguggugguugacgccuguaauuccaacacuucgggaggccaaggcggguggauugcuugagcucaggaguucgagaccagccugggaacuguggugaaaccccgucucuacaaaaaaguuaaaaauuagccaggcgugguugcaugcaccuguggucccagcuacucgggaggcugaggugggaggaucacuggagcccaggaagucaaggcugcagugagccaugaucaugccacugcauuccagccugguugacagaguuagaccuugucuuggcugggcacaguggcucacguguguaaucccagcacuuuuggaggcugaggcuggaggaucacuugagcacaggaguuugagaccagcgugggcaacauagugagaugccaucucuauaaaauaaaaaaagauuaaaaaauaggaaaaaaagacucucuaaaaaaauacaagaaaaagggaaaaucuaacaggaaauucucauguugguagauauugacauaggcagugcuuacaguguugugguaauguacuuugauggagucaaguuugcaaaaaaugcauaaaacuaauuagaauaaugcugacaauguaaaauugugggaaaaaacuuuuaaaaauuuugacauaugaagaaguauauuaguucagggcuagauuauggauaguugcacagagauagucccuaagagcuggccaacuuccacgaucauuauauuuuugaguuuugcaucauggcgcauagcugcuuuuuuccuuuuaggaugugccucuccauagagaagaaguucacauuccuuuucugugugacgcugcucuuuuagaaauucuuccgugauucaggguucgccaacaugaguuauuucccauuaaauuuccccagcuucugugccaugcuucuuuauuguuuuggguacuuggaaauccauucugcauucgcucagguacagaccucagauuugguggaagcaauacugaugauggaaccgcaguacuauguaucuuacccuaccaugugcauagcuguuuuucauccaguagguaacuucacuggcuucuucacacaaauguggcucuucucauuaaaagcuccuggaaugucagccaggcacaguggcucacgccuguaaucccagcacuucgggaggccaaggcgggggaaucccugagguuagaaguucgagaccagccuggccaacauagugaaacacccaucucuacuaaaaauacaaaaauuagcugggcaugguggugugcacccauaaucccaacuacuugggaagcugaggcaagagaaucccuugaaccugagaggcagagguugcagugagccaagaucgcaccacugcacuccagccuuggggacagagugagccuccaucucaaaaaaaaaaaagcuucuggaaugucaucaguuagauggaaugccagugcagacaaaugaugcaguuuuauuuuuuauuuauuuuuuauuuuuuugggacagagucucgcucuugucacccaggcuggagugcaguggcaugaucucaucucacugcaaccucugccuccccgguucaagugauucuucugccucggccuccugaguagcugggauuacaggugcccaccaccacacccagcuaauuuuuuguauuuuauuuuaguagaaauggaguuucaccguguuggccaggcuggucucgagcucccaaccucaagugauucaccccggccucccaaagugcugggauuacaggcgugagccacccugccgggccaaaugaugcacuuuuaaacugaaguuucauccuugccguaucacguggccaauccauucaucugacuuuuuuaccaaaugcauugagcugaauggaaaaaacaaacuuuauugguaauauccugaaauucacuuucagaagccuugauggcaccaauuccaaaucuguccuuaugguuugggauucaagugaaaccuauuuccuccugcaaaguccaucaaaucuuaaauaaguuuuuauaguaaagugcuuuacuuuuuucagcauuugggauuaugguguuuggaauugugucuuucaggauuaugauccaaacccaugauagguaaaaauguauuaauuuuaaguucuuuggcuauaauaaugugggucuucaaaaugugggcuugcaacuugagagacucacacaguggcgucugucugagggagcaaaggagcaccagauucuggauuuuuuaacugucaugaaauauacauaauauaaaauuugucauccuaaucuuuuuuuuuuuuuuuuuuuuuuuuuuuuuuugagauggagucuugcucugucgccaggcuggagugcaguggcgcgaccuuggcucacugcaaccuuugccuccuggguucaagugauuccccuaccucagccuacugaguagcuggaacuacaggcaugugccaccacacccagcuaaguuuuuguauuuuaguagagaugggguuucaccauguuggccaggcuggucucagccaggcgcagugucucacgccuguaaugcuggcacuuugggaggccaagguggguggaucacguggucaggacaucuuagccaauuuuaagugggcuguucaguggugcucaguacauugacauugcugcgcaaccaucacgaccauccaucuccagaacuuuuccauuaccccaaacugaaacuuuuuaccuauuaaauacaaacucccacuuccccuggcccccaccauucuacucuccuucucuaugaaaugacgacucccgacucccggcaccucaugugaguggaaucuuauaguaugugucuuuugugccugacuuacuucacuagcagaguguccucaaggcucaucaugucguagcagauauuagaauuucugucccugaauauuagaauaugcagccuuuaagaaggcugaguacuauuccaucguguggauagagcacauuuugcuuaucuaaacuuuugucaaugaacacuucuguuucuuccacauuuuagcuauugugaauaaugcugcugugaacguggacauacaaaugucuauuucagucccugcuuucgauucuuuuggguauauaccuagaagugggauugcuggacuauacacuaauuccacgcugaaccgucauaccgguuuuucagauucugaacguuuuauucauuuaaaauauuguugggccaggugcaggggcucacaccuguaaucccagcacuuugggaggcugacagggaacacaugaggucaguucaagaccagccugagcaacaugaugaaacuucaucuuugcuaaaaauaaaaaaucagccgggcaugguggugcacgccuguaaucccagcuaccagggaggcagagacacgagaaucacuucaacccaggaggcagaggucccagugagccaagauugcaccacugcaauccagccugggugacacagcaacacucuauagcaaaaauaaauuaaauuaaaauguuggcugacuugaugaaaucuuuuuuuccuuuuuuuuuuuuuuuuuuuagagaaacagggucuugcucuguugcccaggcuggagugcagugccacaaacauaggucacugccgcuucccgcugcugggcucaagcgaucccccugcgucagccuccccaguagcugggacuacaggcgugcaccaccauacccagcuaauuuuuuuuaauuuuuauagaaacagggucucauauugaccaggcugauuucaaacucuuggcuucgagugaucuugccgucuuagccuccccaagugcugggaugacaggugugagcccaccuggcccuaaaagcccuuucuaaaggccuccaaacauccuagugcguaaggacuagauccuuacuuccuagagauguaaggacuagaggaaggaggcuaguccuaggagcagacuagccccaccuccccagcgggggagccagcagguaggcugcugggcaaggacuucacugcaaggagggacagggugggccggggggacuucccaguuaugucagguuucaaaauauauuuggggaauaaaaauagggugcuuggggccaggugcgguggcucacgccuguaaucccagcacuuugggaggccgagggaggcggaucaugaggucaggagauugagacuauccugacuaacagggugaaaccccaucucuacuaaaaaaauacaaaaaaauuagcugggcgugguggcgagcgccuguagucccagcugcucgggaggcugaggcaggagaauggcaugaacccaggaggaggagguugcggugagccgagaucacaccacugcacuccagccugggcgacagagcgagacuccgccucaaaaaaaaaaagaaaagaaauauggugcuugguucuuaauuuugcagcauucaggacauuaaauaagucauuugcugucaccauccuuucaaaaaaaggacauuuuaucauagggaggccguaacaucagaauugcccuacagauucaaaacuggcuuucugagaaccucacuauaugguuuuuuauuguuucucagaggauuuggugauaucuuugccaccaagugacacuugaaagcagcugggcucuccaggaucagcuagagaauuugaggcccauuucaauuuuuaucaagaauuugaggcugggcgcaguggcucacaccuguaagcccagcacugugggaggcugagacagguggaucaccugaggucaggaguucgagaccagcuuaaccaauauggugaaaccccgucucuacuaaaaauacaaaaauuacccaagcaugguggcaugugccuguaaucccagcuacccaggaggcuaagacaggagaauugguugaacccgggaggcagagguuccagugagccgagaucaggccacugcacuccagccugagcaauagagcaagacuccaucucaaaaaacaauaaaaaagaaucucaagaugguaagagcagaaccgagcaugggccccuucugagcacugggccuuugcaaccguagagauccacacccaugcagccagcguuggacuaggagaccccugaggcccccuccgugccccucuucuaagguuccuuucucaccaagaagcucagcagagaguuuugauuuugcauuaucaaagucagugacauugagcaaguuaaacucugugucgaugguagaaaauaaaacaucugaccaguuucugccuccugaucccauuagugauagguuuggugauuuuaaugaaagaauuucacuuagcuuguuaaauaauaaugcuuuccuuacucuggagaauuaauuuauguauucaugaugaaucauucucaucagcuucccagcuacacagccaaacuuaggggggaaaaacaccuaguggguguauagauuugacucugauauuuuuauuguuuuucagguuaagauuaguugaggccggaugcaguggcucacaccugcaaucccagcacuuuggguggccgaggugggcagaucaguugagaucaggaguucaagaucagccugcccaacauggugaaaccucgucucuacuaaaaauacaaaaaagauuagccagacgugguguggugcacacccauugucccaacuacuugggaggcugaggcaggagaaucgcuuaagcccaggaagcggaggcugcagugagccgagaucgugucacugcacuccacccugggcaacacaguaagauucccucucaagaaaaaaaaaaaaaaaaauuaguugagaaagaaaacccaacuguugugcauuuguuggauuuucucuggaaacgccauccagucuguaauaaaauuucaguugucauuacccuggauggaauucaucuuggcuggagugaguggcuucaugcagggcaaccccacugcaaagaaugugagcaucagcuaggcugacacagggguccgcagacccaggccccucauuccaucaguuucuuucagcauguuuccauguuuucauauuuugaaaaaagucaaaauccaaauugauuuucaauguguuucccuuugguuauuccccacucccaugccuguccucucuuaaaaucucuguuguugguacuguuuguuuuuggcuguuggaacuguugugaucccccaccacaagcagauuaaaagguauaccacauuaagaagacuccuuauuguuccaaagcaaugguccuaugucuuuaaacaauaauauuaccacaggccgcaguucuuaaagccacuuggcaguuuuuauuggaagccuacuuggaguucucugcagcuuuuucugaaugugucgccgugucauagccugcgaccuucucuuucucagguuugacagccacuuagccagcaaaucccugagaagccaccggccugaacugggcccucugcagucacuccggccuguccccgccucuuccgugugagaagagccuuggcuguuccucucccugguguuuaaagggcgucggugcacguacagcgagggcuuacauccacuuuacgggauccggagcggaggaaaagggccauuucucuucccuuaucuguuuaugaugcgauauguuccaaagccgaucacaucagccgcuguuauggugaacggaauucacugugauggcggcugcaccagcagagccgccgugggcuucaugccacguuacgcggagucuaggacggccucaccccgcuggcucgggcucccucucacuggguacacauuuaucgggauuuaugcuuuaaaacaguaguucacauuuuuucuaauggugaaguacagaaacuuccauucugugugugacuagcauggcuuagcuauguuucugugcaaacauacucacacacaguuuccaaaugaagucacaaacuucccuuauaaaacuuccuuugaggcugggcccgguggcucaugccuauaaucccagcaauuugggaggcugaggcaggcagaucucuugaggccaggauuucgugacuagccuggccaacauggugaaaccccgucucuacuaaaaauacaaaaauuaggccgggcgcgguggcucacgccuguaaucccagcacuuugggaggccaaggcgggcggaucacaaggucaggagaucgagaccauccuggcuaacacggugaaacccuguuucuacuaaaaauacaaaaaauuagccgggcgugguggcgggugccugugguccgagccacucaggaggcagaggcaaggagaauggcgugaacccgggaggcagagcuugcauugaggcgagaucaugccacugcacuccagccugggcgacagagcgagacuccaucucaaaaaaaaaaaaaaaaaaaaguuagcugggugugguggcucaugccuguaaucccagcuacucaggagacugaggcaggagaaucacuugaacccgggaugcagagguugcagugagcugagaucgcgucauugcacuccagccugggcgacagagugagagacuguuaaaaaaaaaaaaaaaagaaagaaagaaagaaaacuuccuuugagcagaauaauaaaggugccuguguuaaaugccgaguggguaaaacacgucugcaaguggagaauggcaggaaggggcucagagacacaaugagacuuugugaguuaagggggugucacuggcgauuuuuccuguaaacgucccguguuuuguuguguuguuuuacaacagauuagaaaaugguggggaaauacuaaaaauaaaaauauguccggcugcuucuggaacauucuggauguuuugccuuucgcuaauaguguaacuuuuuuuucaaaagucauugucuuaaaagacuucaaaauugcuuucuguucucccaccgcaagcccccgccccaccucuuggcucugccuauccccuccccuccgggguuucugcccaccccccacccccaggccuggccuccugggugccacaucuccagggcccgacccauuaauggccugcauucugaccgugacucccagaagacucagcccccugcacagcgccuccucccugcuccagacagcacaugugucguggaggggucucccucaccaaaaccagcaccucugucccguuccauccuccggccucaccuccgcccacugccucccagaaaaaggaaaaaucucuacaccgaggucacuggucagucaccccgggugccaagcucugcuguuucuaaaggcauggucccacccauuggucacaagcccugagcacccaguuuggggcauguuagcccccaagggggcagcugggcuggcugguccucauuuuguucacagccugugcagucugacccugcugggccacuccccgccccccaccucagcacaggcuccaucuuuuucuccugggccccuuguuuguuugucuuucuuuuuucuuuucuuuucuuuucuuuuuuuucuuucuuuucucuuuuuccuuucuuuccuuucuuucuuucuuuucuucuuuuuuuucccccugagacagagucuugcuguguuguccagagccggagugcaauggcguggucucggcucacaguaaccuccaccuccuggguucaagcaguucuccugccucagccucccaaguagcugggauuauaggcacccaccaccacaccuggcuaaauuuuuguauuuaguagaguugggguuucaccauguuggucaggcuggucucgaacuccugaccucguggucugccaaccucggccucccaaagugcugagauuacaggcgugagcgacaugcccagccucuccugggccccuucuaggcaccccgccauccugucuggcuccuguccccacccugcccugugcguuuaccaagggcugacccaggcauugagccacaugcacaaccgccuuacguccuuacuaugucccugagauguggaggguuuuauccccuuuuugcggguagggaaauugaauauucaaacccaggccugcagcaaugugaaaccuuagguacuucccacuugcauuuagguggggggccuugggcagugggucugccccaggagccccgcaaggcgggaggccuguguaaaggccugcaggaagaggcugagggcccgcuccagcagccggggcgcugguagggccaggccuguuggcugcugugagagauacgccaccaggccaggcugacaugggcaguuccaguuucccaaggcaguccagccuccagcacuccauccuguuccauccccagugcccucugacugcacggggcugagaagucccccagcggugcuccuagacagguggagaccucaauccugcagccucaucaaaugacuccccaacagggguggauccugccccucgaccagcaccugugcugucugccccucacaaaauccuugucccuucucagauuccuugggggcacagggcugugagggucaggaccaccaucagaaucccuuacaaagccacagcccucuggccucuuagagaauccaacuuggguuacaaagacaagcgugcacaggccaggcgcgguggcucaugccuguaaugccagcacuuugggaggccaagguggguggaucacaagggcaggaggucaagucuagccuggccaacauggugaaaccccgucucuaccaaaaauacaaaaauuagcugggcauggugaugcgugccuguaaucccagcuacucgggaggcugaggcaggcaggagaaucgcuugaaccgggacccgggaggcggagguagcagugagcccaaguucaugccacugcacugcagccugggcuacagagcgagacucugucucaaggaaaaaaaaaaggacuagcgugcacagagcccucgagguaccagagcagagcuguggaugcccgucuaagccugugcccauagcucugacuggauuucaccaacuccacucuggcagguuagcaucaggagagacacuguccuggcugcugggugggaagauaaagcugaguuccuucugucugucucggugagagaaggcacggcccucacccagggcagcagagaucagggcugacuuuccaagccagcaagacaugcauucaggcuaccuacaaggaaaagcaguuagauucgagcaaaguggugaauuggucugaauggaaaaauccaaaacaucccacuuuaagaacccugcaugcacacagucuugcgucaacuucaguuuuaacacgauagccagguaagggggaaagaugggcggagcgggggaccaaggacagagaggaagacaaaggcucugugagcugugccugcuguaacaaaauacacaacagaaaguauuccucacacuucugaggaaugggaaguccaaggucaagguguuggcugauucauuucuggugaggggccucuuccuggcuuauagacagaugccucuugcaguguccucauguggaggagagaggagaggggcaucucucgugucuuuuuuuuuuuuuuuuuuuuuuugagacacagucucgcucugucacccaggcugcagugcaguggcgugaacucggcucacugcaaccuccgccucccggguucacaccauucucccgcguucacgccauucucccgcguucacgccauucucccaccucagccucccgaguagcugggacuacaggcgcccgccaccaugcccggcugauuuuguuuuuguauuuuuaguagagacgggguuucaccauguuagccaggguggucucgaucuccugaccucaugauccacccuccucggccucccaaagugcugggauuacaggcgugagccaucgugcccggccccucuugugccucuucuuauaagagugagaaucccauucaugggagucuacucuccugaccuaaucaccucccagagguccugucaccaaacaccaucacacaggggguuagggcuucagcgacugacuuuccggagcacacacacaccagugcuccuguugccccucccagggacaccuugcauugcagcaaaucacuguuuucuggcugcccuuggcuggcuggcuggcagccuuuggggcccuaggcaucaggaugucugcucuguuuguuugccaauuucaaagcacauaccggaaucaguguggcuggagcuggagaggaccuugguuuuagaacuuugauugaagccuaaggaccguugguccaucugcagagcagcagugaccaagccucucuuggccuuuccuagcaugucauccaagccugagugggaagcggauguccauaugcagcucaccagagccggccuaaggaggguugaugugcaggcacugcggcagcgcacagggcucaggaccccugggcgggcaccugugugccacccgggcugucgugugcgugacucggcuagccccugcccucugugugaugggcaccacacuucuuccagccuuguggcaucccaaguaggcagugaaaagcuucgagaagggugggcucugggggccaugcugggauuccaggaacccgagaauucacguaagccaauucuuucauucugggcucccaugaaugcauuuggagaagguggcuggagucacgcacagccagcuggugggcagggcucucugcaggccaugggcucauuuucccaccugcguaagucacggugcuggugguagcaggauggggucugcaggucucgcaggaguaggucaagaggaccaggcaaggucuggcuuccugauggggacccaggagagagaagccaagaaccccugcugccuccuuacccaacugcauaucacagagugugcugggccccguggagguggcugcagucuacaaggggguggcugcccuggccuauggugcauuuuacagaugugucaacgugggaagcugggccaaggccauccugugcggaggcucaaugagagagcacccuggguagggucuggaccugcugugugggccucuugcuggcaggcagcucucuguucccgagguugcagcagcugcuuucuguccucucuuuacccguucccccccgccccacccccgccagcggauucuccugcggaaccucaaacuucagaggcagcaggccuugaaucauugagccuccagagggaaaacugaagccugggagaggguggcugcccagggccccacagccaaccauguccuugcccagagaggccugggucccuccuccucugugcugggugcuuccugagugcuuggcacaucuagacaccaaacagacccuugggucugagcugacuggguucacuagcuagccucacgcauccucccugccgggcugcugugggcugcuguccuggucccacaucuccuuuuugcgcgcuuucaugauuccucagacagucuccauagguugccucaagacucuggaagaaugagguugcauaugcacugugacuuguauccaggaauauuauccuacucaggcuggucagguacucaacaggcagggagcgcuaguggcagcaaagccacgagugccccaagucucaacccgaaccucaggcgaagguuuggggacaagacuaagcucagcucccaguaacuggcccuccccuugccucaaucccuucuggaacaacacaggcugugccagccugcacagggcagugcagaaucaggaaaaccuggcuggggccagaguacccgggcacauccucgcucuccugggccgccuggggccugcaccugccgggggaucugccagcccccauaccugcggccgggcacauuuaacugugacuugcagaaguaauaagccuaauaugguugacuuuauuuaauuaauaaugauccucuucuguuccucugcgcucauaaaacacccugcagguuggcaaaaacacucauaauauugaucagaagucaggcgggauauuuauuuugucuuugccccacuagcauaaauccuuguccacugccuccuccuccccgcaugcgggauuuacaguggccagcuucuuaaaagcauucaguaauuaaggaauaaauauccauuggccuuugugggcugugcuccgucccuccgccugacccccuagcaacgcagcucagggagaaggcaugcaugcaagggggaggcagcugucagcgcccgcucgcagugggccggggucuuccccuaccgagaaaggaagccccucucucuuccucacguauuguuccagcccccucuuccaugccuccccucccaguuccuguuuugcuugaggcaggaagcacucuggaaauuccuugcugcuagcccucuuuucucuccuuccucugcccuuccucuccuccuugucaguuucaacaccaggcgggcggguccccuccagugucugcuccucacccugaggguguuccuccacgccagcccgcucugcuacagaaucuccuugaaaaucacugccaaacuccucucccaccuguuggcgggggcagggcagcuguuuccaaaggaaagacugugacaaguggcgggcacacagacgcaaauucuucuuuuggccuuuucgcacuggaagagagaggggguuccaauaaaaaugagcacauuagacuugaccuggagugcacuuucgggaagggguguugcucaguguuuuguagacgugcucagaaagccacauuugugagauuugaaggcugaggaugaaaccaccaagagacugcuuuacagccccccagagcgccccagcccugccacacacagcggccccugugaggacugagguggacgucuggcugcccgcucucuugucugugucccguucaucucccagaccccgccacaagacagugcugaaaggcagucagaagcuuugugguuauuugcuuaaaacuuucuuuucugggaauccaacccauuaaccuuauuaccccuugacaaugugcugacccuucccugccaggaccaaaacacagcugaugguggcugugugagaccucaucuuugcagcucucaaaugcaugaggaacagagaauggggcauugcaggaagacagcauuucucucugaagguaguuguguguaggugugacucuccccgcgcucuccagguguccccagaggucuuggucuaugcuuugcucaucacugacaaggauuugccagugcauagaugacagugccaccagcagugaccaagcucaccucugggacucagcugccuggucagccugaccccgcccugccgagcaccucauucccgggcagcacuucuguuuuggguacugguaucuauaugacuugccuuuuccuuuuagugaucuccuuucucuucauucuaaaauuccaugaauuauuauucaucuuuguaauuauuauaaauauuuauaauaauaaauuauagauaguuuugauagggaagaagaggaggaaggaaaaacugagaugaucuagauccgugcauccucuguaauggcagaaguguucucgaucagcagccuuggaaauguccuagucagcggcagcgucggugcucuggaccggcagccaugggaauguccuagucggcagcagugucgguguucuagaccggcagccgugggaacguccuagucggcggcagcgucggugcucuggaccggcagccguggaaacguucuggauccgagcaucccaggguagcagcugccaaccacauacuuauguaaagcacuggaaaugugucuaaaggaacuguguuuuuaauguuauuuuguuucaauucacgucaacacccacgggcagcuuacagcugccccauuggggggcacaccucuagauucuuccucugaagcaaacccuaccuaacccuucgucagagaccagaaccaaguguuaagauggccaaagggagagcaugagaaaaugaugcuguggauccaccuagacucucaaagcccagagagucugguuguacagaugggaagauguuuccuaauuugggaggcaucagaucccugagcaagaggucagacagugccagggcagccagucugucgggugucccagcuggggacccugggcaguguucuguaucacugaccuucuccucuaagauggggguaagaauaggaccuuccucacuagguguuguuagaauuaaaccagguaauuguguaaaagguucagccugggcugggugcagugacucacaccuguaaucccagcacuuugggaggccaaggugggaggauugcuugaggccaggaguucaagaccaaccugggcaaacuggugaacccacugcacuccaaccugggcaacagagaaagacccugucucuaaaagaaaagaaaaagacccccuucucuacaaaaaaaaaaaaauugaaaauuagcugggcguggugaugugcaccuguaguuccaccuacuugggaggcugaggcaggaggaugacuugagcccgggaguuccagacugcagugagcuaugauugcgccacugcacucuagucugggugauaaagccagacccugucucaaaaaauaaaaaagccucaagucagugguuggcacauugcaaauacuugauaagcauuggcugugaacauuacugauacuuuuccuagucugcauaacagaguuugucuaauagugacucuacauuuauauaaauauauguccaugaucaaucaccuaaaacccaccauuuggcucauguagcauuguaaauaaagauggagaaauuaugcagaaaggccuuuguuuauuauugucuuaguccucuggggcugcuauaacaaaauaccuuaaaugggguaauuuauaaacaaaagaagugucuugcucacgguucuggaggcuggaaaguccaagauagaggcaccggcagauucggugucugguuaggguucggucucugcuucauggagaauaccucauugcuacguccucacgugauagaagaggcaaaccagcccccucgggccucuuuuauaagagcacuaaaucccauuuaugagggcagggccaucaucaccuagucaccucccaaaggcucuaccucuuaauaacaucaccuuggggaguuaggauuucagcaaauggauuuggggugacacaaacacacagcagugauaaaagagcagacuuuguugauaaauccgugcagggaaggcacccucacugcaguguuuccagucacugggaugagaaagggccgaucccagcugagcgugguagugcaugccuauaggcccagcuacucaggaggcugaggugggaggauugcuugaaucccaaccuggacaauauggcaagaccccuaucucuacaaaaaaaaaaauuaugcaggcaugguggcacacgccuguaguugcaacugcucaaggggcugagguaggaggaucacuugagcccaaagcaauccagccugcucaaacccagccugggcaguauagcaagacccugucuuaaaaaaaaaaagagagagaagaagacugggcacugugucucaacacuuguaaucccagcacaaagcagguggaucacuugaguccaggaguuugagaccagccugggcaacauggugcaaccccgucucuacaaaaaguacaaaaaauuagccaagcauggugguauacaccuguauuccaagcuacuugggaggcugaguugagaggacugcuugagcccaggaguucgaggcugcagugagcccuggucaagccacugcgcuccagccuaggcaacagugcgacucuaucucaaaaaaaaaaaaaaaaaagaaaggguccaucccgguaucaggcaaugugaagugcugggaacacacagaccugcccauggcaucccccagucacuugaggacagauaaaccaucacaguugguuguugccuuuugauuggagucaucggcaguguugucacgcgacuggucuugcucaggugcauucuccagugggcacugcagugacggcucccacguggucuucccucgggcuuuuaccccaggaccuguaacaccaagacagagcccggugcagccugcaugugaugauucgcccccacccuggguccuugccacagagauugaaauaaaagcucucuggaggccaggcgugguggcucacaccuguaaucccagcacuuugggaggccgaggaggacagaucaccugagguccauaguuugagaccagccuggccaacauggcaaaagcccaucucuacuaaaaauacaaaaauuagccggacgugguggcacgugccuguaaucccagcuauucaggaggcugaggcaggagaaucgcuugaacccaggaaguggagguugcagugagccaagauugugccacugcacuccacccuggguggcacagcgacauuccaucucgaaaaaaaaaaaggaaaacgaaagaaaagcucucucuccccacaacccugacuugcacauuuucuucuguaaacauaaaugcuucucuccaucccccguucccucccuccugaucuguucuucacucugccuugguucugucgucgcuggguuggcugucuugcugucugugcagcaccugcuuucuguucacaggugcugggaguuguaugacgcugggcaaacugggagcagcgugggcaucccggcccaagcucaggggcucaggaggcaggaggcggcacucgcauucacacgcacacgcacagaacgcucucccgcucucucagucuggucccugggcagguugaaggcagcucagcauccaucuuuuuccagagaagagaacuuuggcccugcuagguugcuggccggccaccuuauggccccaggccuguccugaaggcgggggccagauugggagccccccugcuuccgcucugcagcccugucuggcugaaugguguaaaauucccuaagucuuuccuuccuucuugcuguguuucaaagaaggaaaagccgggucugucaguucuaggcucuccacuguuuuuccccuuuugaaacuugcaauaaaaucuaccugucucuucuuuccugcagccuuucuuuuuucccacgauuucccaaaauacggccaccacucugccgucacgugugcaucuuguuccacauuagauauggaguuuguuuuguuuguuuuugagacggagucucgcucuuuugcccaggcuggagugcaguggugcaaucucaacucacugcaaccuccgccucccggguucaagcaauucucugccucagcccccccgaguagcugggauuacaggcauccgccaccaugcccggcuaauuuuuguauuuuuaguagagaugggguuuuaccauguuggccaggcuggugucgaacuccugaccucgugauccacccacuucggccucccaaagugcugggauuacagucaugagccaccaugcccggcuggaguuuguuuuuuaaaauguguacaugcuugaggguguuaccaggaaugaucaauaaagucaguuacugucauccuuaagcccacacuaagugcuccgguuacauggagauuacaccuugccagcugagucaugcaguggauuuggcauggcaggcacuaaguaugcggguagcagguggggaguguccaagagaauugucuuugggauggacacagggaagccaccuuggccaagucaccaccccucaaggucaggugcggcaaagcccgucaggcagcaaugcuagagugucugucuccgagcuggcagaccccgaaaaauccagaggguucacggcuccugcaaccuacccagugauuccuauguccugugcucagugccuggcugucccuguggauggcuuccugucauggcccagagagagguaaagagccaccuuuaccucuucuuuuaggcaggaagagaagcaaauauaaaauacgauggcgccugaaauguaccuuuucuuuuuauuuuggggauugggucagugccuuucuucugaugagucgcccauucccucauuuucccucacucuccugcggcugauuuauuuaaaggugugucagcaccacaucaaaugaggaacugggcccccuccuuucugcugacggccggccgcgccaauaauucauuuuuuagcucauuagcuaacggaggcugugaacggugauccucccggggauuggaaugaggggaggugaucuacugccggcugccugcucuugaacuggccuuccuuggggaaaaugaaaggcucagccaagacaagccagggaucccagaaguagaauugcggccuccgagugaccauuugagucugugugcuuugacaucauggcuucuuagggcaaaugccucuagacggaauagucucaucgagaagaagccauugucagcgugucccuuggucauaugugacuugcguauggagacgcuagugagaaagaugaaggaugcuauccagaguaugugucagcucaggcugccaaaauaaaguauuacacuuggguggcuuaagugcgggacauucacgucucacaguucuggaggcuggaagucuggagucagggugcccgcaggguugguucuggugagaccucucucccuggcugacagauggugccuucucccuguguccugccuuuccuccgggugugcucagagggagagagacaucaccagugucucguccucuuauacgggcaccuggcuuauugaauuagggcucuaucuuuauagcaucauuuaaccuuaauucucuuccugaagaccccaucuccacauacagcaacauugaggguuaaagcuucagcaugugaauuuuaugggauacgacucagccucuaacauccaagaagcccuuaaacaucucaaggcuaugggcaggagccaaccagauguugcuccugcaacucugacagcuaugaggucauuuaaaccagccagacuccuucuuaccccagagucucaggauccucugcacccucgggggagcucacaagaugccagcaggcuuggcaagaccucuggccaagagcauccccccuaccaugcugagcaugaggaguugcgugaagcucguauguacacacagccgugauuuagaagccucccgugcccagcaggccuucgguacccgcggccccgugccaccagcacuucccccacacgugccgcuuccacgggugagcuccugugugcucacauaacauugaauuaucagagagguuguuuucuucagucgugacagccgcuguuugcaggggaaccacuguggccauggugucauccaaaugcgugaucccaaaucccaaaacagcccugccuuguguagaugucacuguccucauuugacagaugaggaaaagaggguccaagaaguuauuagaaaggcgaacgucuacaccacuaagucgagaaaaggcacauaagccacagucucucuaaugcuuaagagugcagccugugagcuuaguguugguggggagauuggcuuuucccugccuuugggcauugcagaaaguacagggagcuaagcuuucccccugguaucuggaugggagcauccacaggagguggccuucaagucacagcagguggcugacaugcauuaguuugcugaaguagcaccaaaaaacccagugcccuugucugaguccuguuuucauacuagugaaauuucagcugcuaacaagaaucacgucugaugcagacacaaagcccaguggcugccccaacucccuggccaccuccuacuguccgagaaaacacugaaauauagcagucccaaaggacucagaagucagcauugaaagcuucuguuuuuguuuuguuuuguuuagacagagucucgcucugucacccaggcuggagugcaguggcgcaaucuuggcucacugcaaccucugccugcuggauccaagcgauucuccugccucagccuccugaguagcuaggacuacaggugugugccaccaugccaggcugauuuuuguauuuuuaguagagacggguuuucacuauguuggccaggcuggucucaaacuccagaccucagguggcccgcccagccucggccucccggagugugaggauuacaggcaugagccacugcaccuggcugcaaacuuuuguuuuuuuguuugugaaauggaguuucacucuuguuacccaggcuggagugcaauggcgcaaucuuggcucacugcauccuccacccuccacaagguucaagcaauucuccuaucucagccucccuuuuguggguuucgggcccacaaaaccuggaccuaccuuuuauuacauaguuuaaacaaugcugauuuuuuuuccauaaguuauugggguacaggugguauuugguuaauuaaguucuuuuuuuuuugagagagaguuuugcucugucgcccacgcuggagugcagugacgcagucuuggcucacugcaaccucugccuccuggauucaagcaauucuccugcaucagccuccugaguagcugggauuacaggcaccugccaccacaccggcuaauuuuuguauuuuuaguagagacaggguuucaccauguuggccaggcuggucucaaacuccugaccucaagagaaccacccaccacggccucccaaagugcugagauuacaggcauaagccaccacggccagccaugaguaaauucuuuaguggugauuugugagaucuuggugcacccaucacccgagcacuauauacugcacccuauuuguagucuuuuaucccucgccccccucccacucuuccccccaaguccccaaaguccguuguaucauucuuacaccuuuuauguccccauagcuuagcucccacguaucagugagaacaugcgauguuuggcuuuccauucuugaguuacuuuccuuagaauaauagucuccagucucauuggaggucccugcaaaugcuguuaacccauuccuuuuuauggcuguguuguauuccgucguauauguauauacaccacaguuucuuuauccacuuguugauugauggccauugggguagguuccacaauuuugcaguugugaauugugcugcuauaaacguguguguaaguaucuuuuucaaauaaugacuucuuuuccucugaguggguacaguagugugauugcuggaucaaauggcaguucuacuuucaguucuuuaaggaaucuccacacuguuuuccauagcggcuguacuaguuuacauucccaccagcagcguagaaguguucccuguacaccacauccacgccaacaucuaccguuuuuagauuuuuugauuauggccauucuugaaggaugaaggugguaucaacaaugcugauuuuuaaaaguaaagaacagcucauucaaauguguaucagcuugucaguucggaugagguugccuaugaggugagaugugaggacagagaaucacuccagcaguucccggggagaacauacugacacagcgaaggguucaggagccgcagguucguacucauucuuuggcuggggugugggaauauuaaaaagaaauugaauacuugcaguuagcacuguagcuacuaguucaguuaugugguuuaucccugggugauuuggcaaugacuauuaaagucaaucggagcggaaucaaauaguugugggauuuuaaugucuaccaaaaaaugagaguuagcaaauuggaacuggaaaaucuggacgcauccuucaccgucaucccuuuucauuuaauugacguuuugcuccuucucuuuugugauuuaugaaaugcaucaacaaacguuuaauacauuuuaaauaaggccuuuaaaauaguaucagaacugcuucuuuuugucugucuccugaacccguauuucccagacauugucagugcuuuugugcuuguguuuuugcccgaguggggugcaggggcugccuccgcugcauuugugggggccggugucaguucucagcuguagccaaguguuuguccuggaaaucuccaaaugaaaagagucgggggucacucuggggucacucacauguaccaggaagugaagcaaaacuaauccagauuuacuccuggaagaauuuguuugccuuaguauuuaaaaacagauuagggcuaacccgacacuagaucacuaggugcaauguaaacacggguaaaagguguaaacaaggccuuuccucuguacuucggaagcagaaaugucauggguaaugaguuuucuuucuagacuuucgcggaagcccugagugauuucuccgugucauuuguaacuguguacucugauuauuccccuggagaaaccugaauuuuggagagggcgauugugaaucagugcguuauuaaagucucuauggguaacugcagucccuucuuacauguagggcuuuucuuucuuuucuuuuucuuuuuuuuuuuuuuuuuuucgagauggagucucauucuguuacccaggcuggagugcaguggcgcaaucucagcucacugcaaccucugccucccggguucaagccauucuccuaccucggcuucccgaguagcugggauuacaggcgccugccaccacaccggcuaauuuuuguauuuuuaguagagacaggguuucaccauguuggccaagcuggucucgaacuccugaccucaggugauccacccaccucggccucccaaagugcugggauuacaggcaugagccacugcgcccagccucuuuucuuugucauccucaucaaaaaggcaggcagggagcacuucccuggcugggcuuggcuccugggauccuuguaaaauuucaagagcuacuuguaaaaucucacacuguucuuuguaaauuucuugucccccaccacccuaccuuuuuuuuuccccucuagcggugcugcagagucuugaguuuucaguaucugucacgcucuuuuuugagaaaccagaaaccaucaucaguagccacaaaguacaggagcugcucgccugggguccuuccuuugggucaacauaaacaugccuuacuguugguuuccucuucuauuuguuaagcuucucaucucauccuguccucuccuucuuagcccuccccacagauguguagcaggguccccauccucuguagaccccccaggaggagaccauguauuacacuggccaggucgggcagccccaucucagccagguugugaugcuggggccggggcgggcaggcaucagcaucauccacucuccacaccuccgaccccauccacccccuccccagcuuuguccucuccucugccucugggcucagcucuggcuucugggagcuaccugccuguuucccaggcccuggaacaguuucccccaaaaaacucagccauuccugacauucuguccuuuccacuuaagccuuccccaaguaucuggagauuccaaaagcugcaucucccugcuaaaccuccucauuggagucuccacccucuccugcgugagucuguugccauguuuuccucagcugaaaggguuuggagacccuggggaguccacacacacccccuauuucggaguuugaagcuaaaagcacauggucacccccagguguggggagcgcaccggcugucccuuccccccacccccggcccagcuccagccaaguguccuauagcccucacuuacaguccugcuuacaguaaagcaacucucggccccagagaccaugcuuccaucgugcgguccgugcucucggccccggagaccgugcuuccaucgugcuggucccaggcaguagggugguuuccccugugcaucggugugugagagccacugauccaaggccauggccuugagcccucacuugguaguuuucuuuccaaggacagcuucuacacuaaaagugacagaagcagcaccaaggcaguguaugagccugagaucagcggcucucacaccuugggccuauuggaauccccugcagggcuucuuaaaacaccccgagagguuuggauucagggggucuggggcgugaccugagaaucugcauuucugggcugaugcugcuggugaggauacuguuuugugaagguggauaaacguuucccccagggggcuuugugccgagugaagaccuuugcuuucuguuauuucacuucccucucggcuucucccgaccacacugggcaggggcuggcagccuguguucucgggccugaucgugacugcaccugucugguggcucuuugcagggaagagaaggaacgguggauccgugccaaguacgagcagaagcucuuccuggccccgcugcccugcacggagcugucccugggccagcaccugcugcgggccaccgccgacgaggaccugcggacggccauccugcugcuggcacacggcucccgggacgaggugaacgagaccugcggggagggagacggccgcacggcgcugcaucuggccugccgcaaggggaaugugguccuggcgcagcuccugaucuggguagguggucggcacgccuggcagaggacggggccacaggaggcacucucugcuuuguucugcuuccgugggcaucuuucuggcagaaggcuguuguucucgaucugcaaguggaaacaguuccuaaugggaaacucugauugaagagcagagggccuuacggagagacagccgguccuccuuguacaguacuugcuagaguuucugaaaauugcaacuuugugauugccccuuaucaagcaggguuggugcuaucccucuuuuuucauuuccaucaucuucuggagagaaggcgguguauuaacgggauggcuuguaggguuuccccauuuccaaaccuuugguguuuuuauucacuuaacacagaaauacuggacccuaaacuuugaggucugauguggcaggaguuugucaaaggacuucuuucgaaccauucugauuaauuucuacuggggaaaaguauuauuuacauuccuauugaagcaugugucacaaugcuugaaggagugaaagagaaggauaaagugguugugcagagaggcccugccugugccacccaggagcuacgucugagaagccacgcccacuuaggggcugccuguggaccccuggggcuucugcugaggcagguucccaccagaggcaggcagaaagcugccggcagggaggcuccccagauagggaaggcaagugugugcccagaaguggagacagcacccagaggugggacacccagcuggaggcucuucugucuccacccgcaaggcaggaugggucaguccagcacagcagcacguucuacagcagcauggguagagugcagcagguuucugcauguuuuugaucugacuuuuuuguuuuuuguuuuuuugagacagagucucgcucugucacccaggcuggagugcaguggugcgaucucagcucacugcaaccuccgccucccagguucaagcaauucuccugccucagccucccaggaagcugggauuacaggugcgcaccaccacgcccagcuaauuuuuguauuuuuaguagagacggggcuucaccauguuggucagucuggucucgagcuccugaccucgugauccacccgccucggccucccaaagugcugggaguacaggcaugacccaccacgcccagccuugaucugacuuuuuugaugggugcaguuggugaaugagugagauauagacacuacaccaaaaucacacagauacucccuuuugcucaugagucauacaugugauguaaugcacauuaaauaagaguuguguguagugugcuagggcugccauaacaaaauaccacagacaggggugcuucaacaacagacauuuauuuuuucacaguucuggaggcuggaaguacaagaucaaagggccagcaggaaugguuccuggcgaggccucucucacggcugguagacggccgcccucucccuauguucucacagggccuuuccucugcacucgcuccugguagcucucuccuuuccccccacccccuucuuuuugggacaaagucuugcucugucguccaggcuggagugcaguggcacaaucauagcccacuguaaccucaaacuccugggcucaagcaauccccccacccuagccucccaaguaauugggaccacaggcaugccacccccaugaauggcaguuuuuaaaaaauuuuguagacuuacguucuuaccauauugcccauggguuuugaacuccugccuuuaagcaguccucucaccucggccucccaagguguugagauuacagguaucagccucccagcccagccuuuuccucuucucauauagauacuaacccuauugugaccucauuuaagcuaauacaccaccauaaaggcucugucuccaaauacagucacauucuaaaguacugggugucaggacuuaaacaugugaauuguuggugggagcgggggacacaguuauaaauuacaggccaucuuugcuucuccaauugagcaaaaauuccuuugauggcgcugguuccaugcuguugaguggccucagacucccacacauugugaguuggcagaaguggaagugaauucacucuuuuucaugagcaaaaagcuuaaaaacguuguguacuuuaaccucauauuuucccccuucugaucaucacucuaauaaucaaucacagauccuaagaaagauucuaugugaggacauacauccgggcacuguuucuuccagugacaauuuuuuuuuuuuuuuuuuuugagacagagucucacucugucucccgggcuggagugcaguggcacgaucucggcucacugcaaccucugccucccggguucaagcaauucuccugccucagccuccugacacuagcugggauuacaagcguacaccaccaugcccagauaauuucuguauuuuuaguagagacgagguuucaccauguuggucagucuggucucaaacuccugaccuugugauccgcccuccucggccucccaaagugcugggauuccaggcaugagccaccguguccggcuccagugacaauuuuuacaaagugugcacaguugaggggagaguucugaauucuguucaugugguggaauacuguaugacuugcauaugucaugcuuuuugagggguggggagacagggucucacucuguugcccaggcuggagugcaguggugugaugucggcccacggcagccucugccuccuaggcucaagcgauccucccaccucagccuccugcauagcugggaccacaggcauaugccacgugcccagcuaauuuuuuuaaaauguguuuuuuucuagagacagggucucccaguauugcucaggcuagucuugaacuccugggcugaagugaaccaccgcacccagcuuguguugugcuucugaguaauuuuuaaugauguaagaaaaugaucacaguauaguaaucaauaaaaaaugaaaaaaauacaaauuauuuguacagucuuaucucaauuauguacauauacauguagauucaaagaaaacucauugaaaggaaauacacuaauucacaaagguuaucucuaaguaguaagauuaugggugauuuuuuuucuucuugagcuguuauguguuauuuguguauuuccuauaaugaaaauucugagaucaaaacaaugauuuucuuugugcaauuggaaagucaaaauagaaacagcaaaacuaaaguuaucuuugauuccuuaauguugcacaaaggaggggcuuucaguugaaaaaaaaagacauguucuuuccuuaaaagaauccgcuggccacgggugcaggcugugccaccagcacuggaugguccuggcaccccagccaguuguguagcuggccccgcuguccaagcacaagccacaugcaagggcugagagaaagcuucccugcccccucccuccaucacaucccccaugauacuaaugugggcucccuuaccuccgcaguacggaguggacgucacggcccgagaugcccacgggaacacagcucuggccuacgcccggcaggccuccagccaggagugcaucgacgugcugcugcaguacggcugccccgacgagcgcuucgugcucauggccaccccuaaccuguccaggagaaacaauaaccggaacaacagcagugggagggugcccaccaucaucugaggaacagccgugcccgccugcucgccgcaccugggacgcggcagccucgccgcauucucgcucagaagucgcagcacgugagucccgucgcauccccucccucuuccugguggccaccucccucccgcccacccacucucaccccaaacaaaaucacaaaaccuggacaucccucaaggggcgaagaggcggccgggagacugcagaaguggcuccuuuucauaaacuccccuaaaccacacacaggagagagcgacgggccucggcccuuugaugauagcacauggcgcaggacccuuguccugguggcacaagggauggggacgcgagggggaggggaggcgaggaacaaggagaaggggcaacuuuccuuaacuggcaguugagcacauaguacauuuccccucuaccaaacggaacacuuggauuccaucucuucucugaggagcucgacggcauaaaucagaagcaagcacagaguuugucagguuugaagccccuaugauggugugugucaaaucaguuguagcuaaucuguccagggagaauacuggcuucauuacacuuguacagccgaguucuucccgcauuacugcuguuuaauagaacgugauuagucaucgccgagaagaaagcauauuagccgaggagguagucacgcggcacgcgccggugauugccacgaugugauugcaauacucuuagaagcaccauauuaucccagacauguucuuucaagcccuuggagcccucucuaaauucacugucaucauuuaguaucuguuuaauuuuucaguccaaagagaggaaaucagucgcugaguauuauuugacuccggucuccuuggugcaaaaacaaaaugggaaaaauaaauaagaauaacucagaaacucaaaaggaaaccacaaauucagcuaauaauagcauuucgaguauauuucguaaacuaaggaaauacacaaaaggcuguuuuuuccgacuguaagagauauuugauguccuuuugccgagguggauguguuagucucaggcccuccuggaccacguugcccaagucacacaggcuucuguguuauguauuuagauaagaugugugaaaauauauuugaauaaaagaaguucauaaauaugcauugauuuuuguacagacaaauggcaccucucuuaauuuauaaauugaacuggaugugaacuaauaaugugcaacuaguugagauaagaggguuacagaucauuguacauggaaaauauucccagcaguaaacacuuccauuaaugugaucuacggcuuuugaaaaggagcaucucagaauaagauggugguacaauuugcuuauuaaaauugagaaagaaaaaaaaagacacacuggaguauauuagaaaggaaaaagaaggaauguggucucucaugauugaaagcaugauuuagaucggauacggcuuuugcuaaccaaggaccaagggacucuggcaagauggggugguuuuccgaaugccagaccgaggugccuuacgaaggcagcugccaaugguucuguggcacagacuggcuccugagaacccagacgaccuugaccuggcagcccggcccuccacgcuaguaccucgccugauuuuccaucguugcgguauccagccgcuucagacguccgccgccuucaguggugguagucaaauguagucaaccaaaccacagcaucccuuagguuaaaagcaaacggggcagcuuugccuagagcucauugacagugugauggggggagaaggguugucacaauggaagaugaggacacuagacucauguagcacagaaacaugaagccacacgcaccggcagccuccgggguguuccucgcucucucguauguuaaaccuuauauuuuauaagaguuuuuccucuuauuucacuuuuuaaaaaaaauuaaaguagguggggaaaaaaauaaagcuuuacacagaauuuauauguggguaaguguuucauggaaauuucuaaucuuaacgaagcuaaguggagcucacucguauccaaaaguauaacaggugcagaagccacaagucugagaaccuugacgacaguuccaucguccugccauuugauuuuucagucugcguuucaucacuguguagcuauuguaaaugugaauagaaaaaaacaggucauugccuauuuuugaagaacgcguugguguucgaguccacuagacacacucgcuccacacagccuucaccguagacucuguaguggacacagauauagcauaaaugaaauuguuaaauuauuucauuguaguuaauucccacuauaggaaugcuuuaucauagugaaguuucuuuugagaagaaacggaacuccuugaggcuucucuuugggauguauaugagcguguacauauuauucuauguguuuauaauauaauauuuucccaaaugacuucuuguuucacuuugccuuccacaaccugaaugccagauugguuuuuucccuuccuggcccccagcacaagcugccaugacucccccucagaaaacacagccccuccucuaccauucucagugauguccaucugcuccacuccgcagccacuuucuagggcccaaguuuugguagcagaaggaaaggcaguuuuugagggucuuucgaaaaaaagaagacggggcagcuuugcccagagcucguuggcagucuguuuguauuucagugucuaaccagaaguccuuucuuugcggaccgcacucucguucccacuuucaagcuaauuaccaccaaggcugggagaggcaaggacugggggcggagcuaggaauaacucguuugagaaggggguggaguuuucguuguucauuuccauguucaguucugugacgugacgaugacagaucaccacugcaggaucccccucaccuuuccuguucagaauuaaaacucucccuugaugagaaacagccagcugagggaggcccacgagcggccuguguaaccccaugggugaucuggacacaucugcacccccgcguucagcuucgcggagacugaacuuggcggggaguggagggguguggugcagaccuggcugcagcagaaacaccccgcagggacaguacucugugauucugaccucaggugcugggacgggcagaugguuucccccgcccagcaccccaguccuggucccuggucccucucucuguuucaucccaggaaaugagcagcucgagggugagcaagugacaaguuccugagucacuggccccaaaaccaggugcaguguccugucucccaagugugugcacaauguauauaugcacuggaaaggagggagaaggcagcgggucacucgccaaucgcaggguucucagacacaggagagagcgggaucuuaaugaauugcauuuccugcagagccucuagugcacaggccaguucucggcaguggcuuuucagcacaagggccuugcauugaagcucccucuucugagauuucacccagccugaugaggccugcaugguuccggccucgucauccaguguagauaccagucuuccuauuuuugugacaucugcacauuuggggucauucccuauaucugcauaggagcuauugcuaaccuuguuagggagaaacauggucuaaugagaaagacagaccccuaggcucagcuggcccugccauccuuccagaggauuccucugcaacucuaggcaagcacccagcuuccugggcucuuuuuccucaucugugaaacuugcagggugcagugagguuucaaaccagugugauaaguguuggccucacaccuggcccaggggaugcugggagaacaggagcacuuguuaauaacagaaacacugaugggaccgaagccagugcacacaccaggaaaccugcccguggcugacacuguccuccagccugcauucuggggaggcugugaugggcacguuugccaaccccccccccccaguagagcccaggacccuccucucucagcuugccagugcccugcccuccacauggcggggaacagcaucaaugagguccuugcucccugagagccucucuggaaccugcccacuuuucucaacauguauauucugcuuuguagucugagguugauuuucuagaggcgaggaaggggcugaguucugcccucgugcuguucgcuggugcugaucagggccaagacgacccuucccucucccccacagccuguugaggugccguugacguggacagcgccccucccuuaagaugcccccuugccguugccaugagccgcugugacucacgcgugcacugggccuugcuuggugcuccccuccuccuccugucugagaucggagcuugcuggagagcaccccaggucgccgugcuuggcugcaggcccgucccucucuccccauccucggguucccagcguguuuugugcuugaacuugguggacucaucuuaccccacaagaguggccugcucaaccugcagccuccaaugugccguaggcgcucuagguccccguggcgcccaggacaccaacucucccucccugcacuuaggauguucuggaaaugagaggaaauccacauuccugccccaggaggugggaagccuggcaacgauguagcuuccccugagaugcgguaugaucaggccucagcaacuacucaggaggcaaagguguuuggaaagcaaaccccaaaccucccggcacggcaugugcucugcuuccgucccucaccgccugcacaaggucguugagacuuuucuagaacuccccgggguuguauuuauggccuucaagcaaacaaauugaaaagcagucaaggaggaguucagauagaaaagugcuggagauacacaucuuuccuucaaaggaaauguaauuuauuuccaaccgcugccucagacggggguuucacauguugugaagucacaucuugaaugacugucacccucauccuuccccaaaaagcuaaauaagggccuuuggcaucaaugcgugcauucuccaccuuuccgcggcuugcgcuuggauuucugaguggcuuucuucagggagcccuuguggucaugugucuuuaaugcugcuccccaugcccccaggccaggccagcacgcucaggugauagcgaguggggccaggagaccccccugcccugcccaguggacagaucugccccagcccugcuguggggacgggcccucuaucauuuaaccacauacauuagguugcuuuucagcaaaaugucagcuuuccucccauuaugcaggagagagaaggggcgcagguguaucuccuuagaguacaccuuggagcuggaucacuaagaaacaguccucagacugguccuuccgacacaggcagagagugaacuggaucgcuggccccugggaugcugcgcugucugugauuagagagaaguggccagugucccgucugugauuagacagaaaccccuguggcagacuccuccccucuccaugaagaaagaaauauuuacuuagauauuacuguuucaaaacacaaacuuuauuccccuuagagaagaaauacugcccuuaaauagacuguugaaauauuaauggcccccccauuuaaucagugugucugcggcuuucuucgcgucacauguccgcauuggcaggugauucuggaaagggauucugggaaaccaacaagucuuuuuuaaaucuuugaguuguaugagaaaguauuuaaguucaccaguguaguaaacacccaccccagagcagcgguaagcaaaccuaaaucugaaaacccauucuuacugucuuucaccaugagaugcugguuuugguguaaaaugacagcacuugguuugggguuuugcaccuguuggguagaacuguucuugucugagguccucacccucuacagaugggccucagggccuggaggugggcagauggggccagaguggccagcagagacuugcaugggcucugaaagccccagagcucaggccuaaggcugcuaggugagaccagcaggcagcuguggcauccgaccuugggacgcccaagcugggcagccgcuccaugugccccaaacaggauauccucaugaaugugaggagaggcuggcucagggcuugguuuucauuuuggccuggcacaggguaccuguagggagcacucccccaaccugaggauggugaaaccauaugauagagacuccuugucgaaguccacaucggacugaucuagaaugccccguggggggauugcauggccuuugccuugagaugcaggugaaagaaaggaaccaaacaaggcaugaguguguuggggaaucuucccaguggagcaaacccccuuaacacaccagcuguugggaacagcugccccuaaauccaauuaaacccucaucucccuggugcugaacagucuacacuggcccaggaagcuaacgucugagccgcuuggagagcuuugguaaacagaagacacuggaagcccacucggucagcagcugggcaugaggaugucaggggccuuuggacuugaggaaggacaguccaggugcauggaauccuaaugggccucaugcagacacuggaagcagcccagcccccugcccaauaccacagcccugggguguccccugacauuccuggaggucccugggcaaaugcauuuccugccuggguucucaggguaggagaacagagaaggcuccaaggguguugggagugagccaggggcuggucuggggagugggucucacgcacugcucagguuggcacgagggaccucccccaucccaacccagccccaagggucccagcagggcucucagcauggcuguuuugaggguacacagguggcuggagagggguggggcaguugcaugguggguggcaaagugugcauuuagaagcugcuucguggcguuaagaacggggggagagggaccagcacuguaacguuagaaauaauuccuucuugcagacuugaaaagcaucaguuucccucccacggcuggguuuuugugucugaaauacaucuaauucuccagacugcagccccucucagccccgagcaccugagcgcuggggaggcccuuauugagcucagccuggagaggggagggucgcacgggucccgggggcaggucuccugcacuggcucuucccuucugccagcuuggaauuugguucucaucuugccacaggggugcguuuccuaaagggcagccggagcagcucaaaggugacaacugagaugcauuucuaggcaggggcagggaaggccaacccaccuugcagccaguuuucuguuucuguaaauagcaguguauagagauggaagggcagcguggguguauccacagauggguuuagguuuuuuuuuuggauguuuucuauuaccucauucagcaacuuuauguuucacaaugacucaaugaugcuuuauuuauauuguuuguacuguaauuaaaaccauugacagacauuucacuuugcuuguuauuucauaugaucuuguuuugauuaaauaugccaguuuguauuuuccugccuugggauuuuuuuguguccgcuguacaguauucuaagggaaaaagaaaaagaaagauguguaaaguaacagagagagguggcuaugguguagagaccucuuucuaauaaagaaaugaaaauaugucuacaccgcu

SEQ ID NO: 191127 - RNA, 38490 nt, Homo sapiens
gauuggcuggggugcuucgcucagccaauccggacgcgcccgggcgucgcggccccgccuccuccccggcgcucugggcccguagcgcuccgcgggaaggaggcuggaugcccggcagcaguggggcggggauggaggcggccguggcgccggggagggaugcgccggcacccgcggcgagucagcccagcggcugcgggaaacacaacucgccggagaggugcgcgccuuuagggcagggcuggggagcggccggcgccugucgccgauugucccgcgcgggaggacgaagggggcucccggccuguggccgcucucgcguggggcgucccgcgcggggauguccgcgaggucggccuaagucagggaugcgagcuucaaggaggagcgggugcgagcuguggccccgcaagggcccacggagaggugacuuuggggccgaaacccgagugacuuccaggggugagguuugcagguucuggggaagcagagccugccaggaagagggcacagcagaugcgaagggcaggggacuugccggaggugaaccggcagagccccugagcccgggaagaacuuugggguucauucggagccuuauggggccucggaaguugaucacggggcgaugcaauuuaaguguuuugaaggaguccuucuggcugcuuccuagaaaguaggggcgcggguaggcaugggacgagaggaagccgggaagccaguuggggaucuuguaacaaccuaggagagagauguggugugcgcccagaaacggaugcguugguaggaagcuggugcacuggggcaggugaaagggaaucaaggguucucccagacugcuggcccagcugcaggaaacgggauggccaccgcugagaagcgcggagacccgaagcacgugguauccauacuaguuaaguccgagaagagcaggaggcagggguaugcauuuucugguuugugugucuucuuuccagaccccucuuuuuccuuuuugugagcucauucgcuacccaugcuuagaauaugaggggguccaggccuaaagcacacacauuuggcauucuaccuugguuggaacaaagugaagggaucugggaaaauauccccuagggaaucaguggagcgagauucccaagauuuuuuauuuuuugguuaugaagcuaacaaaguugagccugcucauccaauacugauagcauuuuaaggaagcagcaaauaaugaagcaaaggaauguguaaaguauuaaucugaacaaaauagauuuguucagcccagcagcagauugaagagcuacagucgcucaacaaacacuagcuagccuaagguacuuuggaugcuuauuuauaggaaagaaaaacagauauaagggcacaugcaaagucaagccgggcugggggauuccuaggacuauuaauacuaguaccagagugguaaaggauggcgagucaaacuugucaaagccuuguaccuauugagugauuuuuuuuuuuuuuuuuaauugagauggagucucacucugucacccaggcuggagugcaguggugcagucuuggcucacugcaacauccacugcccggguucaaacgauucuccugucucagccucccaaguagcugggauuacaggcacgugccaccacguccagcuaauuuuauuguauuuuuaguagagaugggguuucgccguguuggccaggcugaccuugaacuccugaccucaggugaucugcccgccuuggccucccaaagugccgggauuacaggcgugagccacagggcacagccuguugagugauuuugaacagaaaagaugcuucauuucaacuaaugcacauucuguccacacucaguggcuuaacagccacaguuagucauuguaucuggguuuucauguggauugguguaagcacuguuuauuuaaaaacuagauaaauuaauaucaggcaggacuacuacuacacauuuuucuaaaggcuuucgaagguuuuggauauuaguaaaaagauauacagauaaauuuuacuuagugagggaucuuucagggaauuuguacuuucuguggcauuuauuuugucaucuuauaaaaaucaggccccuguuguguggcaaccaugggcuucaacauuggugacagggcagugagaaaaacagagcccccaugcccauggagccauacuucuguuacucuauuaagguagacaguaagggaacaagucugguaugucagaugaugaugcugcccagaaaggaaggcgggaaggggaccuggaggcuggggagguagggacauagguggcugcaguuuuguggguuuguuuuuuuuguuguuguuuuuuuuuuuuuugagacggacucucacucuguugcccaggcuagagugcagugauaugaucucggcucacagcaaccucugccuccuggguucaagcaauucuucugccccagccucccuaguagggcuaauguuugcauuuuuaguagagauggaguuucaccauguuggccaggcuggucucaaacuccuaaccucaagugauccaccugccuugaccucccaaagugcugggauuauaggcgugagccaccgcgcccagccagcuguaguuuuaagcagagcugcagggcagggggucucacaagaggacuaaguuggaacaaagaccuaaaaaaguaaggugggggcagggcauguagucuuucugggcaaagaaacugaaagugcaaggucuggggccaaaguucaccugccccagggagaagcccaggucacuaggagccccacaggccaucgcaaaaaugaguguggggaaauaaggcgaaccucugaugaaguuaaaacagcagacaggaaaguucccuuggggaaugugcagcuguuccccuccuuccauaaggaagaggccagugaucugcccuuuacagcagucagauggguaaucugggcccaacagaccauuaauccuaccaagggguagaaagaguguuuguuauuagagacugggucuggcuguguugcccgggcuggagugcaguggcuauucauaggcaccaucauagcucacugcagccucaaacuucuggccucaagaggucauuccgccucagccucccacauggcuggacuacaggcacaauccacugugccuugcuagaaagaaauuuugaaaaccgaaaugaaaauccaaguccuaucaauuauaaaagaaauugacaaaaacuagagucuuagaaauuaugcaugcauuuuccauaaguaguguagaucuguagauucccaagugcagcuuguggaugccugcagugcuuaugcagaggaucaccaugcccuugacauuauuugcuccugccgaugggauagacacagagcagccauauuucccauaugccaucuccuuuuccuuaaugggugucuuugcuuucuuuccuucaggaaaguuuauauggacuauaaugcaacgacuccccuggagccagaaguuauccaggccaugaccaaggccaugugggaagccuggggaaaucccagcagcccguauucagcagguaauucuagaagaugcacguguucacugaugggagauaauggggauggggcgcucuuagagaaauugcacacccacacgugacggcuuuguuuugaauagguuucuguuagcugcaauucuugagcuguaauuuuugauaguuucuuuucugggaaggccccauuuguaagcugagccuugucgauacuguaaucuuuaaccuuuaauguuuaaucuuuaacaugcuguccugucacccuuucccagaugagaaaggugucuacugagaguuccuugaaguagcagucaguaccuguggagcacuucacagaucuagcucagucaauccuuacagaauuugcaaaauaugucuuuuaggucaucaggauaacauauaauccuggcccuuuuuaaagaugaaaauuacuuuuucauuaauuacuuuaguuaugaauauucuuauuuguuuccaauuuauucuuauuguaauguagaccauuaaauuggagguuuuggagaagaauuugcuucaagucaguuauaugacagaguuacauucuguuuuucagacagaugagcaagcuaaagucuuaccuuucuuauuucauguuuaugagagauaauuaagauaaacuguguuaacuguggaugaugaugaacuaaauuaacuucaaacagaauauugccaggccauacgauuuaguaacacuugcguacaauuuacagguuuaauacguucuccuauccauuugcuuauuaaacguuucacggcaacuuaauaacaaagcccuucagcucagauacuagucauucauuaacuuauuuguuggcuuauuuguuggucuauucuggcuaaucuucugcacauugccucguauccagucucuccucuaguaaaauugaaauuucugacguauuagacuugaaaauauggagaauaauuaaaugccgaugacaggcauugucucaugaaaaagucugggaaucgcucucagggagaaaucauguucuggaccugaaugaagccuggcaguggcuuuuagguuuccuugauagccuuuguuuccacaaauuaagaaccauaaacucaaaaguguugcaguucacuuuguguugcuacucagaucgaaaugcaaaagaaaaaaaaucaauuuauagagugguuuaauuauuuucacaauauuguuauuuaaacuaauaauauuuuauuuuauuauuauuauuauuauuauuauuauuauuuugagauugagucucgcucucgcccaggcuggagugcaguggugcaaucucgggucaaugcaaccuccgccucccggauucaagcgauucuucugccucagccucccaaguagcugggacuagaggcacgcgccaccaugccuggcuaauuuuuguauuuuuaguagagacgggguuucaccaucuuggccaggcuggucuugaacuccugaccuugugauccacccaccucggccucccacagugcugggauuacaggugugagccaccaugcccagccuaaauauuaucuaaagccuuugagggaaauuuauuuuaaggaauauguugaggauguggggauuuuacauaccuaagauauuuaucacagucuugcuuauaauagcaaaacaaacaaaaacccugaaaauaagcucagcauucaugaauuuuuaugaaaaauaaacuaucuucggcaaaacaagaaaccuagugagcauugcacuguugugcauguggaagucucuuuacugccuguugcuggaagauagcuggcgcucauaccuccccguccagcccacugcagucacaucauagugacggaagccucuggaagguucaccauauaccugugagaaaaggagcgugaaaaaggcaguucuucucuuaguaucaucaugaaaacaguuuugacuuuguggaccuccugagagggccuugggguuuuggaaaccgcugacguaagcagcacugacugagcaccagcuguguacucagcacccuguugggggagggaugaagcacggugcccaaaauguauuuggguuuucgaggcauuacuuuguccacuauguggagaauggacccuggugggggccugcuaggagaacaucacagcaguggccuuggcuugguugguggcugggcgguggagaggcagagucagguuuggaacaucguuugaacacagagccuacagcauuugcugguggauuaauuggcggggaaugaaaagggaaagagcccacgcuuuugcccugggcugcugagggauggaguugccauuuccugaguguauuagucuguucucaugcugcuaaugaagauguaccugagacuggguaauuuauaaaggaaagagguuuaauugacucacaguuucccauggcuggggaggccccacaaucacggaggaaggcgaaagaggagcaaagucacaucuuacauggcagcagagaagagugugcgugcaggggagcuccccuuuauaaaaccaucagauuucaugagacugauucacuaucacgagacuagcaugggaaagaccugccgccaugauucaguuaccucccaccgggucccucugaugacgugggaauuaugggagcuacaauucaagaugagauuuggguggggacacagccaaaccauuaucacugagagagggaaggcugagagugagggugacaguuuauuacggugacuuuuagugucaccaagaaaaaugauggaguuuuccuaaacaccacuuagguguuuaggaaacuacuacuaaaacugacaucuauacaguagcguuaaggagcagcagaauuacuuugcauauuuauuuuaccucagcuuuuuauauuucucuuuuuuaugauguuucguaauaguauauguuuuagcggugccugcucaauuuuuucuuauuuuuaaauaagacugaauggucaaaaaaguuuggggacuccugguguguacacuaagaauggucacugaaacuuucggcauucccaugccagagccuuuccuucuuugccccaucaagcaugguugcuguguuuuccuucuagccagugaaacugggugauggccggaugcauagcccuguuugaaagcaggugugucccugagacaguaaccuuuguagcccagguacccugugggcgacaugcaaaaugagauauggcacuggacuucgcgucgagucaugaguucuguuuuugcuuauuuuuguuguuugcaacucauuccauccuuucauucuccucucuugaugaaugggaagcaaggcagauggccacagcugcccucccucuagcauccaguaagaagaaagccacaucuugggggacguccagguucauagccagacucccuuacuuguuucugggucucauggaguuaauaacucucaguuuggucccugguucgcugcugucucggccgccccuuugccggguugugucuagguuguagcauuuugcugugcucacauuaaggggccagguuuugucuuagaacggcccacgcagaccucuuauuccuuuguauuugguuguccuuuuagaugcguugauugagcuuggugaagcaauguuaaugaauuuccuuuuuggucccucaaggaagaaaggccaaggauauuauaaaugcagcucgggaaagccucgcgaagaugauaggggggaaaccucaagauauaaucuucacuuccgggggcacugagguaaagcuucugaacacacucacauucuguuaacuguaaguuauaauaaaauacacagaaagugauuuccuuuugcuacauuuucauuuaaagaaagaguaggccaagugugguggcucaugccuguaaucccaguacuuugggaggccaaggcaggaggguugguugagcccaggaguuugcgaccucccugagcaacauagggaaaguccaucucuacaaaaaaaaaaaaaauuagcugggcguggugguguacaccuguagucccagcuacuagggaagcugagguggcagaaucauuugaacccaggaauucaaggcugcagugagcuaugaucacgcuguugcacuccauccugggcaagagagugagacccugucucagaaagaaagagaguaauguguggucuugcuauauugcauacuagcucgagauaauuaguauauauccuuuaaguaaauuccagguagccgauaggauuuuuguaauguaauauguaaaguaaccugcuuugcauuguuauuuccauaaagguuuccccgucauuguugcccuggaaucaguccuuuucaucccuaauugauagauauuuaaggacuuuccaagguuuugcuguaacaaacagugcugcacuuaauaaauaaccuuuauacacacuauuuuguuucacugugaauguagcuguaggaaaaaguccaagaacuagaauugcugggucacggggcucauuugguagaugugauaaauggcccacaguagagguuguaccaauuuauacucccaccaauaguggguggcuggacaaaauacucuuuauggcagauuuauaaaauuuaaaaauucauaauauucuaugcauauaaccacacugcacuuauaccaauacauuuauauaaauucuuaaaaauuaauaauauugcuuaacuauaaaacagacauaauugacuggaaucucauguuuuugaauguuggaaaaccccaaaucuuucaaaaggucccacucaggaaguugaauuucuuugaagcuuuuuugauguuagccacaaaagaaauuaaguaacagaaauuguugcucugacccuuaccucagcacaguuuuuguaaaugcuuuuuuugcuguaucucugcagucaaauaauuuaguaauccauucuguggugaaacauuuccacgcaaaccagaccucaaagggacacacaggugggcaccacagcccagugaagggggccaagccccauuucauuacuuccucgguggaacacgacuccauccggcugccccuggagcaccugguggaagaacaaguggcaggugagugagugcaggguggcccugggaccagccugcugagcuccagcugcgaggcgggaaguggccugcgagcagagcccgggauccgcugcagagauguagauucagugugccacucacuguaacucacugguucugaugaggaggcaggcccuggcaccuuggugaauaguugccccucacugcacugggcucccuggcugccccucucggugcagaggccagcugccacaaggggguuggcaaguguggccaaacuuucccuuaggaaguucauugagaaugaauauguagaacuagccauuuguauaacugagugauauuugaaacuugcauguaauaaauauuuaaccuuuaaauaguacgccugcaaauaggcaaaugaugcuugucauuauuugguuuucaucauaaaaucucagcucccacucuccucucacaugaaggaaaaggaucaaauagaccuaaacuucaggugugaagccuggaauaagcgagcugccgcaccugaucucagcacccaugacgcgaggccuccugcuauguguggagaagcggagugagguggugcccaagugcggcaggaggcgcaggggcccucagggaggaggaggcucgcugcagcagcaguggccuuguggcugucacacagcacggacagagccacagagucauaggaagucccaaaagggagugacauguucaccagguguagaucauuaacuuguaaaaauggggcagccaauuaaucaacacuauccuugagacagauuuucuucucaaccugaguuuucuuguguaaucugucuggaaaccugcaggugaauaaaaagaaaauauuuuuauuuuaaagauuaagggacuguggccaaacugcuugguuugacuaugaagccuuuuuugaaaaaaaaauuuuuuuggcugggcgcaguggcucaagccuuguaauccuagcacuuugggagguggaggcggguggaucacuugaggucaggaguucgagaccagccuggccaacauggugaaaccccaucucuacuaaaaauacaaaaauuagccagucauggugguacgugccuguaguuccagcuucuggggagguugaggcaggagaaucacuuggauccuggagauggagauugcugugagccaagauccauuguacuccagccugggagacagcaagacuccaucucaggggaaaaaaaaauuuauaacauucuguuuguggucuuacuugaaugcuugcccguagguaaacauauucacaugaaggauuuagaucccaagauuuaauuuuuugccacuuaaaaaaaucuaauuuucuuauuuaaguacuguuaguuuuugguaccuuuuuuuuuuuuucuuugagauggagucucacucuguugcccaggcugaugcauaguggugugaucucaguucacugcagccccugccucccagguucaagcaauucuccugcuucagccuccugaguagcugggauuacaggcacacgccaccaugcccggcugauuuuuauauuuuuaagagagaugggguuucaccauguugaccaggcugcucuugaacuccugaccucagguaaucugccugccuuggccucccaaagugcugggauuacaggugugagccaccugagcccggccagagcccagccucugguaccuuuuuuucccuaucuuaccaauacagagaagggcaacuugguauacaucauuauuaguuacuguuguaauuaauuaaccuuuuguuuaaaauuguacaauuuaaaaaauguauagacaugcaugugauggaaauaguuaaaauauuauagaaaaguauaaaguaaaaagucugccagggcacgguggcucacgccugucaucccggcacuuugggaggcugaggcggacagaucacuugaggucaggaauuugagaccagccuggccaacauagcaaccccgucucuacuaaaaauacaaaaaaaauuuagccgggcgugguggugggcaccuauaaucccggcuacucgggaggcuaaggaggagaagaaucacuugaaccugagagggagagguugcagugagccaaaaucgugccacugcacugcagccugggcgacagggugagacacugucuccaaaacaaaaaaacaaaagucauucuccugcugccccuaaaccucugcagcagcaaccacuguuacaguuugccuugaguucuucuuguggauauuaucauuuuaaccacuuccaguuuaagcuaaauaacuuaaaaaccuaacccccaguucuugguuuaucaacacaagcauccucaauguaaaaauaaggacuuggaccuucauaagccuuccucgcacucccucugucuccacacaucccaguggauuucuuguauaucggcuuuaaugagcuaucauucauccacuuaaaguguacaguucagcaguuuuuagugugcucaccagguugugcagccaucaccacuauauuuuucaguuauagaaaauuuuucuauaauuuucaguuauagaaaauucucgccagccccaaaagaaaccuuguaccaguuaacuguaaaucuucauuucccucaacucuaggcaaccacucaucuacuuucugucucuacagauuucccuauucuagacuccccuaugaauggaaucuuauaacgugcucuuuuugacgggcuucuuccauuuaacauaauguuuucaagguucacucauguuguaacauguauuuaauucauuuucuacagaugaacaacauuucauugucuaucuguaccacauuugauuugucugucaguugauagacauuuagguuguuuccauuuguuggcuguuacgacuaaugugacauuugugcguauguuuuaguguauugguauguucuuauuucuuuuggguuuauacuugagugagauugcugggucaugcgguaacuaucugacaaauguuagguaacuguuuaaccuuaagcuuuguuuuccaaaguagccacaccacuuaguacuccuauuugcagugucacaggguuccaauuccuccaugucuuugcugacauuuguuaucugucuuuuugauuauugccagccuaguagguguaaagugguaucucauuuugguuuugauuuacaauucccugauggccaguaguguugagcaucuuucauguacuccuuggccauuuguauauaucuucuuuggaaaaaugucuauuaaaguccuugcuccuauuuuaauuggaugacuugucuuuuuauugaguuguaagaguucuuuauauaugcuugauacaagucccuugucagauagaugauuuguaaauauuuucucucauucuguggguuugcucuugcucucaugguauccuuugaagaacagaagcuuuucauuuugaugaagucuauuuuuguuguuguuguuguuccuugugucaugucuaagaagauuuuguccuacccaaggucaugaaaauguacucauauuuucuucuaagaguuuuauaguuuuagcucuuacauuuaaaucugugguacauuuugaguuaauuuuguguguggugugagggaggaguccaaauuuacuuuuuuugcauguggacauccaguuguuccagcacauuuguugaaaagacucuucuuccauggauggucuuggcacccuuauugaaaaucaguugaccguaauaugugaggguuuauuucuugacugucaacucuauuccauuuaccuguauuucuguucuuagauugguaccaaacuguuaugauuacuguaguuuguaguaaguuuugaaacaggaaaguaggaguucuccaaauuuguuauuuuuuaauauuguuuuggcuauucugcaucuguugacaucucaaaagaauuuuaggaucagcuuguuaaauucugcaaaaaucuagcuaggaguuugauagggauugaauugaaucuguagaugaauuuggucaguauugcuaccauaacaauauuguuuuccaauccaugaacaugugaugucuuuauauuuacuuuaauuucuuccagcaauuuuugcaguuuucaggauuaaguuuuugcacuucuguuaaauuuauccuuaaguguuuuauucucuugauacuauuguagauggaauuguuuucuuauuucauuuuuggauuguucauugcuaauguauguaaauguaguugacccuugaacaacauggguuugaacucugugggucuacuuauauguggauuuucuccuaucucuacugucucugugacaucaagaucaaccccucuucuucuuccuccuccucagccuacucaaugugaagaugaugaagaugaagaccuuuaugaugaucugcuuccacuuaauuaauaguaaauauauuuuuauuccuuaugauuuucuuaguauuuuuucucuagcuuacuuuauugugagaauauagcauauaauauauaauauacaaaauauguguuaaucaacugcuuacguuaucaguaaggcuucuagucaacaguagguuauuuguuguuaaguuugcagggagcuggcuggguguggugucucacaucuguaaucccagcaguuugggaggugaagcggggaacggaucacuugaggucaggaguucgagaccagcuugaccaacauggcaaaaccccaucucuacuaaauauacaaaauuagccaugagugguggcacauaccuguaaucccagcuacuugggaggcugaggcaggagaaucacuugaacccggaaggcggaggcuguagugaacugagauggugucaccacacuccagccugagcaacagagcaagacuccaucucaaaaaaaaaaaaaaguuuuuggggagucaaaaguuagacacaaauuuucgacuaccugagggguccacaucccuaacccucacauuguucaagggucaacuguacaguugaguuuguauguuacucuuguguucugcaacuuugcugaauuuauuaguuuuaauuguuaguuuaguuuaguuuaguuuuguuuuuuugaggcacuuucgcucuuguuguccaggcuggagugcaauggagugaucuuggcugacugcaaccucugccuccuggguucaagcgauucuccugccucagccucccaaguagcugggauuauaagcaugugccaccaugcccggcuaauuuuguauuuuuaguagagaugggguuucaccauguuggucaggcuggucuugaacuccugaccucaggugauccccccgacuuuggccucucaaagugcugggauuauaggcgugagccaccaugcguggccuaauuguuaguuucaguugguuuuuuaauggauuccugaggauuuucuauauagagggucauaucaucuacagcuagagauaguuuuacuucuuguuguccaacuuguauuucuuuaauuuuauuuucuugucuaauugccuugacuaggaccuccuguacaauguugaauagaaguggccaagguggauauccuuaucuugcuagugauuguaagggaaggcauucauucuuucauaauuucauauaauguuagcuguggguuuuuuauagauggccuuuaucaggaugaggaaguucccuucugugcuugguuuguuggguguuuuuaucaugaaagggguguuggauuuuguuaaauccauuuauugagaugaucauuuauugagaugaucauguggguuuuuguucuuuauucuguuuguaauguuguauuaccuuaacuaauuuuuggauguuaaaccauuuaauccuuuucauauguuuuuagauuugguucacuaguauuuugcugaagauuuuucugucaauauucauaagagguauuagucuguaguuuucuuguggugucuuugucuaguuuagugucaggguaaaauuugccccauauaaaucaugggaaguguucccuccuguucuguuuuuuggaaggguuugugaagacuugguuuuaauucaucuuuaaauauuugauagaguuugccaaugacaacaucugggccugggcuucucuuuguggagaauuuuuaaguuacugauucagucucuuuacuuuuuauagguuuguucaggcucuaucucuuuugagucauuuucaguuguuuguguccuucuaggaauuugugcauuucauuuguuaucuaauuuuauuggcauaccauuguuuauaguagucucugguaaucuuuuuuuauuucuguaagauuuauagaucccuuucauucaugauuuuaguaauuuuauucuuuuucucugucuuguucaauuuagcuaaagauuuaucuuuuuaaaaacucuuuuuaaagaacuaacuuuugauuuuccuguguuauuuuuguagucucuauuuuauugacuucuacacuaaccuuuauuaacccauuuaugccggagguugcaaguuuuuuugugugaaaaaucagaccuuggcaauaaccuugagcaguaggauauaaauaacucccacaagcuuagcguuccaauaauggaacaccaggcauaaauggguucuuucuuucuacuuguuuuagguuugauuuguuccuuuuuuuuuuuuuuuuuacagugucuuaagguggaagauuaguuaugauuuguauuuuuuuuuuuuuugagacagagucuuauugcccaggcugaaguacggugacacaaucucagcuuacugcaaccuccaccucccagauuuuagcaguucuugugccucaaccucccaaguaacugggauuacagacaugcaccaccacaucuggcuaauuuuuguacuuuuaauagagacgggguuuugccauguuggcugggcuugucucgaacuccugaacucaagugacccacccaccuuggccuccaaaagugcugggauuacaggugugagccaccacacccagacguuuuuucuuuuuuaauguaggcauuuaaagacauaaauuucccucuaagcacugcuuuaacuacauuccacauguuuuaguauguugugucuucauuuucauucaucucaaaguauuuucuagucucccuugugguuuuuuuuuucuaugacccauuagauauuuaagaguguauuguucugcggaaggccgcaggguccucugccuaggaaaaccagagaccuuuguucacuuguuuaucugcugaccuucccuccacuauugucccaugacccugccaaaucccccucggugagaaacacccaagaauuaucaauaaaaaaauaaauuaaaaaaaaaaaaaaaagaguguauuguuuaauuuccauauguuuuuuaauuucuaagauuucuuucugcuaaugauuucuaauuuucuuccauaagagcuagaaaauacuuugauuuaaauucuuuaauuuuuuuuauuuuguggccuaggauguauguagacauauauccuagaguauaugucaagugcacuggaggauaauguauauucugcuguuguuggguggagugucuuguagaugucuguuaggucuacuuaauuuguaguguuauucaagucuucuguucccuuguuaaaauucugccuaguuguuguauccauuauugaaaaugugauuuugaaugaucccaguauuauuaaucaguggucugauuaauaguugaucacacuauuaaucaguuucucccuucaaaccugucaguuuuugcuucguguauuuuggugcucuauuguuaggugcacauacauuuauauuuguuauauauuauggaugaacugguucuuuuaucauuauaaaauguccaacuauauugcugguaacuuuuuaaaucccuuuuauuuuauguaaguauagucauuccaacugucuuaugguugcugcuagcauaaauaucuuuuuccauccuuuuacuuuuaauccauuuaugucuuuaaaucugacauguuguaauacacuguuagagacauauuguggcuauaagauuaaugauagccguaaggcccaugcaaacaucuugcagggcugacacuaugugucaauuagcaguaugaugcaacauggucuagggauuuccaacccuggcuugggaauuuccaggagguaagaccaccucagcauagauggaacucucauaaaccauaaauacaaagcuuucccuuaccaaaauagcuuaacucccuuauggaagaaaaaccugguaacugaccuggacuaaauacaagauaagaaaggggaagaauccccaaaacucugagaauguucucuggacagagacuuucccggccaggcagucaucugauaccugaauguaucugacccuugccaccugccugcuccugcuagcuaucuuguaagagcacugccagaauaaacugcuugaacaucacacagcaucuaagacuuaucuuugaugugaauaauaggaaaagggaaaagucaccuuuggggaagguuaacuaggcccagcccaagaucccugaacaagacacaugggucuccuguagauucucuuuuuuuuuuuuuuuuuagacggaaucucgcucuguugcccaggcuauggagugcaguggcacgaucuuggcucacugccaccuacgccucccagguucaagcuauucuccugccucagccucccgaguagcugguacuacaggcaccugccaccauggcuggcuaauuuuuguauuuuuaguagagacgggguuucaccauguuggccaggcugaccuugaacuccugaucucaggugauccaucuaccuuggccucccaaagugcuaggauuacaggcuugagccacugcacccggccaguucuuuuuaaaucuagucugacagccucugccuuuuuauuagauuguuuaaucauucacacuuaauguuacuauugacauaguuggaguaccaccuauuuucacuuuuuguuuccuagaugucucauauauuuuuuguucucuuuucccccuuuaccguuuucuuuugcauuaacgaauauuuucuaauuuaacaucaaaauucuuuagugcuuuuuucacuuuuuaaauuaguuauuuccuuagugguugucaagggcuuacuauuuauguauaaacuuaccaguauauacuucaaauuuauacuaauuuaauuccaguaagauguagaaauguuacuccuauacaguucuguuccuucuucuuuuuugugcuuuuauuguuauggguauuacaucuauauauguuacaaacucaacagugcauuguuacaaauaucuuuuuuuuuuuuuuuuggagacagagucuugcucugucacccaagcuggagugcaguggugcaaucuuggcucacugcaaccuccaccuuccagguucaagugauucucaugccucagccucccaagcagcuggaauuacaggcgugugcaaucaggcccaucuaauuguuguauuuuuaguagaaacaggguuucuccauguuggccaggcugaucuugaacuccuggccucaagugaucugcccaccuuggccucccaaaaugcugggauuacaggcgugagccacugcagccagccacaaauaucauuguaguuaauuuccugucuuuucuuucuuuccuuccuuccuucuuucuuucuuucuuucuuuuucuuuuuuuuuuuuuuuuuuuuuuuuuugacaagauuccacccugucacccaggcuggaguuuggugucacaaucacaacucacuacagccucaaccucccaggcucaagugauccuuccaccucagcugcccuaguagcugggacuacaggcauaucccaucgcacuggcuaauuuuuuauuuuuugugcagauaagguguccuuauguugcccaggcuggucuugaacuccugggcucaagugauccuccugccuuggccucccaaagugcuuacaggcaugagccagugcaccuggccaauuucauaucuuuuaaggaagcuaagggaagaaagagcaaguauauguuuauagauuuugcuugaguaaucuucuuaguugccuuuucacauuaucuucauuuguuccauggaucugaauuaucaucugguguccuuuccuuaauagacaauucugcucccucccaccuccuuugugcuauuaugaaauauuguguguuauagcccuaacaaaauaauuauauacauguuauuuuauacaguugcuuuuaaaucaguuaagagaagcaauauacaguuacacugcccuuuuuuuccuuuacuuuuuugagacggaaucucuuuugcugauugcgagauaguuucucugucuuuggcuuucaacauuuucauuaucaugugucugggagugaaugucuuuguguuuuaucccacccagaauucacugagccucuuagguauguagauuaguguuuuccauuacauuugagauguuuucagccauuauuuuucagagacauuuuucugccccuuucucuugcuccugcccuucugcuacuccuguuuucccuauuuggugccuuauggugucccacauuucucugaggcucuguuuaucuuucucauguuuuuccugucuuauauuuggauuucguaaucucuguaaaucuaccuucauguugacuaaauguauuuucugccaguuccaauauacucuggagccccuccagugaauucuucauaucgguuguacuuuccaacuccaggauuuccuuuugguucuuuuucauaauuucucucuuguuuaucuugaggacucucuauuugaugagccauugucaucauacuuuucuuuaucucuuuaaguacagucauaggcaguuuuuaucacuugccuuuuuuccugcuuuuccacacacugaagauaccaguuagaauuuuuuuaguuuuccuguuccugggauugcuucuaugugaucuagaaucagucauuuaccuguucauccugguuuuuccucaggcuuggggauccuggauuguuccuguggauggaugaagcauuucguuguuugauguaggggcuagggauggcucaucuccaguucucaaugcguuuccccaggaggugucucccaggaaaggaaggcccacggugggcucugcauaaggugguggcagcagagcccggcaagccggguggacccccccaacuuuucucgugacuucccuggacggagcugccuuugcuuugcuccucugaguucccuagcagaugccucaagcuccucccccuuuucuagauccuucccccauccugggagcccaccuugugcccgcccucucugggcguguggugcugucucagucugaggucagcaccucugccgcugacuugguguacgggagcagggcguguucggacauugggaagcugaccucugccggccucgguagcuggcccgugcccugcgcuucccgcuguccacccugaacuuggguggccacuggauacuuucagauuggccuuuaaguguucuuuucccuguuaaucuaaugccaucaucuugcuacauuuuagggacuccucaaaauuccuaguccacauacccccucccacccccuuuuauuugagacaguguguuacugugucacccaggcuggagugcaguggugugaucucccuauguugcccaggcuggucuugaaccccugggcucaagcaguccacccaccucggccuuccaaagugagccacugcgccuggccagauacccuuuguugguguuguuuugauuugauucuuagucggagaaguagcuguuuucucuuucauuucaguaggauccugagugggcaguggauacauuuguuuuucaccauuuuaaacucaaagcacuaaagcuaaacaauguaguccccucugcucauuuuccaucugcaguagugagacucucagugcccggggcagucagcgccuggcgcguaggagcggcuucaucagcacuggcucggugccaaaugcauggcagugaagugcugugcacuaggacccuccccaaaagcaagagccugcaucccuguugccucuuccucuuccgucuccguagaagcagaaaggcacacagcuuccacgacacagauucacugacugcagccgcguuaaagacacguucacacugaagcaccugacagugacucugggccagugaugaugggcggcuuauauucuucuuuauagucuucugaacuuggacaacaauuuacuuuuauaguuguagaaaacuguuaagcucuguuggaacgcaguuuugagaggaaucaauuugugcagcucaguucgguacucauguuuguuucccagcggucaccuuugucccgguguccaaggugagcgggcaggcagagguggacgacauccucgcggcaguccgcccgaccacacgccucgugaccaucaugcuggccaacaaugagacuggcauugucauggugagucggccuuuguuucucuuuaaggagagcucauggggaagaacagcagcuuagacucauggcguuucagguuucccagcucuggccucucccguuucucuguucacuuugauaacauuuggccugcgcucacuacuccugauuucugucauucaguuuucaucagaucggagcaacauacucaacuguuuccuuuccccgucagccugucccugaaaucagucagcgcauuaaagcccugaaccaggaacggguggcagcugggcuaccucccauccucgugcacacggaugcugcacaggccuuggggaagcagcgcguggauguggaggaccugggcguggacuuccuuacaaucguggggcacaagguaagucugcagaggcuuccugccucugugggcagagccuacugcgcagguggcuguuuacuccucgguccguaagccucacugcccaccgugagccaggccuugggggcacugcgaggagcaacgugggauccuuguccucaggagcuuuaagaggggagccccacauggccagcaugccaggacgaaugccauggcagggaugauggggggggugcccagcccacauggggcagggugggggcgguagaccaagcuaggggaggagacgucgagaucucagggagaguaaggcaggggguucggccaggcagcgagugucucugcagcggacagggcaucugcagagggugugggguggaagauguagggacaggaaaucguugcuuucucuaaugugauuucagaugcggcuccucagcaaaaccuuugcagcuaucuuuaaggugggaguauggggaaaauaguuaacagugaagacccuucugaaaauuuugcacaucuuucuggcagcuuaccagggcccgagauauuuuuaguacucaauuuugaagcacaguccucagcugguuuccaaaggagugucuaugcuggccugacacuggcacuccagaguucugcauugugucaguuggaaacauggaaucauuugcaggaaaagcccuggccaaccgcugguuccaaccccucucuauuuaugcauucucuuucuuuuuuuuuuuuuuaaaccugugauucauaugauuugagauccuuuuacaaauucuaucacaugaugcgcaggggagagcugccugccacagagcugagcacgagagucuagcaccugcgcugccuccuagguugggguuccacccugccccgaaggcuuuugugacucugcgugucaaaagggguggcacucagaggcgccacaaggaagcagcaggacuaugcauugcagagcauuucuccugugugccccuaagcacuuagcauguauacagaguagguccuuggaaaguucuuguugaauaaaugaccaacuuuuccuuccaguuuuauggucccaggauuggcgcacuuuauauacgaggacuuggugaauuuaccccucucuacccuaugcuauuuggagguggacaagaacggaauuucaggccaggguaaggcagaaaguuaacaaagucucugaccuacugaccgugucauuuguagagcagugacauuguaaagaaacauggcgcuguuucuuggucucguggaggcucuguagcauguccacacugcugcugugucagaacuggcuccacugauugauuuuacacugagggcucacaggaccugcagucucuuugggaaugauugaaagcaaugaaggaaaucucuguuucuuuuaacugcuccaaugcauccaauuccccuuguaauuuuggcccagcccacugaagagaacuguuggacccuucauggcugaggccugcugcuguuuuaacuucggggaucagcaggaccacacagaagcacuggucuccuuucugauagcuccuguguccccucuauguauagugacguguuaacugggaaauuaguuguugcccccaccacaccuuuuguuagaaacuacuuaacaagagagagaaacaggaacagcaugguggugaguuccuggguuuucuuuucaccuuguguaucccacacuuagugcugaagaagccggcaaaccugauaugcuaguaagggcagacacaaaaaugccccaaccaaagccuguccucucuagccaguggaccaggaaaggaauggccuagcaagacagaaaacuuugagacaacacuugcuuuacuccagccagaugcuacaggggaaauugugcugccacgccuauccacaccugcaaagauggagugggaaacccagacuuccaccaauacaggcuguaacaagguaucccacaccaccaccgggugugucaagaaggccagguagagaaccgggacuuaggcacucccaccauggugucaguagagaccauaucgggaucuuggacccacaccugucagucacagggagcguccucccauugggugucaacaucagccaaguaaaaaaucuagauguuggccaggcacaggcucaugccuguaaucccagcacuuugggaggcugaagugggcagaucacuuggggucaggaguuugagagcagccuggccgagaugguaaaaccuuaucucuacuaaaaauauaaaaauuagccaggugugguggcgcaugccuguaaucccagcuacuugggaagcugaggcaggagaauugcuugaacccgggaggcugagguugcagugauccgagauggcaccacugcacuucagucugggugacagaacaagacucugucucaaaaaaaaaaaaaaaaaaaaaaagcccagcacgguggcucacuccuguaaucccagcacuuugggaggccgaggcggguggaucacaaggucaggagaucgagaccauccuggcuaauauggugaaaccccaucucuacuaaaaguacgaaaaauuagccaggcguggugguguguuccuguaaucccagcuacucgggaggcuaaggcaggagaaucauuugaacccgggaggcggagguugcacugagucgagaucgcaccacugcauuccagccugggugacagagagagacuccaucucaaaaaaaaaaaaaaaaaagaaaccuagacuucuacuuccacuuggcagugaugguggcauaccccuucuccugccagcacaacgucagaaaauggcagcccaaacagaaagauugaauaagauccagguucucauaaaguaaggcaaaaauguccagguuucaagugaaaaucauucaucauaccaagaacuagaaagauuucaaauugaaugaacaauaauaaucaauauacgccugcacuaagaugaugauguuaaaauuaucuaacaaauauuuuacagcagacacaguaaaaaugcuucaaugagaaauugugaacacccuugaaacaagugaaacaaagugucagcaaagagaaggacaacauaaaagaagaaccaaauggaaauuggaaauuguagaacuaagaacagcagcagccaaaauauaaagcucaguggaugggcuuaauagaaaaauaagaggacagagaaagaaaucuaugagcugaaagacagaacaauagaaauccagaccacagagaagaaauagagugggucuucggcugggugcuguggcucacaccuguaaucccagcacuuugggaggccgaggugagcggaucacaaggucaggagaucgagaccauccuggcuaacacggugaaaccccaucucuacugaaaaaaaaaaauacacaaaaaauuagccgggcuugguggcacacgccuauagucccagcuacccgggaggcugaggcaggagaaucccuugaaccuaggaggcagagguugcagugagccgagaucgugccacuccagccugggcaacagagcgggacucugucucaaaaaaauaaaaagaaugggguuuaaaauagagcuucagggaccuaugagacgauaacaaaugauauaacauucguuucauugaaaucccugaaacagagaaagaugacagccugaaaaagugcuugaagaaauaauggcuaaaaaauuuccugaauuuggcaagagacauaaacauacagaaucaagaaacugaguaaaccccaaauagcauaaacgcaaagaaaucuaugccagagacauaugauuagacuucuaaaaaugaaagacagaauucucuaaagcagucagagaaagaugacacuucaccaguaugggaaaaagaauuuggaugacugaauuucucaucagaaaccagaaagaccagaagaaagggacacaauuauuuuucuucaagugcucagagaaaaccgucaagcuagaauccuguacccagugaauauaucuuucaggaaugaagaaguaaucaaaacauucucagaugaagaaaaacuaagaauuuaucaccaaauacaauaggcuuuccuucuucuuuagaguuuucugaauuacguuugauagcagaagcaaaaaucuuagcaauaucugaugugguucaaaauguacauaaaggacauauuuaagauaauuauagaaaggcaaagguaaaggaacauaauaggagaugaggucugugcuucacuggaacuggcaaagugacaacaacacaggcugacacgauggcucacaccuauaaucccccugcuuugggaggccaaggcaggaggauugcuugaggacaggaguucccagccugggcaacauagcaagaucucaucucuaaaaaauuuuuuuuaauuagccgacauggcagugcgugccuguagucccagcuacucaggaggcugagggggaaggaucacucgagcccagaaguucgaggcugcagugagcuaugaucacaccauugcacuccagccugggcaacagagcaagacccugucucuuuaaaaaaaaaaaaaaaaaaaagacaauauuggccaggcacgguggcucacgccuguuaucccagcacuuugggaggccaaggccgguggaucaccugaggucaggaguuugagaccagccugaccaacauugagaaaccccaucucuacuaaaaauauaaaaugagccgggugugguggcgcaugccuauaaucccagcuacuugggaggcugaggcaggagaaucgcuugaacccgggaggcagagguuguggugacccgagaucgcaccacugcacgccagccugggcaacaagagcaaaacuccgucugaaaaaaaaaaaaaagacaacauuagcugggcgugguggcucacauuucuaauccuagcacugugggaggucaaggcagguagauugcuugaggccaggaguucaagaccagccugagcaacauggugaaauccuguuucuacaaaaaaaaaaaaaaauggcuggaugugguggcacgggccuguagucucagcuaugugggaggcugagauagaugguaggauugcuugagcccaggacagaccucuagcaagacugaccaaaaaaacagagaaguuauaacaucaggaaugaaacaaggaguaccacuccaggcccugcagccaucaaaaggauaaugagggaaugccacaaacagcucuacacauaggaaguugacaacuuagaugaaacugaccacuuccucaaaaaacacaaacuaccacaacucacuugauauaaaauagaucauuugaauagcucuauaaccauuaggaaauugaacuuacagcuuuaaaacuccccaaagagaagucuucaggcccggugguuucauuagagaauucuaucgaagaauucuuuguuuaaagaagaauuaacauuucuauacagucucuuccagaaaauaaagaggaaggacaacuucccaguucauuuuaugaagcuaguauuauccugacacuaaaaccagauaaagacaguacaaaaaaaauccuuuacagaccaacauccucaugaauuuugaugcaaaaaauauuuaacaaaauguuuacaaauagaauucagcaauacauagaaagaauuauacacugcuggguguggugguucacgcguguaaucccagcacuuugggaggcugaggcaggggaucaggaucacuugagcccaggaguucaagaccaggcugggcaccauagugagaccccucuacaaaaaauaaaaaaauuaacugggcauggugguacaugccuauaaucccagcuacucaggaggcugagauaggaggauugcuugagugagcgugggaggucaaggcugcaugagcuaugauuacaccacugcacuccaguuugggugacaaagugagacucugucucaaaaaaauaaagaaugauacacugugaccaaguggcauuuauuccacagaugcaaggcugguucaauauucaaaaugcgaucuagagccgggagugguagcucaugccugcaaucccagaacuuugggaggccaaggcggguaaaucacuugaagucaggaguucgggcccagccuggccaacauggugaaaucucgccucuauuacaaauacaaaaauuagccaggugugguggcagacgcuuguaaucccagcuacuuggaaggcugaggcacaagaaucgauugaaccuggguaacagaguuugcaugagcugagauggcagcaccacacuucagccuaggcaacagagcaagacucuaucucaaaaaaagaaaagaaaagaaaaaaugcaaucaaggcaggucacaguggcuuaugccuguaaucucccaguacuuugggaugccaaggcgagaggaucacuugaggccaggaguucaaggccagccuaggugaacugcaagacccagcucuacaaaaauaaaaaaauucaaucaauguaaucuaccauauuaacaagcuaaugaauaaagaagauaacaugaucauauuugaugcagcagaagcauuugacaaaauucaaccauucauguuaaaaacucagaauaauaggauuaguggggaacuuucucaacuugaaaaagaacaucuacauaaaaccuacagcugauaucauacuuaguggugaaagccugaauguuuuacuccuguggcugggggaacaaagcagggauguccacugucaccacacuuauccagcauagugcuggaaguucuggucagcguaguaaggcaagaaaaggaagcaaaaggcauauagaucagaauggaagagguaaaauuguuucuaaucagaucacacgauugucuauaaagaaaaucccaaggaauguacaagaaaacuccuagaacuaauaagugaggauagcaagguugcaggacacaagauaaacaugcaaaaaucuaucuuauuuuuauauagugguaaugaacagguggacaguaacauuaaaaauauaauaccauuuacaaugaaacaaaauuacucagauauaaacuagcaaaauauaaaggacuuauaugcugaaaauaauauaauguggaugagaagaagaucuaagcagagacacaugccguguucauagauuggaagauucuacauaccaaagaugucaaagguggauauacaagccuaacaauuucuaucaaaaucccagcaaguagaucaauggaggagaauagacccaaacagaaauaggcccauaugaguuacgggugcagauacaaccgcaggagacgcaaaucaguucagcagaugaaaguuagccuuucaacagaucgugccaaggcaguuagacauccauaggcaaaagaugaaccuugacccaagucuuacaccaagcuuguccaaccugcggccugcaggcugcaugcggcccaggacagguuugaauguagcccaacacaaaugcauaaacuuucuuaaaacauugauuuuuuuuuuuuuugcgauuuuuuuuuuuuuuaaagcucaucagcuaucauuaguguauuuuauauguggcccaagacaauucuuccaguguggccuagggaagccaaagcauuagacaccccugucuuacaccucauaaaauagugucucaaaauagaucuugaaauuaaauguaaaacauaaagcaauaaaaccguuuaaaaauagaaaaucuucaaguucuaggacuaggcaaagaguucuuagacuugacaccaaaagcauccauaaaaggaaaaauugauaaauuagacuucaucagaauuuaaagcuuuugcucugggaaggaccauauuaagaggaugggaagauaagcuaaaucuaggaaaaaauauuuucaaaugacauaucugacaaagaaaugguaucuagaauauauaaagaacucacaaaacucaacagcaaaaauaauauaaaaaauucaaucugaaaauagggaaaaaauauaaacagacauuucaccaaagaggagacccagguaauaagcacaggaaaagauguucaacagcauuaguuauugggggaaugcaaauuaaaaccaccagauaucacuaacaccuaucagaauggcuaaaauaagaauagagacaccaccaaaugcuggugagggugcagagaaaauaucuauugguaaacaagcaauagccgaguccagagguuuaagaaaacuuuguucaggcaaacuuaagaaauuaaugggccgggcgcaguggcuuacaccugugaucccagcacuuugggaggccgagguggcuggaucacgaggucaggaguucgagaccagccugaccaacauggugaaacccugucuuuacaaaaauuagcugggcauggcggcacaugccuguaaucccagauacucaggaagcugaggcaggagaaucacuugaacccggcagguggaggaugcagugagucgagauccacugcacuccagccugggcaacagaacgagaccccaucuaaaaaaaaauuaagaaauuaauuauuaaguuaauuuuuuuuuccugaaaauaggguaaugaguucuguuuuucgguuuguuaggucagaguaugcaagccauugucuuuaggggucucuugcccaucuccugugugugugcacacccacacgcgcuugcacacauacacacacacacacaccccucuuguuugcugaugccugaaauguugagaacaaaggguucuccccuguuccauacuauacugauuuggcagugaggacuaaagagagcugugccuuggggccuacaggaggcagagugcuugcuuuggguaggaaaaggguccagauagaacugucacagugaacacccaacacaucacccacagugggccucguugaccuucacugggccagggcaagugaaaacuuggcaggggagguuucuggggccugcagcugccauugagauagccacauggcgcgugcuuaggaaagauguagcgugaguuugauuuuauuuuaacacaaugacuuucauggagacaggauuccuuccugagacauuuguuuauucuugcuuaaucccuuguuucuuacaggacagagaacaccccaaugauugcuggccuugggaaggugagcccuggugagcuugaggagaugaguugauugcuuugucaucaguguccccagcggcucuaguaggaaucuggggcuuuagggagaucauauucgugaucucauaagcggacugacaagaaaaagccuggaaucugauuuaucaaccuggagagcuguacuuuuucagaucuguggauuaguggcacuuguuuagcauuuaaaagggaaaaacuccuugucugugucucuucugacaugagaaacagugauacuguuacagcagaggugaagugucaagcugcagguucaccauucccaaaggcgucggcagcccccgcaccaucgacguucuguccccgauuggucugugggguggccaauccagcaccugccaccagcccuccacuggggccuguccugcuucugcgacaguaaccaggcucagguuuugccgugcgaaggcagagguacugguuacaccucggcgucugcaggcugcucccucacugugcggccucuggucaaaggccaccaccuucaagcaacccuccaugaaccacagcuacauugguucccccauguccccugcugucacccucuaucccugacacugcuuuauuuccccuaucugauguuucucuguaguguguucagauguaugccccaccuucugcuuccccgagagcaggggcuuggccaugucggccucaguauccccaguacagagaaagggcuuagcgcccaggaggccgggccuugggaagaguaugaauggauucccuguuacuuagaauauucaaaauuauauuauuaacagugauaacuguggcuacauuuacuagaaggaagaguguguguuuguuugagauggagucucacucugucacccaggcuggagugcaguggcacgaccuuggcucacugcagccuccaucucccggguucaagagauucucccacuucagucuccaaguaguuggaaccacaggcaugcgccaccaugccuggcuaauuuuuguauuuuuaguagagacaggguuucaccauguuguccagcuggucucgaacuccuaaccucaggugauccacccgccuuggccucccaaagugcugggauuacaggcaugagccaccacgcccagccggaagaguguguuuuaaguggaguccgguaccugcucguauugaccugagugaugaaguaguggugccguccacaggcuuugaaauacccaggguucaaauccuggcuugaagcuucacucaccgugugccuugggucaggucgcuggaacucccugaguccuggcugccagaugggaaucacgguaacagcuuccuagguagagcuucagcucacagugcuggaagccccccagccccugaccuucuccgugcuccugcagcugcaucugcaccuguaauggcacaagugccacagcugggucccagccacagcaccacacccccacugguucuucagcuucgcccagcccagaccccaaugccaccagcgcucuagacagccccccuccgccacccagccuagacuccauccugcacacgcccuccccagcgugcuuucccucacccauuccuuucugccuugguugcgugcuggcagcccugcaccugagcccuuguggguccgucuguccugucacugugaugcuagcuugugcuccugccuuuaaacuugacaucucagcuaggcccuggcccauguccugagagauccauuccucugaguucaaaaccugucccgacugcucuccuccaacccucuucccacccugggcaccucuugcuauccagguucucaccucugaaguccgggggaugcccucagucccuccuugucaucguccccugccuccaaugcagcaccuuccugucugucuggauuccagaauacacccacuaccggccucauguccauuuucauggccaccaacccuagaccaagggucuggaugccugccauggccuccugggggccugcugcugccauuuuccacacggccacagaaugaccaacagacaggccagucagaccaucgcaucccucccucagccucacugcgucugccccguggccgggccugcagggccugucgaucugucccugcgccuucacccccuccacacucuccacccgccacgccaggccccucuguucuagagacagaaugucugucuguccccugcaaagcccuugcugggacgccauucccugcccuuguacagccaucucugucaccaccccaccuugggccugcgaggugccuucacagcgccaacugguggguaggagucuguuccccucuuccccugcuuuuguccgucugccucucugggaugcuggcuccucgagggagcccuuucagggcugcuuugcugaggcaucuccagugccuggugcugucaggagguaccuggugaagucaguuucuggggcacuuccacacccuccaaauggcagcacucaaaaaauauggucugucugugacugucaggagaaugagcaguuucaggaaaugccaccuguaccguugaaagcuuuuuggcccuccuuuauuuugcaagaauugugcauccacuuguugugugucugcccccaggccgcggagcuggugacccagaacugcgaggcuuaugaggcccacaugagggacguccgcgacuaccuggaagagaggcuggaagugagcgcagcguggggugggcaccaggagggggagggugcguggggcaggugcccagagaggagggguguggugcucccagaccccaggaccuguggggauugcagcguagccuggaacucagcaggaugcagugagggaagaaagaacaguggcagaaaguacauugggaucugaaaccccgaaagcaggacccuaggccaggggcaugaucuuuuucagagacacaggaucaaauaugcagaggugguauaccucaugguuuauguggaagguucauauguuucugaauauuugguuuuucuccuaauuaacuuugcuuuccauaguccguccccguaacuauucuggguagaugcugauugaaaaguaugcaccugcugaaguuguguuucuggaaaagucuaaauuucaaacaguugcuggugguggugucuuugaagcugucaccaaauauuucacuuauuuuuuucaggcugaauucggucagaagagaauccaucugaauagccaguuuccaggcacccagcggcuucccaauaccuguaacuuuuccauccggggaccccggcuucaaggugauggccccucacccuggucuuuccgagugugagcacagcucccucggugcguggauucugguccgagccagugacucccacucgcccugcccugagcaugacacagcucgggcugucagagggccuugcugggguugccaagagcaggcucggguggcugugcugugguccacagggcucucgccgcuggccccuccucucccugacguggcucauuuugcugcugcugggauguggacuguggcaaacucucgugucuggcauuagcgccaccccaaaagccgucagggaaggaagcaacauuaaauucuagacauuugucuauuuuguuggcaguuuuaauuaaauauuugagugagggaaaggggaggugaucaguuuuaaaaacuggcagaggcugggcacaguggcucgugccuguaauccuagcacuuuuggaggcugaggcaggcugaucacaaggucaagagauugaguccagccuggccaacauggagaaaccccaucucuaccaaaaacuacaaaaaauuagccaggcauaguggugugcaccuguagucccagcuacuugggaggcugaggcaggagaauugcuugaaccuggagguugcagugagccauaauugagccacugcacuccagcuugggugacagagugagugagacucugucucaaacaaacaaaaaacaacaaaaauaacuggcagaguaaggaucaagugcaaaucuggauuuccugcaacaucugccucggcuaggagcaguuaggaucacccccgucccagaugcaccuaaaaccuggucugcccugacucccugagaguggaaguccaggugauugaccagccgcaugucauuugggaggagguuauaguggcccugagaucacgaugagcugcaucuguaaacaaguuuuugacuucuuagaagaugaaaguguugcuucuuucuucuuccuggaucacgcagagaaacccagcagucguguuuggcccaugaagaagaacccguggguaaccgucaugauggcugcguucaugagaaccugggcugaaaugcguucuugugggcagugaagccugggucuccuugaccaucucaaauuccucaccauggaaaggagaguucucugucaacguuccccuuguucuggggucagacuuuguguucagugacaaccuguguuacuuuaaaugagacagagguucucauuuuauuuauuuauuuuuugauucagggucucacucugucgucacccaggcuggagugcuguggcgcaaucacagcccacuguagccuugaccuucuggguucaagugauccuccugccucagccucccuaguagcugggacuacaggcaugcaccaccacaccuggauaacuuuuuuuuuuuuuuuugagauggaguuucacucuuauugcccaggcuugaguacagugguaugaucucggcucaccacaaccuccaccuccuggguucaagcgauucuccugccucagcguccagaguagcugggauuacaggugccugccaccacgcugggcuaauuuuuguauuuuaaguagacacgggguguugccauguuggcaaggcuggucucgaacuccugaccucaggcgauccacccaccuuggccccccaaagugcugggauuacaggcaugagccacuaugcccggccuuggcuaauuuuuaaaaaauauuuuguagagauaggguuucccuguguugcccaggcuggucucaaacuccuggcucaagcaguccuucuaccuuggccucccaaagugcugggauuacagguguaagccacugcaccuggcugaaauucucagguuaauuacaucagcagucauuaauggcugugcuugugaaagaagagggaaaugccuucuggcuuaauagaacucccacgugucucuaccauccagaacacagguggagacgugauauugccggggcugccagcuuguaaggaaggagcgggucaggacuccaggugucuuagcaggcaguugauuacaaaugcgauuuucaaggccagcuuugugaggcagaauagugucugcguuugugcagccaagggagaaaggaagcguuuucuucggcuccugcugugagaucucuccccagcugccagaauggccagugcuggaauuccaccagguggcacagagggagggaagcagccugcgcccagcaggaccccgggaagggacagaagggcaaccuggcuggagccccaucucaggggcaugugcucugucuccgcaggccacguggugcuugcgcagugccgagugcugauggccagugugggggccgcgugccacucggaccacggggaccaguaagugcucuucacaaacccaguccagggcauagggguccuccgggcacuggguguggugggcaggcggcaggauccggccacugggccgcacucuggcuggugaaggacagcccugucugggcccuaggaggggcagagggagggcuuccuggaagaagugacuuccaagcugccaucugaaggacuaggacuugugcgggagaagagggcuucucgugcucaguucugaaggcggagggagggcagggccuggagggccagcguggccggggcuggggagggcuggggcgggcuggggugggcugggguggggauggccugagugucagugcuuacuuaaaccucauggaagugggagcccugagggccauggugugagcagacucaggugucagaucagccaucugcaagaugcagcagagauucucagauagcagggcccgggugagcgggugggcugccuggcggagacugugggguagagggcguggggugcccgagcagcggccugcuggcagcaggggagaagugguucugggucuggucugcugaaaacgugaggccccugugggaggucggaguggacgcaggaggaacacucaggguucuggggagagagcggaacuguagccagcagcacguggccaucaaggucagggcagagggauugugcaggagcaccuggagcgagacaguggugggccuggcuccagggaaaaggaggggcaggauggggcccuuuguuggggggacagugcccugcugcaggaggggcaggggaggaaagggacccgggugugaugaggucaggccccuugacagagcccacaucucgagccuccaacagccuugcuucaggauguccccacgcagucaucuguucauggcuagauacugacugggucccuagugucugcaaagccccaugcuaggugccaugaaguuaccaaguggcucaggugggccgcauggguaaggcacugucugugucggcauccguguucuccaggaccucagaccccucaaggacaggagagccccuggccccagagcucagugcgagagggaggcagugucaccugggagugccaagugcaagagaacucugcagggagaacgggggcgacuuugagccacaccuugaugugggugaucuuaggggugugcuuggucugggaguuuagcaggagguggaugccaggcgaggcaggcgcacauccgggugggcagagccccacuaggggagugguccagagcagggggggcugugucucuuccaugugcccucagcagcagcugcagcucggucucgcccuccccaggccguccccagugcugcugagcuacgguguccccuucgacguggccaggaacgcgcuccggcucagcgugggccgcagcaccaccagggccgagguggaccucgucgugcaggaccugaagcaggccguggcgcagcuggaggaccaggccuagcacuggggccgccuuccccaccccgcuucugggaagcccguggcagggcacaggguugucccuccaguucccuccugagggcugugccaggaugacugucucaugcccccucugcauuuuguccuggagugccagcgagugugcacccccaguuuccuucccuggaccccugcagagcucacagggcccaggacaccaacgccgcauaggacugcccacaugggaccgcccacauaggaccgcccacauaggaccgcccacaugggaccgcccacaugggaccgcccacaugggaccgcccacauagaaccguccuccaguggugaagcggaaacacuuagcuuuauccacccuccccacugggaacugggcacgccuguugugagugcccuuuccuggaagguguuuuuaucuggaagauagaauccaaguauuuauaacucauugucagccaaaugcuaucaugaacguaggaaacuugauuuuuuuguuuugaucauggccucuacaugcaccuuuccagaguggucucuucucaggcccuuuuuagucccuuuccaaagcugcccccaccacccugcuccucuggccucagugcacaguggcccccagccucggccaggccugcucugcucagcgcccaccgcccaccaccccuccugcuuccccgagccugacccuguuccgcccacuggcaaucagggcugcgcacuucccuguccacgguccccaggccuuccugucuugucccuuuugaucauuauuaacucaggguuucagcuccaaccucgcugaguuggugcagcuccaggucauuccuggggugggaaucggaucaucccugacucagcuuuuaccuuaauuuuauuugcagaggauucuuuucucaaaaugcucuggcauuuggacacacaucacaugucgauauuugcauaggagucauuuucaguggaauaacauuuuuaaugugugguuuuacgguucaaggaacuacuugaugauuuugaggaaacacuugccagaaacuaaauuaacgaauaaaagauuucagugcccga

SEQ ID NO: 191128 - RNA, 352780 nt, Homo sapiens
ggagguuguggggccgccgccgcggagcaccguccccgccgccgcccgagcccgagcccgagcccgcgcacccgcccgcgccgccgccgccgccgcccgaacagccucccagccugggcccccggcggcgccguggccgcgucccggcugucgccgcccgagcccgagcccgcgcgccggcggguggcggcgcaggcugaggagaugcggcgcggagcgccggagcagggcuagagccggccgccgccgcccgccgcgguaagcgcagccccggcccggcgcccgcgggccauuguccgccgcccgccccgcgccccgcgcagccugcaggccuuggagcccgcggcagguggacgccgccgguccacacccgccccgcgcgcggccgugggaggcgggggccagcgcuggccgcgcgccgugggacccgccgguccccagggccgcccggccccuucuggaccuuuccacccgcgccgcgaggcggcuucgcccgccggggcgggggcgcgggggugggcacggcaggcagcggcgccgucucccggugcggggcccgcgccccccgagcaggugggcuccgggccgccgggagugagggcgggggcgggcgggcgccggggccggccgggcgccguuuauguaacuuugucaaaugcugugaguuugcagaaaaacgucccugccggggguccgcggccccgcgcuugucgucgccgcugcgagcgcccggggggucgcgggagggcggggggcugcccgggacccgcucggcucagcccgcagggcgccagcaggccgagacggggcccggucccgcucgggggugggauccgcguuugccggcguugcgaaaacacaccacggaaucauaagcaaauuaucucguauuuacauugagcguugaauuauuugacacuguuauaggaggagaccgugcguaucaguuggaaaggccggggguggaacccaguguacucauuuaaugcacaucaaaaauuuguaauaacuugaggcagcugauaugaguguuuucuuuauugcauguuguaaauugaccugcugugacacaguuuucaaauaaagcguugcagaaauuaaacuuaaguuauuuuaaaacuaaugacuuucuucacuaaauccuaauugcaugacuguagagaccuaccuaauugcuugcugagagcaguucugcuugcucuccgugagggaggaaagggccugugcagucacuuugccgccccguuuuucucuguucaggcuuuucuguuuauucccacaaaucaccgaagcaguuaaggccugggaguaagccuguaaacaguccuggcccagcgccagcccagcaggacuggggggauacuggcagguuugcaccuugaccugguuucacuuuuucuuuuguaauaugaucgugguugccuggaguuuuaauugcuucugauaauucugugcauuauuuucgggacuguccaaagaaggcugguguggugguuucaggaccuagccaggaaaggugguggugguggcuggggagagggaggguggaagggagggagaucgaauuaagaaaacucagcugcuuguacacaaauauacacuacagcaguuacaaagcaacaaaaguuauugcagaauuuugcaguaacuauggcaacacaauuacucuauuauaauuggaaaugcaaaaugccaccgaguuagaaguuucaucagaauggaguuuuggauaucaaaaauaugugaaauuuaauuuuuuuucagguagcucuugugaauucuaaaaucuguguucaauuaccuauuuuuaagacugaucgggcuuucccagauauucuacucucugggaucuguggcaucuuuccccagaagaacucacauuugugugggagggaaguauuuucaugccuuaaaaacacacaccccaacacauuguaagacuucuauagcuuucuguguucugggcuuuuauuuuagagaucaaaucccauccuaaagagagcaguaaucaauuagaaaagaagccggcuguacucagcaggcagauguaacgcugcccucuuuaggguucuuucuccugcaaggggagcuggcagcaggcaugcccccgggggagcccugggcuaaggggacgggguggagggaagaugacuggacugcauaugggccuggaaggccuagggacgaaggacagauguggccucggagcccugcaccagagagaauguucuguguucagcagcuuccuagccaugcaaaauaaaaauccccaaaugccauauucucggaggccuugggggcuguugcuguagcaagauggacaggacaaccuggcacgcuggccacgugcggcucaggcagcccaucuggacucuguggccagagaccucguugagaagaaugcccuauggauguuuaccaggaggacucuagugcuggaaguuuccacacauugugggguugcugcaguuuaauuuuguuauaacucuuuccuuuuaacuacugcauauuuaugcccaguaaucgacuuccauucuccagcuucauugugagguuucaaugcagcaugaauggcuuugaauuccaauccuuuaauguuggggguggcaccaaaggaaaggcgacuuuaugcugucuuaauugccggagcagaagaaacauuucaucacuccuguagaauucauccauaccauucucuauugaaaacggcugggcuuucauagcucagaagcugccaugaguaauauauuaauaccugauguagggcgcgaaggagccgcagaggccgagagaacugccguugcugagaggcagcggggcgacaggcuguggccgggcuuuccuccgaggcucagaauugaugacuagcuggggaugggggaacugaagggcgaaggggcccagucuccaccuaagcuuggggcuguggaaccgagacugagccccugcccuguuguuggcagcccccagucuguccugggguaaggagucggaaaggauggauuuggagggaguguuuguuuugauuucagguggucagcauaugcccugccguguggugggcucuggguuuuuggccuugacguuagaggcggguacugcaccuucugguucaggucagaugaggggugccaugucaaaagugaugcuaccuuugaacagaccuuaacucauucauaagcguuucugugggaacaagugucacuaaggucaguaaguucucuucauacggucaguuuucuucucuugggcuucugugcgugggaagagugggaccuguuuugggguggcaugagggccauggugcugcagcauuaaauggccauguccccuugcugcagccucacugacaaaccuccuacucacuuccuagaaggagggucaggguccuacauguccccuugcuguggccuugcugacacaccuccuacucacuuccuggaaggaaggucgggguccugcauagauugcccccaccgugacuuccuguaucacugucgggggaugaggauguauccuggagcaaggagaugaugccacgagcagcugucacgugcucccguagcugacgccagaugagcaccugcuuggggcucgugcuguuucaugcacucaccauguaggugucagcacaguccugcaggugggcucuaccucuggaggaacuggggguagaaugaaauggaccaugugccacccccugcaucuccagucccaaaggccaguuccucuccgugccucugcuucuaggcugguggugaccuugaagcugaaguucagcuugucgaggugcuugggcgaacacagccucuuagagaagaggacgauuuggaauaccuuucuaguucagugucguuagacuuucuagugcuguguugacuguucuuggcgcuguuacaggcgcguuucauaggucugggcaguacuucuggcuuucucaugcugucuuaugucacgugugggacugcagaacuagaagacaucauguucuucuccugcaaaguccccaggacgccuggaggcaggugggggugacggaagggagcuaaugcuccaaguccacuucagccggagcagcuuuuaguguuuguuguucggucuguugauuaccuuggaagauuuuauuggaagaaagcauuugaggaccaaguuaaucuacucuuucaauaccaacccagaaaccuuaaagaaaaucuugacagauuuaauaggauaagaguuuuuuaaaaaaucucuuuggcaaaagacuccgucagccgggcuaagagacgagagagaaaauacauaccacauuaugccuguguaagcuuaacagucaauauauaaagagcuuuuacagaccaauaaggagagcaugagaucaccauugcaagaugagcagaacguaugaacauugaaucauugugccagugaugaaagguuagcauuacuaaucaauucagugugaaggagauucccuuuaugccuaucauauuggcgaguuugaugauaccuguugcuggucauaauaauaauuucuauuuuguaagguuuuugcaaaguuuaaguuaauguauggaaauuuccuugaauagggccuggcauguaguaagcaugauauaaauguuggcuguuauuuauuaucauuugcucucuggagagacccauauguauuauuauauaaaauauaauagggcugggcgagguaccuuaugccuguaaucccagaacuuugggaggccaaggugagaggaucacuugagcccaggaguucaagaccagccugggcaacauagugagacccucaucucuacaaaaaaaaaaaaaaaaucaggcaugacgucgugugccuguaguccccauuacuugggaggcuguggcaggagaaucacgugagccuggaaagucaagguugcagugaggugugauuuugccacugcacuucagccugagugacacagcgagacccugggcugucccccccaaaaaaguuuauauauguaauguauaaacauaaaauagugauuaccgaauugcucucuagaaaagucuuaagugucaaaaucuuaaaugccauucuccuuguccccacaguucuacauuuugaaaucuauucuaaggaaagaagauaaguguguagauauccagacguguguggaggucggggcugcauuauuuauaaaaggaguacuuguuaaaccugcuggcauuucugcacuguggcauccuccauguguagacaggcagaagugugcaguguaagagggaaaggcggggucuggagcaguccccgggccacuccugguuuuaaguacaugggucucuaagguaaccaucagaggugaggagacgggguacacuuuucuuuuauacauggugguauuguagagauucuuuugguaagcguguauuacuuuuuuacaguaguaauuugaaaacauuuagauaucuucauuggaaagaaaaguacucuuuaaguccuuggcaaguugauaaauaugcuuugcaauagaagaauuuaggggcauuuguuuuucuaacucacauguaagcucuucaagguggggacugacccucggggucugagcgggcucugcuacagcccauccuacaaacagucucccagguuuccaccagaagcagguuuguaccucucauucccuugcuugaaacccuggcaugacuuuccuguauucuuaggauccuaaggucucagggcccuggaaggccugccugauccuggccucuguuuuaccagccucaucugauagcacuugcuguguuuguggaguuucagcugccaccugcuuuacuuucuagcucucucuaaguccccuuugaccucggggccuuugcacacacuguuccccuuccuuggaauggccucccuuuaccuuccucuucuccagccccucaguucaugcucauccucucauccuuugauccccuguuaaacuuagccuaauagcuuuuuuccuccuuucuaacagcaucccauugugcaauuucaggaaggagcucauugugaccuuaguuguuuaaugccaccuuuucuacuagcuggggcucuguaggauugaggggcccugagggccucaugccugcucuguacccugugcuuggcaguguaggugcucgaagaaugaaagaaaaugaaugagugaaugaaugaauggaugaguagguagcccagugaauggcacaaugcgggccuugggugggagagcuggggugaggccccaccucuggccuggccccucugcgggguucuugccagugcucuggaauugccuguuuccugacacccccugcccccaucugggaacuucuugguccugauuuuggagauuacaugcuccuaaggagaugucauaaaugcaaguggagggaauucugugaugcagaaaggaaugggagggagaagggccuucaacacagcugucgaguggcaaaugcgacuguugugccaaggccaaggcaggugugugcagcuuguucuccagccgcuucgcccagggccccggcgugugaggaggcgaguggugcuuuuaugaagaaguuuuucucugcuuguuuuaaauuagaauuaaugacauuauuuaaucacuucuuauuuagcgucauaauuuuaauaugauacauuaauauguuuguguacauaaacauuuuggagucugcucuguuuaaaaaugugaguguugggcuuugugaguuuacuguuguuuaugaaguacuccgucugugugagucaagugcuuuugcuggauugauguuuaagcuugaaacaauaaaucaguucuuaggaccugaaagucugaaccagcauuccaagugggaguauuguucaagcggugauggaauugcauuuucccuugggaauggcccaucaucugguuuauguguugcuauuugcuggagcgguucuuuuuuaaacugaggaagagaaguuucugugguaucuccacuggccucccugguggugggguuggggguggagggggggugguccuugggggccauguucccugaauauuucuaauugauuaguuauuauuuugcaaauacucauuuuacaccccagcccaaguacuagguuuuacaugagaugagacucaguugaacacauucucugugccagacgcaguggccagccccaugaccccaggcuugaucaggaaaacuggccucugcccacaagaggcuuugguguugguagggacagaggagaaaaaggagcuaaacaggcaggugcacacgggucaccauccugagaaccagggcuguggcuggagggcuugcuugguagggagagccguggugcaggagccaggcccagaugaggaggaggaaggggaggcugggugggugggaauggggugugguccuuuuuagccagagccagaguuucggggcugcauugugaaaagggcauuguggccagaugguggccuggugacugaggucucugaggccagagugcgugagccagugaugagccgggccaacuggcaggcugccugggugggguggagguguggucugcacaaaggacuuccuugcguuuucauguauguguagucuucuugcauuuaauggagaguuugcuucuguucuuucuauuuugugcacuggugccuggcuccagcugggugauggaccugaucucucuuguucuaacuuuguggaggcaggcccauucagaugcaucccaaggaggccuccaggugguccauggcgcggcuaggcccuccuuggggcacaugcuugguggugcuguuguggggacuucugcaugaaaagcaagggcagcuuccaaaacaagggcaaggugaagaagguggcucacacgccgggggucccaguccuguggcucugagacgggccgcauccagaagggaggggguuccuuccuucuagcagugcuggcgagagcuuccucugugccuagguccaggauucuguagaguagcugucaggacugaagccugccaggagucuguguagaaaccgugcuggaggggacccgcugggggacccgagcuggcacccccagugccaccgguuuacacaccagaauuccgggucugaggcugagcccagccuggcccaucugcaggggccuugcuggcuggcaccgugccauguaagucaaguggcagaaagugggcccccagcaggucagcagagcguggccaagggccccugagccucaguccucccuguggccuggggcuaaucccagcuggcuauugaggacuuacccacccccaggacucauguccgagccccguaagcucagggguuagaguguucuaaggaggcugacccccauuccaccucugggggcuguggacaaggaggggaagauggccuguggguccacacaagcgggguguaucuuaauuagugaugccaacugugccuccuugcuugcaggauguggguggcccucugaccuuuuggaccuuuaaagugagccauaaagaaaaccauugggagguucuggcauauuaaaacccccucuacuauaaaauuuacaucagauuuugcacugaaaaaauccucauagguggucacaguccccauucuuuggagaacacuuguuugccagcucaagggcucuguguuggaauccgccccuuggcucuccaggucagaaggaugcaucaaaggagaugucacuggggugccugugucuucucgccuuucgagugccugcccugaagcagcuugcuuuccuuugccccugagugugcagcacagcccagcguagcucgguugcuggcuggggcagcagcugaccugcagagccguuacgugcaugcccgcugccauccgaggguagcagccgggcugggccaucccaccccugcccggcaugguggcccgggcaggauggggccuggugugggagcauccaacucaccucccaagcugguggggauguugaccuuuugggcuucggaguucacaaccaaccaugugcagugcuucccgcggucccucccugaagaagagugucuuuccaugucagcgugccagcuucagcacacgcgggcugcguucugacgaaguucuguuuucagaauucuucugguuaagcggaggccagagcugaggcacgugggagcugcggagggccucuucucuuguuucacguauccuucuccugguuccucggugcucucguggguguggggugaagggucugauugguggaugugcucucuccugcucgucacacugccaaugugccugcaguggacaagagugauuugcagugauguccuguguuccauggcucugggguguugagugagcaucgguugagaucccagcuucacugucaugaccccaucaccucagugaguccuuugucaucugcugagugagugucucucccgcagagacucagcuuuccucuuccuccucccccgcuggcucugaggacacacagcccucucugcuggcaggucuugggaggaaugaggaguaggguauguccccugcccggggccugcugcugaccgggccuuggaugcaccugcaggacuuucugaagcuccugcaccugcucagggugucucugcagcaggucguggugugguggacgucuccccgaaggaccuuaguacaguuugagaacaagcucucgucugccuuuguccuugcagggacugugucauaguuuacagagauuagacucuugaaagcucagaagcaccgugaugcuucccacggacacugucagcccccagggcaugcugcgcuuguuagggaccugaagggccagcgucccuacccgguaugcagagcccggcucgugaugguggcucagcugcuauggcauguccagauugcgccuuggccacagugugauucguaucgaggccgagccgaggccccuggcccugaggaugacucgagcggucugauggacacugugccacggcuuugccgucugucaugcuucccagugugcugggagagggagcugcccugagacuguggcugugcguaaauccaggcugccccgcuuucccuccccuugguucuuucugucccgucuucacugcuucugauuugcaugagcagggacccugaaggacugugugcauuuugcccacugccuuggucagagggcuaccggguguggcugcagugucucaagggaggcugcguggcugggugcucagguccaggcucggggcuccaggcauguggcggcuccugguagcaaagugagggguagugccgcucuggagggcagugaaggacagggagaugggagaggucagggcuggggcugcggccgcauggugccccugugggcacagcuccuccacagguggagggugggaaaggcacucuaaggggauuuuuggggguggcuuccaauauauauauauaucuuuugagacagaguccugcuuuguugcccaggcuggaguguacugguacaaucaccacucacuacaguacaaucaccacucacugcaaccuugaucucccagcuuaagcaguucucuugccucagcugccugauuagcuggaaccaaagacgcaugccaccauggcuggcuaauuuuuuguauauuuuguagagaugagguuucgccauguuguccauggcuggucucaaacuccugggcucaaacagucugcccaccucggcuuaccaaagugcugggauuacaagcgugagguacuguaccuggcuggcuucgagggagguauugagcagggagguauuucugguagcuccccaucagauaggaucucgcuagguacuguggccucagggaauuguuuggcuuguuuuccuagaaagugccggaggaggaaguauucaggcacuguuugauccagcuccuccacagugucaucuggggcuuguuucuuugcccuaccuggggagagucagcuucaugggauacacaggcccugcccgcugcucccaggguuauauacacuggcugguucacacccaucaggaaggacagcaucuuugucuuagcaagucuuggauucacucuccuucggucuggcuccagccacguauugaacucugaaccagucacugugaccggggugcagagcgcaccgaguggcucagccugggugcuggacaugccucuuccagaagccggcuggggaacuggccucccugguauggaauucacugaugucaggaaggaagggggaaggggacagaugcugaggaggaaagccgccaguagcguccucagugaauuuagcuccucgugccucaugaaucccagcagcaguuccagaauagucuuggugugggcucagugugcaugggugccacacugaacgcucugcggaccucgccucagaaucccuuagcgggccucuaggagggcagggugggccccauccuguguccggaguugguuccuuccaguggguucuuggucccacugacuucaagaaugaagcugcagaccuuugcggugaguguuauagcucuuaaagaugguguguccggaguuuguuccuucagauguguccgggguuucuucuguccagcagguucguggucuugcugacuucaagaaugaagcugcggaccuucgcggcaaguguuacaacucuuaaagguagugcggacccaaagagugaacagcagcaagauuuauuguggagaucgaaagaacaaagcuuccacagcauggaaggggacccaaauggguugccgcugcuggcugggguggccagcuauuauuccguuauuuguccccacccacguccuacugauugguccauuuuacagagugcugauuggugcauuuacaauccuuuagcuagacacagagugcugauuggugcauuuuuacagagugcugauuggugcauuuacaauccucuagcuagacagaaaaauucuccaaguccccacccgacccagaaguccagcuggcuucaccucucaaucccagaggcagaaugcgggcucccagggccugugggagaagcccucggcaggguucucuggcaguggagacuaacacacaguggccucccugugucucugcugcuuccugggaaaacccggggcccuggaagucagagcccaagugugccaaaauggccagugggaaagguggauagaaguaauggcagcucagcagggagaucccuccacacacucccuccgcugaugacuggcuggaugcagagaagccuggggcccuuagaguggggagugggggccaggaagggaggagccuguguggcagagucccugcggcugcagcccagugaccccaaggggcggggugggggcuccaacccacaggaugguggaggacggaucagggccauggcugccaaaggggggcccagagggugguccuuccagccgugcgguccagcugcccucuggggccaggcacccaggucacccagaggaccaaggcucugcuggucaucugaggaugcuccagagaaggguugagccauguuggcucaucugucccaugcagaggugggcaggugccugagaaggccgaugcaaacguggcccgggcccagauaguccuggaagccgcacugaccgcaucugccucccugcgggcaagugguguguuagaaggaaugugcuuugggauuagguggaugagcuucaaaguccaggcuugcggcccuccagcgagcggagagccacaguggucaguuugccaccucccucauccggguccacccaucugcaaagcagacuucaggguuuccuccuugaagaacuguugucaggauaaguaacacaggaggucaauggcccagccuuuccccaaccccaggugcuaugaggugaaugaacucgcugccucccucggcuucagggaggaccugcccagccgcguccugccauguuucugcagugggugucuucugugugcugggccccauguuaugacgugugguccguuagucccugcacaccuguggcguggauacccguccucccgucugauaccuguggccacugcggccccaagcgagagcggugggguggggguguggaucugagcuggcugcugcuccugagcccacgccuuccacuccccuuagugcccauugcaaugcgugguggaaccaugagccccaggcaggaggcgcggcuccuccaggggcgcacucuuguuggaaaguagagugaggaggagcucggcuuuuuaggcuuuuuagggcccaggugcaucuugguggagccacguuccagcugcucuggugccauugacccaaccgcucuaagccucgguuuucuucuccacacgaucagaauugcaguaucccugcccuggcugaauuguuuuggguauaaagcguauugucccugucagcuggggcacaaggcuggcacagaugcugccugaagacaggcuggagcuuucucuggucacagagugcugugccucguccugucucuaggcuggagggagaggcagagaaccucaaaccugcacaccucuaagaggagguuucuuccaggcgaaggugggggguuuuguaaaguaaggggugggaggcucuccugggcauugcguugguggcggccggcccugugguccuggccaggcacgcagcggcgggacugaggcuggaaguggccuccuggccugggugcaccgggggaucuucuggccacucuccagccccugcugcagccauucuggugcuugugggcccgcggcugcuucagugggugaccccauccaggccacuugugagcaguccccucuucucugucuuuagcucccacugaaguucuaggacugcagcccuagugaguguucuuccuccucaacacacauguacgugcgugugcacgugccacacacagcaagcauucccacccacacacucgugcuccccggacacgcacacacccucauacagauagacgcacggacagacaucugcacacacgugcucacgcacuggagucgugugcagucuggcuccucuggcgugauuccuggugaacccagaacagccacucaccucugaucgcugccaccuaaugaggaaggguggaguuucucuaaaauggguacaucugaugguggugaggguggcgaaauccucucucaugcacaguucucacccagcuucucuucucuccagggagaccacuguguuuucacuguuagaacugggcugucucuggacaagggccagccuuguuacgagcagaaguucucgguacugugucugggauguggcucuugcuccucuaggucgugacuacguuguuuaugaaagucaagcucuuacaccuaaagccggugcucaugggauuuccuuacagugcauuacauuguuaaauuucaggcccagacguggucuggcggcuugucuggaacacacaguggugcuccaagcaugccucugcauggacgccuuacccaccaacauccgugggcuccagaggccucgcacccuccccuggccggccaccccgggaugcccccaggaccugcacccucagcugacgcuccucuugggaaggugguuuugaaccucugucaugugguuccucccgugguugggacacacucaucugccucuggugugacccaucucucuuuggucuuuccucgucccuccagugccacccauuuucguacagaaacugaggaugccucuaauuccguuugagcauuugagucucagugucugugaccuugacucccccugugcggccgccccagccccagcagcacagucaggacugggaccugacaguggcucugaaccuccgagacacaggccccagccucucuucccugugcuccgacucucagccuuccuucucugcccugguccuggcauccuguggcucaucauugucuagaguaaaacgcaggccccucugccuugccugccgggucuuccaggguuuggcccagccuccccgacccagauuccuucucccucauccuugggucuggccacauuguuuagcccuuguuuagggcacaccugagcuuuccugucccugggccucuguuuaccuugccuccggggcuuguuuggggcucccagagcagagcuguaggagacugucuuggaccgcuuuccggggcccaguggccucuuuuugauucuguaccggcaggaagggucaucacagccuccguggcuuccucggcacucaccguggcuugccuggccuccuguccccuuugugaguuguagugaguaauggacgaggcugcagucaggcucccuguguccuguuguaucacaugguccuucuggggcuccugggguggcgucuguagaaucagggacaggcgugugcguguuccuuaucacaggccggcuuugcccacugguaggcugugcugugcacgugaagcugcaagggcuccuggcacaggcaggcagggggcuugaggcugagacuucagagggaacaggggccccuguggccacucauuuccaugcucuagcucugccuucccgcucuggccaccaacagggagccggguggaggcagagcuuccccgcugcugagcugggcagagucgugggccaggagccuccuuuucuucaguccucggaggugacccggaggcccccggaaccuccugacacugccagccagugcuuccuccugcugagagcagccagcccgcugugugcccccauguacugagcuccaagagugucgccucuggcuaagggaagcugagggcaaggcuucuuccugaggcuuggaggagaccuuucagcugaggugcuggggaugcuggggagagggccuccacgcaaagcagucaggggcuaugggccuccgauugugccaguccuguggaggcggccgggaagcaaggugcccuucucaggagagagagccaagauggaagggaagggaugggaagggcucuuccauggaagccuugucccugucccugugcacaaaauguccgcaguucuguucuccuguauccuggcucgcuggagcccuugggugugcaccuccccaucaguuucugggcccgguggggugcagagaggagcccugagccccuccucagguccugccugugucucaucuuccuggugcuugguccgagggcugauguauuuggaaguuuuauuuaagcuguuguauuguuaaagugucaucuuuguauguguuugaauacaaaucggcauuuuagggaucagaagcaggggacagagccgugggguauauggugcuggggccauguccacugaaacaaagcagacucauuguugccgccuaggacccauuccuucggaugcagggcaguuuucccuucucuuucuuuucuuccguuuccuuugccuuuuucugagauagagccuugaucuguugugcaggccggagugcagugggacaaucauggcucacugccgccuugaccucuugggcucucuccaucugccugccucagccuccugaguagcugggacuacaggcgugcaccaccacaucuggcuuuuuuuuuuuuuuuuuuuguagagacaggggucucacuauguuguccaggcuggucuugagcuccuggucucaagggauccucccaccuaggccaccuaaaguucugggauuacagguguaagccaccaugccuagccucaguuuucuuuuucauuaaacauuuccauaugauagagagagguacuaaaauaugucauuucgaauguggcuuuagggagaucauggaucuuuucagcccacgcagguaucccagauuacgaacagcugauacagaggaccugggaucugggcauccccuaauauuagccugggugucuuucccaucgauguggugugcagccaggucccccuggguuuucugccuuugcagagcacgauggaggguugcccacgagcugcuucucugucuguguccgggcuguucguggcuucccauuagaggcgagaguggacugcgccucguuacucacgucaguaggccucucgcacggugcccaggugccagcgauggcagcucuuccagccgcccugcccuccaguggcucucacgucuguccuugucuggccuuguuggcggggcugaugcugucugggggacucugugggacuguguggaugagcuucauccugucugcauccuguuuccacuuuguaucauuuuucucacuuuccagucucuguuguccauuccugccccggccaucguugagggaggggccaucagcuggcccgaggcagugcucuacccugccccccaccccacgcccuugagugagagcugcugaggcggugucguugccgcgcuuucucccaccagguacagagagggaauaaaugguaauggauugaucgggcgcucuuugagcguauuggguuugcaaaacuaacugcuuccuuguugcuucauuguggcccagacugcgcuugccguggguuucucuguggcgcucagaggagccaguugaggaggcaccuguuccggcugagugcuuaagaagccgaccucugccaccccugccccugccugcccacaugucaucagaucuguuuccaagcccugcuccaucucccgagaggcagcuuuauccuucuuucagauucugaacucacagacacugacguuuguccagccuccaagcgaggaucugcucagugguuaugcacuuuacgggaaggugcagggcucagagcagugccagggccuccugcuugugaggggcaucaugguggaggauucccccugugggcuggagccagggucagggguggccacgggaaacaagcacaucuuccucgacaaggggagccuuugggugagcggggugagauccgugaacuggacugugagaccguguuggagaacacuggguauuaagccaaccaugccuguaacgugggcaguuacacagugaaaugaacacuucacuugaguuguuagaaaguguaagcuguugcucacgccuguaaucccaguacuuugggaggccgagguggguggaucaccugaggucaggaguucacgaccagccuggucaacauggugaaaccccaucucuacuaaaaaaaauacaaaaaaguuagccagucgugguggcucaugccuguaacuccagcuacucaggaggcugaggcaagagaauugcuugaaccuggauggcugagguugcagugagccgggaccgcaacauugcacuccagccugggcaacaagaaccaaacugcgucuaaaaaaaaaaaaagaaaaagaaaguguaagcuguuaaagaaagcucccaucacggugggcuggcuuuuccuggccuggccccacccacaggaccccugggcuguuucuccccuuuguggggaggagucagggaagcccuguuugggggcccauguagagggcagagcacuguggcuccgggguucagucucugagacguggcccaucugggucacucugggugguccuacccauuacaugaucagaaaggcacaaaguagaaaauguguaucuuguauugccugagaguuuuauuaaagcauuuccaguaucauuaauauuagaggaacuaaauugguagaauagaucagcaauacaaauaagcaguugcuguaauugggaaaaauacuaaugauuuaauuugcauauguggcagaagcgacguuuuaugauugcuuugauaauaaaagacaggcugaguaucaccaaugcacgcaaauaaagaauccauuaauucuauucauuuaaaaaaaugguauucccagcuucugcagcgacaguuuaacaauuagcgugccuaauuuuaaucuguuacgugggugcagguccugacuaacuugggaaggcagcuccugcuggugugagucugugcugucgcugauugugcugaggaauauggagaucccagcccuuggggaagcagagcccuuggcccuagggagccguaugugaucuguaucacuguuggcuuugggggccugagcaacugggacuguguugcccuggcuuccaaagcccagugagcagucucagcugauggagugugugugugugacguggaacuggggggcggugacuucagucacucuggcuugagucuauuuuaggggaucucucgccuaggagguuuugcacccuccucccccaggggacauuugucagugucuggagacaguuuugguugucacaucugggggcgugguacuggccuguaguaguuugaagccaggguugccacugaacauucuacagcacaugggacaaugaauuguccgucgcaaaugucauugguaccuagggugagaagcucucuugucauuaaguccagaacaugagcauuuauuuagcauuagaaguaaauggcaccgcauuugcccaguauggauuuuguuccacuguacagucauagaacuuaaauaguaauuuugaaaacucuugggacaaguuacauacaucauuuaccagcuugggggugaggaaaugaaaccagcuuucauuuacauuuuuuugcaugugaauaaaauguaccuuucuccucuccuuuucguuucuuuucauuucuccaucucuuucagauuugaaaaauggguuucgauuccccagaacuuacauuuucccagccagagcguguuuugcaugcagauguaguucgagauaacaaagaggcauguuuguguuguagugacuacauaaaaagaaaggauauugcugaauuguaaauugcauuuuuagaauaugcuaaaacgaagcacugagagucauuugucuucacugcagcucagcucacugcguguuuucauuguagugauugaggaaggcggucgcgggaggcagcuccgugacucuugguuccuagacgguuuccuuccucagagcaucgcguguacgucacguguucaggugacagcucagucaccauaaauauacuuuaaacauccugauguguguguugugugugggaugcuguuguuucagucacugccagucauuuucucagcuaucaggacgugaacccguguuugcuccuugcauccgggaggcgcugcugaggggugaccucgauccacaggaagugugcgcuguguacgggaacguuuaaaccgggcaucccucguuuucugagaugggacgugaaggccgaguggagaucgguaggcagcagcaaugccucugaaguuggggacaaagcgggaaagaauccaugugaacaagcaguuugggcaauuuauuugauuguguguguguuuccggcuuuuaaauauaaaaaaaauuuucaauugugguaagaaacaccuaacaaaauuaaccauuguaaccauuuguuaguguacaguucagcaguguuaauuauauucacgugguugugcacccaauuucuagaauuuuuucaucuugcaaaacugaagcuauuaacauacacccauuaaauagcuauucaauuagaguuuuuaaaggcaggugguucuucugaaacacaagguuacugucaggcccguggugaacucaaauguuugcuaacuauagagagaaagaugggaaaaaacaaauguuuauacauacaauaacuauagcuacacauagauaaaauaugucuauauuaucaauauagaauacauaguaaauguguauuuauaacauauguauaauuuaauguaaauguacauuaaauacaugaauuauauaagaaguuaaaugugugcacggacgugugugugcauaugcccauccucgauuuacccaaagacgcgggccauugcagagcucgcgcauuccgcagugggauuucuucuuauuccucugguccagaucuccagaacugauugugcuguuuucuuucucugaaugaaucgagccucaugagggcccucuuggcucuggcacccaugggcccacgccgcgcccccgaccccaggucucauccccuuuuucgugcacgcccucccagcccaguggagucuuggcgcccccggcuggauggcaggcuggccacacuccaccacgggccagauggagccugcagucugcauccgcuuccccccgagucaccccgcagccagguccggagcauuccacugucucccuaucccacugucagugucugcgugcaggugcugagccuggcuugguguucuucuguccuuuguuuccugugacccuguggugagugugaccccgugguggggcaggggcugcucucuggccuucccaguggagaggaugagcaaggggccccggcagccgauggggggcuuggagaaagggcgcuuaccccacccuggggcuccuuggggcugccaggggaauggugcccaggcuggcucugaagauaggguaagaugacugggccaccaaggugggggcuguggggagcgcuagggaggcccugccaggagccggugcccugagagcagggcgggcacugggccagcucaggccgaggggaccugccagaccccuccugggagcuuggaccuccuuggguaagaaggagcagaccuugauggggcugggcuggggcugugcuugagggacuggagggugacaggcagaagagggcaguggcuccacaacggguagacggggugagucuuggugucugucagugacugccagcaugcccagcaucaucacacgcucugcuuucuccuggcaccggccuggugcgucuccccggggcucgcccaccugcgcgggagccagcacuugcagggacccaccuuccuggguuggucaccuggcuuccuuccucuccacccccagcgcccacucccccuggcuggacucucccucuguccuccgaggaacagcuuuucuuggcggccuccacccccagcuccugccuuccuggagugacuugccccugggcucccugucacuucugaauuacuuagccugaggagcguuucuucccuuugugucuccuucccuagggcacuuccucuuuaccuucccgucccaccccugcggcugacacugaagauucugcugugugccagugagugagcgggcccagcaugggacacuuuuccuuggaaaugaggggaaagagggcugcuuccuggggaacuagacagagcuuggcagucuucgaggaggccugguguguccucuuuguucgaaagacuguuuugccucaggccaaauuguccgacucugccaaggcaggaaggagaguaggagaugcauggaucccucaagugaacaagagaagagcccaggacaugccggggucauugguugcuggggucauugguuccugggguuauugguucccgggguuauugguucccggguucauugguucccggggucauugguucccggggucauugguucccgggguucuugguucccgggguucuugguucccggggccguuucaggccaccucuggcuccugagagcgaggggagcccauggaggccugcagaggagagugggaggugaggacagggaccucuggauauggcccucaacaguacgaugguccuugugaugcugccaucuggguggugcacguucagugugggugccagcccuggcgcagugucagaacagccguggucacguugagcaugugacucagcucuucguuccccggggccaacgccuucccucuuccaggccaucaucguguggaccccagcugccaacuccgucuccauccuggacucugcuuuagugcccuccccacccuggucaccgcuggacuuuaugugccugggugcucgucucccccaggaaggaaggaaguccccaagcugucacggaugcccacugggcugcucuucgacagacgccucaggguccaagaggugucucccgggccagaucuaugugcacagggcauguccccaggcugagaggggcacccaccugccgcuggcauuccccggauguuggcugaguggaggggcaccgcguuugcuggacagaggggaugccucaggacgcgacgucuccccuggaggacaauggccauaauucuuuuugaaaaccaggcauuuugauguccauagaacuccuauuucagggaaaauuagagguccuugagguggguguaaaaccaagcagguggggcgcucccccuguggcauauggagacagucccagcagaagguggcggcagcugagcucagcgcggugaucagucuugggccugggcuugucugccuggccgugcccaguugugucugagauguccgucuugcauccuggcaggugcucuaggguccugggggucuuuucaccacguugggucucugcacauaauacuggucccagccagaugagcugucagcccugccccuugugagaagccaguggugagacuguggcccuggggccuccugcccgcaccucggcugcuccagguugguggucugggcgaagugaggcaggauacaucauaggucccuuuggggaaggagaaucucgugcucccuccauuguggugaugcacugagagguguggagaucugcauagaagacagggccuccaggaggguccagagaggcccauugguggcagagaggaugcaggcgucggggcagcccucgugacaggugcuguguugcagccuggagcaggccucucaugcuggcaacacagagagucacggagucagaggcccuggacauuuuggggccuccagaggcacacguggccugugagccagcaccuguguggacagcgcccuggcaguggcuucgguuaguggacggccucguaaccugugguggcgacgccugagcuggggcagcugacgccuggggaacugcuuuugguuucaaguucagagucagagugagcagagguagccuuugggcugccauagaggagcgcagcccaccccggcuuugggaggacagcaucugggcaccgaaggcagaggccccgcaggcuggggaugucucugaagcacgcucacggguaagguguugguuccaagugaccgugucuggcagggcaguggugugaguaaggaaguggucuauguccaggagggacgggcguggaauagcuccccuuccaauaaggaccugcacucagagccacuuauuauugaaacuugcuaucaucgugcaaccccaguuugugcuguaguugucaucagugugucagaaacauuuugugcugugcuuacucagggagucugguuccaccgagacccugccucccagccguaugccugcauuaugaggauuugugucauagcaguggcguguucuguugagcacuguggcuuuuuaaucguuacucaaguguggccacucaggcuguauucaggaacacacggucugaacuaacaaaaaacuaggcgucccgggcaaucuguggcuggauggcguucaucaccucccccuggggcggguguugugcucccggcagguggugugugugguguggccaggaggccauguuacugaugguaguagacacgugccuucgggccagggcggucgacagagucugugucccaccucugauggcgcgguggugacaucuggggcaccaucaggaggguugugagcacacagcaccuuccucacaucugggcaccaucaggaggguugugagcacacagcaccuuccucacaucugggcaccaucaggaggguugugagcacacagcaccuuccuugguguuuggaugguggaggguugugagcacacagcaccuuccuugguguuuggaugguggaggguugugagcacacagcaccugccuugguguuuggaugguggaggguugugagcacacagcaccugccuuguuuggaugguggaggguugugagcacacagcaccugccuugguguuuggaugguggaggguugugagcacacagcaccugccuugguguuuggaugguggaggguugugagcacacagcaccugccuugcuguuuggaugguggaacaucauugcccagaaccugccagcccugcuuuagggaccaucaaaggacacauugaagcagagucagacgaggcuggccccagggcguccagcaggcuguggacaggacaugacgugguccaggugacacucgcagucggguggggugacugccaggcaccccccucuucuccagcacccucccccauaagggccggcaagaggccugggcugggcaagauugccugcagucgggggcacucacugguugagggagcccagacuccccaggcccccuggggggccauggaggaaacgcccguccagagcaccuggcagugggugcuccauggcaagcagcguccccaugcgaucuuccaccccagacugcccuucugcugcgccacuggagccugugcgugacugaguuggcaggacccucuccugcagucauacuggaaggcugugauggccuguagcguccgugguguccgugugccagguaggcgugagugccauccuguggacgcugugaggcgucaccacucgcugaggucagugguguugcccugguggggcugaaucugcauggaggacgcucaggccugaggcaggggcuucgcuucacacauccucacggugggguugggcuggccgugggccaccaggcauccucgcuggcccggugaggacaagugaguggacgguccguggccuggcagguguucagggaacauuuagggacaugcguggaugggagggugggugggcggaguccgcaggccugcaggacagcagagagaccaagcaggcucuggcaccucccggggcacccucugcuccucugauucccaggccccuggcucugcugacuucuuccuacguggcugcccugccccaggcacaucugggcguuccugcugccugguucccaaugucaguguucuucacagcucuguggacccugccuggcucugcguguucucccagcugacccaucagaccccugcggcugcccuuccugcccgcagcaggcaacuccugagucugucuagcucacacccacccguccaggugcccuggcagcgucaccccucaccugggucuucaggccgugagccuuagggaccgucccucucuuuagaucgggucucugacuuacacagggugcccgauuugcacgcugcccuucacguaccgccagggugggccugugcagcugacaggaccuguggccagcuuggcucucguccagguuuaggugucuuauuuucauuuuaucugaaauuugagaucuucugauuaucuuugauauucugaaauuuaaaauuuaucccauuuagcacacaugaguuaacuuaauuuuuaaagccuuguuggccgggcgcgguggcucacgccuguaaucccagcacuuugggaggccgaggcgggcggaucacgaggucaggagaucgagaccauccuggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaaaaaaaaaagccuuguuuucuauucaucuggggugguuuccuccucuccuggucacccucgucaucauugucggcaucauugucauuucccugcagcaccucugaccuguguuuuccuuuggugggauuccugugaaugccauuuuggcuacugguuuauuucucugauauuuacucaaugugaucucccagguccucugugcaguuuuguucugcuguucaccggcugaaguuccaggcccugcugccugaucgccucugcuuugcauccguuggugccuguucugcggacgccauagcaucacuguucucagugucccuccuuagaggggcuugaauuaccucugugucuuccgggcucaguuuuucuguguaccuuggucauucuuuuucuugcuucaacuuuuucaguggcuggucaauuguucauaucuaaguaugaggggaagauacauuucagauggauucaaggcuuaacuguaaaaaguaaagcaagagaaaucuccaaagacaauuggggcaucaaggacccguccucauugaccccggaucucuagaagcggacaaagaugcaauugacagaauaaaaaugacaacuuuugaguggauaaagauauuagcaacaaagucaaugaagaaaugagaguuuuggaaaaauauguguaacauuugacaaagcugaggcaggcggaucaccugaggucgggaguucaagaucagccugaccugcauggugaaaccccaucucuaccaaaaauacaaaaauuagcugggcgugguggugcacgccuguaaucccagcuacuugggaggcugaggugagagaaucgcuugaaccugggagguggagguugagccgagaucacaccaccgcacuccagccugggcgacagagugagacucugucucaaaacaaacaaacaacaacaacaacaaaaaguuuacuauggagaggucucuuccaaacuggagagaaagaccaacauuagaaaaugaacgcucagugugaccaggcagcccagggaagaggggucguugcagacaugcccaaacuccccagcccccagggagaugcccagaaaagucagcagagaucgugcuuuuuaccuagcuuggcagaauauggcaagagagaugguguccauuacaagggaggauguagaggccgcagcagugucgggcauggcuggaggagguacgcgcggcugcagccucuuuagaggucguucugcucacauguccugaugugagaaauaagcagauacuucacucagcccccacucccagggcugugcuccacagggccacagaccccaggacgugaggcucuuugcacccggcagucucuugcaguguugugguaagagucaaacgcuuggaggaaagucugugcccaugagugggagaaugcuuggcuaaauguuggcacagccacgugacggacucccccgagacaugguauugaaugagaaacggaagaugcugagaagucuguaggauacaauuucauuuuuggaggcagugaccaccuggugugugcauguguacauaugugcacaugugugcauugugagcaugugugugcguguguguguauguguauggaauggagggaaguguggacagcaaccacgcaaagguuuccuguuggguguuugaugguggagagagcaggaaagagagaaagaagcuauugcucugaacaugaagcagugugucuguucugucgcuguguauaaacugcuugcuugugcguguugccgcguacacucuguagagagaggggaccagagcuccugguguaccgggaggccgggauguaggagugggagcugcagagcagcguguggagugcgagucuuugggcacucacagaagcgaagccugucugugugugugcgcgcgugugugcgcgggagcccagcccaaggaaggacccugguggccuugcaagggagccagggacagagaucaccugugugugucuuuguguggugguguuacucuugugguaacaacgacuuuuguaaaugggagugcauggcugagguguugcuucuuaaaggcaggaguaaggaggagggcccggggauggggagcggucggaugaguagcugggcccuuccagugccggcuugagggccuuuucucuggaucacaaacuccccaccugcugccucgggcaguggguucuguucugguucugcagaggagaguccuggggcccacuguccaggaguuccugagacagagacccucagggaggcuccccaucagguuccuauggguuccugcuucacccuacugcccucguuggagagacccccagcagucuggggccuugaggaugccucuggccgagcagccacccacgcgcccugcccuggucugcuuugcagcucugcgggugcagcugcucccguccgccagcugcuggauguuuguggggcauuguugaaaucucugauggaugcugcccccugccccuccacgggcucuucacuguuuuggguccaugccugugcuaucacuugauuccgauuuaacaauacaggugaaugaggcagggccggaugcgcaggcccagauccucaucuuugugcaaaagcuuugagggaccacagguaaaggcccgggccacgccgacagaggcuccagucuccauccugcuugugcggccaugccugagccagguccccugugcuguugccacacacgugugugugugagugaguccgugcguauguguguuugagguuauaugaguguauuugugagugugaaugugugagcaugaguguuugugaaugucuguggguguguuacacugugagcaugagugcauguuugcaugaaugugaucggguguguuuaagguuaugugugugagcaugcauguuuguguguuuguguuagugugugugagugccugggugugagugugcaagugugauugaaugugugaguuugagguuguguaagugcaugcuuguguuuguauuaguguauaaguguuaguauaugagcgcauggguuugagugugcguguuugaguguguucaugauugugaguuugugguuaugugagagugugugugaguguauaaggauguguguaugugauugagugugugaguuugaggucaugugugagugacacacguguuuauauguuggacuccuuguuggagccuggccugaguggacggggccguggugcaggccagaacaggugucugcacagacaagguggccugaggcgcaggguuccugccuggacaaagguggacucuguccugggugauucccugucccagcuggggccugcccuguggcugccaggagcugaggagugacugacucugggggcgacaggcugugggaagcccugugguguggacagcagcugcacaucaguggcuccaaagggcagaggguuagagcaauugcccuagauggcagcugucaucgacuauccaacuaggagaugaggggcauguugguccuucaccuuuaugacucauuuagcugucuguaauucaucccaggaacguucuuaaaguaaucaucaucauuuugaaaagacccagcaugaugcggggaugagcugugaagacagguuuucaagcccaaguccagugggugcucaaccagcuccucugcucggcuccuccaggcgccgcagggcugcaggugcaccagccuuuccaccaggugccuggccagcacaagaguccugcucucccggaggccgcugugcaggaucagcucugcacuaucuguugccguuaaccauacagugcaugaccuccugaaaaacaccagacaugcuucacaggccccagggcuggcaaggcagggagcagggaggccuggauucaggggggcgcugcagggaguccagagugcccgugcugacuggguuuggucugucucugggcaaauccaguuuuacaagucugcuaaguagcagucuuuaaaacugcaucuugauugguguggcaccugucuccugccugcgagaaccauaccugcuuuuacucuacccuuuaacaggagagccccgagccaugucuuucagugggaucgagggaguuggaacauuucagagcuguggggugccucccucagcgcagcauuuuggaccucuagcaccacucucugacgguuguugguggcccauggcuaaggguugcaugguugucuuugcauuuuuaaacucuguuuugaccccgcagagccccuugggaaaagucgggaugcuacccucacugaccugccagucccggggacacagggcagacggccugccguccuguacagggccccgugcaucugggcgugcuuuucucugccucaugaagugugucgccagccacgcugcaaucaucuguucuuuaagagaaagaaaaguggagaugacaggauguggcgguccuaugauucucuccgcccaccagggaggaaugggaaguucccaucagggcaugacgccacuuucaguacaagccuucaggcaucugugccacuuccuuucaugcacccugcacuguccucagcuccuuuaagcucuucauuuccguuguuuucuaugaaagguggcuacgauucuguguguucugcuugagagaagguggcccaggccugcugagacgucaugggccgugucauccagcaaccuggcuuccgaggcgcuguguugaacacuucuugacuucaugaguuuauaaguacuucaugcccagcuacaccguguacgcggaaaugagagcagggcuugacccgucucuugauuaucugcagcaguuuuaauuuauuuuaaaauagaaauagcuuugcuuuuuacauuaaaauaaaaaugcuuuuuguaaacaauugcaacaauaaauaaacuuagaaaguaggaguuuaacgaaccucugaguuucgcucacaugcuugggaaaccaaccggguuagcgggacuguagcuuggagacauugcagcccaagcggcugucucuggggagcccuguggcucccgggcugcccaccccccgccgggcagucggcuugcugccaccagcaggugugagcuccaaccguagacaugcucuugguccagacguccauuuauugggacccaaaacucagaacugugggcaguucagaccuggaaagaugaaaggggaccgucggggaaugggccgugcugcugucuuccuucccgcuuguuggcaucuguccaagccuucccuccuuucuuggagacugucaccagagagggccugucugugucuugucaaacagagaggauuccucccugccggcgagccuguccacugccugugugugcagguccuuugucaccuuccugcagcuucccuggggucaccaggggaguggugugucacccgugggguuggcauucaccuccccccaggugagggcucucugacggcugugaauaaucacagcagcagguaccaggauugucugcggguucccaucugcagggcagccucagcugucgaugccgacaucgauaguuuugaguagaguuggggaggaacuugggcuaucaccuggaaucaaagcaccuuuauuuacugcuuugguccgaaagaacgcaacacuuaggaggguccacuccagcagugauaagcaccucaccugcagaacagggagggcugccugcccaggucucccaccucaccugggcaggagaggcaccugcagcuugagacaggcauggagaggacgguccugaccacugaggagugucugugucuggaggaaacagccugugccccucuccucaggacggaggcccuucacuuguaccccccuguuaucccccaauggagaaggaagugggugggcggcugggacacgucaguuuccaguuuuucuugcuuggcacccugucaaucuugaguuuguuucaagaagcuguucugcugccuugaugagacccccuccacgugaagaaaggugaaaugcagcagcgccagccacgcaagaugguacugugcuuuggacggugcauuucagggucuucucaucgcccccuuugcuagucccugaauuccucacagccaaguuccugugucucugcgggccccacaucccucacaucugacauucagggcccuccugugucuccgaaggaagaggguuggaacacaccugcagagccacgguucucaaacuccggagcccuucacacuccugcaaauuagcauggacuccaaagagcuuuagcuucaaugauugagaugcacaggcugacugucguucugacgugcuugggaccagaaguguucaggcucucagaguuuuuggauuuugaaguauuugcguauacauaaugagauaucuuggggaugggaccugagucuaaacaugaaauuuauuuauuuauuuauuuauuuauuuugagacggagucuuacucugucgcccaggcuggagugcagugguguggucucggcucacugccaccuccgccucccagguuuaagcgauucuacugccucagccucccucccgaguagcuggaauuacagacauacaccacuaugacuggcuaguuuuuguauuuuuaguagagaugggguuucaccauguuggccaggcuuaccucaggugauccaccggccucagccucccaaagugcugagauuagugugagccaccacacccagccuaaacaugaaauuuauuuuucauguucaccuuauacauauaaugugaagguaauuucauauaguauuuuuaauaauuuuguucgccaaacaguuuugacugugacccaucacaugaggucagguauggaauuuuccacuuggguuuucauguuggugcucagaaaauuucagauuuuggagcauuuugguuuguggauucuuagauuagggaugcucaaccuguauugguauuuauuguauuagaaacuaacacacaucuaaaaaacgugcuuacucauuugaaacugaauaaacccauuacauguuaaauagauagguaacauuuuuaacaaaaaauaaccguucgguaaaacacaaagcgucgugagaagagaggcaucauuuuacccuuugccagucuauggaagguguggcuuaauggcgacaguauuucugcuucucacaccggcucucguucaguccauguccacuguaccccugugagagaagggcacaugacauuuuucuauuaugaacaaaaauuugacuucacacaccucuuguaaaggucucggggacccucugggaccccagaucgcauuaugaggaccgcuguuuuagaaacggguuucuguguggcugggggccugggggcugaucacuuauuuggccgauagggucuuuugucaaaggguuguuuuccauccgcaagugccugucagugacggaggcuuucaggcauguuguuggugaagcucaauucaggcccguuguuggugaagcuacgcgugcuugggugcauggugguuaugguggaagagaucuuuccuuacuuagucugguacugacauaagguucuggggcuguuugucaccugcccugggggugcccugcguagggcagggauaagucagggauaagucauguuuuccuucgugggguugcagccaucugccugggaccccacuggccuuuugcucucucgggguguucauggcaguugauguuaaaugauccauugagcccagcguuucacaccguaagucaaauccuugggccuucugugugucugucugaaucuuuuucucugaaauucuuuuauuucacagcaaacggaaacaagucuuguuuuaucuggaugccuucuccauuuggacucuuccucuccagaguuuauuuuaccaauaaguuuguacaugcuagagaucauaggccagaauguggaucuuuauccacucuuaugcuuacgcagacuggcaauaaacacaccuaggcaucugcaaaagggccucagugcugacaucucuuuuccuccauggagaaaguucagugcugacgucuguuuuccuccauggagaaagcugaugcucuguugcugcuaacggacaguuauucuugugcguucaucugugugucuguguccgccagugccacacgcgugacccugacgacccugcucugugcaugcauguuuguguguguccgccagugccacacgcgugacccugacaacccugcugugugcaugcaugucuguaugugucacauagugccacacgcaugacccugacgacccugcucugugcaugcguguuuguguccgccagugccacacgcgugacccugacgacccugcucugugcaugcguguuuguguguguccgccagugccacacgcgugacccugacgacccugcucugugcaugcguguuuguguguguccaccagugccacaugcaugacccugacaacccugcugugugcaugcaugucuguguaugucacauagugccacacgcgugacccugacgacccuggucugugccugcaugucucugugugucccccagugccacgcgugugacccugaugacccugaucugugcaugcgugucugcgugugucccccagugccacacgugugacccugacgacccuggucugugcaugcgugucugugugugucccccagugccacgugcgugacccugacgacccuggucugugcaugcaugucuguguguguccccuggugccacacgcaugacccugacaacccuggcuugugugugcaugucuguccaugucccucggugccacaugcaugacccugaugacccuggccugugcaaguguguguguguguccccuggugccucaugcauggcucugaagaccuagccuugcuggcucccauggcccuuccucuuuauccucuugguaucugaucuuccgaacguuccagaaucagagggugggggaaucagagccucagauggaaugguggccucagcucagcagagccuguuuuggccuuguucagcauaagccuguggauugugugaaauccuuccuauuuuauucccguuacagcacagugaaauggaauuuuauuacuuucaaguguagaguccauuaugaaacuaaaguauaaaucugucccaacaaauuauggaggaaaaauaucugaagucuugcgccauguggccacguaucauaaaaugacacucuuauaaaacacaauagccagaccuuacacuccacauuucacuaaggaaaacagugcuuauuaaacucacuguauagacaggagucagaaaugucauauagcaacaguuugcuuucuaaagcuuaaaauuuauuucaauuuuaauuacccuaaauucaaauuaaauuaaucauuuaauuacacaaauuaaaaaugauuucauauauauuuugucugacaaaccugacuuaguaccucuuugggaauucccuguuuuuucuccauuuaaaaucugcacccuguguuugcacccucguggguucugaaagaauucuuuuccguuucugcgagguuucuuuuaagaggaguaguauggugacuauuucuccuacauguacugguuguaagaaaugguggcaagaauuauaaaauacuuccucacugucuggaaaguccagguaagaucgugcaagcugcauggaccagucagaucaguauuauuuggaucuuucuuggugcaagauggcuuugagucauuggucugcaccaguuuuuuauugaauuauaaaauacaugagaaaaguacacaagccaggagggauaugcgggugcugacuuucugcaagugaaggcucugccuucucuuccacagaucaaggagcagguguuccccccgccaccgcucccuuguucuuccuucaguggccgucccccaccccucccaggggaaccugucuggaugucucccaccucggauuaguguugccuguuuucacauuuuaugcacacggagcccuacaguaggcgcugcugugugugucugcuuuuucucagcaugauguuucugugauuuaucugugucacugcauauagguguaguuuguuuauuuuuacugcuguaugguguucugugguaugaugacaucacaagguauuuauucgugcagcuuuuggcacguuugggagguuucugguuuuugacuguuacagauaaugcugccgugucuucguagaugucuuucuguuggguagaugccucgggcuggcauugcuggggcauggcacuuguguggcuguaguaccugccaccgagggguuucccacagggugugugccguugacuguuuuguaaccucgugugugagugccggccaaccacauccuuaccaacacaugguauccuuucguuuauagauuuuagccauuuugguggguauggaguguuccguuguggcuuuaucgcguuucccugcagucacacaugcgcaggaccuuguguguguugauugaccacuuggaauccugucuuguaaaguaccuguugauguguuuugcuuauuuuucauucagguugucugccuuuuucuuagugauuuguaagaauuauuuauacauuuugaauauccgucccuugcuggguguauguguggcagggucucuucuauuuuguggcuugccuuuucccucuucugcaucuuuugauaaaugaguguucuuaauugagugcagcacaauuuaucauuuucuuuccuucauggucaguaccuuuuuaacaucugucuaucuuugcccaccugaagauauuuuuuguuguugucuuuuagaccaggccucauugcuuaccuuuaacauuuaggucugugauccagcucauacuaauuuccaucauggcgggcuguaugggcugugguucauuuagcaucaaagagcagcugacgcaagcacugcauauugaaaagacccuguuuucccuauggauuugggguggaauccucacaauaaucagaugacucuguguuggucucauucuagcauauucuccuugguuuacuuuaauuacacaaguuuagaagaagucuugauauuugguagugugagucccccaagcuuguuucucuuccagauugcuauuucagguucuuugugcuuccauuuaaaauguaaaauugucaguuuucaaaaaaauucugcugggauuuugauugcgauugcauugacugccgauuacuuugcaaaacauugacaucggaaucucauugggguuuccgguccaugcacaugguauauuccuccuuguauugagaucucuaauuucacuuacguuuuauaguuuucuauguagaauucuucuacgucucuugauagauuuaguacuggauauuugcuaauauuguaugcuauuauaaauguuaucuuguuuucaaagcuuauuuuguauuuguuuauugccacuguauagaaauacaauagcuuuugauuuugguacauuauugaccuuuuacucagcaauccuguaaaauucacuuaguuauuuuaauaguuauugguagauuguuuugaguuuucuguguauacacuauaucaucugugaauagugacauuuuccuuuguaaucuuuuugcuuucuuuucuuuucuugccuuacugcccuggcuaggaucucugccaggguguugaauggaaaugaugagagugggcauccuggccucacucccuguuuggugaaggcucucuguugcccaggagaugauguguauuuggcguucuggacuggguucugcaggcugcucuccuuugugugacucuggguucuccuuuugguucacuagcacuggccguuccgucaccagcauggcaggcugaggccauggugggcacuuugagcuauagucacugcccgugaaaugggguggggagggugugugguaagggacaaaacuggcccuccccacacugucacauuucuuugugguagcuugguaagauguuuuagaagaauguucucugauggauuuauagcuucuaagacuuuugcucuuuggaagguuuauggcuuauuccaugaaauuaagucaaccaaaauuucaaaauuuccaagcugcgggaggaggaaccauagguaaccuuagauuccaaguguuuggugaaggaaauacacccacacguaagcguuagugaugcauuugcuuucauugauucuguguggagcagaaaugaaaagagagagaugucuuuauguaaacagaugcccagugucagaaacugcccacuuggcagagugaccauggcugucuugcuaaaggugcuuguaaauuaaaaucacaggcucuguggcucaguguggacuucuagugcaucugguaaguuaggggaaaauacauccuaaaaggcauuguguuugaaaguuguaauauguccacauucgucuauuauuuauuagaauguauuuuaguuagggauguacagauacacauuucaaacguccuucagaaacaaauggauccuugagaucuuaguagcaugugcuuuccauguguuuucuuagaaaagugaucaucguaguucucuaaucugguuagugaaguaucauuagacacauacaucaagauaaaaagaacuagaucaugcuuaagucuuauuaaaccauuuaauuucuaguagguuuuuauguugugaguguugcguuggguuguucaaagacacaccaccuaaggagaaggugacggaaugggcagaaagaagagagguguaucaggcagacagcugacugauggguuuucaucccauauccaauagaaaagacugcuuuccucgugggcuucagauagcgcugcuuucuuuaugagggguuccauuuaguuuucagcuguagaaucguuuguucuuaacuccauaauuuuucucuucucugccugugaucuucaugagggaaugugaaguuuuucuuuuaacccagauauucugagggccaacagcaguucccugcauuguaugugacucuggcuuucucauggcagcccucugcaggcucucugaggcauugggaguccugaggcuuaaaguaccacaaacuugugaauuucuggaaucuuugauaucagauccuuaaaacuuaacucuagcccccaaaaggcagaaaacgguuucuuuugcaauuugcuuucaacuucagcccccugugagguaguuucugaggggaauccaggaagaccuuaaaaacguucauucaguucacaguuuuguugugugccuacugugugccuugggccaggggugcagcaggaggucacauuccagccaggggcaggcagaggggccgacagauaaugagaaaacaaacaacuacuuaaugucaacauagaaugaaauaucagaaaaaggaaagaacuuggaagggcaagaaaguagggugacaggaaugagcgucugggguggggcgaucaggagcaguuucugggaggugggacguggguguggagguggagagagaggugccuuuccuguccuuaccugcagccucuaagccgucuggagaacuuacauuucccagacagcguuggccccagagccuuuuuccuacagcacaccagggaugccgaugaacuccaacccaguacuucuauggggagaaaagaaucaggcucaggggugauaaggaacugguccagggugagagaacacacugggcuagugcuggggccagguggagcucggguguccccgcucccugucuaguacucuuucccaagggaccagguagagcucgggcguccccgcucccugucuaguacucuuuccuaagggaccagguggagcucgggugcccccgcuuccuaucuaguacuuuuuuccaagccagaguccgggggugugaagagauacauguucccguuugcucucaguggaacuugcagccaggcacggggcaggugcucaucagauaagcgagcacaugagucacaacagacccagccagagccagaacagcuugggguccugcugcaggaaggcagggugccugggcagacccugaagguccugucuguggcuguuggagcuacuuuuuuagcccaacugagcaucauggcugcugacucagucuccccagcugugacacgggggcuggggucuccggguccccuugcggcugucuguggcgucugucugccuuguccuauuucccccucugguaaugauucuucaguuuuccuucgaggaaugacccucauucccauuggucccacauuggcggcgcugccugucaggguguccuggcuucccuggucaagggcuguggcucagcgcaggccaucaggugugguuggacaguguucuggagggacucuccguuaauuccugccucugggucccuccaccugcuuugccagcuaccccguucacucgcuggagcuuccucuguuugccuagauuauccaaagucaauuuucuauugcuugcaaccaugaacuccuaacagguguaccuugggucuagcaugccugcucuguaaaaccugaauucucacuuccuuuggcucaaguacucuguguucucgccgguuuccagaaagaaggguucauagacugugggcauugauauucuguccagcagguucuggagcuggcuucuuagccuccucaugucagauccacucgucuacagauucccgagucuucugcuuccucucuaaaucgcagcucccacuggcuuccucccaggaggcugugggugguuccuggugaccuggcucucagugagccuucaccagaggcaccagggaaugaccauuucuggcugaaaaggugacccgaaggcugaguaugugaccgaguggaggggcauguucuccaugcacuccccaguagcuggagcccccaccccccagcucugggaagggguccccacccaagcugcuucugucaucucggccuauccuagacccgaccccagguccucuguccugcucagaagccuucaguggcuucugcuucccucagcgcagaggacacaagauucugagaagcccucuuguucaugacacagccggauucuggccacaucaugugaaacauguuucccauuagcuuggcugugcguguaaaagugaggaggaacucacaugguaauagaguuacauggguauaugcauuuucaaaauagugccguuaacuuucggacguuucaguguagguggaaggagguaccgacgcagcgugaaugccaggguguuggcuggcguugaagcuagaugccgugggcugucacacaguucucuuuacucuguauauguuugaaguuuucauaauauaaaagcuuuguuuuuaaagagaaauucauguuaaaaccugugaaaucuuaaauugcaaauaucaauaugaaaacacuuuuuuuuuacuuaaaauauuuguacuuuuuacauauccaaaaaauaaacaaaugacuaaaaccaaccaguauguggggaacucaacaugaaauacauaugcuaaccaaggaauuuaacucucuuacaaaugcacucaccugauaacuuuggaaaccagugucuuaccuggauacgguaaggcugagaacaaggagaaucguguauaaaugguggucuugugaauguguuucucauguguagagguuagcgauucugaaaugacuuuguguguguaccggaauuaaacaaaugagaaaagauacuguagauaauaggaaccagguuucccacuguuagaaagauauuuaauaaaaacaaggaaagaggaagacuaaaauacaccuugugauguugggaucugaggucucaguauagacucaugauuauucaaguguaaacucauacagagauacugaggugugagugagucccuacgcgcgcugccugcugagagggcccugcgugcucugucgcccagcagcaguuagcacaccuagcacuagauuggguccgaacacaguucucccaaacauggauccaggguucccuggagaagccauugauuccgggacugugacagggacaucuuguaaaaucagaaaguaagcaaaugcucaaaaacaaacaaacaaaagacuggauuggaggcuugccagaaaaaccuaggagcugguuugcaggagcucccgacggccggcgcuuuagcaccaacaccaaugguggcaguaugggacuaauaacacagcggauaacguaacuaucugugaguccacacgaacggaagcagauuacugagucacugggaagauggagcagugaaagcucauccuugccuuggaauucuaaguaauaagugcagcaaaaaggaggugauuuggaugucaccacuaggcaaacaucaugacagugagugucacagcccggcugcucugauggauucaggcccacgaagacguguguugauaugugucucucuccagugagcuucgguagcuugggcuuuucaaggcacuuguuuauuucaucuaaguugucaaauuuauuggcauaaaguuuuucauaauauuccccauuguccuuuuaauauuugugcaaucuguaguuaauucccacucucuuuuuuuuuuuuuuuuuuuuuuuuuuuuuggaacagaggcuugcucugucacccaggcugggguacaguggcgugauuuuggcucacugcagccuugaccucccggguucaagugauccucccaccucagccucccgaguagcugggacuacaggcaugcaccaccaugcccagcuuauuuuuuuuuauuauuuuuugucgagacaggguuucacaauguugcccaggcugcucucgaacuccugagcucaagcaauccccccaccucggccucccaaagugcuacaauuacaggugugagccaccacaccuggcccccucucucauucucgauauuguuaaucuuugucuuuucucuuuaucagcucugcuagaaguuuaucaauuuuauagucucaaagaaucagcuuuuaguuucauugauuuuucucuguucuguugucuucuguuacuguuuuuuuuuucuuauuuugaguuuaauuuguucuuuuucuaauuuuuuaaggugaaaccuaaggucauugaauugaggccuucuuuucuaauacaggcauuugguacuuauguuuccuccuaagcacugcagauuuuuauguuguauuuucauucguuucaaaauguuuucuaacuucuuuuaaauuuuuucuuugauucaugauguguuugcaaauacuuaggauuuucaaauaucuuuguuauugacuucuaauuuaauuucaguuuugucagugaacauacuuuguaugacuugacuuguccuuuugaauucgagacugguuuuauggcccagaagguguucuaucuugguaaauguucuguguguguuuuuaaaaaagaacgugaauaacguguauucagccguuguuuauggaguguuccaugaaugucauuuuggucaaguugggugguaguggucaggucuucucuguucuuauuuucugucuacuuguucuaacagcuacuaagagcagggugugaaaauucccaguuauaauuguagauuuguccauuucuucuuaugcuuuuauuauuuuauauuauuauuuuauuuuauaccuugugauguugggaucugaggucucgguauagacucaugauuguugaaauguaaacucauauggaaauaucguggugugagugaauaccuaugcacacugcuugcaucaaguaugaagcccugccaacaggugcauaaauguuuaggacugugugcccacuugaugaaccaaccccuuuaucauuaugaaguggucuucuguauugcugguaguauucuuucuuuaaauuuuacuuugauauacauauaaccauuacagcuuucuuuugauuaguuaugugauauacauuuguccaucuuuuaaucuauuucuauauuuuaaauauaacaagauagauuucuuguaggcagcacauagcuggguguauagugcuuggggaagauugacuguacguuauaaaacacagagccuccucucuccaaaagcuuuuuagucccuccucacacgauuccucuuuauacucugggaaaguagggucucgcuuuuuuauccagucugacaaccccugcccuuuaaaugggguguugagacaguuugauaugcucacugauauaguugggcuuggcugucuccaguucugcaacuuagaugcuuuaauucuuccuuuuacuguuccgucaaacuguuuucaccuuuuuaaaagguaaauuucuauguuuacuggacuuuucauugaucaggacuauuauauauauauuuuuaaaacuaugugauguuuuucuuaauguaauguucucuguguaauguuuuuguaaugccuuggugaugaaauagcauaguuuugaauagucuacugcaacuuuucuuuuuucuaagauaagcccuuguguuuuuaguauacaguuuugcaagagcgugagguucuuccagaacauuucuauuauagugaaaaugccugugcucuauugaaucugcaguugggagaagaauccguuucuagcugucagcacuauguuaggugaaaccuugcuagacacuggacauuuggcuaggaaccgugcaugucagcuugccagaauuauagcuuugagaagcauaauugaccaguauuaaagugaacacagaacaggguaggagugagcacacauagccucuuggcaguccucaggucuggacuagagcuuauuccuauuugaagauaaauaaacagaaacaaaccucaccuuuggaccugucaaaaaaaggguaucccagaauguauggaagagggaaauacccugaagugcagaagaauaugccucugaaaaugaaauuaaaucaggaaaaaauauuuucaaaaggcuuuggcuagaagaauaccuggcucaacaaagagaagcagaaggugauguaugaggagggacuaggccgagugagaagaugaugagaugaguuuaaagggaagugguugagaacaaagaguucauggcuuaguuaaaaucuguauuugaagccauaaggaauaaaauggauauuguggaaaauagcagcagugaagugaagaacauacuugagaggcugccugggaaugcagaauaaacaacagaugugucaccggugaaagaggccagaucugauggggagacuucagccaaauagcauaggaacucugaagaagccagaacaaguuuaacaaaaauaauaaucagugacauaauugaagaacauuuuccugagcagaaagaagaccuauauuuguugaaagagucauguuuugaacaaaauaaaagacucuuacuuauguaucuucugacaacguuuuugaauuuuaagauucaagaaaaaaaugccaguagauuccaggcagaagaaaaugguaacaaccacaacaucaagacucggcccccaaaguuuuaccuggaaagaagcuguaauugagcuggacuuaaacuucccuacaauguugaggggggaaugacauccaaaaauuuugaggggggcauauuugugaucuaagauuuuuauacccagcugagauguguuuuuuugugugaaggauacugucaucugagauuugugaggguuugaaaaauaugccaucuacauucccuucaagaaaaugucucuuucugaccaagagaugaauaaacauucugacccugaagacaaauaagucauugucauuccuaaggagauaaccagauacagaacaacagucaugaagauauuaaucagaguuguagauacaaugaacauaaaguuggaaagcaucuagauagccagccuugggggcgggggugauucuuuacaugaugaacugguuagaguucuuugguuauaagcaauuggcaaaaaaaaaaaaaaaaaaaaaaaaaaaauuucuagacuaauuaaaucaagaaaaggaauuggucacacuuuuaaagaaagaugaacacagaagccucugaaagcacuugagcugggaucagccagggacucucagugguaggagugcugagacuugucucuuuuggguucaucuagugacugaucuauugaagaggcaggccuuggaaagagaacuugaugagcucagcuggugccacaugccacucuuuggcccgacacuucccugggagcagcaggcucauccgaagcuccugaaguggggcggggcagcugucuauccacacauggaauaggaaacagcccuucaaaacgaagcuuaccagguauuguuaaugccauuggaaaaugccuggcuguaauaucagcacagagaacgugauagacagcuguaucacuagagguucguaugggcaaaaggcaaagaaaaacaacggcaaggaagcaugucagaauguuaccaagggcuugucugugugugauggcaucauggaugacuuuuuaaauacuuaaccugugaugcgcauguauugcuuuuauaagcagaaaaugaaaaccugagaaaauggucauuaugaagacagaaacaugagggaacuauuuuagguuaucauguuacgugaggaaugcggacuuuagaauuaaauucugugauuacacagacauugugacuacgaaugucuauggauccaggcugaugcaagcgugcaguaaugacauuuuguggugggaaugugcugaaagugauuuuucuuuuaaaacauuuuauuucauauuuauuucauaagcuaauaugacagaauaaauuuauauuaguuggaagauacucugcuuccuuucaaaagccuaauguuggagaaacuucuggaagggguaaggaaggugucucuagaucagauauuuugaaccaggggaugauauuaucccccagaggaccuuuggcacucccuggagacauucuugguugucaugaccuggaagaugcugcuggcaucugguguguggaggcccaggauccugcuaaauaucuuauaauguguauggcagcccuacaccccaacaccuaaauacgcaaaccaaaaucccagugguacugaggcugagaaacccugcucucuggagacauuuuuacaugucugugauuuacuaacaaaaaucccacugcucguauuuguagaaaugauuccgucgaacuguucuaucaguccuuggucagaacaaggauaaagaaggaaguugguggggcgugguggcucaagccuguaaucccagcacuuugggaggcugagguggguggaucacuugaggucaggaguuugagaccagccugggccaacauggcaaaaccccguuucuacuaaaaauacaaaaauuagcugugccugguggcaugcaccuguguucccagcuacucgggaggcugaggcaggagaauugcucgaacccaggguugcaggggugguggagguugcagugagcccagaucgugccaccacacuccagccugggcgauagagcaagauucugucuccaaaaaaaaagaggaagucaucauuucccuaguuggauguuguuuuccagaucggaacuuccauguuguaacuccagucucuuuucuccuucugaccuugcagguucaucugcagaagccagcggacgccucuguucaacuuguggguuaccuggcucaugagaccuugccggcgaggcucggcgcuugaacgucugugacccagcccucaccgucccgguacuuguauguguuggugggaguuuggagcucguuggagcuaucguuuccguggaaauuuugagccauuucgaaucacuuaaaggaguggacauugcuagcaaugagcucccaaagccauccagguaaggccgggucauuucuucucugggcacacagcggggcuuucuuugcccaaaguagaaguucuugugacugcagcuugcuuucuggauuugagacuuuuguuuuucuugauaguggucacuguugguuuuugacagcacaaagugcaaaauggaugguuuauucuuccucuuggugaaagaagaaugauaaaaccugggaggauguggagucaagucugcgaccccgguuugcaggcugacuugagaggcacacagguuuccucgaugcuuuuugacaagggugauguugaaaggucagguugugauguggagagcugguuucuugcccagugucuuuguuguuucaugagggguugugugaggggugggagugcuccuccaacugggcgucugggcugucugggaagaagcucauguucccacugaggucguggccacaguugcuccugguguuugagggccucugugaggggcugcacuaagcauuuuacaagcauuuaguacagccccagaucaucucaggccuggagggaagaaguaauuugccugaggucacagagcugguaggugggggacccacaugauugggaagcaagcuuguccugcucugagcuucagaagcaugucaugggcccauccauuuacgacuucacacuuucuguccuuggaaagucaccgagagcgugcaccauaaugaaaccucgaggccugccgccgaccugccugaguguggggcuccugcagagccaguccugugcugcccagcuuccugccacuuccagcgcaccguggccuucaagggcacuuagccaucgacuucugucuugcguccacaugagagagaagacgguggccacuggacagacgcuuggacaggcaccugaggcucuguuagccuuggcucuggguccugcuccuuagagcagaggcagagaggcucagggucugucugggucacucucuuugagauugccggaacgcuuacacacaucuuucccuggguggaaucgucuuugucugaaaauuccagagggcaagauuccagguuuuuuuagauaugaaaguuuuauugaguuaaauuguuuauguauugacugauguaaagaaaugguuuaugaucauuccaagacaaaauuaagcgcuauggcucaaagugucuaaauagacauugaauggagcuggcucucucccuccuacacugggcugcuguugggugagaguguaucuuuuuucugugucuaaacauagugugaugugugugagcauuuucauagaguauaauucuauaggcagggcccuguguuuuacauucuguccauuuuaauguguuauaagcaucuuuugguaucaguaugugugcaaauauaacuugcucuuuugauaccuugcgaauggauauuuaugugguuguagcaguguuuauaccaauuccaaauuggcaucaaacaauuauuauacauauauuuuguaaacuucuaaguaucacuacuagacaaauuccaggaaguggaagcugggucagugagcccgugcacuuaaaacaucauuagguugacugucaaauugcuccagaagccucguuccaacugaucuuccuaauuccaguguaagaggaugcauauuuuucauuugugcuguaccagcacuggguagguucagucucucucauuuuugucagugugcuaugggaaaauuauuguuugaguacacuugauuauuuuaaugggggugcauauuuuuguaugacuugguguacacauaaucauaauuuguacaugcucugcaggcauuugaagagaaaguaugcucuuaggauuuuguuucagucuaaagacgucuguauguauguaucaauauuguauuuaaaguucucggccgggcgcagaggcccacagcuguaaucccagcacuucggaaggucagggugggcagaucacaaggucaagagauugagaccauucugaccaacauagugaaaccccaucucuacuaaaaauacaaaaauuagcugggcgugguggcgugugccuguagucccagcuacccaggaggcucaggcaggauaaucgcuugaaccugggaggcagagguugcagugagcugagauugcgccacuguacuucagccuggcgacagagcaagacuccgucucaaaaaaaaaaguucucucauuuauauauauuuuauuuauauauaggaggauauguauccuuucuuuauauguuguuuuaauuauauauuaacucaguugaguuauuuaaaucaguauagcuuuacuuauuuuuuucugucugcucgauuucuuggaaaaguguauuuuucuacugugauuauagucuuauaauauucuuuuuacauuaauaaccauuuuuugcuuuauauaguucaguguuuuuuuuuaaagcuuaaaaauuaaugacuguucuuuugguagaucaggucucuuaucaaaauauaauauauuucucuuuguuuaauguuucuuugaccgagagcuuauaguguuucaugagguauuucuacccuugguuucuuuuggcuaacaaauauuucuccauccgcuugucucuaaccuuuucaggccggguucuuugaggcucagcucuggaaaccgcggggugcuggguuuguuuggccuuuucugugggaauuucagccgcugcgguucaguuugaucaccggccugcccgggccuguccugcccaugugaguuggguugugugcgccuuauugccacccacgaccucuccauucucucucucaguggguuggaggcugaagacaggccgcacuggugagggcagggcugccccuuggcccagcccauucucugcucuccaucugugcaggggguacagcugaggugguuugccuggggccugaagucugcuggcugccuccucugcccuguccgcugucaucuuucccugccgugucugcccuuccgcccggaggucccuugggaggcaggaccccuugugcccaacacgugcauaccaccaccugcacacacuggcugguggcccagcggccucugcccacgucucaggcgggggauggggcuugcccagaaccgugcccucccuccugggcgaggcccacucgcuugugugccuucccaagcagcuccauccccagagaucucuaguuucgggaaguuccucuguguuucuugucagcugaugcaccuguccguccgcucccaggcauugcuggaagugcuuuccaauccugcuuuucaucauuuuaguggguuuugggaggaagagaaaucauuaauacuaaaggauucaguuugcucucuugagcgggaaauuucuaggugugucagagcacagccacggaaccgcugucccuuuuccuugagccgaggagccgaguccuggcaacgugguguucggggccuaccuggcugcaccuccccucccuccgugugucucucgugccguccucugcuagcuggcccuguccuucgcccugcccacccggcucacucuugccugccuggcucacccuugccugcccaucuggcaugggggcccugcuccuguguggccuggugugggugcccgugccgcccucacucccugggcaggccgggcugggggaguccagccgcccaugggcccccucucacauuugucaugugacuuggcuuugcccugcugaugaagugcccuucuagugcaguguguguggcuuuccucuccuguguucugugaaaguccucugcugcugggugaguuuuguguuacgguuuuauugcuguucccgcugaacuuugccagagccaggcccugguucucugacgucaaagcugcuuaacuguugggauuuuauugcucuaaagaacgauuucuaaugaugugagcggccugagggaagaaccuggauugacuuagccuggaagggcucuccuuugaaaggaggcccuggagccuuacgccccuugcccggccagcccuccacacccucccugaggggaugcgcuguggcagggcaggaugcguuugucaggacacagagccucugccuugaagccagagucccuggcaugaaaccgggaguguggacggaaagcccacgggggccugcuggcaggacaagcuacgccuccuuuuuuuucucccauucccuuguuuuccuccaaggacaguucuccaaguaacuguccuugucuuuccuugugguuaagggcuuaggauacuggugacuugacuggccagcaggaaaggcagacguuguuacuuggccacccacuuaacacuaccccgucccuccagugucauuuacuuucccuuccggaauguucgugccuagagaaagucuugcccagaaaaguucucagugucaaggagccccgcaguggauuugcugggacguggauuugcugggacgugucuguggucagcgggauggugcucucgauaggaagcagugcauuugcugggacguggauuugcugggacgugucuguggucagcgggauggugcucucgauaggaagcagugcauuugcugggacguggauuugcugggacgugucuguggucaccgggaugaugcucucgauaggaagcaguggauuugcugggacgugucuguggucaccgggaugaugcucucgauaggaagcaguggauuugcugggacgugucuguggucaccgggaugaugcucucgauaggaagcagugcauuugcugggacguggauuugcugggacgugucuauggucaccgggaugaugcucucgauaggaagcugguugagcaggcaguggucgguaacuugagcauccucucgcuccuggaaucuuggugcgagguacggauaauguuuaguucaaaacaaaauaaguggccgggugcgguggcucaaaccuguaauccucgugcuuugagaggccgaggugggcagaucauuugaggucaggaguucgcgaucagccuggucagcauggucaaaccccgucucuacuaaaaacacaaaaauuagccaggcgugguggcacgcgccuguagucccagcuacucgggaggcugaggcaggagaaucgcuugaauccgggaggugagguugcagugagccgagauggugccacugcacuguagccuggccgacagagcaagacuguugucucaaaacaaaaaaaaaggauuuugugggaaacguguguaacuuaagaucaguguguucauuugggccauucuaugauuucuuaauauucuguucagucugagcuacccccauccacauaaaagcagcuaaaaagucucuguccacaaugacuuggugaugagugaguucaugguaauacaguugcuucagaccacuguugaguguuaacccugugaguccagggagaaggcucuccucugggauugcuuccaguccucauguucugcucuaacuuuauuugaucuugaaucuguuuauuuuaacuauuguggccgccaagauuauuauauuuuaauauagaaaugauccauaaagaugcauuuuuauggcauuuaaauaaugcucugcagugguugaaugucucaggaauaccacaaagugucuguguguauguguguguuagaguguguguuaggguguguguuuuagacagguuguaugugugugaaucaggguguauguguguuagggugugugcgugugaugggguguguguuuuagacaggguguguguguuagggugcguguguguguuuuagacacaauguguauguguuaggguguguguguguuuuagacagggugugugugugagagacaggguguguguguuaggguguguguguuuuagauagggugugugugagacaggguguguguguuaggugguguguguguguuuuagacagggugugugugugugagacgguguauguguuaggguguguguuuagacagggugugugugucaggguguguuuuagagcguguguguuaggguauguguguguuaggguguguguuuuagacaguguguguguuuuagacuguauuaagauauggguguguguuuuagacagaguguguguguguuaagguguguauguguguuuuagacagguguguguguuauggucugugugugugugugugugugugaagguguguuuguguguuuuagggugugguauguguuagggugugugugucuuagacuguguguuaaaguauggguguguguuuuggacaggauguguguuaagguauguauguguguuuuaaacaggguguguguguccuagacuauguguuaaaaguauggguguguguucuagacaggauguguguuaagauguguguauguguguuuuagacggguguguauggucuguaugcguguguguuaggguguguuuguguuuuagggugugguauguguguuagggugugggugucuguguauuaaaguauggguguguguuuuagacaggauauguguguguuaagguauguauguguguuuuagacaggguguguguguuuuagacaguguguguugggugagugcaugugugagauggggguguguguguuucagacgguguguauguguguuaggguguguguguguugggugagugcaugugugagauggggguguguguguuucagacgguguguauguguguuaggaugugugugugagagugagugcaagugugugagacggugguauauguguuucagacgguguguauguguguuaggauguguguguuuguuagagugagugcacgugugugagauggggguguguguguguuuuagacgguguguauguguguuaggguguguguguuugagugcaugugugugagacggggguguguauuuuagacgauguguauguguguuaggguguguauguguguuugagugcaugugugugagacggggguguguguguuuuagacgguguguauguguguuaggguguguguguuagggugagugcaugugugugagauggguguguguguuuuagggaguguguguuuuuuagacaggguugagaguguuguuuuacacaggguguguguuaggguguguguauguguguguuaggguguccguguguguguguuggguguguguguguguguuagacagggucuugcugucgcccaggcuggaguguggugguaugcaccucagccucagcuuccugggcuucagcgauccucccaccucaggcucccgaguagcugggaccaccucuggcaugcaccucugcaugccaccacgcccagcuaauuuuuaaaauuuuuuguggagaccgaaucucaccauguuguccaggcuggucuccaacuccuggacucaagcaauccugcccccucggccucccaaaguccuggauuacagguaugagccauuguauccggccaggaguacuacaaaguuuuaaggggcagaaaaggaauuuugaagaccugcaauuaacccaagaccuugauucugagcuucuggugacagguggguugcagauucugagcauggcccuugcucagaaacaagguggcgggagguaaugagaaagccugggagcugagaguggcuuugcaggaggcccaagagggcucccaggaggaggggguguguaggcagcaggugcagccagcuggcaggaguccaggggagcuuggacaagguggcagggccugagagcaugcuuggugccagcuggagaagagcuuguucauggccccugcggugggcagcccuggggguucuggauaggagggagugagauugaaccccgagaacgugggagaguagaccagcccuacaucaacuggagguuuuagagaaggacaacagaaaugccuggauaguuccggcugauguuggggugggagaugcuuuugauccccauguacugcuugcuuccgcuuucuaaaggcaagguuucaaaaauacuuguguacguuuucugacgcacagcaccgccugucugaaugugcauccucccagccacccggcacggggcgucugcagcucucagauugucacuagccuggauucuccaugccaucauuaucugggaucuuaaucagucaagguuuguucuggaaaucauguagacauaaggacuuauuuuucaaccuacuuuuuuuuuugauccucaaauuguguuuugucuuuuaaaaaucacgaguacucagucauuaugaagagcucagaaaauucgcugucaauggagcauugaugguuuguuuuggcaauucucugaaaauucuuacacaguuuguggaacauuugcauuugugucccuuuuucaaagccacuauuguagaaaugcaaauuucugaguucugagaugcugaauguuggaugauuaaugauauugaaauuuaagaaugaacucccgguauguauuugacauagaaaacgcggugugagaaucauuagaaaccauugagcacagcuuggcggggaacagaaaggcugugauugaggcacccggcagugggggcaggucgcacguggacaggugugcaggugcguggcugccuccgggugccaggcugugugaggcgggagcuacugccaucaaaggucuggcucuacuugaccauagguguucaaaacucaucauaauaauacaucagccuugaugacuugcuugcucagucaaccccacugcgcguuuaagagaacgaaaugaacagcagguuuguucugaguuuugcuugcugcuacuccauuugugcuugcauauagccugugacgugagcuggacacguuauuucuguuuuguagaugaggaaaccaguguuacugcuaucgagugcuuagguaggcugaggcugggcagcgcaucagaggccaaucuggcaccgcuagaaucggucaccuucccucaaggagugugcgccucucugcggcagaacacugggcaccugggaccugagaggcauugagccugucugcuugugugagcucccuggccagggcaggcagggcaggcagggcagcaggcacucugguccagugugguucaugccacgagagggaugggcugggcauggaagcccccugagggauguggaggccaagggaggcuguccccuagaaaggaccugaggcugaaacagccuugugaggaggguuggugggccucccgcagguccugccccgccggcuggggcccuguccugcaacguaggcuuuuuugugucccaguugguuucaacgagcauggguuuugccaucagggaacuucaucuguccuuccucugucuuuuugugaacuuucucugagcucucuuugccgguccuuagaauguugggacugaaggagugacugggugauuggcauaaccaagcgaacucugagauuugggcugaaacuuucacguuguggccacuuagcauccuucucuuuguuuauuucaugagaacauggcaaaaaaugggcacuuuggggaaaauuauaaugaaaauuacaguuaauuuuaagaaauuaaaauuaagacaaaaaucaacugaggcauauaccuaaacuuuuuugaauuauaucuggcccugagcuuuuaaacugguuugcuuucagccaccuaaucaguaagacacugggagugcuggcccuucaggagugauacgcauugguggggauggaggccuuggggcguuauuuucauguuugcuucucucuccuucccccuuuuuaggaaaacaaauacaaauagaaaagauaaauucugccucucagggagcuaggcacagcugauuuggagaccgaagcccauagccaggccuuugggagcccccuugacaguguaggcggcuguuucccuccaagacgacgcugggccugcgggcucuugguugucugugaggauccugagcccggcuggcuuaugguggcuuuguucucacuggaccccaggcucccucaucucccucagcccucacuguacucuccuccaucucugcccaguguccccuugcugccuuuccuucagugcuacaacacggacucaggacccagugugguuccaugcugacgggcagcuguagagcuguugggauauuaccuugaaacacaguguucaggaugacugucauuuccuagcuuucaccaagacucuguacuuucaaaaggaguaguaaaacuuauuguaacguauuuguuuuuuucaaaauacagaaaugaccuaaauguacuuauuuuuguuccauuugaaauagcauuuauaaagaauuaggacaaguuggucugugugucuuaguguucauuauuuagugauggucauuaacugggggaguuuuuucuuuucuguauacaacuacauucucaaagguucaaauuagcucuuugaguuuguauucacuugagaugucagaauuuguuauuaugaagccacugucuucagagccuuucccuaaaagaaguuuugugauuggagccaguuuuuuuuuuuuaauuuuaaauuuuaaaaugcuuagaccauuuucuuagaagauugcuuccauaaugugguuguuuaggugaugccuuuguucguucagccugcuaucauaaaauaccuuaggguggaugauauguaaauaauagaaauuucuugcucacaguucugggggcugggaaguccaagaucaaggugccagcggacuuggugucuggugagggcugcucucugcuucacagauggugccuucuugcuguguccucaccuguuggaaggggugaggggucucacuugaaccucuauaauaagggcacuaauccuguuccugagaguccauaacuuaaucacucuccagaggccccacuucuuaauacugucacauuggguauuagauuuuaacacgugaauuuugggggggacgccaacauucagaccacagcagcugcuaaagccaagagaauaccuuucauuauaagagcuaaugguuuucuuucaauuaguuugcauucauagccaaagguauuccuuuuuaaauaccuaugaguuuuccuaggaaauauguagaaauuggaugcuuauuaacacuguguuucucagugacuuguugauucaguaggguuugugaaaugcuguuggaguuucaggcaaggauguggagucuguucugagcacacucaggguuuccauguguuguccugaaagccuuucucaccucuucacaucuaggguaaggccguauugaggggaaguuccucccucccuguuagguagugugaugcagaauucuugacacucuuuguuuucacauggacugaauccaaaucagguggggcugauucuuccagcccugucuccucaucccggucugacacugcacaacacaaaccuuccugcugcaggcucaccgaggugcugccuggcccugucuuugccugaacaccugcagucucaauguggcugugcgggagcaaaggcggccuucgccccacgucucucucaugugcuuccauagcacugccuuguuuuugugaaaggaucggggagggaggaaggcaagguuaauuuuuucuuucugauguacuaguggauaaaaagaguucuagaacauuugaggaggcccuaggggaaacuggagacauggaaagcagagguuuucguugguaaaccagagagaugaggaguuuuaguuuuuguagugcccgaugcauuguacguguugaaagccgaguccuugaugguaaugguggcucugaugaugguggagaugggagguuaggauccccuuagagauguuuagugggugcugcagugagcccaguuuucugagugacagggacuagggugugacugcugaagagggggccagaucuucagugcccuuuaucucuggugggcuucucauccuuggucuugcagcaucaggauggggccagggugccuggccuggagggguggacuugggccgaggacugcagggcacagauguccucucaguguggcccucagcacggggagcccuguggcuuugaagcagaugcuucauucaaggcaggugguucuuuucugaacacaaacauacacgugagcauccccaaaggcuguuuuugagagauggugugugucuccauguccaggcuguuguaacagaaugauaaggugcagaggccaucugacagcuggaaggguacagaggcaucucuaagcagcagcaccgauggaguacccagccuggaagugcugacaccccaccaugguccuccucugucccaugcagcccagccuuuaggagaugcaccaacaggcauuuggguggcagacuggagcucaguggggcugcccccacuggggccccucuguagcuucugagaacaguugaauugucuaucugccuucacaucuaucugugauuugguucccuuuuguucuucgccaguccucaguaggauuugguaagacguaauuucucgaugguucaggaagacggguggggcuguguccaugcuugcacagccuacugugaacagcugagcucacugcccugugacuggcuugguguagcugaggcucagggaagagcugggguguccuggggugagggagcagcagcaccagcaggaccccaugccccaacugcugcagggaccauccuggccugaauguguuagaaacuaggaggguaucugggguggggacacaucccacucuucuugcuuuguguucaggcccccagccucuuucugucaugaugucuugaugucucccuacucagcugcuagcacuucugcugagggaagcagucacaaaggccgguggcccuggccugagcauggauguggcuuucuugguucuuggcugcgguuuccuugaacucucuguggucugcaggaccugaugcaugagaaucacauguggggaggguguuucuuguguuuaucaguguuuccauuucuuuggaaguuaccuggaugcuguuaugaguggauuugguggacugauuugcauggguguggccucaaggacugcauuuucuaaggagaugguguuuuuaaugccuuagccaggagauugcagggggccgcgggccacaugugugguucucugggaagauucugcucuggagcucugcugagggauguuauuucaaacuucaguacuaucuucaugaacaaaagaacaacguaggucuccguugaguugcucacaucacccgagagagcauggcuuuggugcuccucacccauguccagaucagagcauuuaggcuucaccuggggaauggacaggggcaggagcugggagaucacugcccagggguggcucuguguccggggugaccuggacugggcccauugccuccuggggcugagguugcuuccuuucaucgggcccuguuucuuuagaaagauacugggcuuugacuuuugccuucugucggcaccuggcccugcagcugauggaaacuggcagagcaaaggacuucacugggacagugagcaguggggcagcccuguguuuacaggcaaccccagacccucuuaugacagaaggggagggcagggcagccggccuucaccuggauaggaacagcagguggcugauguaucugaguugguauauucauucagagacauugguuaaaauuacuugucaauauaacaucuuuaccauuguuuucuucaaagccagauucuguauuuucugauuuuauguaaacuaaauacauaguuuucuuaaauacagaugaccucugccuucacaguuucuuuggauaccuuucaagucaguuuaacacacaugcucuccggaaacaaaacucagccacuggggaaccgaaccuacgcuuuugguagaaucucagccuuggggggagccuggaggcccugagcccuggaugacaccugcucuggaauccuccaccaguggcuuuugaaaugugguugguggcugaaucucacuucugccuuggaugcuuauggaaucuucuggauggacugagcucagaaucucauugaauacugugguccucucagucugaacuuuguaccuaaaaauccacgggaaucucauagcagcugcugaggauuuggagaacucccuuagaaaaauaaaaggaauuuauuuuuuccuauuuuauguaguggcuauuuaaauuuugaacaucaaaugguaguuuuggauuuuaaaagcucagugugaauaaacuuugagcucagaugcagccguucuuuuagugugucaauuuuaauaggugucauuugauguuugcacuaggggguuggacgaaggucggugugagaaucucagggauaacugggcugcugcaggggucagacaaggccuccuguaauagggauuuuggggcacugauggaaugaagggaagcgggaggagaggguaacgaguagaggcugccgcugccccaguuguauuagaggguggugagggacgugguggauaggaagcugcaugggccuccaggaacucacugcacuggcuuugagucgcgagagaggugccacgggaggucuagaaaccgugcauuuugggacugagauaaaacacguccagcugguggcacagaccaagccagcugggagcggaguugucucucugugcuugucuggaguaccugccugugcucucugagcagccucugcaccuggcuggugggcggggcugagccucaccuucaaggcugcagauucccuggcuuucggugugcugggggaugccuucugcauggccuggcuuuccugggauuuccagaccagauccaccucuuucuccccuuuuucuuugucuuucugcccccgaagagauagcaguguacaaaaacaagccagcauuucuuguucucuugcuauuuguaauugucccgagccuggacuggguccaguccgcucauuuauucugccagggcccagucugcagaucucagccgaagccgguuguccugccuggcucgcucuguuccuggaaagcuuugucacgcacagccaggggccacuuugggugcauccugucucccccgucgccguauguuugggagcagaaguuggcucuggucagauauguggauguuaauuuauccucauucuuggaagcaaguugggagcucagaggaaaggaagagccacaaaaugucaaacccagcagcggccaucugacucgguugcucaucgcuauaauaugugauuaagauggaaguguuugauuuccucgcuugccggauuuaggccucauuuugcuuacucccgugaguccugauuucuuccuguuagagagaggaaguuugcagcgauaaccgacuugcagugggguuuucugugaauggagcuuguauuggugcgauguguggcgugggaguccccaccgguuaguggcuuaugcagggugugaguuucucucaaaguggacguuuucugccuucccggagccaaaacguuuauuucgccggugaguacagcugagucucacgugcaucugacagcagugucuccgagccuugccauuuccuccacucccucccuuggagccguuugugugacaaccugcuguucaguaaaaccaguuuaguggaguggguguguguuaauucuaguccauguguuuaaaaaucaauucauaugaugagaauggcacuuucccccguggucuuccucucaguaacccauagccccaguccaaccaugggaaaaacaucagacaaauuccaguagacacccuuccuacagucuacucuugccaggcccacucgauaugccaaggucaucagaaacaagcauccuuugagaaacugucaccaccaggagggaucucaggacaugcgacaccuaagugugauguggaauuccuggaugggauccuggauggaucuuggaauacaguaaaagacauuagugggaaacuucaggaaauccuaaacucuagaauuuuaguuaaugacaguaaugucaguauugguucccaauugugacuaacauaccguaguaagguaggaugcuaauaaucgcggggaaugugcaggugguauugguaggguauauggcagcucucucuacugucuacucaaguuuuaauaaaauaugucaagaauuuugaguucacaaaaugaaguacauuuauagauacucucuuuugcuuaauguuuguucaugaauggcuguauacuguaguuacuuuagcaccuagcuuuuacaguuuuuccuuuggggacucuuuuuuuuaugguugugcauggaugugguagaguaacuuaacaagucauuguugguggacagggaguuuguuuucagccuuuccauuguuguuauuauaaacauguagccuugaagaccgccaaugucuaagugaacuuuuuaacugaaguaucacaggcauccaggaaagugcaagaaucaugacugcuuagcuugaugaacucucccaaaaggaagaugccuguaacugcuacccagauugugaaaugggacaucccaacacccagaagccccguauauguccucucucaguuacuguacccucacucucacacccucuagauaccacuucucuagcuucuaacaugaguuucuccugguuuugaacgucauauaaaucacguaauacuuauucuuauugucuggauuauuucacuugacaauauguuagauuuauugauauuguggcuuauaguaguaguuucuucauuuaauggguauauaauauuucauuguaugaacauaucacaaauuauuuauugguucaauugcugaugacauuuuggugguuuccaguuuggaauuauguauaaugcuacuguaacauucuuguauauuucaauugguucauauaaguaugcaauucuuuugauaagguguaugugugccaaacaguucuucaaauugauuguaccaauuuacacucugaccuauagaauguugcucuguccuugccaauacaugguacuguaauucuuuuucauuuuaacuauuguaguuucauuuguauuucccagauuacuaaaaauguugaauaccuuuucauacguuuauugaccaacuagaugucaucuuugguggagaaguuucuauucauuuaagaaauugguuugucuuuauuuuucuuacugaguuguaggagcuauuucuguacacuggcuaugaaugagcuuuuuguuguuuguugcuauuuucuaugugugugcugcguuuucccuuucuuaaugguguuuuuuuuuuuuuuuuuuuuuugcugaacagaugcucuuaauuuuaauaguccaauuuaauaguuuuaucuaugccuauuugaagauauucuauauuauuuuugauaaacuucauuguucuaucacucauuuagaucugugauccacugggaauuuuuuuuuuuuuaugugugagguagggauugagaguuacuuuuccguuuggaaauucaguuggccuaacaguauuuauuuaaaagagucauccuuucuucucugcuauccaaugcaacuuugucauaagugaaauaaauuauauaaauggaucuguuuuugcacuuuauucuaguucauuggucuguuugcauaucuguguaccagugcaacacugucuuaacuaauagauuugcaguuaaccauaguaucuaauaauguaggucuuccaacuuuuuaaaacuuuucaaagcuuguuuugguucuuuuuagcccuuugcauuuccauauggauuuuuuuuuuuuuuuuuuuugagauggagucuugcucugucuuccaggcuggagugcaguggcacgaucuuggcucacugcaagcuccgccucccagguucacgccauucuccugccuuagccuccccagcagcugggacuacaggugcacgccaccaugcccagcuaauuuuuuuguauuuuuuaguagagggggguguuucaccguguuagccaggauggucuugaucuccugaccuugugauccaccugccucggccucccaaagugcugggauuacaggcaugagccaccacgcccggccuccauaugaauuuuaaaaucagcuuuucaauuucaacagaauaccugcuguggucucaauugggauccacugauuugcauaugaaaucaguuuauuaggagucuucuaaucuacgaauaugcuacgucucucuauuuuuuucgagcaucuguaauuucuuucgaucauauuuuguaauuuucaguauagaggucuuaguuuuuuuuuauuuguuuguuuugagauggagucuugcucugcugcccaggcuggagcgcaguggcacaaucucaacucacugcaaccuccgccucccaggcucaagcaguucucgugccuuagccuccugaguaccugggauuacaggcacaugccaccaugccuggcuaauuuuuucuauuuuuuguagagacggggcgucaccauguugaucaggcuggucucgaacuccugaccucaagcaauccguccuccucggccucccaaagugcugggauuacaagcaugagccaccgugccuggccuagaggucuuuuauuucuuuuguuagauuuacuucuagguuaugcuguuuuguugggggaauuuuauuuuuguaauguuuagaagcacaauucauuuuuguauauuugucgugucuccagauaccucgcacaguguuuauuauuauacucauuaucuauauauucuuuuggguuuuuaaugcauauugucuauggacggugaauguuucauuucuucuuugcuaauuuuuaaaacuuuuaugucuuucuugcuuugcugcacugccuaggaccuucagucaaaugguaauaguaggcaucuauaucagucauugguaguaguaggcaucuaugucuuauucuaauaucaagagaaaaauuuuuaguauuucaucauuauagauaaaauuugcuauaaguucuguguaguccaugagaugaaugcaguuuacuuuuguucuuaguuugcugaguuuuucugauaagcagcuguuaaaauauuagauggagucaugugaaauugcagauauuugaucuuuuuccaucuacaaaaaaugguauuuucauuugguucaacuuaauguauuagacuuuuucugcaucuguuaauagucuuaugcuuuuuuucuuuauuuuauuguguugaauuuucugauugacuugaauguuaagucaaccuuacacuucuguaauaauuauuauaauguguuauucuuuuuauauacuguugaauuuacauugcuuauagucaguuuaauuuuuaucaucuaaagauaugagauugacguguuauuuuuucuugaaaugcuuugucacauuuuaauauuaaaguuauacuaaucucuuaaaauaugaaguugcuuucuucuucuauuccuaggauugccaaaauuuuucuguagagagucaguaaagacuucaugcuuuguggaccacauauggucucuauugcacguuuuuuucccuuuuuucuuuucuuucuucuuuuuuuuaccaaccacuuaauguaaaaucccaucuuauuuuucagguuauauaaaaucaagccacagauuguacuuggcccaugggccauaguuugcugacaccuguuugauuuucuugaagaguuuauguaggaaagaugcuauuucuuucuuaaguugggauggauuugcuuaugaacuuaucuuggaguuuucuuugugggaagauuuguaaauuacacccucaacugauauaggacuguuuagauuuuuaagauuuucuugugucaguuuuuguguguuuaguuuuucuuggaauuuuuuacauuccaucugcaucuucaaauguauugaaauaaaguuguuuaaauaccuucucauuaucuuuguaaugacuguaggauuuguagugucauccccuuuuaaauuccugauauuguuuguucucucauuuuuccuucauuggacuuugcuaggagcuuauuuauuauauuaauauuuuuuaagaacuguguuugguuuucuugauuuuuuaaaauugaauuuaaaaaaauaaauuucuguucuuauugcuauuauuuuuguuuuugggauuuaauuugcugggguuguuguuuuuacugauuaagguaaauauuuagaucacugauuuuuuuuuuucagacuuucuucuguaauccacgugcuuaaaacuauaaauuuccaccuauguauggcuuucgcuagauuaugugagcuuuuuaaugucauuuuaauuauaauuugguuuagaauauuaucuaguuucuuuuuuugacuuguguuaauuagaaauauauuucuaaauuucagugcuuuaugaauuugcuaguauuuugcuuucauuuuguuauugauuucuaguuuaauuucacuguggucacucauuuuauguaauuucaguuuuuagaaauucuuugaauuuugcuuuauugauuauauggucaguuuugucaacauuuuauguauacuugaagagaagaagucagccguggagauuugccaguucuacauguccauuuaaucaaauuaaucauugugcucagaucuccuguuaucuuuacuauuuuauugucugcuuuucugucagauagugggaauggaauauuaaaaucccccugauguaacuguggauuggcauuguuucucuuuuuagcucugucagguuuagccuuuguuuauuuugaagcuauuuuaagccuaggcagauuuagaauuuuaugcauaaaauuauuccauaaaauuggaauaacugccuuuuuguuacugugaaauguccaccuuucccucuuguaucccuucuuacgcucaagcugcggauucugugaggacuggucagguccguguugcccucacuccuggcacggggcucuccucacccccacgcucagucuggcguucguuucccaggguccgagccguccggugcugcuccgcuccucagccucuggaggacacgcgggccgagugugcccucuuuccaccucccuucucucccaggccugggcuccucgugcaucgccguguuuuagauugcauccuguccucuguguuccuggcuggaggguuaguauggcccgcuguagcccagaguggaagcugagguuuaccuggcaguccccgcacgguggguccagugcagcccuggcgacgugucauugcaguucgcucaccuggcccgugugugcuuccugaaggcuucccccguagaacucacuaucugggcggcuuaguucacgagucccagcuugcuuuccaggcuugcauucaucuuuauguugcaguaaaauaacuguugggcauauuuuaaaguggacugaaauauaucugcagccuugagcagcucuuauagcacuuuuauucagauauuuuaugaggugauuuaugucgcaccuuauaaaugcucuaaaaucucccugaccagaaaugcagugggcagggccaccccaccccuuccugcuugucuucccucccccauccugccuccuucucguggcuuuuaccguuuuccccucgaauaugaaggaagaauucauuccagauuuagcuuuaggaaucaugugcaggacguugaguuucgugccaucaaugucacgacagugcuggccgcgcuuugcuccgauggcccaucagccccgcuuccuccugggcaggcugagagcuucacuuggccgcucucucaguauguccucugggcuguauucaggcauaucugccuuccuccccacuccgaauuucgggcagccaaggucaggcagguugggaaugcgcacgcacagggcagcaggucugugucagcagcguggcauguggggcugggguggcagcacagccuguccucuucaguggccuuuuugggauggagaaggcugagggugagaucucuuuugccacauuaaaccaaagugguuggguuacaaauaccacguuuaguauacuacguuuaaaaguauauuuuauucaguauaauugcucacuuaaaacauuuaaagauaaauauacuuguauugacacauugaauuacagauagucuaguaaggaagccagcgauuuuucucccuguagaaggccaggccucaugaccaggggauguuagcauuauggggaagcagccauuuuguuugucagaaucagcauccuccucugagauaagaaaacagagugugaagguuggcugaccugugccacuucugccacguggcugccuucaaccacugugcgcggucacuggcagccuguucaguguugguggagaagagcuucuuggagcggaaguccaggccaguguucgguggggccagaguucagguguccuuggugagccacacuccuuccugucgcccucuugcaguccugauugccagguugcuggcugcaggccccaguggcccuugcucaggccuuuggaaccaggcaggguuagcagcugccacucccucgcggggucuccugugaggcaucucuuccuuuggcacagggucccccuggggccugguuggaccuccccuucccgaugcuccuauggaaagcuggcaguugggccacuuggcaccacucccagugucccucuggcucuccuguggcucucccauggcucuccaggcagcuguaccuggccugcauacggccuccggccaucggcucuguggccgcugauccaggccccuacaaguuugauucugccccgucaucucagugagacaggcacagccucugcagcagcagcuugggcuuggagggcaggggccacgucgggccagcagcuccucuccagcuuucugcacaccccuccucccaccaggacaccccuccuccuugcucccccauuccugcuccggcugggggagggaagcuggcaucacacagacacccguggccgccucccacuaggcuucugcucccuucucugagacauggggcuccuaagagacuucaccuuauaggguugucgugaagauccagugaggcaggcacggagcccagcgccuguuccugcccagggaugucagcugcuguccuccuguugggauccagaacccuuuguagcccagcccaggcccugagugucuggcaagguuuaguuuagucagccuugucagacucaugcccuuuuugauaaauauaaauaaccuguguccuucaguguuugaaauuucagaauaacuuggacaucagaucacaaaacaaauggagcacgggugucugugugaugccagcuucccucccccagccggagcaggaaugggggagcaaggaggaggggugucccggugggaggaggggugugcagaaagcuggagaggagcugcuggcccgacguggccccugcccucccagcccaagcugcugcugcagaggcugugccugucucacugagaugacggggcagaaucaaacuuguauguuuuaccuuuuuuucucuuuuggugaugagugaugguaaaccauaaaacucaacuccugagaaaggaauuuuacuagcagauaauggaggguuccugucauuccaauaggaggacccgccuuuggggucugcacagcuggugggguccccguggaccccuucugaguccuucugggagugggcuagcccaggaucggcugguggggagguagcugcacugggggggaugugggggguuggcauugcaggaccuuccaugccgccugccuccaucuggggccaggaguuggcccugggcucugccuguggguccugggugugcugcugcugccugguggccugggccuggaggaaggagcucagcuuacacucccagccuuucaggcagguucgcagcagccaagugguuucuuaaaaagaauuccuccucccuugauuaauuucuggcaugcugcuucggggagcucuugcgucaguaaaucgucauaaacccccaguugucuggaucagacauaaacaccaagcccagcuccaccgcuccugacucuuggccagggcuggccugcccucugagcuccgggcugggcugcuggagauaaagagggccagcgggcgcccgagaggucaggcguauggcugcacccgacaaaguccuuuucucagaggugccgagccuggcaguucggaugugugcugugcucgcugggggaggaugccgggcacagaugugauuuauuuccugaaauguuugguguuucuuuuuccucccccaccagcuccccacucucauggauaggauguuuuccucguugggaguauuugccuccuuccagugggcauucuguagggguuaagaaagaucccugugugugaggcuugcacaguguuacauucaggucugggaaacucaggggcuggacagcaaguaccucacuguccagaucucaaggacagaaugccuuacagaaugcuuccuguugcucacagcaaaccucaucuuaaggccuuuucagcagcguuugagaucgucaggaggucccggacuacauucauccugcccuuguuuuuguagaacauuuuucaucugggguacccgugaagaggccagaagccugggagcuggguuccccacaguccuggguuaccggggagcacacuugggccagcgccagggcuccuccaggguggcuagaagaaagaacuugggccuccagucauuucagggcugauucaggcauuuggcaaguauugauugagccccugcuauagguggauggugggaauguguggcuuucagcgugucauccagcuuacauugcucagggcggggaccagucacuggcagauguggagggaugugcagugaggggccuuguggacagggccaggcaugggccuguacagacauucagaagaaauggcagccaccccaggccccuggaugguguguaugcggggagagcaugggaaggaagacuguccagagacuguccaggggccucugcuggauguuagcuugcagggagcagugugggccaggaaccaggcagggcuuggccaugcccaugaauuuggccagggugucucuaggcuugcucuggguuuccgagggccugcagggcacaggcacgcuuuggggaggcugucaggcccugguucugagucccauccugugagccaggcagucucucugggaaagcccuguaggcagaagggcagucccgggccaagucugggcuggcuggcugggggcuagcgucugauuucaagauugcaguuucgacuuguuuucugccuaugcacauaaacugugguaugaaccaaauuuaagggaguuucaugaaugaaaaaaaguccaggcugucuacgauaauuaacuuuguguguaaaauugagaaaagacuuccguauuguagcugaggggcagaacagcugaguuucacucgcuggacaccugggcucugcagagcagguucugagggcaggggaccugggccccaguuucugagcugcaugggggugccucccaaccccuggggaaggggaggaacguucaucgggccccggcuugccuuauucaugccauuggcucagccgagcccugggccaccccgugggaaaggcacacccucccucccagguggguacggcuaggcucccagggcaaagccaggugccccaggaaacccagcugccagcagagccaggcgaggcugccgccuucugaccccaggcucuuguggcuuccuuggggcucugcuucucagauucugaaacauuuguucagcgaaggcaguuggugaaucauccuagucaggguuuuuuuccagaaacaggugcaccgccagugagugauguggucucguucagacugugccucucaugccugcacucauggccugggaaggucguaccccugggccuguugugcacuucucuuuagcaguaugacaggggugaccucugugugcuuggggguggcaugugaacugccccacaggcucccaucagcauucagagaggccucaggugcgguggaugugggggucucggaccagagaagcagccagcugcuggcucgcugggaugcccauggccccagaaguaucuagcaaaucauagagaguuuaaaacauacugccaucuguuguuuucuuccaacuccuugcuuugccauuuauucugucuugaagauuauuucauaucaguuaauaaagcaaucccugauucuuuuaauaaauaacauauuucuuuuuaauucuugaaauaacacuuggguguuguuucugucuaccaacauguauauuaauuucuuuguucaucaugcuuuuuuauugugguaaaauauacauaacauaaauuuauaauucuaagcauuuugaagcgcacaguucaguggcaguaaauauuuucccauuguugggcaaccaucaccaccauccauucccagaacguuuucaucuucccgaacagaaacuccauaccuaguaaacaauccuguuucccucccucuggcugcggcacccaccauucaccauucugcuuucucagcgaaucugacuccucuagggcccuucugugaauggacuuguauuuguccuuuugugcguggcuucuuucacuuggcauaaugugucaggguucacucguauuguggcauggucagaauuugguuccuaaaacuuuuaaggaugagcaguccauugugugcauacaucacaucuuauuuauuccaucucuugguggaccuuugggccgucuuaacuuuuuggccauugugacuaaugcugcugugaacauauguguacacacgucucugagucccugcuuucacaucuuuuggguauauaccuuggagcagaauuguugaauccuaugauaauuuugugcuuaauuuauuauuauuuuuuuuucaucccacucuguugcccagccuggaguacagugguacaaucucggcuuccugcagccucugucccccgggguucaagugacucucgugcuucagccucccgaguagcugggacuacagacacccgccaccacgcccgguuaauuuuuguauuuuuaguagagaugggguuuugccauguugaccaggcuggucucgaacuccugaccacaggugauccacccgucucggccucccaaagugcugggauuacaggcgugagccaccacgcccagcccuguguuuaaguuuuuagaaaccaccaaaguguuuuccacaacacugcaccauuuuauguuccugcccaccacguaugaggguuccaauuucuucacauccgcaccaauauuuuuuauuuuccaauuuugaaauaauagucauccuagugagugugaaugguaucuuauugugguugugauuuguauuugccuaauaauuagugauguugaacaucuuuucauguaccuauuggccguuggcauauuuucuuuggauaaaugucucuucacgucuuuugcccauauuugaauuggguuguuuguuuuuuuguuguuguguuguagggguacuucauauguuauagauauauaaucugcaaauaucuccuucuauucuguagguugucauuucacucucuggaugguguccuguggugcacagaaguuuuucauuuugaugaagugcaguuaaucuguuuuuuguugcuuggccuuugaugucauaucuaagaagccacugccaaauccaaggucaugaagacuaacccccuguguuuucuucuaugaguuuuaugguuuuaguucuuauauuuagaucauugguguauucugccuuaaguuuugcauaugguaugagguagggguucaacuucauuccuuugccuguggcaauuugaugguccagcaccauuuguugaagaggauguugcuugccuuuagcugcuguaagagagcaugugucuuagaggaaagaucuugcucauuucugaaguugugcuuuggaagugucugagcugcaguuguucuuccuucccaggucgguguagacucugcucuuccuaagccagggcgcugcagccauauucagucucuuguucuuuggcucccgucccugucgcugcgucccuacagcagcaccucgcccacgcccccuucuguuauggccucuccaagggauggcgaguuuaacaacaacugaccaggguuuccacaggagacagagaacaggcuuucugcagcguggguucccaguugugcugugagcuguggugccucgugaguggggcucuuccgaccauccugucaccacuugcgucagaguccugcgugcuaucugccuggggguccugagugugcuggcugcugcacugaagcgggugggcugcugagcaggaagccacagcaugccacgcaggcacuuuggcuuugcuuggccccuggagagcaaacacauaauggcaauaggcuuuacagggaguaggauuuauuuacuuuaucugaaggaguuuaaaaauugcuauuguucucuuggcuuuuaauuuucacucucaccagccuuucuguucaggauacugugcggugaggaccucuuucuccauguuaaguucgcacuggugaguuguggcaggauugguuuucuuguaggauggcucagggcuguguuucuuucagcuaauuguggcuacauuuuugccuuugcguguccaauuuggguuucaaauucaggauuguccaaguacucuauguuugaaaauauuuuccagagaccccagauuucuuauuuaugugcguuaguuacuuuuuaauuuuuucagcugccuucuaguuucacaccuucaauugugcuaauccuucgcauuuuaaaaguuacaccagccuuugucaguguuucaucagugcauaccguagcgcauguggucccguucagaugcacuuucuguggccuggauucuaggggaagcaauagaggauauauuucauucugaaauuugcacuguuucuuuuuuaaguuaaauauuucaacagcaauggauguucuugucuuuuuuuagaaaaaauaaaaaugaauguuuuuguggcgcuucugccugcuugaguggcagcguuuuuucccugugcaggcccccaggugugugugauuggcugccccggggccccgugacaggggaugcuuuuugagcucucaccggcaucuuccuccuuaaauccagauugggcggagacaugaauucagcauuaccucucccauguccacacgugaagaagcacuuuccaggcgcacacaccuaagucguuggccgcggguucuuggagggcguggccugagcucccagacgccuccucucucaccuagcacugcacagugccuuccacacacaggcucuccgaggaucugccccauuuauugcuuugauuuuguuggaugaaagcaguuuauuaaauaaaugggaaaauacuccccuuccccaguuucaaaaguuaagauguagucuuuucuuuacuuaacauccaacaaugcugaaagaugaaagaaaggaaaaugcucucuuuacccugccagaccacauuuagcugggaggcacacaguucagagaaagucacaggugacauuuuguagauucucaagcaggagcucucucucuuuuucucucuuucccucuuugucuccccauguccauaccuguaccuauuacauacacgauagaacagcaaugggauuuuuuuguagcuccguaauauuucaguauuuaaaaauccucuguuaaugggacuuaaauuuuuuguauaguaaauaacaccucagcgagcauuguugcacaugugucuuuauguuuggggcugguuguucuuaucaugauuguuuuguuaggauaaaguccaagaaacagaacuguggggacaaggggaugcgugagucacccucaucaucaagagugagccguuuguggcacgugcaccccacccacuauggcaagaugccuccacacaccccgcagcagcgcuggguuugucucagucacugcaguucuuucugggcuucccgagaaggaagggccacaagagucuguccaggugcuggggcagacauuggugacgucgcuuaucgaagccaggaguggggccccggguguggggccgagugacagacccaggcuacccacacccgggcaggaugaagagucucaagagugcuuuccuuaggcugguucccguccacacaccagcacucagccagucaagacaccucuugugagcaucugcuacaugccaggcugcuguaagcacuggggucuacuggugaaccacacaggaaaagcccccacccauugccacacccagugccagugggaaagucaaacaguagauggguaaauaaacaacuacauaaugguaaauauggcuggcagugauggagucugcccugcacaggcacuuugcuaaguguuuucuacauauuuacagcugugauccccacaacagccuacggauggguccuacuaaccuuacaucaucuguauuuuacagaugagaaaacagaggcauugagaaaggaagucacuggcccaaggggcugugccaagcaacugacucuuaaccagugagcuugcgcucugaaguguaaggcuuuacuccccuaaacuugucauugcaaggcaguagaauaggaucuggagacagggggccuucacuucagcauccgauugguugcaggcugagcuuucacuucagccccugauugguugcaggccaagucuucauucgcauaggguguaacuucacuuuggccucugauuggucaugagccaagucuucauuuacauaggguguaaccaguaggaaaccucuaaaggguacuuaacccccagaagauuuugcaagugggagucuugagcagcuugcucuggagcuugcuccugcucuguggaguguacuuccgcuuaaacaaaucugugcuuucguugcuucauucuuucauugcuuuguuuguguguuuuguccaauucuuuguucaacaugucaagaaccuggacgacucgcagugaagacccucccccuuaacaaccggaugugccaucagggauagaugcugcccugagaaugaugaagccagugucuaggggaaguccuggugugggcgggagcugugauguucugugcucuauggcagggcuuuggagggcuuugacugggccagagcaaguaacuauaaaaugucagaccuuagaagaaaagcauccuguacucugacaggaagcagcaugaguugguugucacuaaaaggaagaacuucugagaaccccacaaaggacccaguuagguaauuguugaaagcugcuacuccuucagggauaauguaauauuuuuccaacauuuacacacguucaccuuauuuaagauuggcucaaaacacagaaaaauguaagcuaaccuuuuuuuuuuuuuuuuuuuuuuuuuuugagacggagucuugcucuuucacccaggcuggagugcaguggcgcuaucucggcucgcugcaagcuccgucucccggguucacaccauuguccugccucagccuccugaguagcugggacuacaggcgcccgccaccacgcccggcuaauuuuuuguauuuuuaguagagacgggguuucaccgugugagccaggauggucucgaucuccugaccucgugauccgcccaccuucaccuuccaaagugccgggauuacaggcgugagccacugcgccuggcugcaagcuaaucuuaugaagcuuagaguaucuugauuuuagaaccugcaagagacaauaauaaagcaaacguuauaagcacauuuuguuuguaaacauagguuuaaaacccugaauagaauauuggggaaaagaaaauaacaguacauuauguaguuauucguuaucaaagguuuuauuacaggacaguuguuauacaaggaaagcgguauaaaucauguaaauaugagagaauguuuugaaaaauaaaaaagauuagauaaaauaauuauuucaguuuucauaauugauuuuaaaauacccaaguuggagagaauauguaguucuuacaaguuggggaucauuugaaagcaaaaaugaaucuuuuucaugguuggaaaacucuagaggccuugucuuaacaagagcuguguucugagguugaccuuacgguagcacauguguucaguauggcuugagaugucagcaguuucauuaagaugggaagaaccaaaauaaauucacauaaaaagacucaaaaagauucagaaaauuuuauagauuaucagaaacccacuagaaucauggauuuuguauuugccaauaauuaauagcuagaaaaguucaacagcaaaauaguuuugauuaaaauacauauuuuuacauaacagaagaguccuaccaauuuccuuauuuccauauuuggcaaauuuagauuuaccuaugucauuugucacugguggagaucagcauuccauucucuauaauuccuucuaaauuuuuuuguuuguuugauuuaucacuuuuuuuuuuuuuuuuuuuuugagaugaagucucacucuuguuccccaggcuggagugcaauggugcgaucucgacucacugcacccuccgccucccagguucaagcaauucuccugccucacccucccgaguagcugggauuacaggcgccucccaccacgccagcuaacuuuuguauuuuaaguagagacgggguuucaccauguuggccaggcuggucuugaacuucugaccucaggugauccgccugcuucggccucccaaagugcugggauuacaggugauuuaucacuuucucagcccgcuuagucauucuguuuuuauccccuccacacgcauuuauuuuaaauuuuaauuauaaaucucuaauuaaagaauuaaacaauucauagacauuaucugcaucauuuaaagcaauacaauagcagugaccgugugcucugugagacagagaccacuacaaggacauuuacauguuugcuuuucauucugcuguuuccaaaaaaaaguuuuaucauacaugcacauguuccuaaacaauaugauuuuaguuuuauguuuuugaacuucauguaaauagaauuauacuauacguuuucuauuucguggguucuuuuucaggcaggacuguuuuugagaaccagguuucugccuguagcugucggugacugguguucauuagugucuugcauucaauuuugugaauuuucacaacuuugauucauguucagauguggcugcucucaaacaugauguuguggacauucuuuuguguguuuucugacacacgcaaacuugggucuuugccagguuccugccugggaaugggagugccgggucacggguaagcuacuuuuaacucugcgugaccuccagcacggccacaccgucuuagaccuagugccagugucuucaggcugaccagggcgccuugcucggucccgggagguggcccucgccuggccugugccugaccgccagccugcuguggcugucagugucuucugacaugggucacccauuuuuauguuuguuguugguuucguuuucuuaaucauuugcagaauugaaauaucuggguguguguggcuuccuuccagcagcuaacgggaggcugcggccgugugcugccuucauugucacagcuuccuauggccacugcuccuuaaaguuuccuauauguggauauuacuugcuugcuguuucuuguugaauaucagauauucugguuuuuugcucuuacuuuucuucuggaaguaauauccuuuggaaguaauauccuuuagaaauuccugcagaaguuccguuuuuuguucgucugagaguugccuccuuuuccuucauuguugaaugaucccucacagaagacagugcuggggaggcagcugcucuuccccagggcucugaggaugugauugguucacucaguuccacuggggcuguuccguuccuuggcaggaauccguugugucucucuagguguuuuguagucuuaguguucuacauuuuuguaagcguuuucacuuaccccuguugauauuuuuuuggacuuccugaaucugaagauuagugucuuccaauaauaauggggaauuuuauuccuuaacuuuuuucuuuuuaacuuuuaauuuugcuguaauuucaaacuuacagaaaaucagcaaaaaauaguccaaagaauuacuguuuauugauaugcauccuuuuuuuuuuuuucagaaucguuugaaaguuaguguuagaugugaugccuucccccaacuaauaauccaggccauguugccucagauaagcguggucacucuucaacuacggucagugaguagaguuggaaaauaacagcgagcaggcauuguucucucaucuguaggccuuguuuauguuucgcugauagucuagugaugucucguuaucaacagcagaugacaggcccugcagggccuucaauucucacguccuccccaguccccuuugcuccgggacagucuccucgucauuuuuauguuucgugacauucacauuuuggaagcguaggggcagcuauuuuguaaaauguuuuucagcuugggauuucggcauguuuccucgugauuggauuccagugaugccgcugggcuuggcggccaccgcaguauuucguugcugcugaugcugcccggaagcucucagugaaggugaugcuggcggguguuuccacugugaaguuacauuguuuccugcauaauuagcagguaucugguagggagauaaucugggacugugcagacagccugcuacuccccgagcacugacccacaagucucagcaucauugaugguucuuugucggagucuguuguugucguggugguggcuacuggucaucuagugucaccguucuugcuacauucaggacgggaagcccucauuaaccucaggagguucuuggaaacugacuuuuaagugaaauggucaucuagugucaccguucuugcuacauucaggacgggaagcccucauuaaccucaggagguucuuggaaacugacuuuuaagugaaauaauacagaauaaaaccaagguuauuuuucucaccagugcaccaguguuauagucaaacgacuggcauugcuugaggacccucugucguuggcuuaaaguugcgguuuccaagaaccuguggacaacgugaaauguggacuccuguaguuaacuuucuccuguaaagagcuuuccuuuccuccuuauuuauguguuuccuuauuguuuacuuauauuaguuugaacucauagauuccuaauuuauuaacuggguuauaaccuuuuauuaucaauaucuauucugcugcccaaauuguuccaguuuggccaaugagagccccuucaugcuggcguuucuggcaggucccucccguuuugggacccuucuuuacucucuuggauacacaaaauguccuaaucucgccuguacuuacccuguccuggccuggaaucagcuuuuucucaaggcggccugguuccuuucucggggaaugcuauuuagaaaccagcucucggccgccagagcugugaauagauguguguagaucggccccugcacccacacacgccggccccacccacacacauggcaguucacuuccagcccagccucacaaaggccaccggcuggccuucuccuuucacauuuguuacucccucugcugacaaggagacguggagcucucagaauccaucauguacuuacuuauuuguucagucucaaucccagaauacucagagauuauuaaccuaugccucugugaaaaagaaacccccaacuagaguccagcagucgcugaaggcguaugguccagauaccgggucuaaaagccacuuuggcaagcucuuacgcacaccccacccugccccagcgugguuguuacucaucugaaaugggguuugguuauuuguuucuguuuguauuucaguuuagaauuuuucccccuguguacuuuuugauuguauuaauuuucacuuuuugaugaugugaaacccaauugcagcuucaaaagccagaacuguguagcagccagacucagagaagcggguccccuaccccugcuguccccuguccuuuccacccuguccccaugagcuacccuuucuuuccuggguggccuugugugcuuucauuugcccacuuucuugcacggaaagaauguccuacagggaacuccucuucccuagcaguauguccuggaaaccacgccacgucuguccacaggcuccugcucauuccuguggacagccauacacucugcaauucauccagccgcucucuuaccuagggcccauugguauacuguacaggguagugguagaaucacagcucacuacagccuccaccucgugggcucaagcaguucuccugccucagccucccaaguagcugggacuacaggcccgugcuaccaugccuagguaauuuuuuuaucuuuaauuuuuuuguagagauggggucuugcuguguugcucaggcuggucucaaacuccugggcucaagugaucuucccaccuuggccccccagagugcugggauuuacaggugagagucaccgggccugccaucugaguuuuaucuucagaguugguuuauggagugauuucuaucaaaagauaaguagauuauaucauuuuauuagauuuuucucaagauuuccuauaggaaacuuauaucaguuugcauuuccgccaguagugucugagcgagccuauucccacggggcuuuggaguggaguguauuacuuacuugcugauuugguagaugaaggauauuucaguuuguaagggccguuuuucugucuuugcuuuuggcuuuucuguuaggcuuuuggucucuguucacacaguuuguaagaguucuacugauggaagagauuuuggccuuugucuuucauguguauugcaaguaacugcucacaguuuguccacuguauuuugacauucuuucucaugcugcuuucacccuguaaaagguuuuuccuccauguaucaaacuuacuguuuuuuuuaaauugcaucuggauuuucaguccugguuagaaagccuuccuugacuuccagaagauguuuucuuugagugcuuguacgguuucguuuuuuacauuugcauccccaauucguuuggaguuuacccuuguguaugguguuagguuuggauuuaauguuaucuuuucccagacagcaacccaauugucuccaguacuguuuauuaaaacaucccuguuugucccagugguugagaugggcaccuuuauccugcccuggaguuccgucuguacuucuguuucuggacuuucucacugucaccuggucugccggguugauggugucugucgugcucucugaagcguaggggcuuugaggcguguuuuagcaugugguugggcaugcuggguuucauuuugaauguuucucuagcgcucgugcaucggcauugcccguugcucucccaucaucucucuucuuucuuucugggauucugauuacagguguguaaaccaaaaguaucugagacaggucucacucaauuuaaaaaguuuguuuagccaagcuuaaggacgugccugugacacagccucaagaggugcugacaacaugugcccaagguggucggggaacagcuugguuucauacauuuuuagggagacaugaggcgucugucaguauguggaagaugaacauugguccaguccagaaacgcgggacaacucgaagugugaggcuuucagauuauagguagauuuuaaaauguucugauuggcaguugguugaaagaguuauuaucaacacaaaggaaugucuggauuaugauaaggguuuguggagaccaaggauuuaccaugccgacgaagccuccggguagcaggcuucagagagaauagacugaaauguuucucaucagacuuaaagagucuguucuaucagcaauuccaaaagggaggaggguaucaugaggcacaucugaaugcccguccccaucacgaccugaacuagcuuuucagguuaauguuggaaugcccuuggcuugagaggagggguccauucagaugguugggagcuuagaauuuuauuuuugguuuacagauguguguuagcauaucuuccucuguccuuccaguccucuaacgucuccagcuuucuaucucuuuaccuuuauguguugcauccugguuuauuucuuccgugcuauuuuacuguucacuaauucucucuucagcucugucuauuaauacuugauuaguuaacucacucauuuaguuuuaaauuuuaaugaugacaguuuuguuucuacaaguuccauuuggaucauucagauccaugugacacuucugauaguuauuaauaauaacagcugagacaucugucuccuuucuuccuuagccuugcuccagggagagugugggcucuucuaaucccccuuuuuggcaaaugggaagcuaaggcacagggagguugaggaagccaccagguuuguacagucacuaagugacaggaucuggaggccucuagcuccagccugacccuggaugaccucucuuguuuugucgaguguccuucguauguguuuugggucagugccugauuuuccuacaacugaggucuuuccgggacuuacucccgcuacccaugguucuugauugugacuuuauguccguccuucuuggauguuuuuuugagguucauagcguguuccucuagagaagguuucugccuggugcugggaggugccaccugggacaugccuguguuugcaggugcuagggaugcucaucaggccucauggguugucugaauucuccccaaaccauugcgaggggucugggauuaugaguucugaggggaguccucucucgauuugaccccuucuagccagcaccaagcccaggcccggaugugucccuugcaggccugucuucuggcuuccccugccaagggaacuacagccccuccccacgcacacucacagggacggugcagugguaagaggcagugcagguggcugccccaggacaggcccugggcuccaggcuggcuuucauguucuauuugcccugccuugaauuccugucuuuggaguauauuccucacucuucagccaacucagcccugaguauaauuagacgucucuaaaagugcgugugccauauugccaggcgugaaggcuuuucugaaucuuccuuucugucaccagugcuguacguuggcuuucuuuugaggcgcuuauuuucauaagaaacuuucucuguguccuuaacuuccagcagagagucugggagaucggggggucaggaggugcuaagggccugaccagcuguguuugcgaagugccauggaaaacugggaugauuccggucaucaccucucgugagguuaggaagaguccagccugcgguaucagugcucggugggauggccagcccccaauuggaggagcgggcuccugggcagccuggggauacuugguucuaauccagauccucacacucuuuggggaggaggccguuuccagcaagugagugucccuuggguuucuccucaaagccccuucuaaaauuagucccuggcugcugcagggacauuuacaucagcgcauuuuguuaaguacuuuuguugcuuuccauuaagagcauauuuaaaaauaugaaaugaauucaggcagaagccaggcucugccgcugagaacaucugugugcuggugagagggagagacugggcgguggauaacgggcugcagcuuccuccuccgccaccucggaacgcccccggggaggcacgggacagagcccaagccugagugaagcucccuggcugggggaacacccugccccaggcuggccaccuugacuccuugcucugcaggcugcccccggcaccucgucugccucccgucggcagccagugagaggagcguggggccugagagcauugccugccugcuggccggccgcccccacagugcagagcuggagcggucuucagaggcucccggucucccucugcagaugaagacacugggggaacguggccuacccacagucagcaggcuccccucuccguguaccaggcuagucugccggcgccacggcagcugggccaccaccacauucugcccucagugcuguggugcagucgaggggugugccuuggaggacccauaggaagaccaacuucauguccaugggacacgcuggaagaaacgccacagaccuuguuccagaugcaguuuuccguuuuuauaaagacaaguguggauguuuucguuucauuggacgcauagaggaaaggugacuuggcuucugcugaagcccagcagcccauucuuagcguuugcuuuagaauggaggacagucggggacauuuuccucgugaauuucaccaucaucuggcuuuggccuucuuuccaacaauugaggaagaaagggccuaauguggaacuacgugcgugcgugcccugcgugugggcuccugggccagcauggaugguggugcuggcagcaccaccaccgugcaguugggggugggcagcaggccucuuggcggcagccaauguccuucucaucuucccugucaggugcuaggagcccuggcaccaaggcuguggugaugguaccaggguucucuuaguugggaggggcugcauuuccucuguagcguggguggcuggcuggccugguguccugcccugcccaggggugccccugcccgccccuccuuccagguugcagugugguagguggcaccuugguggccaguguuuugugauggugacagugaugucagcgccgagguuccucaagucuaaacugagaugaucuggugugauuuuucuuggcuuucaauuuuuggguaaggcuuuuagugggcauucuucucuguuuccccuuccucauguuagucuagggccccagggaaccacagaaccccugcucuggaaggaaccuuuagaggaacccguucugagcucuuccuuucacaggagauugcucagagcugccccgugggcugcccaaggccucuuaggucaaggacccugcuggcuccgguccagacuucucccugccaugucaccgugaggaagcaccgccccaucacuguuccaugaucauuguaacaccugccauuaaaaagcacgggagcuucgugucagaauguaguuuaaaauguguuguaauguuugcguagaacagaaacuugaaguuuugugagaaacggaguccccugugugugguuuuggaggggcugagcuguccuuuccugucaugggucacagugucccucucccccucacccaugaaauaaugacagcggccuccauuccuacaaaguccucagucgcgggugccguuuuauaucguaaaucugucaucuucaacuggaugguguaacacuuggauucuacauuucccggaugcuuggaaaggagugccaggaguuauguguucugcggaucagaacagcugacgccggcugaggacacuucauccacuguuugcucggcgcuugacaaaugcuacccagucuaacggugagcgucgggugucuccgggcuuggugccugcuugugccacacaucucagugccaugcaagaccagcaugccagugacacagcaggggacacguggaguucaggcugcugagagcucggaaggggccaggccgucccccuggcccuaaggcugcaaggcucugcccuggagcugcagagcuaacaccucacucugcgggguuguaaaguggagcugaugcugcuugaccccacaaaagcucacaggccuuuuaggugccuguuaaugcuggaaugaaaccacagguagccaagaaggccugccugucagaccgcgaccgcgcagaucucagcagaauguuuaaaaggcgcucucugcaguuuuggaauuguggcgcugcucuugcuuaguauuagggcucaagcagguuaacgucaggguucguuuucuuaaauggccgguggccguggugguguuggacguggcuaaccuggcacagggcagcagagauccaggugucaggccaguggaaggguugaagccucucaccagcaugucuguuuuggagggaaguguuggacauugagugaggccccucugcacucagcgacccugcccugugcucccagacccaguuuugggucugcuugguuggcaucaggguccuggcccuuucuguguuuugggaccucuguuugcuuaucauauuugcaucauugccuuuacucccuggggggcagaggggggagcuccugaagccauuuagcccugccagccugggucugcccuugugccugugcuguguucuuucugccuggcaguccugcccuacgcagucucauggaggcagggcucaugggaggggccuucccuuggccccagccauccccccgggaacaucacacucucucacagacacacuguggccauuuucuguugaagcuacucugugaaacauucucuauacuugguucgggggggagcaaaauccagaaucugcuaaacaccaaugcugucacucagaguuuguguaucugcugucuguggagcucuggaccaggcuugagggacgccugggguuuccacccacaucuggggcaaaccagacccccaagucacugacaugucgguuuuucuacuaaucacguuggcuuuggcaauucuguauauaauaagaaguauuguguucucacuugcacuugggcagaacgguucacuccaaggcugaaugacugccacggaccauucccccagcaggggguccugggguuuagugguuugauucugagcaccucuacgcacagagccccuuaguggguucccuaacuggacggcuaacccugcuguggaaucugacuuuuucuggaccgaagaggacaggcugcucuggagaaacuccuugggccuugugccugaugcuggcucgggccacccuggccacccucccuucaugccccaugggaccaggcagcagcaugggagggggcagcuuccagaacacccuucugcuaggggcugcuggccucccugcuggcacggccacauccauggucugagugugugguuggaauguuuuaucaacaccaguccucacagcuuccccagaugagcgaaggggaaggggaugguguguggggggauugccucccuugaggccccccagcucccaggauacuugcuggcggagcucugccugcgguggaggcccuaugacuugaccuccaucuucucccugggccccucgcuggcccucacuggcaggggcuccugcacgccugcaaggccagagccucccgccaggugcaggagaaguaaaugcaggccagagauaaaucguauuucccucuaacucggauguggagugagaggaaggaagcaggaguggagcugaguguuagugagagguggcugagaaggcggggucccgcuucuugcuuccuugggcauuugcuguaggugcuggguuucagccuggaagggugcagccucugcacuaagucugguuuggugaacguucauggcccccaauauaaacaguguucugggcguucuuugugacucucgagccgaaacacuguggugaucucucguaucaucugcuuguuauguaaugugacaacauggauaugaaauagaaaccagaugucaggguggagcggcugaauucuuccccagcgaggccgccgggagagcaggacuuggguuucuccugaguuacggcgccgaacgcccugagaaaaacgccuuuggagcaguuuccgggauuaagcgaaagucugggcugaagguaaagcaccaagucaguacgauuaacucuuuuuuaagaaacuuguaagggauuuucugugcuguuauguaacugcucagugucuuccagcgagccggcggcuuguuaucaagaauccguuuagaauguuugaacucagccucugggggagcugggagcacuguggcaccuccaggggccugcagcgugcuuccgagggcuuggguguagaggaaggggaacccgucuuucgccugugacagccuugcccuugggucugggagcaaugaggacucggaacgugagccuccugcuacagguacaggcccugggggagugagggcgcuggcggacagcagucuuggcacuucacguuagcagauucggaguuucugcagcggcugaaccccugcacugggcuggaagggggggacacccggaggccuguuaaccacacucugccuggacuacaccaugaacauagaucuuugugcuuuugaaauacaaaaaacgagcucaccuggauacgaagugugguuccggaagcaguaucuggcuguggauggagguuauguauuccaccaacgauaucuucauuauuguuauuuuccuuugguagcugaucuuucagagagaucugcagauuccucacuuugcuaagaagacucucugaaaacaggaagcuaaggaacuccucacucccaaguugauuacagccucauggaaguguggaauucuuauuaggaaagccuguugcugaguaccaagcagguuauccucuugucccgugucaccagggggccagcuugaugaggaagaaagugacccuggcucccucguguccccaaggcaguggacucccccccgggucucuagcucucuugucccuaagcugauagcucaucgucaaggagggcuuccugcacgcugaccacccccaucucacagaugaggaagcuggggcccagggagggugagugaugggguguaggaagggugagugacaaggcccagagagggcuugugaugggcccggcucucaccguugggggugggaugggccauccuuggcuccucgcagcucguugcuguguggccacucauugcuguguggccgcucacuuugggggggauggggacacuuugcuggcuguugcugccgggccuuguguuccguuuucagguggagaucaggaauucugagauaguggcaaaacgugauguggcucggggugcguggagacgugugugacaguccccaaauccacaguggcugugggguggcguuucaggcugggaaacccucuggaaagaaagcacgaaacacuccgacauccucauuccauuuugcuuguucuaaaagagaacuugaagaaaaucaucccagcagcauuugcuuagaccaagugcggucaugagaacgucaucugagugaggagggcuucucuugcaugcguuuucuugagcaggaguugucguuuggcuauuuggaaaaccaaguuuagggucccuggugagucugcgagguccaggaagcagacacucacuuuaucuaggugagaggacggagcugcagagaugggccuuagugaccacugggcccucguaucucuggcaggucccugauuaguggugggagggggguucccuuuuguagccacuuggucuuuugacagcuugggguacccauccuucaagccccucucuccuggggcccaguggccgccucugggcaucacggagagccgcucuuguguuggggccuccggcuccucggcucucugcuucuaaacagaacacccucuuguuucugaaaguagcccaugguccccugaggguccugagcacagcccccacucaucugaggaugaccauuggggcacggagccugccccaggcccugggcuuugugcccagggcucucuucucccucccugucaggguuuccagaccccucgugggcacccaggauggacggcaggcacagagcuggaggguguggccugagaugggccauccggacgacucgggccucugggcucaccagagugcugaaugaaggccggagggcgagagugggaaggauggcaucacccacccugccgguggccccuaugguccugcggcuccugcugcuucuggguuacccugggcccagggugcaggcgcccuuggggaggugcacacgggaggcucaggcccuccuuggacauuccugaacgcccccaugcaucccugcagcuccuuccagaagguucucucgauccugucuggcuccucgggggugugugggaaaccaggccagggucucccgguuguuggcuggggugggguccugccuucgccccuuagcauucacccccuaccccuuuucaccauguaaaacccugugggcccugggcccuggaugcucugcgcccgaggaccuggguucugccaucaccugggcaguguggggggcauauagggggaacauggggugccugauguagugccuguguuugaccuuguuuaggugaagagcacccuuuccagcuuauguuuuguaucaugaccgggaaagguacgaaacaagugugucggggcccagaugauuugauggcucuacgggccgaguaugggacacaggauagcuuggcccugggucagguauuagucaguccuugcuggcaccugggcagggacacauccguggauggggccuggccagguggccucugagguccucguguccacuggaaggcuguguccucuguuguagucacugacuugcuggaccugggugggagcucacccaccuguggaugggccagggagcuccuggaaucacuagaaagaugaacuuuuuuugccuucuaaauguaugaaaagaugggaaaugauaggaaaauaaguggaagucagaucuauucaggaaaaugacuucccagggaagagcuggggugccuccaaacccagaauccucgguuucuagaagcaaggcugaccgaggugggcagcauucuuugggaccuugagugaugaaguaguuacuuaagcagaguguuucucaugugaagccaggcagucuaggacacuaggaaucauuucagcgugggggagacgcagacacugugcuugcccagggugcugcauucaucugaaaugccgguggcuaccagcucuuugucacgguuccuccguggucuccuugaaugcugucagauucagggcccgugugggcagcggcagccucguucccagucguguuuagggaauggggucagagaaguacuugcuaaagcuuccugugugcacguguaauugugugugcauguguguuaaauaaauguauuucaacucgaaauacacguuucguggccaucagucuagggauggcuagaauuuagucacuaaaugaaacuaagccgcaccgucaccaauaaugugaacaugauuaaaaaccacacucaguucuuauucauuuaccuacaaguccagaaacuuuuagaacuuauuucaccauuaaaauaaauaguuuuuuaaaaaauauacaacaauaaggaaaaauuugaaagccucuugccccuccaucccaggccugacagaguggcuuccacaaagaaagaggcagaagccagggcugucugugccugcagggcgcuguugggcucacagaugacccagacucccccguaauggagccgcggacccacagcgagccacuugcaccaggcuuagccaagcugacaggccagcggaguaaggaauguucccuaccauuguccagaaaauguaacgagggugaaggugugccaagcagacuccccgugucagcccugaggcgacugccaucgcuuucagaaaccugacuaccaaccuggaugaaaaccgacugcuuggucauggccaugcaguuagaaaacacagcagcaauccucagaugaguguggccguauuuguguuacucaagcugcuuugucaucugcauuugaagaaacguggugagccuccugugugugcccauguggcagugggcaccucugcccccugcaaaggcugucuaagaacacagagccugcaguacaggcccugccuccugacaugccccaggccggcuggaagaaagcgcgggacuguccuauugacguggggaggggacggcuggacucugugaugcuaacuguguucucugcugggccauguggcuccccacagagacccugggugcccagucauucgcguucuccuauguguguguauauauauuauauauacauguauuuacuaacuuuagaaagcccccaagggggccuuguuucugcuuggacagucagcguccauagcgugucauuccuaagcuccauuaaggagauucagaagcaagcaguuaccccuggagucugcacgcugggcacaagggucacaccuucguugagagcuccugaccccaggagccgagggcaggacacgguaguguuuacaggaccuggcaaaggggcacugccuugugugugagguuuuuucaccagucagucccuuuuaaaaacagcauaucuuuugaagaacaagaaguuuacgcaggcauaagcaacucacuuugcacguggagcuuucaggacguuucaugucuguuacguuauagccucuauccucaugggggcucugaguucagcagggccugagcuguuaaucugcuuuuucaaauuauuaauaaugaaaguaacaccaugccaccaccugguaucauuucaugcuuucuaugugccugguguuuacacggcuuaucucauuuaaucuucccagcauguaauaaaaauauugcaacagguacugcuccuguguggacuccuucccccgagcucacacugcuugaggccuucccagcucugggcuuuguguccuguguggacuucuuccccgagcucacacugcuugaggcauucuagcucugggcuuugugaauauccugcuuuuauccucauuuauagguaagaaagcugacucagagagguuaagcagcuggucugaggucaacugcuuacgggucggggagcugggccugcacacaggggucugaugcagagcugguccuaucugcuuuauaagcuguggcucacagggcacuccaggggcucgagaggaccuggcgggcugagaugaagacuggugaggccugggaggcaggugcuugacugaggugggaagugggaccuuggugccaagcauucccagggccacggggcaggccuguagggucugguggguaucuggggucccggagaagcccuuggcacggggcuucaugagagcauaggcgagugccgcgcccugcaguugagcacgggggaugcagcugucgcagucgcuuuugaagagugaggggugaggccugcaguugcugcccgacguuguuuacaagugagcaaguuuuacaaaaaacauggacagcaucagggcugacuugaauuuuuuacuugaggcagcagcucaaccuguugguuuccucaauugugaauuaaaaaaaaaaaagaaagaaagaaaacagagaaagcugacaacguaacauugaugagaggauucuuaagggagaacaagccacaggcugucccgagaaaggagcggggagaucgaggaagcacgcugccgugucuuguucguggggugcuugugacgcucucgcaggaugcccugugggccacaccacgagugcucgguggcgacugcagaagggugagggacguuucccuucacaccagacggcgggucuugauggcagaggaaccaggcaucagaggaggacaagucaauccgggagcguagauaaaaaggaagcgaaacuuauuucacauugucaagcugucggggauuccagggaccuuguccuccaggccugucccugugcccuccuguccccaggccugagcagccgggugugggaugggaacaggccagggccaggugccucacgcccugaggcuggagucaggcucuguugccacuuugaauccaggggcccacccugaacccugagcugggcuucuguucaguacgcggaggugaugaccucucccacccgggggggguuugaggacucccgagguggcaggggugacgcccagcccagcaugcagagugcccaggcagugcccacaccuuuccucucccugccaaggugcuccgggccugagccuguguggcccccugcuuggggcugucaccacaaugccauuccccgcacgcccagcaagucccuccuaugggugagagccuaacuugagagacucuuuuggggaggaguaagaugaccugcccuucucaagagugagcaguucuuagaugacugccuugagcagcgaugguucuuccugcaggggugcgcccacgaaacgcucugcgugaagcacauuggugccaugcucaggcccagggagaguggagggugcugugcucuuggacuggguccuggcucgaggguugaggggcugggccauguccacaaaaagucacuggauggcugggcugcucccacugugucgcuggaagaggggcagcgcccgcugcaguguuuggagugcuuggucauggccccacguggauucuccuuccugggggaagcuguuccguccccagguuuucagcuaacuuaucugaguuuugaugaagagagcaagggguuuugcuaaucuggauuccuguggaagggccuccucucucugcucguguuuuauagcuuggcaacucuagugcuaguucugcaauauucgaauuugaguagccagaagaauuugcugccaggguggccuugcccuugacuuugaaaugaacucacccgagacuucagcuugaugccuccuuuggcuaaugcuggguucugggcuuuggccgccgccugccuguccaucacaaggggccauguucuccaaucaggacagaguucuaagcauuucacaguaaagccugcaggaguuagguuuucuguucuugacagacugagaaugauacugagaauguuuucugauugauuuggugagcugucuguuuauagcaucauuagagauuauuuuccauggcuaggaauuauucuugaccucacaguaaaggacucugaaucccccacccccugccuguuuuuuuuguuguuguuguguuuuuuuguuuguuuguuuuaaagaaaagacuuguaccaucagucuuaggcguaaucuccuuggcaguagugaggagcaaggcaucugauggagaaacaaagcaugguaagguuuuuaccauucaggaaucacaccgcaguagcauuguaguauuugaucacaauuuacucuuacuuuuuuucauaaagaaagaaauaggccuacaguggcucucacuuguaaucccagcacuuugggaggcugaggcaggaggauugcuugaggccagaaguuugagaccaaucuggacaacauaggaacaccuccucucuacagaaaagauuaaaaacauuagcugggcauggugguaugcgucuguagucccagcuguucaggaagcugaggugggaggauccuucgagcuaggaggucgaggcugcagugagccaugucauaccgcugcacuccagccugggugacagaggggagacccuguuucaagagagaaaaauaaaaaaaaaaaaaaagaaagaaagcaccagcagaauuuagaaaugugggccagugugggagccucgccuggcaucacuggccucgccuggcaucacuggcugugggcugcugcucucgcccuggagcuguuacuuugagagcagaucgaggacucagcaggcaggaggaauguucacggcagggucaguucccacgcugcauacgccccaccaucgccccucgucguggcugggaugggagaccgacuuuagaaccagaggcugggaagagggagauacccccuuccagaaggggccuucugccgcugaguaaggggguggugcccggcuggcuccaugaggggcaugaggggugcuggcuaugcuuggccugagggguugcugcaggaaggccuugcuccccgccggggcugagggacccggcugagcagcagcagcaggaggaaugagcagugcucuuggagcccggaggagggggcagggcuuguccuucuggacgggcagccccaggaaaagagaagcccagagcuaagggcccuugcccuagggaggggucccacauggaccccgaagacguuccucucugcagcccuuccuggcacugcguggacacgauguacggaaugaggaaaacgagcuucuuucccuucucuuucacuucucccucccaucacgcagcgugcaauuauggaagaggauaaagaaggaaagagcagucggaaaaauucuguaagaaccggagaggggaguucggguguuuuuacagcuccugggguucuccgggaaacaaaggugugcuauuuccacuucugugucuucauuccuguucugcagggaagcucagccuggcuucauccacauggguggagcagagucaaguucaguugggaauuuuuuuuuuuuccugcucauuuggaaaaagaggaaaagacacugggauacaaagagggcuuuauaaagaagaggccuccuugguccuccacuccaggacuuucugcgauggcggaaaugguccauagcagcaaugcccaucggggcagccacuggucaugccugacuguugagcuugucagcagccacaucaacacauggaugguguggccgaggaacuggauuucaaauuaaauuaaauuaaauuucaauuuaaguaaccacauguggccaguagcuaccuacagcgcacucucaggaaggcucuagacugagaguuugaggaucauccuuuaucagugauuugaauggaugaggcuucaucuguuugaauuucccaguugggguaaaaagaggggaugcuuguacuggaaugggaguagguucacagcgcacagccugggccagcaucaguguguugcugaauuuaugcuccuucccaagguuguugaggagacuggaagagaaguucuguguuagagagagggacgcccuagaggaguucacuuagucacaaggagcagaaaugcccucaguggcauggauugaaaggcacuuacggauggaauucgggagaaauucauggagcacugcagggaguccucugaugggaccccucuuccuucucugucuccccugucucccgagccccaggacugccggucucccaucugcuuaguccccagcugcgucccugcaggcucuccgcucuguugcugguuugguucgucuggugugugccuccccugugacaugccgggagcagagcggaacagcugugccagucccugggccccagcuggacugugcuggguccagggucuaugagagcugcugggaggccaccagugcaggugggcaggaccuugcuccgugauucuacccaugacgcuucucacucaaggaauuggcuuuuguuucagugcauccuauugaaaaucacuuagccaguaagcaaauguuggcccuuagucuguuaaacauuaauacaaauaagcacgugucgcugcccucccguuguacaguuguacagcuguaauaaacaccacucgcccugccucgugugcaugucucuucugguuucggcaccccagugccgugguugugcgaggggaucagaauaucugcuugagauuagcccaugucagcauuuuauugggauuguuaggcaccuccguccugaucauugcaccacgcucugucccuguacuuaaauaucucuacuuggcauuugaaacaaaacaaauaaaccuauuguacaggauggaccaaucaugaggcauuuucacucugauguuggcaguggauguguugacauugagaggauauucaugguggcaggcugcccccaguuccagguuuuggauauuuggaauaagguaggcuaugacaggccgggugcaauagcuuaugccuguaaucccagcacuuugggaggccaaggcaggcggaucacgaggucaggagaucgagaccauccuggcuaacaugaaaccccgucucuacuaaaaauacaaaaaauuagcugggcgugguggcgggcaccuguagucccagcuacucgggaggcugaggcaggagaauggcaugaacccgggaggcggagcuugcagugagccgagauggcgccaccgcacuccagccugggcgacagagugacugcaucucaaaaaaaaaaaaaaaaaaaaaaaaauaggcuauggccaugaaggguugcuuccggauucaguacauuuaggaggaaauaauguuguucaucauaugacacaguuaagucuccgagagauaauuaaaugaaaaucauucuaaaauguuugauuaaaugccuuucuagccuagccccuguagguggagugucaugauuuccacguuguugggugcuggauaaaugauuuagccacagucucacggcucuguaaagaguggcaggcuguuccuaucacugcugauccugugugugcugugcaccggauguggguggaaugaggcugcaggggcaccugcauccccaguggcuaugaugacuaaaugaggaggccccuguagagugcacagcguucacccagugacagugugauuguaauagcugggguugcugggacccuagaguauccacggugugcaugcacuugaacuucaggauacccuguuucccucugaggugcaagagcucuggcgauuccggaucccuacugugugucagguucuggaagcaucuucucucaucuccacgugaugcccaggggcucccccagcuucuggaagccaccgcuuguccagggcaccagcccagucugucgucaagccuggauuugaucuuaggucuggcugcuuccggaauaccgagacgggccucugcuguucccugagcuugcugucagcaaauguuuggugaggagaauuauuugguuuggaauuucuuguuuauguuuuaguccauuaauuuuuuuuauccugugaaauauuuuagcaacccuaaagacccaugacacacagguaucucuucaauauugugcuaauuccugccuuuuuuuggugucuucucaucucagcaucaguagugguggccauguagggacagaggcacuuagcagccgcggcaccgggaauaaugauuugacuugggggcccuguggaagaggcacauguugccgcuugaauucuaagaacacuauuuaccuuucuguuuugaaaguucacuuucacuuucaaggucucaauuuucucaaaaguucuaaagugauaaacauagucuuucuaagauuuucuuuuugcauuuguggccuucguuguggcacagcccugugucagguggggcugagcccagagggugcugaggggauggggcucauggugacagcguggugcaaucccgaggcaaguccuuggcacugugaugggcgcuaccauuggggccuggcauccccaggccucauuagccagcagugaccacaggugaugcacaggcguucucauguccugcuuuggauucccuccguuaaggaaaccgcagcacagcaccgcuccacaguagcucauagccgggcagccagggagccgcagagucuggacuugaccucugcaaccccgucucaacccuaugcugucacaccagugucugaguuaaauggcaaugcaaagcucugggucccaucuucuagcggggaccuuuguggcuugcccacagguugguggcacggaucgcugcucucugggacagcaugggacccuuucuggagcgaaguccacuucagagacccuggguugcugucugacagagcugugggccugccucauccugcggccaagguuugggugagcgcuggcugcucgugggaagguugggggcucaggcaccuuugugauugccuugucuucagucuccacuucugucagagcuuacaaagagcagcacaugggguccagaggcuucuggggagccacccgugccccugacccaaggaugcauaggccagcccuuguaggaagcagcauaagacuuaauuccuuuuuuuuuuuuuuuuuuuuuacaugaaaacaaacagaaaugggaguuuuauuuguucccugcagccccacgaacaucuuuuggagccaucuggagagcugaucacuucuuuggcggggacaaucaaauauugaauguugagggaaauuagggcaaauggcuccaggacuguccacuuuugacagaccuggugagugaguuuaaucauuaaucauuaauccacgcuuucuaaauauaucugccccgaagaaucucccgggcggaggugaaaguccugguucccaugcucccuugaccugacugaagcacagcuccggggcccgacaguggacaggcaccccauuucaucccugucuggggacacauuuaagcagugcugccucgguuuguuauuuagugacuuauuuucaaggaaaaagauccagaaaugauuagauaaaugcgaaguccuaaaaaagaaaacagcgcaguuucucuuaaaugccggccagcauugugacccugaucugcugaggccuuggaagguaguugaggcugcaggaaaugucacggggugaccuuuagaauuagagugucagcacucagcuggcugccugcaucugaaaaaggagccauuguagccagugaaauggggaaaaaccagaaaaccagcugggccagggcgcugcaggacuggccaugaccgcccugugccacugucugcagagacccugguccaggcggguauuggccuccuucugggcagagugcugguguccacgcccagggcacacauacagcuaagcacauccucugugugcgugcaugugugcauaccugcauaugugcgugugugugugugcuuugagagugguggcuuucugauugaacaagcagagugcucaaggacacggcuccaggucagccugugcaggcuccaguuuggugcuccccuuuucuugcuggauuaacuuuggaccaucccugagccucuuugugccucaguguccucauguaaaaugggcgugauagcauccucagcucucugcugcuucugugaagaugaagagucccucuguagaugcgcccauugccugguagcucuaauuacuggcucuuccuucagcacccuguaagaagcuguugcaaaugaagugugaguuggugacagagcagugaagaggcugagaaagacaaugaagggcucugggggcacuugugaugugguuuggagagacagcugcccuagaacucacacagguggcccacuucuuuggucuguuugugcaaaagucauugguagugauuuuguuggugguggugguuuuggugaggauguccauuuaagaaauaaaaugaaacugaacgggaaugguaaacgagacacaaaacagaaugaaaagccucccagaggcugagcuugaaaggaaacagcaaauuacaaagugagaaugccaagagcuuucuccuuuaacaaaccagggugcauuguucuccuuucuaaugauaagggaggaccuguuugcucugggaaguuuuagaaaggacaaaggcguaugaaggagagagucucugacuccuaguccugucacccuggguucagcugugaacauuuucauguguuuccuuccggcucccaucuugucucauucucguugguuuuuauguaaccagcuuuuggaugaauaaaaaucugcucuuuugcuuuucacccuugccaguuuacuauaaucaucuuuuuuuuuuuuuuuuuuuuuuuuuuugagacggagucuugcucugucacccaggcuggagugcaggggcgcgaucucggcucacugcaagcuccgccucccggguucacgccauucuccugccucagccucccaaguagcugggacuacaggcgcccgccacuacgccuggcuaauuuuuuguauuuuuaguagagacgggguuucaccguuauagccgggauggucucgaucuccugaccucgugauccgcccgccucggccucccaaagugcugggauuacaggcgugagccaccgcgcccggccuauaaucaucuuuucacauuauuaaaaaacccuuagcagcuguucccuagcacuaaaagucuuaucagacgggcguugucccgaagccguuggacagucucucccgggccucccacacacccacccccuuagucagagcagaggccuagcuucuguggcccucuguccuguccugagagcgcacaguccugaccuggauggugcucacaugacccugagggaggaguggcaucgccccauuuuacagaugaggaagcugagacgcugagcuccuggccugggugggcugugcugccuccgaggccuccgaggcaggcccaccugcuccccuuccuuccaacucccuguucuggagccagcucugcuugcuauccugagccucagccaugaggaauucuggggugcccacaaauacaucugugugugccccagcuguucccacuacuguugucccuucccagaaagagagagccccaccuacucagaagccuaggucuaacagagcucuucccuccuuuccaccuucaacggggacuuaguuucugaaacacaguggcgcgaccuccuugcagucucuuucucuuuuuuuucaucucugcccugggagccagguaggcuccagacucccuaucagccuauccacagcuuucagaaccuuuccaaagugcagaucugaucagucaggccucugccaaggcccaucaggagcucccaguguccacguccucacggcgaacagcuucccugaguguucugugcccagguucagaaggggcugccccugccuggugauugcgguccuugucugagucacugggaguugauagagguggaucauggggcacuucuguuuuagcguaaaugugacgccucagcgacccugcacugcacggagcauccaugagcuuucugcccaaccugugagaaugagcugcucuuccucccauaggcagcagagggugggcugggagacgaugggcggguauuuguguggcccaguucucucuagaaaugucucuguuaaauuaacaaauggcaaguuaguaaauugcaaguggaugauuuaaaguccuccuguuacuuuuagaguucuagggcccuaacaggugcuuagcaaauacuuguuaaauguuuucccacuagaaagguuuuguaaggaggaaggaggcuggcguucucgccgucagguuuuuaugccauccgcugagugcagguauuuugggagcacguaaacuguauguccaggugauacagguuagccucccaguauagggugcaguggacccaaaacaggaaaaccacguggccaggcacagcagcuagaagcgcaucagcuggagagagcccagagaugcccugugcguagccacugcaggaagccuggaggugcccugugcguuggucuggggaucccuguguccauaagcaggugggccucgggcuccugcucucagcuucugccuggcucuugaccccuuaacuaccucaugguagcaagaaugugaccuuucucccacgcuccuuugcugcucuccgcccuuguuaauguuccgccccugcugggguagauuguaucccccuuugauuguggaggguagggcccuucucaaauaggguuuucugggacccugcgguuuugcaagguguuugcaguuauucaccauaaaaaccgagggcaggggacaggcccuggucaaaccccuuugggggaagcucagagaaauucagaaggcaacugcuacauucaagcucugggaagcucccgaguagagaagccagcugggaucugucgagaagagacuuguccaguuuauuauuucagggaauuuguaucccauggacacaaauuccucacgggaugcccuuugggaaacgccuugugaggacugacccagcuggagcagguaccugggaaggaaagucauuuccaagggauucugggcuaccugggagcuggccgcuggccucacaccugaaccugaaggccagguggguggucucauuucaugucuauagggacauucagcuguuauuuuuuuaaguaaaacuguaucuaauggagcuugcuauuuauugagugauaacuucaaaucggaaauguucuuuuucccacugaaaggccugagcaagguuuugcucuuagugcuguugcauaccuguuuccacccagcuuuuagucucuuguaauuucuguuuggguauuaaaaggacggucuagguccacgugagagaccuggugaaagagagccuccuuggcuucugguaaugaacuuccaucaccccccuuccaaacaaagaaacaaaaaagaaacaguauccucucgacccagccucccgccuuagucugcuaguucaugacacuggaucaugccuuauuugaccugacccauuacuuggcucgaguucccagauaggauauauugacuugcuuuucuggaaguaaagagaugcauuuuagauguggguuggugggucuguauuuucugggcccugccaaguaugcccacagggguacugguuucucgcuggagugguggggucacugccagcccuucagauuuguuuggcucugugcuccagauggacagcggggcucagccuccacugcccaucucagugcagaagcucuccagggucuuucugucacacaucuaacaaacagccagugcuagaaagggguuuauccucgaacgcagagagcagugagugagggcaucuugucuucugccguaccaggugaaggugaccucaggguccccugggacugcuucugcaggugcucugggagccagcgcauugcagcaccugcccggcugggaguccccagccacacugacaaaacaccggaacacuuggggccccaccuaccauccuggccguccccuugccugccuugccacgaugggcaagcacagccccuggcguggccguccugagcugggcugugcgcgcagccccugguguggccgcccugagcugggcugagcugggccgagcugggccgugcgcgcagccccuggcguggcuguccugagcugggcugugugcacacaccagcauccugccccaucaguugcugugcugcagacaaaggagggauccacuggagcgggaacucuugcaaacaaagguucuauuuucaugcaaauguaaucggcggcucccggggagaaggcccagcuagcugggacucuugagcuuaggccccuuuucuagaaggcgaugguggacacuggaaaucuucuuuaugauaucuguguggacuuagaagaaccaaauaagaagcucuuacauagauauugcccuucccccgaccugccagcuagggcuguaaguagaaauuaaccuaaauuaggaagauaauugucccuguguuaauuguagguugucuuuuaaagcuguuuucauucuccaggccugagcagcaggcuggcuucgggcccuaccguggguugcugcgcauugacacccaugaaaaccaaaguuccagaggggcgaccuagcggccuuccugcuuuccagagcuccagggucucuagaugaugacguuucuuugaaaaucccacugcagcucuuccugugugcccucaggccccccgccacccaggggaccccucuuugagggcgaucaggcucucagcccaggccauguaaacaaacaccggcuauuuucagcaagccuguggugucgcagcuggccuggcaaggcccauccccgugugcacuuggcccuggccagcccgggccagcccuggcaggcgagccaugccuuggaacguucuuacccgccaugcuuuucaguuuugucauaacacccccuggcacucgacggcagcgucccagucaaaagggggcugaacaaggaccccagggacuauuguauuugggguuuucuuuguugggaacuuggauuucuguuugaaagugcuugguaaaaccugccguccucccugucccgggcacgcaccagcagguggaggcaggcgcugccuucugaacggcucuuuccuuuuguccucgguuuucuugaggccuggcucacuuauuccauuagucaugauuggauaaagcuuuuaaagaaaaauccccaccccuugccuuacugugccacgaaaaauuccugagugaaugagcgaagccacccacuugauaggagcccuggaggcugccuuucacauggacuuucaggugggccaggcccuguauagaaccccggcccuccccauagugcccuagaaacacacuaaacacgggagcguguguggugugugugugagugcgugcgcgugugugcguacgugagugcguaugugagugugugcgugcgugugugugcaugcgcgugcgaacugaaugcaugcgugcgcgcaugugugguugugugugcguacauguguguacgugacugcuugugcgcacgugccugugugugugugugugugugccuacucccauuucaggagcuugcccugccuguuugauuuuucuaaagauugacacucuaaauccccuuucucuccaaaacucucuuggggugauauggaagacuccuagggucuccaguuuuaccauauucucccuaguccacacagaagguguccuucagccacauaaaaugggccacucauuggugcuggacauccucacgccauuggugcugguguccccaugucgcuggugcuucaugucacgugccguugguucuggguguccccacagccuggccuuagggugcucuguuucuuuauaguuaaggaauuagcucagcugacagggaacuagguaagaguaaagucugauaacauggaaaauguuagugcacauuugaaaaaaaauaaauuuaguaaaaauguugauauauuuuaaguuugaaugacaagacuugagugaauuuuuccugguuaauguugugucuuuugauuaagccauuucaauggaguguacauuuauauuaacucuugaugccuuuuuuauuugccguaauuggauuagaaaauaagaucuuuucuguaguugauagaacuuuguuaauuuuauucucucauuuguuuuccuuaacucaaaaauggugaguaaagaucacgaugcuguuuuaaaauuuaggaaguggugaaccaucaagaggauaagguuagguguaauuugaaggaugauuaugaagugaggguuuaugcagauuugugcaccaguguguacaguagggaaacggaggguuauaaccaggggcauucucagaguuugggcaggaucaggcagcgggcagagcucuggugccccaucaggcggggacuuuggggggugcucucugcucuccgugggcucccacaucagaugagccagguggcugggaggggcccugcgugcccaacacaguggcugaggggcugcugcuccugcccugugaugugugcucucuccccagccuggauuuccagaagaaaagaccucugcuccuccugucuuuuuauucuuuauuggccuggugcugggcacuuaguuggaguucaguaaagguuuagugagugaagaaggaaaaaauguuacuuagaaguguuuuacucgacuuccuugaucuggaaacacacacacauauuguaacauaagaaaaguuauaugcaaaaacaguucuuaaaugacaccucgacuaagacaaaacacagaccuuuucuuuugugguuagugcuuuuucguauuucauuuaaaaacaaaacaaccaccaaaaaaccuucccuaccucaaggccauaaagauaaccuuguauauuuucucuuaaggccuuugacguuuugucuuucauacuuaagccuuugguuuuuguguggggugcaggguggggaucaguuucauuuucuuuucucauuuugagaaccauaauguuugacacuuuacacccuuucucugggauagcugugcggccagcucauccuccaaguucaaucuguuuuggacccucccugugcucagcugcuccagagccuguccuggggccagcagggcacugucuccuugacaggcgcugcagccgcacuccccugucucagcccccucccugcaauugucccagcuccuccuaagcugugacuugucuagagacaaguuccuuuaaaaagccuagccugaaacuugauuggaauugcauugacucuauggaugaauuugaaggcaggguuggcauccugacaguauauuuguguguguggcuucucuuucccuccaucaggucuucuuuacugucuuuuuucaauagauuuuuauaauuuucucuauaaaggucuuguacgugucaaguuagauuuauucuuuauucuuugguagauuguaguuguuuuguuuuucuguugcagacaauacguuuuuuuuuuaauuaaguuuucccuugcuaguuuuuggaauugcaguugauuuuuauauuuuauuuuuauauccaaucaucuuauuaaaaucuuauaauuucuaaaaauuuuuuucuguaaauucuucaggguuucuaagacaaagacuguuaaaguaacgaugcuaguuuagugucuuccucuccaauuccuguguuuauuuuccuugucuuacugugcuagcugggaauuccaguucaguuuugaguaagagcagaaauacuggacuuccuucugucguccuugacauuaaagagaagauuuuuaacauuuuucccaauuuaaguaugauguuugacauagguuauuuuagauucccuuuuucaaguuaaguucauggauagcuguguuccauuagccaaaugcuuuuacuccgucuguugugaugaucguauaguuuucuguucuaauuuucuguuaaacuucccuuaucucuuccaguggauucagcuuguuugugauaaaucuugucauuuucauacuuugcuagcgcuucaggauucuucaucucuguucuugaauuggaguggacgguaauuuuccuuuuuuaaggucuuuuuuuuuuuuaacuuacagggauaguuuauuuaagauuagaauuaauuauuccuugaaaguuuguaaaaauuaaccucagacuauuugggguucauauuuccuuggugguuugauguuuuaacuacugauuuaacaucuuuaaugguuacugauaaccugaacuuuuaauuccugucauauggauuuaaaagaaaguuuuuaggaguccuacuuaaucuacguuuucaauuuuauugucauagauuugcuucugguguuuacaucuuugcuggauuugucucuguguacccguuuucauuuacaacaugacuuagucuucuucuugauuaaucuguauuaaucguuuugagucacucuggcuuuguggauucccuuaguuguaagucagcuuucuguguuuuaaaugccugcucuuaucuuccugguacuuucuguggcuggcugcacccaguguucucucucucccgagguuggaugugcagcucccauuaguucuuagccuuccuucuguuauaagcuacacaguucccuugaaguaggcauugggugcauacaacaaguuuugacacuuagcauuuucauuuccaucccaaguuuuuaaaaggucgugucaacaguacaccuuugagaugauguaaggaggugccacuuggucucugugaccuuccucccaaaaacauacaaccccaucuggucaugacaucaaacaaauucugauuaagggacauucuagcaaacacccaaucaaguacuuuaaacugucaaggucauuaaaaacaaggcaagucugagaaaccgucgcagccgaaggagccucaggagucaggaggauaaaggaaggacagugggguccuggguggggucucagaacaggaggaccacagggaaaacaggaaauccaggcacggcugcaguucaugcugauggaucacugugggcucacgaagugugacgcaugccccauccugguauagacgugaucaaaugccucguauuguccgagagguccccaggacauucccugcccaggccaguguccaacucccugugcacuuguccuuccugcuugcaucagacacucuccugcuggggucacuuucucuuuucuuuaugaacacauaccccuuaggaguagcuuuaguagaccuguuggugauacaguccuugcguguguaugugugucugaucugaaaaugucucuauuucaccaacaugccugagugacuguuaggcaaaacuuggaggugaguuuucuuuuucuccuuucaucacguuugguguauucuucucauccuuggccggccuaccucagcauagcagccgcuccuuccuugucugucugugucucacuggcugcucgucacaucuucuuuuguccuugaugcucccaguuuugucaggguguguuuggguguggagcacccuguugucuuggcauauguuugccuuugugucugugaguuuguguguuuuaucaguccuggaaauccgcagcuagugccccuuuaaauauugcuccauagucuuccuuccuucccuuccuucccuuccuucccaguccugcagagucagcugucacaccuccucagguggcucuuauggguuuucaacucuccuuggacuuuuacuuucagaauacaaaauacaggauuugggcucuccuucauuuuuguauuuugauucccucugcucagcugauuucuucgucaggaucuucucacucaccgaaucuccuuuuuauuuuugcauggcauuuauugcuuaaaucauucauugaggguuuucuuuuuuuuaaaaugcaucaauuacacuuauuauuuuugaaagucuacuuuguucuuuuccuaaaaugauuaauuuugacaauucuguugcuuccucugauucauuacuuaaaauuuuucaaguauuuucauaaacuuuuuauuuaaucaaaacauacauggggaaaaugauagugaauaaagcauuaagagauucuuugaaaguuucagaaacaguaaucguaccauuucucaugauaugaguaacugaagaacuugacugucuuuugauguguuugcugccuuuuuucacuucuuucuguguuggcuuguguuugcuugggagcguaugucucgcuggucuuacuguuuggaaauagagggaugggagugaggaggccguucuucugauaggcaugccacgugcauuuccugggagcugcccuggacuccagccccugcauccugaacgcugcagcucugggcucaccucgguccugacccccaugcaguccuccacccgcugcccucaacucuccugucagcucgaguugcuuuuguuucccuuaauuauauauuucuggcuuguuggaggguuuccuuacugcuggugagcccagcagugugacagaagguaugucuuaugcagaaccugggguuuccacagcacaagagccuguaagaugacuugucugccacguccccagaagaggaaguuucuaguacuucaaaagcccaaccuuuggccagcuuucucucagccccuuuuacccagcuucguuuucuccccaccagcugggaugacaggucccgcggcggagacacuugcuggcagccggcacugcuccucugccuccccgcacacuagcgaagccccagccucgguggaaccccuugcuguaaggcuucuccuuccuuacccaggaagugcaggaugccagggaagagcaccggcucagcauucuggccacgcugcacagccgcgaacuugggggcccagccgcggcgcguucuccacucccagcagggaucugccccucccacccccagcauggcuguguuccuccuuagcguggcucugucccccuccaccguggcucugugcucauccagcugccuguuuucucacuguguaacgcuuucucuguaccaucugcagucuuugaacuuugaacuuugaaccuggccuuccagguugccaugaagguagacuguagauugucuagguguggggugggauguauuuuauuugauggcuugguagacugauggaugcauuuagacgacuugucucugggcuuccuucaugcuuuugaucccaucucuccuuucauugugaauauccucucauuuuccuuguaaguuuugucacuugucucuggcuuccuuucugagccucuaaauauacccuaauuacuuacauuaaaaaacacaaugaaacaaaaguuucccgauccugggucuccccagucugcagcccagacucuccucagcuuccugugggagggcugcuuguguauuuacuuuugaaccgggacacuggucuccaggacacuggagaguggaagggccucuggcucuggggcgugggcgcucaccgucuggugccuuucccccugcagauccuggaggccccaccucccacccagucccuacugugguggccugcucugugugugcugggaccaucuucaugcaggggcaucuugccuuucaccugccucugccucuguuggcaccggaugcccaggggcaccugaugggcuuucaugcaugucaccuggcguguguggaagcugcucucagggucaccccugacuacgagggccacaaugcaccugcccccauuccucagggaggcagcucugcgaugcuccccgaggccccgcggaggguccccgugauggagcaugcuguuggccaucacugggucagcacaguggcucagggcugcccccaugcguuggcucacucugcccacucccuggcccgcucccucugucccucacccagcaucccaaaccacauucaucagaagcgcagccaguccugccaucgguguccucggcuccgcuguggucggcucccuguagcugggcucaggaccggcacuguccugguggagaguccugcuucagacaccacuugggcuccucucagugugucugcggccugugaugggcagcaggugagugucauguggagagacguggaaagccacugggcguggagaccgcagcauggacuucacaguuuucagaggcccuggggugcagaagcgggaacugugacuggcugggggccccugcgccgacgcccuuggcgcuucggggccucaccgcuguagaucccgaggcagcacuacugucccccagcaauguuggaacugcucuccacuucuccccggcacuacauggccccuccagucagcccaggcauucaagccagaagcuagcaaauguauuuugcuuuucuucuccuaacucccgacagccugcccaucaucccuuugugacagugcuuccaccaaaacgccaucaaggccgccugauccucuccaauuccaugaccgcccgugguggccggcacugcuguuaccgcucgcggaaguggguugccaaacacagccguuaugaaaacgaaauuagcuaaacuuacgacuaaauaagucacauuaaaacaaaugcaaucagugcuuacaacucugccuuccugauuucuguacugcagugcucucuucucugcucgcagggcuuuuguguucuuaugguggaaacgcccagguguggucaggccccuucuagccucugccggcaguggcgucccaggccccucgcgguggccagcccgacacucgcugcagccucgucggcacugauccugcucauggggggcgguagccaugagaccaggcuuucugcuguuugaggagccccgcagcuccuguaccucaggcccgcacccugggcacuucugcugccgggagccccuuccuccggaucucagagacccagcgucaugcagaguuuuuuuagcuuaagccucaguuccucagagaggccuuuccagccagcuugacucgccagccccugcccucauaguccucugcgggccaggcccgugguguccucuuguagagcgcauucuuccacugacugucaagcucccucugcacccucagccucagcauugcuccugcaugcguggcugacugugggcgagcgaauccuggaacaucacauguuuuguuuguggagugguguguacauuguuuguagagugguguguacauuguguguagagugguauguacauuguagagugguacguacauugagagugguguguacauuguagagugguguguacauuguuugcagagugguguguacauuguguguagagugguguguucauuguagagugguauguacauggagagugguguguacauuguagagugguauguacauuguagagugguguguacauuguguguagagugguguguacauuguguguagagggguguguacauuguagagugguguguacauuguguguagagugcuguguucauuguagagugguguguacauuguuugcagagugguguguacauuguagagugguguguacauuguagagugggguguacauuguuuguagagugguguguacauugucgagugguguguacauuguuugcagagugguguguacauuguagagugguguguucauuguguguagagugguguguacauugagagugguguguacauugagagugguguguacauuguagagugguauguucauuguguguagagugguguguacauugagagugguauguacauugagagugcuguguacauuguagagugguguguacauuguagagugguguguacauuguguggagaguggugugugcauuguagagugguguguacauuguguggagagugguguguacauuguagagugguguguacauuguguguagagugguguguacauuguagagugguguguacauuguguguagagugguguguacauuguagagugguguguacauuguguagagagguguguacauuguagagugguguguacauuguguguagagugguguguucaguguagagugguguguucauuguagcaugguguguacauuguagagugguguguagagugggguguucauuguagagugguguauacauuguguguagagugguggguaaauuguagaguggcauguacaugguguguagagugguguguucauuguagagugguguguacacugcguguagagugguguguucauuguagagugguguguacauuguuugcagagugguguguacauuguguguagugugguguguucauuguagagugguauguacauugagagugguguguacauuguguguagagugguguguucauuguagagugguguguacauugagagugguguguacauuguagagugguguauauauuguguguagagugguggguaaauuguagaguggcguguacauuguguguagagugguguguucauuguagagugggguguacacugcguguagaguaguguguacauugcagagugguguguacauuguuugcagagugguguguacauuguagagugguguguacauuguguguagagugguguguacauuguguggagagugguguguacauuguagagugguguguacauuguguguagagugguguguucaguguagagugguguguucauuguagcaugguguguacauuguagagugguguguacauuguagagugguguguagagugguguguucauuguagagugguguauacauuguguguagagugguggguaaauuguagaguggcauguacaugguguguagagugguguguucauuguagagugguguguacauuguuugcagagugguguguacauuguguguagagugguguguucauuguagagugguguguucauuguguguagagugguguguacauuguguggagagugguguguacauuguguguagagugguguguucauuguagagggguguguacauugagagugguguguacauuguguguagagugguguguucauuguagagugguguguacauugagagugguguguacauuguguguagagugguguguacauugagagucguguguacauuaagagugguguguacauuguagagugguauguacauugagagugguguguacauugagagugguguguacauuguguguagagugguguguucauuguagagugguguguacauuguagagugguguguacauuguguggagagugguguguacauuguagagugguguguacauuguguggagagugguguguacauuguagagguguguacauuguguggagagugguguguacauuguagagugguguguacauuguguguagagugguguguucauuguagagugguguguacauuguggagugguguacaugguuuacacacgugugugcauggggacaagacuuggauggaguuugccauccccuguuaacagcagacaguuccaggauguugcgucgcaucuuuguugugccuggugucuuccucacgcgggagagaggcccccgagccuccuggcagaggccacaaugcaccugcucccacaauguuuuccuuacccuuuuuaaguugcuuggaggcuucagcauuugggaccagguggggaggcgugcagugcccgggucaccugccugccuucugugccccuggcucgcccaucggagggaccagucggcacggcugagucaugcugacucaauguuucauacaguggagcuggcuucccagaaacagcucuguauuccucuaauguucuucgugcauguaacgugaaguggaguuuggggcaaaaugugcuuucagggcuuguggccuucuuuccuucuuuaacacagcgucucgggaguacgaggcacucgcacaucagcuuugcccccacucuuggguugcuggcauuguuaaaaacgagagaauauaagguagaaauuuccagaugccuuuuuuuuucuuugaccaacauguuuuucaggguugaugccacaagaaccagcacaugucucaaguggcauaaggagauuucaucagcauggccaguucuuagcugacgagcuggaaucccagggugcuaggaaacacaggcacuuugggguuggggggugcuguccucuuccgcaggaguggaagggaugagaugcucccgagaggugggauccgcacuuucuguggaccacaguuauugauccuagaauucggggagggaaacgucagacaggccacucaugguuuguggccacuuuggaaacauuagggaaggguccuggggaaggcguggagaagcccggugagagcuggccauucauccugagggcgcgguuuccaccuggacucucguggugaggguaggggacacuccucacucagucgcccccaucccaugcccccugcgggccuggccugguguggcugguucuuguccccagguccccugcucucaggagaccuucauuugugggaggcacugugggggcugugugagauuucuggcuucugcugcugcuggagcugucccagcucacuccacccugggcugcucccaccccugcccuucugcuccucaccccgacaguguccucucuagggagagguuuucugcugggacguuggagagaggacagacuucagaggcagagagacgggccugaaccccagcuuuucugccuagauauugggagcauuacuuaguuucuuugaaccuugauuuucucgucuguaagauggauguaguagaacugccucaugaguuuauuauaaggcugaggggaucaagugugaauuuagugccuggugccaguuuguucauugaucccucuaaugagucauuuguucagucacuguuuucagcucagagacgugagcaucuccuggucaggcacagaccucaggcuuugccuucuuagcagcccagagucuccugggagaaacagcaaaucaggcacuuugcuuuugcaagcaaaagccauuaugaaauuugaguuugcugaugcccuggaaucaggaggggagcccuccggccugugggcccugcugccccauuaccuccaaccacuuuccccgccuggggcaggguguggccccacaccagccccacuuuucuuucuuucugguuuuucaguccugccggcagcauagucuuuuuauuuguuuguuuggaagagauagggucugacacuauugcccaggcuggccucgagcucuugggcuccaggcgcccuccugaguagcugggacuacauguccacacuacugcaccuggcuucaggaguguggucuucccggccccggccccaaugguccucauguuuaaagaggaagagagccacacugaugggcaggaaagccguuuccugaaggaagguccagagccaccuuagaaggugaauuaaagcaaaccacagccuucggccacuuauuuugacugacaugugguacaaaacauguuuuuuguuuuuauugagacagucucccucugucacccaggcuggaguacaguggcaugaucucgccucacugcagccucugucuccugggcucaggcgauccugcugcggccuucugaguagcugggacuacagcugcucaucaccaugcccggcuaauuuuugucuuuuaguagagauggugucuugccauguuggccaagcuggucucgaacuccugggcucaagcaaucugccugccucagccucccagaaugcugagauuauaggcgugagcccuuguccuggcccaaaauauguuuuuacauuuuaaaaauuauccuuuucuuuaccaauuagauugucaauuuuuuuuuuaaacaaaugcuuucuguggccuuguagaaaauacugguuggugggcaccucuucuuggaagacugccacuggaggguccucagggugaagucacccccacuuggcuugaugcuuuguuaccagucuguuuuuuuuuuuuucuuuuuuucucuaauggugggauaauuugaaaacucaacccuuuccagccaauggugagcaccuguucauuucucaagacacccugagccuccagguggccuccaccagcggggagccgagugugcggcuggaguguguagcuggagcguguggcuggaguguguugcuaggguguguggcugggguguguggcugggguguguggcuggccugcucaggagagacggggagccgaguguguggcuggcguguguggcuggaguguguggcuggggugugugacuggggcguaugacuggggccugcugagcggagaguauucucaguuauuuguuuccggcagaucugagaaccugaguaguaggaacugcuucaggccugggucccggcccggguggaguugcuguggaacgcagguguuuucugugugaguuugcuaagcgcuguugggcguucuggaagugucuuuccaaagcagacauuaucaagccaggguccuuguggcuacaccaggcugggcggcuguguggcccuuuuaggcagcuagaacuggccucacugguuccggggaugcgugcggugagagugggcacauguccggugagcuuguggaagugcccugagacccugguuccugcuccggaguacagaacgugugaugaucagcgaugggccaccauggcgugacuggcaccaacagcgcagagaccauaaacauguuccuuccugcugaccggcccguacucccagggugguggcccagggccuguccaccugggucugcacuucugggcuucccugucguuuccccagcuucccuucugguaaugagcuuggugcuccuccucuccccaccucucacccuugugccuuuggaaaggccuuacuggacagaccgggaacaagagggcaucugcuauuucuggggagcuucagaagcugagcucaccgggcucggcucugggagcaugguuguccuccaaauacauguuuucuucuuuuacugauccuucugcuaaccucgggaccccacuauaccaggugcuggguacaccaaggugagcaggaccccgucccugcuuucaagaaugguuaagagaauugcaaaauauuagugccgugcagagucccaggugccaccagcaggggcaaaugcaggcccaggagggcgcggcaguggaaaggggcugcacagagcaggggaggcuccacagcugacucucgaaugguguuccccaagggcuagagggguguguguuagggggucaggguugggggauuuuguggcacggugacagacaguguugcaagaagaaugaacucauacacagaccugaucacuuggugguggcuucacccuggagccuguugucauucccccuggccucccucugccgucuugccucgccuggcucugcugcucugcuggccucugcagccggccuuugucugggcagcgagcaguguccaggcagcagacagcggguaguguccaggcagcaggcaguguuccggcagcaggcaguguccaggcagcgggcaguguccaggcagcaggcaauguccaggaaguggccugugucuggagagcagauggugucugcgguguaucggugucucaucuccagcuagagggacuuagguccccaugacuggugaagccguuucaggaacagcacugaugaccaauggagcaaucucuggccuaguugggagguccgucagggcugcuuugaagguggcacaggccauacaugcagaacccgggugccugucccacuccugcccccguccuguggccugggguccagacacagggagcuggaggcagaggggcugcugagucaguuagacaggccucucuguuggcgggaccacgacuugacgccuucuccccucaacacuuccaaggcauacuugccaaggguccgcacccgcucucugguucggggccucucccugccucuguaagacuggugcagcugcucuaacuugucugccaucuucagguucucugcguugccaccagagugaacuugcuggcgugggggucggugucugccgugagucaggucccugcgcaguccucccuggcaguggaggaacacugguucuuugccuggccccagggcagucccagccccagaggucccuggccugcgcuggcucagagcaugcuggccaucugcuugggcggagccuguccaccaccgccuggugccuucccgcccauccuuuuaaggccucuccuccucugggaagcuuucccaaaugaggcaggcgacagaggagcuucaucuucuccgccccauaccuucaggguggcacguggcaccaugaggagcuaucuggggcuccccugggugucuuccccucccugugagcuccuggaaggcagggguccuggcguucuaucuugccuucuugcaucaugggugugccuggcagccugagggguggggagugggaccaggcacugcagaggcccccagccucacucugaggcuggaccuggagucgcaggguggcaguaccgaacccaggugugccacccgcacacacacagaccgugcaggcaggggcgguggcugcuguucuuccaugugugucccccucguggcggcccugcauugcugccuguuggugggguuagggucugcugucacuccgugggccaugacaucgccacugccaucacauuugcagagcuccgugugcauacaugauagcgucccgaccaacagcgccuccgguacacaaagccguuucuuggugaaucagcaagucugggcuccugccguuucugggugagcccugugcuuggacaguuaugaaucauuugcuugccucuugauuugcgucaaucaaaccacaugugaagaaagcggcagugagcagcgcuuugccggcagccuggcuccagcguggggcggcuugccagggacagccucaggaggccagccugcgcggccugguggucugggcugagggccugggguggcuucggcccacggggcuuccggccggcccccacccuuucuucccccgauccccgucagccacgggagaugggugagaugguaaugauagcguagcgugugcuggcuuccuacguguaauccuguggccaggggcacauauucgcagcucugggaauguuuaugguuggaagccccuccgcugaucuguucuucccucucacacaaaaucacuccaggacagggcucuuugcaaagauuacuuguaagaaagccuuaauuaaaaagagaugucaccaugccccuccccuccuucaaaccaagaggagcagcagaagggggaguggcccagggucagaaggacagcugggaggagcgugggggccaggccaggccuagggaagggccauccaccugggacuucugagccuuuucuuuucuggagcagcuuuggggaugaggcuugcccuccguugagucacggugacagcucugcacugugcugggcugagagagccccgccguggagggccaucugggaaaguaggguucccagggccccccagcuucacuggcuugcuuugcuuugguuauuuucgagguaggcaaaugagguucucguuuuuaccgugaagguuacuuguauuguuguugaauuagcuguugaaugguagcuguuguccuaguuuccuaguuagucauggcuguggcucguggcuuagagaccagcggcgcccuggcucauucccaucucuugcgggggcccauacaugauucguccuuaaaacugggaggggacgccggggugcacugggcuuguccugucguuugguaaugaucacaaguguguuuauaugugacucuuccagggaaucguggaaacuuaguggccaugagguccccuggcucugaaauuucucucugaaugagcugggaggguguaaccuuccacaauugugagcccagguuuauguuugcaacaaauaauaaacagcaaaacagaacagagugauacccccguccaaaucuagcaccuucacuggcuaucuuucauuuuuuauuacggaaaauuucaaacauuuacgaaagugaaaagacaauaaggagcggacuaggcugcuguccccaucuucagcgauggcugagcagggccaggccugccucacuguauuguuccaaagcaguucuaccgucaugcaggugucuuccgaacaugcgacccuaauaccauugucacagcuuuaacacaucaacacgugaauccaucaaauaaucagucauuuaaaauccccauugucucaaaaaguuuucagucucuuuucuuuuuguauguggcuguuguucaaauaaguguuaaguaagguucguggguucuaaugggccacugucacuugugauggacacagccguuuccucccucuugcucuccagucuauuuguuggggagcuuggcuuguccuguuguguggccacggcagagcucucacugccuguguccauguggcguguugagcaaguuccuccucccucucuuucuggugaccuggcgguugcagcuggagccugcgccggaccggggcuaguuggcaagacuguggcaugggggcgugggcguucugcugggugaugagcggguccugaagguggcugucuagcuucauuccuuccuuccugggggcugcagagugauaauccaagacacucacuccugaaucagguaaaagacuucugcagagaggaagugcccucaucagcucuucggcucacacaggaaaggcuuucuuuauuuaccaucuuucagaggaaugagcucguugcuuuacaucaucugaaggucacuggugaguuuugucguuuguuuuuguguguaauugugagcuuguggguuuaagugugcuccaugccuuuuaggccuuugcugcuguuacucucauugauguucaccuuguccuccuugauccacgaggcccuguggaguuggcccuugagucuuuuggacauaacccuugcagucuuugauugcuuccuugcucugcugugacaagacaccuugucaccuuguauaauuccuguccccggaauuuaucugauaaucccucaucucaguauccuuaaucacauguguaaaguccguuugagcaucuaaggugguguauuucuagguuccgggaaugaggauguagacccugugugggguaucauuuauccuuccugugcucagcccucagaccugcaggucuggucucugacucugccgcucaucgugggcaacucucuggccaggucgcuagggagggaagaagccguugcaggaauauagggacagcuugggacgagagggccaggguagaugccugucuaagggucuagggagguacagaggugagccccucugcugcucuuguccccuacaguugccugcccugcucugccagagucagagggcaucgccuggggcacccacagcagcagcgcaggggugcauugggggugagugcagaugguuggcugcgagagguuccgaugcuggguuugacagucaggguggucuuguaucuuuuugauccuggccauccuuguggauagaaagugacaucuuauugugauuuugauuuacauuuuccugagguuaacaacuagugaugacagucaucuuuucacaugcucaugggccauugugcaucuuuggagaaaugucuguuuaaauccuuugcucauuuuaaaauuagauuauuugccuuuuuauuguuugaguugucuggcccuuuauauucuagauacagcuccuugaucagauauaugguuugcaaauauucuuuuccauucuguagguugccuuucuggauggugucuuuugaagcucagaagauuuuuauuuugcugguauccuguuuggcuauuuuuuucuuuugcugccuguguuuugguguccuaucagagacauuuauugaacucggauuggauuggaacgaugaugugggcccccucuuggggcuccuggcuuuuggcuucuguugaauguaaaugcuaaaaggcuucucugggcuguuaggagagaggcagauuuuauugcccagccagcuucugcagugucuaauggcuagauucgcuuuucccacaguuguuuuuaauugaauguccgugggaaaguggccaaguaaauggaagguuucacagagagagcuggguuucuuuguugauuuuuuuugaaacugugcuuuuuugucauuacugugcagaguuuguuggaaucuggcgccagguugugaugucugcugagacuuguauuggucuuguugaguauggcagcauuguaguggcuuuucccccacucgaaacacaaguuccaggaaauuucgaagcucuguguaacuuccagguggacaucuucccuguugagagguuaauuaugggacguggagccaucagggacucugaaugugggacacacauccugaggagagaggccacgucuuggaaggaugaagggcaaccugucuucgggguccagaacuggacucucacucagcagcugugccggccucagccacccaggcuuugugucuguaacauggggaugacgacagugucuacccgauaauccggagauccacaucgggggauggagagcucuagggaggaugccggcagaaucggcucucauaguccuaaacacaaucaccaagaugaacuguugcuuucaugugaauugaguauuccucauuauuccaaacacaacagcacugaaaacuuagaauguguaaacaaaaaacacacuaagccgaccgagcacaguggcucacaccuguaaucccaacacuuugggagaccaaggugaauggauugcuugagcucagaaguucaagaccagucugggcaacauggcaaaaccccuucucaaaccccuacucuacuaaaaguauaaaaauuagccaggcaugguggcaugcaccuaugauuccagcuacucaggagugugagaugggaggaucaccugagcccaggaagucgaggcugcagugagccgugaucacaccacugcauuccagccugggcaaccggagcaagacccugucucaaaaaacaccaaaaaacauacuaagccccaaccuuuuuacugguuuuaaauucugaaucuugcauuuccuucagcuccaaauuaaugagaaaagugaagguugugugucuaucagauaaacccgguccuuugaguuguaaguauuuucagagauuuguaacuaauuaggauauauuuaauauuaaugcacauauuugccauguuucugaaugaggaacggacacuguauuuuccuugccaaaagcuagccuaccaguguauaauuuacucuguaucugggguuuuuuggaggucugugcauauuuugguuugaacuaagagccacuuaagucugcacgugcugcucacaguaacgcucacaucugucguauccgucaacaggucgucuuacuccuuuccauuaaguagaugguuuaaugauuucagaaaugucagauaguucccuguuagugcauguaagaaauuauacaaaugcugaaugcaaguagcacaucuuuguuuggaacaagggagugguccaguuccgaggagacuugaaagcauuauaauauuccugauuagguuauaaaugucuagguuuuuuagcccccggacuauuucagcuuauucuggauucucauuuuuaaaggccucuuuuucucuaucgccucauucuaucucauuuuaaagucuuccuuuucucuaucgccugcuucacugugucucaccaugaaauuuccuguuuuucugcauguugccagcucugcucuuucuccuuuccaguugaauacaucggggggcagcuaaugagcaucccauugaggccacagcgaguucuuucggcuugcucagaauuucccucuccaaggugucaccaacggcgcuuuucuguuuccgucauccauucauuuuuacacauacggauguggacaggccacaggguccacacagcugcuccagugcagcccgagacagagcugauggggcagccuccaggacucuggguccuuaccugcugccgugggagucaucaggcuccugaaaggcuggugacauccugagcucauccagagaguaggcucugggaccucaagggccaccugcgugcaguugacucucucucagaguugccuguuguguuuuguguaaggacaucauuuuggggggcggggagauaagucagguccacucgcugcucuugucuaugaagcccugacacaugauaaugugcaauuaacaaagugcugggaugagauccgagccagccuugggucguaagaaccaaacccaucauugcuggccuuguaauuauacuguuguguguggacaguuuguacuuuuucccuuuucgagcaacuuggaagauuugcugugucuuuaaguugaaaugacuugagucaucuucccuuagaaaccuucuguguagaaacucagccucugaacacacggugacccggcagucccggccacgaggugaccaguacuugauauuugucuuuuuaggaaagcgcacgggcucgcaguggccagcccacuggggcaugaauaaggacccuccuccuccaggaggccagcagggccucaugcuucucauucaguggggaaaacugggguucugaagaauggagcuugcagagaauuccugcagacuggaauggaguuuggcacucagcuaaaagguguugaggugacaccugcaggaguuaccuggccagugccaggaagucagaccccacccuuccuugggcacacagacaauguacaauauuugcuaggugcaugcaugcaugcacguguauguagaugugugaauguaugugggugugugaaugugugugggugugugaaugugugugggugugugaaugugugugggugugugaaugugugggugugugaauguguguagaugugugaauguaugugggugugugaaugugugugggugugugaaugugugugggugugugaaugugggugugugaauuguguagauguaugaauguauguagauaaugaauguauguacgucugaaugaugggggugcuuggauggcuuccaucugcugguaaauuaggucuuagugugcacaguaagagggucuucuaauugaacguuuccaaugguagcuccuagaaucaagccgcuggaagcucagcuauggaagugauggguccuugagauuucuugccagugcgauuagucuuucuuuaaaagccagcucaauuccauucuucuaugucgccauuucuuuguuucuuuccauuuuguggggguagggagccuggcaccauccaccuggugcccuaagguccccugguaggcuucugcacaaaagcuugccugucugacccuguucuugguugacaacugaugaaaaggcuaagagaaguucaguucucacaccuggaucucugcgguuuccuggggaguccuguucccuuuucucuguccagcccuccugaggggcugugucccugacaggaaauggguggucaccugggauuacccugucuuccuuggccugcaggccaucuagucacagggcagguucuucugucccuccagguggucaugagcaccaaaccgauuguacuguggaaaugcuugguaaaagccagcagggaagaaguauguugauuccuuuuugugguaaguuagaacucagagagaaauuuguuuacuuucaugaugaauaucuuuauccuugacauguggcuuauuuacucagcgucuuuucaaaaucacacuuuauccugagaaaaaucuagacccaagucuaaucucugaucucuugggucacucuucacaguguggaaugggcccugcuccuuccaggacaggccugccuagggcugucaguggggccuggcccgccagggccaccguccuggccaccagcccgagucugggaguggccagcgcuguuggcauucccaguuugcugaggaccaaguucacuuccuccagcacccauuccaacuuccuaaggagaaagcucagcagcgagaaugggaugaauugagcaaauaaaaaaaauuacaaccaagugaauuuaaaccccucucaaaacauuuucugauuauucugguaacucuuugaccuaauuuggacaacaguuagagaaauucagauuuaugccuggaauucaaguauagccuguagcuugguguguguguuuuaagugcuugauauuugucuuuuuaggaaagugcacucauucuuagacgagacgguauuugaaagacuguuuggaaugugcagaauuaccauguaagaacucagaagcugggaacaauggcaagcggcuggcuuuggguggaaacuaaccagcuggcuggagcagucucuguccuugacggagggagaagccugcgaggggaugcagaggaccugccccagggcagagcucuucgugaggggccucgucccugugauuugaguccccauugccguguagaagggcgcagggccccuggcacaggccucuucuguggagcccuccaggucugccuuggcucagggcuccgccuccuggugaggaagugucacggagcugugguuuaacguuuccgguuuguggcuaguuucuuguguguacaacucucuauagcugugccaagcccuuccgggaacaguuguagauuuuugcugccuucagcacguccucaaggguuuggggaguccuugcuguccaccguuguaucuggggacccugggcaacugcugaguggugccaugggcccuggugcuccgcugggaacuguuggccacuggugcucuucagacuccaucggcuuccucgggagggucuguaucagaggccgucugucuggugugauauggacgggugugguaugcguguccauggucacggauuaguguuuacgaaguguaauuauaggugcaguggaugggaacuuucugugggccgggcacugcccuagauccuggacggugguaggucccaccaucucccaggucauagauggcaacaucagaggucaaguaauguguccagugccacaggagugcuagguggucaagcggcaccccccaugcaguguacagcugccgcggagaccaugugggcacuuacucucccucugcacagcugugagcaccagcugugcacagccacugugcccaggaugcccagggugguguccugagagauuaccaguagcccugccuuguccccuguggcuuaggggaccuccagugguuagggcugggggagacgaaacuaaugaccugguguccccuggggaaggccacagcaccugggugugggguggagcaggagucccaggagcuauagaggccaagcgggugccuuguagacaccgucagugcuggcuaagugaaggaagagccucuuccacuuuacaagcucacaguccccuuugggcuaccuggaaauggugacauugggagggucccaagaggcagauguagaauguggagacagagggagagagggugggaugugagcugugagcugcagcgcuugccuuuggguguguggaagccaugaugauuucuuggccaguggcuuauaauuucccagagggagcaaaggugugugucaugaaaucguggacucuugccucgggacagcugguauguaauuguuagccucauuuguccucagcagccccggaggcaccucuggaauagguggggguagcauggccagcacagggccaggccccccugggcaggugggcugugaaucugugcugcaggcaggauggcugugcggaggucauggagggcugggcaggccaagccaguggcuugcagugcagggcauugaggacagucagaaucucagugugggcuccugggaccagggucccggccuauggagaaucaggggcacguuucccaccuagcggcucugcuacaggaaguaggccugccuggagugugggcucccugccucgggcacugugcugggaugccggcgaggggcuauggcaguguggugggcuccggcuggccuggccccuuggccuuaugguucaccucuggucucagcagccuucacuggcuggcagccccucuggaugccacagcagccucugcgcaggcuuaggggcucugugucccccucccuguccuuagagggggagcugggcaaggcaggccacgcuccugccauacgguugguguaugaggauggacaggcagcucgcuuuggccucaccucaucccaccaggcccaggaggucaguacuccagccugaucggggcacugcccacucagcaccagccagcccauggcaugguucccgcauucccauucacccccaggaccuagcagaaugcuugagcucaugcauaaccuuaaaaugguguuuggaaguuccaagaagccuggugucucugacacuguuguuugggauccugcagagcuggcugaccuugagccugcacccagccugguggcugugucuuuguggggugccuguguuggugccggcgcuguggccuggugagcauuggcaucaccucguguuccugcucuguccuuugugccucaaggcucugcggagcaggagagucaggggcaaagggagggccuggguucccgccccaccgcaccuccccccaggagggcucuucaccugucccacaugcagugcccagaaagcacagagggguggugcugggaggccacuaacagugggguuuuucuuugauuuuggaagugcuguuucugagugggaggccuuggcuucucuggaggagugauuuauuuugaaaccacacccauugcugggcuaagauugacuuccugauacgaaagucuguggcgguguuugcugagaagucacacguuugaaggggaggguuuuaugacuucaucugugaugccucuggaguacugucagaggcugugauuuuuccugagugugcuggacccauccugggguuggcacacaugugggagcccugcuugucacuuggggguuaagggugaccuggagcagcaaguccuccccuggggcggguucacagugguucaagggaggugggagagccccagggcuggccccuggcucuuuggcccccaucccccacucuccagccccugucaggcucugcaccccuguccacuucagcccgcauugggccugcccugcucugcagggggaggggcaggagaguccaucuucaggguucucugaagcuggacaguucugagaggcagcuuccagcucauggaaaaaagaaagcccauugccacaccuccagcagcauaugggggccuucagguccccggaacaccgaguaggaaggaaggggcaggacccuccgacggggcagcagugggccagguguccccccugcacaguguuuacacccugggaccugccgcaaggcauggcuuucagaagagccuccccccaagaaaugcugcagacaggacggggcuucuagagaccuuggcuucuacccaggaaggcugaucuauucuucgacuguugcaucagcuuccucaaccucugcagguucaggcugcgagcccuagggagcaucacucaaagcacccuguuggccacuuaggaucaggagggccucggcucacccaagccaucucccucuggucgcaugugguuggcuguccugucagagccgugggcagccacacuucuuuuuccaagauaaaccgcugcaucugcccagcgaccuucauguguagucuuacauuagcacauucuuaacagacauuuagaaaccaaccaaacaaaauccaguuuccugcccccacggucuuucgcucuuuugccacacucacaaaugugagcugcauuuggaaaugccugugcuuccauuugcaaaccgaagcugaauggaaccuggcaggcgcaucugcuccuccgcaguggaggcuggggcggcccgagcagaaagaggugaagccugugccugcugggaguccccgagcggcaggaacuccggugucugggauggccuuuggggugugaccuuaggcugaggccagagcccgucuccccacgagcuccccgccuggccugggaaagucagcccccuccuuuccagggcugugucuucccccuuuuguuuucagucauugagcccccgcucgaggauggcccccaccccaaagguccugugugcccugaguaagccacuggcucucagaggugcccacguacccuuccuuucagacugaggggagcaguggccagacagggcucugccuucacggagcuuccccucugcagagaaggggcagaguggcgucacugggcagccagcuuagaucgagcagcaggaggcgaggcucagccgagucggacagcuggggccaggcaggcggcuugcucugcaugcccaggacagcagcacugggcucuguccccccgucggugcccccgugucucucaggaaccccuucagaugugguuaacaccuccaacuuggaggccuuuccugacuguccugacccuguuuauucuucucucccguguccuucuagaacauacucucaggcaaggcaugaagaugcugcuguguguagagccucacuucccugcccuugccccuguccuugacagcagcuccgugcgggccuagcaauacccguugggcaucagugccaagagcugcccugccuggggguuccuggugguguagacguggacgccuccacaccugugcagugaggcccauggggcagcuccgagggggaagcuguucaccugcugccuguugugaagagaaggggugaucuccaggcaggggacugggcgggcuucggggcggcugaugugcaaggggcugggaugggcggggguccucagggugggcuucgagacagcugauguguagggggcugggcugggcggggguccucagggcgggcuucgggauggcugaugugcaguugcacaguggccccgugcccuuggagccauucugaccucuggggcagaggcuagggcaccgacacagcagacaugaaggaggguaguguuuuucauauuuucuagcaguaauugcagugguguguaugugccugugucaccgccgcagcagguucugggaucuucucuuggucccgaguguuuggggcaguguccacauccuucauucucucgugucuucaucggcauaaugggcccuuccuggggcuuggcuucccgggggcuucacgcguagaucuuucgugaagcacagaagcuuccaggcugucucaguggugccgugaccuuccagugagggauccacuccuuagagccucacgcucuccugcucaccagggcaccagcuuuuccaagagcugcuggguggaucccagaacagucccuccguguccuuagugccugagcacaggccuccucgucuguguucuugggcugcgagcguggcccacagaaugcccugugcccguugcgccuucagccgugugcacccuugggggugucccgcuuguggugccugcccaccccugcacuagcccaggucucguuggucccacacucuugcccagaaaauggagccaggcugaggauggggacauuuggccaagagugucagagccaggcucuggcccccucagaguagagaucagucuugccugcuaauggcauuaccucaucucggaccugggcaaacaaggcaagggugauuugagaagauccucgucuguuucuaauuaaauuucuaucucugcuuucacaaaagcuucucuuuuaucucuuccuccuaauuauuuuuaaaaucucaaggaaaauacaucccuuccacuuacgauuccgcagagaaccaaauugcuacucuguuucuaaaguguguuauuguggucucugauacuaagccaagguuucuguaaucccacuaaaauuuuaucucacaucacagaaauuuaggauucccccaaggagacaccacaggaggaaauacuagcuuauaaaaagccacguggauaccuugucgugggucucaguggaccguggcuccuucuugggccuuggggugagcguggcccggcgucacugcaggcggcgcuggcgugguugggagggucccucagggcuuucccuuggagcgacaagggggcagaugccacccugcuggauucccaccuagggccucugugucuggggccuucagggaagaggccaaccuguaggggccgggggcucacgaaggcagugcuuucauggcgccaggcaacccgaggacccuccgacauaggcuuuucgagacucucaguugcccugggcaggcuggcagcagaaccuccuggcugggccggguggggggugucccugccgggcuccugccacuguuaaggagcgagggaagguucuggggugguuugaguuggaaaccucgccuucuaagaguggaccagcccacugcugccccuuccuccccgugggccugggccaccaucucaccaggcccucuuaggacgcugacuucugcuuuucuucagcagggagaccccuuguccagccuugucucuagcccguggguugugggggaaccagaaggcuccuccucuguggaccugaggcucccagccugggaagucuacaugcuggcuggcaggcuaguaagaugcccauuuuuggcaacuguugaagcguguuuugucauguccuaggaugccccauggaugcaccuaacaggguccccagggccugcccaccucccagagcccaggccugccacgguuugcuuccgucugugcagagccuggcuggcugugaccacgcuccaucucagcacacggcagcugcugggguggaguucuggacuuggugccuucuguacgcccuccuuagucucaucucuagcguguuaccugggcucguguacauucuguugaauuuaguuccuaaagugcauuuaggccucggcaguaccugucucaccugcacguuucuugauuuucuguuugccuuuacagaaugggccagcugggcucagucuuaucuuuaacaccaccccggccaccccaucucaggaggcugaggcuuaagcccagccugggcaauguagcaagauccugucucuacagaaacaaacaaaacauccagaacguccaccugaaaccuuagugccgcaucgaguuuaggugcauguaccuguggggagcggagacugccgcuccagccgcucccaggcuggcuuccgucuccaccccagugcccuggccuugucaucuuccacguaggaagcuggguuuucuugguggccgcugacaggauaggcuuccgugccuccuucucagguucaaggugugaguccccaucccagcaaagacagagccauuugcacaaugcaaugugagccgccuuccugcccuccaugggaaagagaggcagcgcucgggccccagguggaaggcgugcccagggggaggccaggcaugagaacacugcagcagggggaccucacauccccucacauccaaccuugcaggcugcaggagcagagccggaggccacaggccacaggccacacagcagggccacagagaagcgguacucccaggagugaguggccugauaggcauuugauagagacacuugaggcuacaguguugggauugcuggcgggaagagagaugaggccagcaggccgguuuggggcauucuguaccacgaugaaggauaauagaaacuuagcauguuuauuggacaauaaacagacccugcuccagacccguuauuuguaccacuuaguuaauacucguaucagcacccugagauccaagcguuguccuucccauuuuaugaugaagaaacugggacauauaaaacuugccuaagaucugacagcuagugagugagggagucugguuugaauugcacgucuggguucagaguccacggucuuacccaccaugcgaugcuuuugcaugagcgugugugugugcgugugugcaagagagucgucacagggcgccugcagagucuggacacgcgguccgcagaggggcuuccguuggaugggacaccccaaccucugucuuucagcugaacuucaccaaaaggaauugcucagcuuauagagguggcggccuggcaugcaguuaggaaaucaaucacagcguuggggguggaaggcaagggagcggugucaucuggcuccuugagucuucagccuuccuuccugggcucuggcaggagcuucacccuuagauccucuucuccuuagcuggcugucagaugcccucugugugacaaaggacguuucacugugucacuucucucuuccucuccugccccacaaggccauauuuccuacuugcaggcugugaucuagggacuggggcucacgccauaccacaggcucugggcugagaagaaacuccuuuuuucuucaacauugucagcagagaucuuuccucuucauuagucuuuuuaaacaaccagguuuugguuuugucacuucggucuauaucucuuuucuguuucaguaaguucuguucuuauuacuuccuuucacuuuuaugaguuuaauuuccguuuguuucuaagccuuugaaguggaacccgaauaugaggauuuuaaggccauuuuccucuaugcauggcuuucgcugcuucccagaaaauuuaaugugugcuauuuuuauuacccaauuucccuuuggcauauagguaauuuauaaguguuuuuuugguuguuguuguuuuguuguuguuuuguuuuugagacggggucuugcucugucacucaggcuggagugcaguggugugaucucagcucacugcagccuccaccuuccaggcucaagcagucccccaccucagccaccugaguagcugugaccacaguucuaccacgccuggcuaauuuuguguauucuugguagagacaggguuucaccuuguugcccaggcuggucuugaacuccugagcucaauugaucagcccaccucagccucccaaaguguuggggauuacaggcgugagccacugcaucuggccaaguguauuuuaagguuuuccuaguucuuuuuuguuguugauuuuuacuuuaguugcauuauauucaaaaaaauggggugauacgcugucaaagucaggaaucaguaccuguguuaaagucuacuuugucugacguuaauauugcuaugccagccuuccuucggcuguuauuugcaagguacauauuuuuccaacuguuuucuuuccauacuuugcauagcuguauguuuuagauauuuccuugugaaaagcauguguuugggaauuuuuuuaguuuauguucuucuaugcagucuggcagucuucacuucggaguagagccuuuaguuuguuuacauugaacaugauugccuagaauguuugugugcccaucugccauuucacugugcccuuacuccuuuguccugucucuucuguggcauacuuuauuauuugucaauauucauuuccauauauccacacguguaaacccuuuucauuguucuuuauauggguguucauuuccagucuucccucugagaucaggugugagaaugucuucugguguaagaugaucagucuuuguuggaaaaugacucuuugaagaaugcccgugcugguuagaggauucuaguuugacaguuaccaucuucuaguacuucuaagcaguccuucugcacugugaaagauauuacuguuuucugguuuacguguuuccguugagaaaucaccagucauccuaacugcuguucuuuguagguaauccccccucccccuccacggccguuuuuguuuucagcaauuuucccuggugucuuuuagccauuugggguaguucuuggccaggguccuuucagacgugcuuuugacccguucagugucuccuuuccugugucugccugcacauucugucucggugccuucuguuucuccaacuuccugcccuugacuuuugagaucauucuggaaauguccuucuggcccaccuuccuacucacaaauucacucuagcugugucuaaucuguuaaaugauggaguccuuaauuucacuuuuugcauuuuucaguucuagaauucucuuuucaaguuuccaacucaucuucuuaaacauagaaaucaucauuucuuuaaaaucuauuucuaaaacugccgcaggaucuuaaauugcauucaacucuuuuaucguuacuagaacacuauugauauuccuacuuugaaacuauuguuuauggguccugguauugcagcaaauaaguaacaaagucucuuucucagaauucuauuaucuggagcaccugagggucuuuuucuauuguuuguuguucuguuggguuuuuuuuguuggguugucuuuuccucugccugauaugugaauguguaaguguguguguugaaaauauuauuugcaaaaucuguugagacaguuugaggccuaggaugaugacaucauccucauuaguagacugaaguuuguuucugccuggugcuugggggcccuagcaaugagucaucacuucaguucuauuucaaggauuacagagucauuagaagcagagcugcaauuguugaggguccauuuauuguggagucucuuuuuuucccuagggguugcuuccagaucccaacccacauuucccuccuucucuccugccugucagucccuggaguucuccuccuaacccuaauaucugcaagaggcggucaaaaguacuaaagauucuuagauggcuggggguggggcucugcaaauaccaacaggggaaaaucagccccaaaugccaucuucaccccccagccuuugucugguccuguaauucuucacuguuuuuuuuuaacuuaguagugucaucaagaagauguguuuauauuuguccagcuuuugugauuuuucucucugcuaaggcuggaccacauggccuauuucaccuuuuuucuuuuuuuuuuugcacuuguguuuuuugaagcagucauguuuauuaaauaucgauauucagaguuuuuuuggucaaaaacaaaauucuucuauaagaugauuagcaguauauauggaaaaucaggcaauuugaaaugaaauuaauaacuaagauaauuauuaaaggguuuauaggaaugcuuauucuguuauuuacccagaguuauuugucuacauggauauuuuagaguuuuaacagcaaguuuaugugagaauagguguuucuguugagggacaucugaaaauacccagguucuucugucuucuuaggcuaucccacguggauucuuggucuaguggauccgauuagcaguauaccugcauucuaacaaauggaaugguaaaauuaguauuauuagcauguuaaggucaaacuguuuccagguacucuugcuuggguagagauuuggaaguugacuauauuugaaaucugaagggugacaagucaguguuucuccacauuaucuguuuccccauagguagcuugauuuauucauccagucaucugcccauccagucccuucugcugcugaacuagucauugcuucagggucauggacacaaaaacagacaaggguaugccccucuuaggggcagacacagaacaguaucaguggagcgaucugaggaagccaguguuggcagggagccuucuagauggccaacaccuucuaugaaagaggaggaugcugcuggggugaaguccuggccuucugggaggggcuggaacccgccucggcgcugggucagugcucuggauggcagccuggccccgaccagccuguccuuucccccauguguuguucugaaucucuuuccccugcgacagaauucacagaaaaagcaaaccuaauuuuuuccuuagucaaaacuauuaaaaaagaaaaaucccacacuuaaagccagaccucugcagaaguaaauuugggaauucauucuuggauuuguuucucuccugccuuaaaagagaaagaagccuccuagaaggagccccacugaacuuguuugcuguuuucuucagugaaccgcuuucuguggcucugccucucugagaauguuucaaacucugaaacgcagcuggaacacacuugagaugcuccacacagacuacaaagugauggcauggacugugcagaacagaugcuguuugcauuaaaauaaaagacaaacauaauauuugcauuaaucgagaaccuuugcaggaguauuugcauagagugguuuauccuuuuccaagagcugguuacucuuaacuaauuucugaguguagaaaggauaagcaaucuuuugcugauuauuucucacaaagaauugcuuuugcccaaguguguagcuguuuccaaagacgggcucuccgacaugcacgugugauguugagugcagcacaggaagaauggcccaugugccuggcagugauugcugucagucaugcucuugggagcuuuuuguguuucagaguaggauugcugagcucguacccugcuuuuagugguacugaacuuuguuucagcagaguugugcagaguuacucacacuagaccauauuucaguggccuccucuuccuccuuauaaugagaagaagccaaggcuguggcauguuggcgugucaaguguuuuggugccugugcguacaauuucagggacagcuguacuuaauucuuauuucauuagugaaggcuguguaagaauaaagacaaaggacucagagcaaagaaaaaaugacggucucucaaagagaaguagagcccggagaugcaggucauaaacccugcauaauuggcucugaguuucuuagcugucaaaggaaaaagggaagcccuuuaauuuuaaggucuauguuguucuuaagaggaaaccaaccagguguuuuaaacagugacuuugaaacacacacacacacacacacacacacacacagugagaaaacaagauuacacauagucucgguaucuguaugaaccuuuguauuaauugaauauucaguaguuauuaauguguacuuacaugauuuacuaguguuuuugccuuaccauugcuucugucaucuuacucuuucaccugggauaugauuuucuuccuucugacauaaucccuuguuaguucagcaaugguuucugaaugguaaguacucaaguuuuguuuaucugaaaauguuuuuguuuucccuuuuacccgaaugauaguuuagauagguguagaauugcagguugcugugucuuucagcauguuugaagacauuucauuaucuuuuggcuacuuuuguugcuguugaaacauugccucucaauucaauguucuuagaucaucuaacuuuccuaccuuggugcuuuuaagaucuuuuuccauguuuaguguuuaaauguuuuauugcacugugucuagaugucgauucacacuuauuuauccuaauagagacuuagcaugcuucuuaaaucuaaggacuguuaugucugaauucuggaauauucucauucguuaucuguuuuaauacugcauuuguacauuuuuuccauucuuuaggaacucauacuaggucuauguuggaccaucuuauucuuuuauccuugcuucucuccuuuaucuuuuccuaucuuugugcugcauucugguuaguuaucuagaucuaguuuuaucuuuauaucuaauuugcuguuuuuaucuuuaacuagaucuaaucuguucuucucaauuauagaaaauucacuuaauucuuuuuaaaaacuucucaucucccauuuccagguuuuuuuccuucaugauaguuucucuucuucauuuaacuuuuuuuuuuuuuuagcgcagcuuguugucuuuuccacauuguuuuaauauuuguggacauuuuggagucauuucucgguuuuguuguucuugccgauucccacaugguggguuguuuccaucuaucauuugugauguuaaauuugcaugguaaacucuucagcaggggacuuuccucccucccuuccucucauccuucuuuguguguuuugugugcuguggauuguggguguagcccuaaggagcuauuuuucuuugucuuccuggggcuacaggguuucccagguucuagacuaguuuuacccuuauuucuagacuugagauuccagaacuacucaaagaauaugaaucuggaggccacauccacagggacccagguuuagggucuuagauucucacugaagccucuuccuagcaacccucuauugcuucccaggccuggugggugggguuuucuaguucucuuuucauagaccagacaguccuccaagaguucugcccggacacagggucucaguuccaguucccuguccaagccacgcucauggccaccucuccugcccacccagauaugcagccgcccacuggcucccuggugccugucuccaguucugaugacucuugggccccaggaacaggcagcugggucuuagugcaccugcucagagggccguuugcuuucuuuccuuucugguaauuggggucuucucuugaauucaacucugccuacaauauuagggcgagauuuuauucuaucuucauaacuguuucuuuguucuuacagugggaagcgagggauccuuaucgagucagugcaguaagguuugggaaccuaaaguucugguugacuugcuguguucuguagcucuguguuguggacaugaggaggcucugugcuuuucaaaguguaaaauuggcuuuuacuacaggcgcguguuaauucagaacaucaaagcaaggaguacacauucagccacugcuguuuuccaguuccucuuuucuuguaguugaguuaaaaggcuagcccuucuuucuaguugucugaauauuagaugugacaucggucauaacagcauacagggguguucguuuuaauucaagauugccuucaugcccaagugugggacuuuauggguauaaaaccaaagaaauuugcuuuagauuacgaaagcugcaucuuuguuuuguuuugauguaauuucuguguuuucuuugccguaugauucugauuuuuaccacgcuaacgcagugguacaagauuuaucaucugaguugcacguugagugauaggaaguggauuuguucccgagacucuaauaucuuaggagaagaugaaaauaugucaugagcuuaaugccgcguaugaagugugaugggaauguguguugugccucugcucugccaggcacacugccagcuacacaggaagccugcuaggaagugugcagugcgggccgccguggccagcgggcucuccguugcaaaaccgguggccggcgaagcgcagguggugcguuccuggcggagaacaggcugggucuuaagggugugugcgucagggagggaggagagaaaugaucggauuucugcuucuucaaaauucaaaaauaacuuuauuaaacagaagauaagggauuauauuuuuaaaauuuuggauaacucuguucuuagagcuaugaagcauuuaaaaccuuggaaaaucguuuaagaaaacauuuuaaccuauugacugcccucugguuuggugcaguguuuguccuuuggcggagaagcaaggggaggagguggcgggcacagaccaucuucccauccucaagaaggaacuuccgugggacaugagagcucuuggaggcaacagcuuccuuuuuguucugcucuuucccucgugccuuuugauuuuucucuuuaacuuucugcuaaaaccugagaaaugcucucagccaaucugcugaaggaggggaaagucagaggacuugcucccacaacgugggcuguguccauggugacgugggcuguguccaugguggcgugggccauguccauggcauaggcuaucuguggcacugcggcuugugaguacguuugugggugcuuaguccaguccucucaguccugcaagguuggagagcauccuggcacccauucgauggcuguugacggugaggcccacacugaucagcuggcucauguggcaucacaggcuccugggaguggauccuggcuuugaugcugggcgauccugcucccacacucccggccagaauccuggaaccaccaugacagucgucauguggaaaccacaagcuggaaagucuggaaggggcagaaauccacauccugccagugacauuagcguagugaacauccaacagcaagucgcuucuccuggugguggcucuauuuuuagaagauuaaaauagaaugcaauacaaagaaaucacuguauauuuagaaacugaagcuucuguuguauaaaaaggaauagugauaagauuaaguuagucuugguguaggggagguugugauguguaggguauauucauucugugcauaacagaaauguaauagugauuucugcacaugguacaccugcuucuuagaggauccagaaaagcugguuuuguuggagggaggagugugcuggaguacuauugaauuaaauaauaaugaugugauuaucuugaauguacauuuguaccauugaauaaugagccuugugcagugggagagcguguucuagaauacaaggagguagauuggggcaucucaagcaggagcuaggacugcagguacugugugguuacagcuggggccaguguguggagaauggaacucuuuguuuuuauuuuuuauuuuuauuuuuggaggcaggucuugcucugucacccaggcuguagugcaguggugugaucuugcucgagagauccucgugccucagccucccaaguagcugggacuacagucacacgccaccacacccagcugauuuuuuguauuguugauagggacagggucucauuauguuacugaggcuggucuugaauuccugaccucaagcaauauucccgccucauuccucccaaaguguugggauuacaggcgugaaccacugugccuggcugggaauggaaaucuuuacccagaucacccacgacgcuagcugugguggcaucugugugucucccccaucuucacuuuuuagaaauaaaauuuuguuugaaaacauuuuagauaugaaaauaaaacuacgugguguauauuauucgguaguaccaaaauuaaggagaguaaaacgucuugaaaucguuuaaaguugaggacauggaaaccacucauguggaaaggcccuuuccaccccacgucauccucuaagggagcugacggcgcccacagggccaggugccagcugacgagucucuuuccagacgugcuggcugcaccgguaaguugaugcaggucucgaggugaaccaggcguguggcgggggcacgugaacacacgugggcagguuccccgggucugcagaggggaggaucccgccaagggugagggaaaaccgcccccgagucccaucucuggcagcucuucugcuggggaggcccaugagccaguccacugucgugccccuucgcuguggccucuggcagcgggcuucuggcuggaacacagcaguccacagucaggccacugaaaaccguccuuucugucgaggucccagggaggaagugccucuucuggccccuucuccuuggagaggccaagacguuccucuaaaggaggcccgaugccugugucaccacugccagugcacgcugaacccauagcagcuucuggauacuucaggagaauggccugcugugugaaccagugcuugauuuuguacccacugugucugccccaagacaagcugcuggaggcuccagccaguggcagccccaguggcaggaaggcacguggagcugacugccuggagcugggccgugcggggcccuggacuaucugaaucucaugucacauuuucacagccuucaauuccuuguucuuccccacugguucuggccagguggccccgggaucucuggggagccaccugcaggguuagagaccggguacugaagacacagugauguuaucaccuggaccucuccucucggaccccugggggccgacucugugucuucaucagcuggguucucagcaccuaaggugaugucuggaccacacgugucuccugauagugcuugucagagucauggaauaaaagcagggugcuuuguuuaaccagaggacauccacgcauccucauaggagauguggagcgggguauucccugcaauuccgaugggagaggccgcgguggccaucacggaggaugcugcgcugggccuccuuccagaggcgggagggcugugcacggccuccuuccagaggcgggaggcccggaagcagagcuuccccuuggaugacgcgucacagcaggaaggagcacagcugucgcggggugagagacggcagaaccaguguggagcagccagcugacacauuaaacgagucuucacugcuuauguauauuuugugcacauucuuuccugacacaagaguuuugagugcagugugugucacuuaauauucagcuccuuguuuuuuuuuuuucuuuaauagcucagcuaaaggaaugaauaaauauuuuagaagauuagagccccucccaggauggcgugguauuuggauagugagauuucggguagaguaaaggaugcugcugaaauacauguuguuguagaauauggagaacuugaauuuugaaccauugacacaaauucugaacauuuuggauuuuuuuuuuccugagaaagucacaaaguaaugauucaaaggagguuuagacguacuguuugcucuucaaaauggugauuggcucucuuaaaaucagcagguuccaucaaaucugcauuuuggauuuccggcuugcuucuccccacucaagucucucugucuucccuaccugggugaguguggcacacccacgccaaguccaucgcagaguccugauggaucccuuuccccaucucucccagcucucucuccgccucccccgccuuccgcagccccuccccgcccugggcgacacuccgcaugguggcugaagucggaauggaagguccuuaccauggccuucggaccugcagccgugucuccucugucugccccgugggaacccccaggcuuguuccccucccaggccuugcccuugcuguucccuccaccucguguguaccucguugggaucguugaucccacauguccuucaggugucggcucaaaugccaccaccucacagggcccucucaggucacuuugucuaaaagaacagucccugccguguuccgccugcgugauuguuauuccagcacgugaucccacacggucuucuaauuuacgugucaucaccucuucagcaguggaaguuuggggugcagggacuuacaacacuguguccccaaaauuguggccaucacuuaaucgcuaguucaggaaaacuugaaugaaugagccagugaugggauguugaccuugaggcuugaaugaguccguguggagaggcagaacagcagagugggggucaguuugcuuuugaaaguuggucccaaccuugaucaggauggucuuuaucaucucccuggcuucuuuaaaauggggacaauaacaguaucugugccaguuauuucucuggugagaaccaugaguacuacuucugugaaugaaacccagagauaagugccugaccaucgucagcuccugcuaggaguuacuuagcuguuauuguuucucauuuagaauguaagcaggauguuauguuuaguucuagcaagauauggcaacaauaguuuagaaaaugaaauacauuuucagugaauugaggcaaauauuguccuaaaaagcgcuagagguggccgggcucugcagcucaugccuguaaucccagcacuuugggagguugaggcugcggaucaugaggucaggagauugacaccauccuggcuaacacggugaaaccccaucccuacuaaaaauacaaaaaaauuagccaggcgugguggccggcgccuguagucccagcuauucgggaggcugaggcaggagaauugcuugaacccgggaggcggagguugcagugagccgagaucacgccacugcacuucagccugggugacagagcgagacuccaucucaaaaaaaaaaaaaagugcaagaggaguaagucuuucaacccaaggggcguguuggcugaagcaccuuggagcagacuuuugcugggugaagccaccggccugucacuuggguagcugcuggcagggucagccugacucgcacagaacaucaccgaguguuaugggcgcugggggagccccagccucacucucuccccaucucacuggccacugaccacagauuggucacuuccgaaaugcugccuuaaacuuggcaucaaaggauccuuuuucugcacagagaaugagcggugcuuucaggucugguuuggugagaggaggagagggugugguccacuguggucagcgcccuccguucuccaccucgcuccagggagggaucucugcuuugaugcucccagccgcgcaguuaaugugccugccuagacuuuccgcaaauggccacuuugaguuuauuguucuaaauuagugacucauuuuucgugagcuacuuauuaacaugcaccuauuuuccagcuuccugccaccuaaccacaagcaccuuuagcgaguuugugauguucagcaguguggaaaauauucugggagaaugguucgucuguauagugguuuucguugcugagucacguuuggugagcagcuuguucggcucagaugcccuggcguggagggcacgggccccggcugcggcacugaagcaaaggugaagcgggaggagcaaagggagucucucgccccgcacguacugugugccucguucuuuaucuguguucguuuauucacuccucaugucagccucgucuccacucgacaggggggauauuccaccccaaacccugcaggacugccucccacacggguucuacguccagguggaggguagaugcggguaggaauuguauaauauuuguuagaauucucgggagugaaaagguguuaguuuagaaaguaggaugccugcggggaaacagaagugguggguacagcaugaaaaagugggccuuuugguuugcccggcugugcggguggcccggcagcgagggagcgcgguuauccacgagcagaccgcagagcuagucuccagccauugccgauagcugcaucaccuuucaucauuaacugaagggaaccuauccagaaaacuauuuuacauuagcuguggagaugcuauuuguguguuuugcagcguuccuauuugacgucuguugugugugacuccucccacuggcucuggugaaacugcacacggugcaugccaggugauccuccucgcacgcucccagcgcuguacagcacagcugugcagugacgcacccacaugugcccucgccacugggcaguggacauccucucaggagcagagauggugcuguuuucaaaggcaggcgaggacauuuucuccugauuugcuaaaucacuuaugaacgcuucagcuggccugugccacuugguagguagggguagcugagagcugucucuccguguugucuuacuuagggaggaagcagccuggccaugccaggcccugcagaaccgucuaggagaggcccugagacacucccuccaggaaacgcuguucuccggcccuuagagcacagagcagggcccugcggagcaggaagagcggcuugcuuucacuccugccggcgccguggccaucaccugcucagccagcgccuggccggcccccgcccacacaccuggcucuaugcucggugccaggaccuguggcaacaggacagccccauucagcccccgggcagccccuuuuccacacugauuccugacacugcuccucgcguccuguggccugcagcaaccccggugcuucuccggcugccacgccuccugggugcauggaugguuucuccgacgggggaggggaaggggcgaggugcuguguuuccacugccacauuuucccugggaaaauccccgaguaaccugcuguucccuuucccccguggcucacuccugcccgcguuugccuccccaccgggcucugccugccugcugagucugcguguccagcgggcucaguuugcacguuuugucccuaucacccgacuaagccacagguguuagcaagccuggccuggcacgugagagcagcuggacaccccccugcagucuccucugcccugugucugggcaggugcuggcaccaggcagaccccauggcgggacuggacgcaggcagccaguguggguugccgguucugcugggccggggccaggccucugcguugcucacucucacguucccagacgcucagggccugcucgcugagcugugaaccagacgugugugucugcuugaacacauaggggcuggggaugaacugaagacuguugggauauucgugaaggaacaaguuagguagaucacccagcagaugcucaggaaagacauauugaauagaaggugggggcaggcucgucuuuauuccuggcaucucuugaaaaauuguuaugaaaaguuucaaagauauaugaaaggaaagagaccagugcauagagcgagugcccacagccaccucccgccaggaaaucccugaggcucuccaucgugaccacuucaucucuccacaccuuuauuuucuggagaauuuaaaaccgaucucagaggccacagcaccaucccuuaaauacuugaauguguguuucuaacagauccaaccccauuaucacacucagcagaaggaaucaugauuccuacauaucaucuuauacccaaacgauguuuaauuuuuacugguugucuuaaaaacugucuuuuuacagccaguuguucaaauccagaccaaaacaucgggacuggugggcauaucugaaauuuccccugcccacucuccgccucacugaguccuuuguccugggauuuucuguuucagggcuugacugaucauagccaauccaguguccuuuagcagguucugccaaacccguacuuccuguaagccggcagcuacagcuaguuuugauucuuaguggagagacaacaggaauacuucuuagguuauccuugacauuuuaagacugccugauuacccugaaggaaaaauauugcuuagggaaagaaucuuuuuccauuuucauuuucucuaauaaaugcacauaaacuauguuggacaugccugaggaauucacagcacuuacucauuaaaguuuaauuucuauuaaugggcagaugcaagcacuguuauggaacuuugguaauuuucaguaaccugcgcaguggggaaaagcagaaucuaguggccugggaugcucgaggcuauaagcagagcucccagggagggccgguugggugggcacaaguuuauggagcaucaagccuaugccuaguaucugccaggcccagggguagugccagggugugggccgcacaguggagggaggaugggcugcuggggucacucagcaaagcaggaggcugagcugggaggaggccagcgcaggugcagguccugcuugagguggcagauggagaccccucuggggguucaggucaggggaaggaccuagggggaauuugaguauuuggcugaccuuguagaucauuuuguuuccaagccaugacauuucagcccacugaacuuccuuuuauaauuuaauugaacaagggcaucagagugccaguaaaauucuacuaccucuggucacacagguuagaggccugaggggauggcaugauggccccaaacccaaauagauacccacuucauuccacauugacucacacgccguguggagggaagguuugcaugugagugugcaccgcaccacgcccuccaggaggugcaggucuuggugggccacaugggcccucgcgcagcgcuuucucacagacaccugccaguuuggugcaggccaagaggcuguuuuccucauggccaauccucccagcagaaggaguuuuccgucccuccuuauucaggcaaaagacaaguccuuuugccccagacacgagaaccaagugguuucuuuugucuuugcuuuaaggcuaagcucuuucuuuaaaccaugggaacucugccguugcccaugaaguucgguuugaagguaucggggcuucucuggucugacgucagcccuugcuuagguguucacgcagcucagucccuggagucccagugaggcccugggacaaaccccaguugaagcacauucuauaaaauacccaagcaggauugcuuaaagcugucaagguggucaaaaacaaggaaggucugagauacuguugcagccaagagaggcaggacccuggaugggcgcuaggacagaaaaugggcaccagggaaaaacggaggaaaucugaaucaaguccgggcuuuuucugucaugacaccuaagcacagcauccugauggaagguguuaguuguagggcauggagggugcagaguacaggaauggaagauguuaguuguagggcauggagggugcagaguauaggauaagucucuacuagcuuuaauuuuucuauaaacucacagcuguucuaaaacaacaccuuuguuugaaaaauaugaaaggauggggagauuggcugcaaugaagacugugucguuacuguuucccaguagcccuaagcuuccguucccgugucugaaaagcagcucuguuagcacaguggggugugcacagugaggugugaccuauacuacucuugagucacagcgguuucauuguuuuugucuaugucagcaaccccccaccaaacacacuuuagaauguuaauuuauccagccgggagcgguggcucacgccuguaaucccagcacuuugggaggccgaggcaggcggaucacaaggucaggagaucgagaccauccuggcuaacauggugaaaccccgucucuacuaaaaauacaaaauacuagcugggcuugguggcgggugccuguagucucaccuauucgggaggcugaggcaggagaauggcgugaaccugggaggcggagcuugcagugagcugagauccagccacugcaguccagccugggcaacagagcgagacaaugucucaaaaaaaaaaaaaaaggaauguuaauuuauccaauucucauuuuaugcucauaacgaaauauugaagugaggugcuaaggugaaaugugggacugaggucuccaagucuucagaaucaagcguggaaaagaguuuagguguagcuuguguggagcucuugcugccuuccuguucccaaaaacccccugggccugaccacgcugguuugucacaggaaugcaaaguuaguuugacaugagaaaaaaaaguuuacuacguuaucagauggaaggggaaauuauuuaauaagcugaauugaugcagaaaaguuuaauacaguuaagcaaacaugugauuuaaaaauaugucuuggcaaacuaggaguagaugggaacuuccuuaaucugauaguuaccuguuggacaccugcagcaagcaauacacuuuccaguaaaacauugaaauauccuucguaagaucagaaacaagaccaaagugucuuuuaucaccauuucucuuuaguuacuguacuguaggacugagccagcagaauaaagaagaagaaaaggugugaggucuggaagguggaaacaacugucauuauuuguacgugaccugauucuauauguagaaaauacacgauaacuacagaaaaaugauugaaauuaauauucuacgauacagaaccaauaaguaaaaauuaauuguguuuccauaugcaagcaaacagaaauugauaauggaaaucaaauaucaaauaccuaguaauaaaucuaaagauguucaagaccgcaacacugaaaauucugaaacauuucugagagaaaugaaaggagguaauagcccauguucauggauugaaagaugcaguacuguaaagauuaucuucucucaaaaugacagaugcagugcaaucccaggcacuguucguuucccucccucccucccucccucccucccuuccccuccuuccucucucguccucucucuuucucucccucuuucucucucucucuuucuuucucuuuucuuucuuucucuuucuuucuuucuuucucuuucuccuucuuucuuucuuucuuuuuuucuccuuccuuccuuccuuccuuccuucucuuucuuucuuuuucucuuuucuuuucuuuugguggaacuugucaaguuaauuuuaaaauuuauguggcggaguaaaaggccaauuuugcccaagaugaucuggaagaaaaaaguaggguuuuuugccuugccaauauuaagaguuauuguacaguuauggugguuaagacagugugauuauuggcaaaaccaaaaacaaguuggccaacaggauugagauuuggcuuauaagggaacuaauguugcccauccauggugaaagauaagaccucuuaauaacacugaggggacauuuggcuguuaucauaggaaaacauaccccaaaccccugucucauagcguauacaaacaucagugccaguagaugagagacuuacauauaaaagggaacacugcaaaguuucaggguaaaaauauguuaaaauaucucugcagccuccaggaagagaagaguuucuugaaccugacauaaaagcagaagcuuugaaagauugagaaauaggaccuuugagaggauaucugcagcauuuaauugacagaggauuaauguucagaauuuguaaagaauuccucugaaucaauaagaaaaagacaacccaacugggggcaaaaaacaggucaaaaagacaugaauccaaaacagccagugaaaaagccaauaaacauguaagaagauggucagugucauuggucaucugggaaagacaaaugaaaccuucaagagacacccuuucaccccaaccugggcaggacuagguguucccaggcaggucccaaggguggaaaccacacuuucuccccacucccuuccccucccaguucaggagccugugcguggggcuuucauguacuuucuuuauuggcucaagaaaccuccuuucuugugugucgguauugugaugugaaacccuugguggagggcacuggucuugguggguaccuguuugcucaagguccagcuucagacaagccgcugguuuaauugagacagaacuggauuccggcuggugcucacuccgugauccuaggaaacugcacagcccuugaggccauuuccccaagugugaaguggggggccugggcccuccgggugaaagugagguuccuuuggcuccagaaggccggguuucugguuagacauaccuacccgucugaugcaagguggauucugaaaagcaaaagcacugucugucuuaguccuguuccucccaugggcggacuccgagucucaaacaaugcucaguucaggcuggguccugucggcgcgaaagggacuccuggcaagagugauguggucacugcaguugacugugggugcauugagcacacuggggcacaucaugugcuggugaggacacgagguacccgugcuccucggccucccucucagugugcaucuggucugcagccccagcgcugauuaaaugcuguuugaggacacucaguacgaucgucccuguccagcaggguuuccaaaaauagauucucaagcggagacagauaagggggaaccugcuugcagcaggcgugugaugaggaagugguacuuugcuucccaucuucauuauuuuccugcuuguaaacgcuggguucuuagcaccgcuuucuccucagccugagaaauuucagcccagaggcagauaaauauggaaauuccaccucucaucacuaauuucauuuuaacucacucuggaauaugauaucugaaaaaacacagcguuaagaaucuauucugugcacauucacggaugccgucaugcguuccagcuggcuguguaccgcagcuugucuauuucacccuggugacagacguucuuugccccacuggccacgcuuuguuuagguccguuccaaagcugucuuucccaggccugguggccccugcgccugcaaagugcacucaccgccacugcuuuacccccaggauuguguuccaccagccaccucuggcaaaacgccuuuaguguuuggcuucucgaucauggcugcugcccugagccccagccuuucauaaugagggaugcggcaucugucaugcuguccagguggacgaccaaggacggcucaggccgggaucuugucuuaaagagacuguggccgugcuuccagcuggcuggggcucacggggccuccacaugugggguuagcguccggcacugagacccaugucugugccgccgccuccaaggccgccugugcuugagacacuccugcuguuuucugauaguuccacauggcugcccuguuccgcgagaggcaggcacuuccuauuaacccagugccgccucagaacagcuuucccuucgagcauuuccaugucauucuacaaagaugugaacauggcaguguuggggguuugaauguacagguuguuaugagacuagccaggcccaguggcacacaacgagaacaagcagcaucucugugugguggaagaauaagccuuaucuggucuuuguccucguuccuggcagggagcucuuaggaucccaggagcuuccugaguguccagcgagccuuucguuauuccuaaggaggagcuucuuaugugcuucugaguuuaugcuaaugaagugacuuagggcaggaccccuggauagccucgggauggggccagucaccaggacgcagagacgagaggagcagcauguucagccgcaccugcugaccccagugguacugacacagaggcuccugcacucaggaccccuccagacccugccuucauguuacuguuuauuugcaucuuuuacaauaaacccaucaacaugguaaaguguuuuucugaguuuugugagcccuucuagcaaauuacagaaccugagaggggcuugugggaacuccugauuuauagccgaucuuuagaaguccaggaggcccaggacuugugucugaaaugggggcagccuuguggaccugagccccuguggcgugugugcuagcucugggcaguuauugucagaguggaacuggaucauuggacgcccaguuggugccaguuggcuggugucagaaaccaccccacccgccaguauacaggauuggacauguuaaggucaaggucugguuuacgcagggaauccacaugcuguuaucgaacggcauucuccuuggugugccagcuagugcaagcaugcaauaaaugucuucuugaaggguaggugggacgcggaccagcccagugcccagaaauguaggugagccaagacccacuaagcugcaccuugaucugaaacacacgagugaugcuuguggauacaggaacaccacguaucgugacuuacaagucaaaucgguugcacugagaucugaugugucuuccugcuucaguguaguaaaaguaacuuguaauuaggccucauguaugaacucggugcuggagggauccgccuuuugggcucaggcauaagcaguucacuuccaaacucaagaaagggcuucaugugagcugggacucuggccccaccgcugcugcucaccacugggggcuucuugguuuccaaacuuucugguucuagggcuuuugcugagguggaagcuaagguugggcguugagcugacuacaggggaggcaguucugggggacaggcauuggcucguaggaacuguugcagaacccugaccagggugguccccccaagcccccuccucuugaccccuucccauuggaaaacugcagcuacauugagaucuucaaaagggccuucugcuguuucugaaaguauuuauagugggauuuggguuaaauacacacacacauauaaacauacauacauacaggcaccuuuucgaauuuuuuauuuuuugucuacaaugagcauuuauuuauuuuuauuuauuauaaaaaugaauacaaauauauuuauuuuuaggggaaaaaaaggcuugaaaaguacuuuccaccacuaucuggggucucuuucugaguugcagugaagguucucuugagacauggcaucauguuuacaauucagcauccaggccaucuccuaagguggccauguucuuugagaaagcccuggaaugugugaagacuuggggcgauugcucaggucuggugguugcuucuaagguguaacuaugaccugccggucuuucuccugacccagggaagcagaacuguuuugccuccgaauaugcccagugucuuacugucuuuacuucuguuuucaaaccuuaagaguugccgagacuugggaggagcugcugguugguuggagagguccccgugguuuuuuguuguugucuucauuuugauuuuuauuucuggcacccacguuugaucucugcauugcccaagagcagccucaccugcugagcuccugcagguccauguuggccucacacuuucccaguucuaacuucaagagcaugcccuccaaucuccugggacccuuguuuccguucuugaauauugaacaucuccaaggacaugcacggguuggcaaugcuaggaauuaucuauuuuggauaaaaaaauggguuuuuuuuuuuuugcagucauuugaccugauguuagucguuuuuguccuguuuuaaaacuuguaucuacagaguuccauggcugcccugcgaaacuggugcucuccuucgcuuaguaaggaaaaugaccuccgcgugcaagucuguaaugauaugcauauuauugcagggcauuuuacaccacuugucagaagcuaauuuuaaaagaaaagugugauuccuggaaaucuugccagaguuuucuuuccuuucugcuugggagaauauagaaaaaucccaggcggucuaaauccagccugugccagguuuaggugguggguggguuccagucucaucuuugcagugagucugaauagauggaaaccgcuccauaauacagucuaaaaauggauuuaaaagaaaggacucuauaccuugagaacaccuggugaagcguucuccuccaugccuauuugcagcuagaguggccucagcuugccuccuucccugucugcacaccuggcggguuccgagggcucccugugcuguguuucugugagcguccagaccguuugucacuaucugagaagaggaagagcugcucuucucuuuuuguuaucuuaaugcuuguggucugcagaagagccgacuucugaucagcacgaguggguauaaugugguugcugaacagaaguaaacccaaauugcuaagccaguggcucuuaggccagaaacgggcguuugccauaucucaguaggaggcuauuuugauuauucuacauuggcaaauacaaauaaucuaugaugaagcugaaagugucccccuguaaaaguaggaaggacacaugcauuucauuguuuggggaguuacucccugcagacucccagcauaaaguauguuggcugaaaugcgcgcaguuucugaagccagugccuucucuguucuccagauggacuuucuggccgagaccagccaguggagcugcugaauccugcccgcgugaaccacaugcccagcacggguaaguccgcccaccccugcccuguccggccggcccugcgcugagccaaagagguguucagacgcucugccuuauuggaggagugcagagagggcgaggggggaggugugggguaucagguucacugaauuugggugcucuuccuggugguaaaagaggccauccuuuuuggaaaugaaauggcuccgugccauguaaaugguagagaaaugcugauuuuuuguuguuuuuuuucucucuggugcuaaaggauguguucuucccaaaggcaccaacugccuggcuuagguguaaccccuggcccugauccccgugagggccuguaggaaagaccucugagcuugcagugggcggggcugggucccacuggccacgugaccguggacagaccgcgccuuuuccauugccaccagcuuuuguugguuaaaugagucaguggcaucaucugucuuccaaguaccuuucagcucuuuaacaaaaaaaaguaucgguggugaucagaaauauuucauuccauagguaauuuuuaguuauuuaugcauuugucuauuuggagacggaaucucacucugucgcccaggcuggaguggaguggcguaaucuuggcucacugcaaccuccaccucccggguucaagcgauucuccugccucagucuccccaaguagcugggauuacaggugugugccaccacaccuggcuaauuuugcauuuuuaguagagacgggguuuuaccauguuggccaggcuggucuugaacuccugagcucaaguaaucugccugccucggccucccaaagugcuggaauuacaggcgugagccaccgcgcccagccccauagguaacauuuuaagguacuccaagucuauaggccauggaaacagacuuuuucccccuuuucuuugucuguaaaacccguuuccacauagaauccuccaggguuuaaacuccuugugaggguaccauucuucccagccaugcagccucuccgagaauaaaaccugaaccuccugauggcguggggcugagggaaccaguguuccguuccacaugcguccugcagggcaguguggcugggccuugcagggacugcgucccgaggccugggucucugguuuuggcucugcugcaccuuccuugacagucagccuuugcugccgccugugcccuccggugccccaguuagacccacucaucaccccgaaaggaaguugaagccagcuugaagccaggcugaacguuuccaagaagagauuuccuucuuugccuugugauucuuccaagucggccagguuuucugucauuuuccaaacccggaguucuggaggugucuuugcccugcuccgggaaggcucucugugucugugggguacgguccccuggccucuugggggguguucggggggcuccuuucugucuguuuuuuacaccuugauuuuacucugcauuauuacugaucaagcaguuuauuuuuuaccccagcacacuggagccugggggagcgguggggagcuuuaaguaccagaugaagaugcacaauuuuaaaauuuuggcuuaugucgacaguuuugguuuucacuuucucucaaguucacuuugccgguguuguuuucguguaaacacugaauucuguggcuggggcauuuuugagacaacuugcuugugcuuaaccaggcguggcacgaggguaagaggauuuucugauagcuugaugggcugggaaaagaugguaaauaugcauaguuuccaagugaaccaaaaaaggugggcuucaaauuaauauucuggcuugggaagcgcacccugccugucgagaccugccaugggaucccugccuggugugaggacaggccggggcuucagccucccacagagggcaccuggggcccgccucugcugccuguuugcgugggagcuuaggcgaguugcugaauagcucaguuuuguuuucucauuucuuagccggggaugauaaugccucucuacagaguucucauaaagaugaaagauaugugucagcuuuuuaguaguuccucaauaaaugucaucucagugucccguugacuaguacugaggaaugugugugauguagccuuuauauccccguucaaggccuggaccucuccugcagccugucacccucauucucuuccuuuggggugagccgccggacuugagaaguggcauguugggaaggcugccccaugacgcuggccauuuaccucccuugucaucagguucccauuggucugagucagagagagugccgugucuccuggcauuuauugcauauucaggcauggguuggugggcguggugggaguguuugcaggguaauuuuaaauaacguagcagcgaugcccaggaacagugggcagagaaagcaugcaugcaugugcagcaguccuguaugacauccaucauugagccugcacaguggccugugccuuagaagccucuaaugugaagcguguucuuucaaacugcauuuuggucauuucaacccacugaaaaauacugcaaagaaauauuaaucucagguuaggugauaacuggaaaauugauaggaaaaugucuuuaaagccacauuuuuaugguaugggaguauaaacauuuuuagguauauguuaugucaguccucaauugcuguuauacauuuccuaaugauugaauuuaaucuuaacuauucuuuagacauuuugauguuugaagguguggaaacagacugauacacacacacacucaauugucaggaaugacuccagcagucacugugagagcucgcucccuuugaacagaugaguguguacuuggagcaggaagggcgcccgggcagcccuccccacuguugaucuguccuguuuccugaccauucccucgugugaaugccguuauguucaacacaggucuuuuucugauuaugguucuuuuucaauacacuuaguccuaauaaauucccacuuccaacagaaaagcauuauucauaccauguauucgugugccaucuugagauuuuagaaacgucaggugagcauaucaugugcuuugggaaagucuauacagguugaguaucucuuaucuguaaugcuuggaagcagaaguguuuuggauuuuggguuuguuuuuuuuuuuuucggauuuuggaauauuugcauuauucuuacugguugagcauccuaaguguaaaaauucaaaaucagaaaugccccaaugagcauugccuuugagugucaccgugaaaaaguuuuggauuuggaggcauuuuggauuuugguuuuuggguuugggauauugucagcuguacuggaggaggaaaaagccaaaaugccauuugucuuagaucaacuuugauuucuucaacuucccucauaacuuuuuaucuguagacuuuguucucuuucuuuuuuaaaauguuuuaaaaauuuuaauuguaaaguagcucuaucauaaaagaaaacacauaaccauuugccuaccacuaagauauaacagacauguuguuaguauuauuccaucuuugccuccuauuucuuugcguuuugaauaaguggaaugucacaguuguggacguggcuuugcucuucccccuuccugggaguuguugucugcuugcugaggggaagggccacccuuggcuuggugagggaagggccacccuuggcuugcugaggggaagggccacccuuggcuuggugagggaagggccacccuuggcuuggugaggggaagggccacccuuggcuuggugagggaagggccacccuuggcuuggugagggaagggccacccuuggcuuggugaggggaagggccgcccuuggcuuggagagggaagggccaccuuggcuuggugaggggaagggccacccuuggcuuggugagggaagggccacccuuggcuuggugaggggaagggccacccuuggcuuggugaggggaagggccacccuuggcuuggugaggggaagggccacccuuggcuuggugaggggaagggccacccuuggcuuggugagggaagggccacccuuggcuuggugaggggaagggccacccuuggaggagacuugacaccgaggcagaucccaggcggagacaugguggcaggguggggugggggcgggagcucgugacccccgguucucugccagagccuuguguuuucccauggagugagcaaacagagccauugacugaguuaggcuggggagauguugcaguuugaggacagaggagaagguauggaauuagucagccaggagagaccagcaaaaugucauacaggauuauaaacccaacuaugcccaagggcugaauuacggggaacuuaaaaacuauuacuacucagucauuuguuucagauucauuguagcuaaaacuccuccccuuccugauuauaaaagcaauguauguuuauuguagaaaaaaaucacuaaagugguggguguuggguuccaaggcuggaggucgagcuggcuuccagccaggccuugcaggcgcucagcagccucgauugaggagaggggugcuucggggaggacgccuaccucaggcauccgggagcaggugcucagcagccucgauugaggacaggggcgcuucggggaggacgccuaccucaggcauccgggagcaggugcucagcagccucgauugaggagaggggcgcuucggggaggacaccuaccucaggcauccgggagcaggugcucagcaaccucgguugaggacaggggcgcuucggggaggacgccuaccucaggcauccgggagcaggugcucagcagccucgguugaggacaggggcgcuucggggaggacaccuaccucaggcauccgggagcaggugcucagcaaccucgguugaggacaggggcgcuuuggggaggacgccuaccucaggcauccgggagcaggugcucagcagccucgguugaggagaggggugcuucggggaggacaccuaccucaggcauccgggagcaaaccggaggcaaacaaaaaaagucaguagcaacaggaaguguggaugaaggacuuacuguuaaacagacggcaugcugagggcuuacggcccucauggcgcugcucuccaccgugaccgagugcccuggcuccugugccccccacugcuccuacagaaggaaagccagagccucagaucccguggccgcugucccagggucgcucagcauauacauuacagggcaggacacaugacugcccugagggcugugcuacuggggagaaagacauccucagaaaaugcgaugcccuuccaucggccaaaaggggaaguagaggccgauguuaagaccgggaugcuggacuaaagagaagcacguuccacgguuuccugaggcauagggguggcgguuucaucacccucuguaccuguguccugggaaacguguaucugucagaguuagggaggcucuuuuuaagguuauguuucaaaagcaccauuuuuaaaagaaaacucuggaaccuuaaaggggauuaacuagaaacuguagagaaacucuccaaaauaacgcaaaauucacguuuggcuucagcguuggauucccacaucuaagggguguuugaccagcacacugucaaaggagcuguauuuccagacacugcucuuacauuuuggaacaggaaguauuugagguuggcuggugccuggagcucaugcugccuccuagauguguuuuguggcgguuguugcauuguuucguuuggugagaagaaaguggaaucugguacaaaucugcaaggacgugugaccucaggggaagcuucgaaagucucccuuuauuggcaccggaagcuguuaauuaccuucauacacagagcccgugguaacaaaguccuugguuguaauauuccugcguggugccccuuugugaguuuucaucauaaagcuggcauuucugggguuuggauaggguccagugaaggacccacggccaucucuggugguuccucgaguggcccccacggaaggacugggcaggaguggcaggaagaagagaggccguggcggccucguccuggcggcgccugccgugacugcuuggguuauuuuccuccgaucagggaagugucuuugaggaaucaaugcccuccggcccacggacucggcagcuugccagccacgggcaaggauuggccaggacggucauguccgccacggaacaugucaccugcuuugcuuuuuuuuuuuuuuuuuuuuuugcuugcuugcuuuguuuuaauuuuuagagguaaaaugaaguguagaauguaaagacaucaaaguaaaacuguuuguguaaaccaaaaauaaaauucuaagucccccaacccaaugaauggacccccuucuugaccaaggggucccaaagaaacuugaaaaaugaguucaggcccugaugggaaugggggguuggacaggccuccuuagacgcccccuccuuuuggcguucaggcccagcugaccagcguuaacaucaaaacagcgaucucacgacugauaaaacagacacagcaguaagauucccgguuccacccugacucugggauagcagcaggcgacagagagcaggcccugcaggaaauaaaaguauuuuaccccagaauauauuccuuccaccuauuuugaguggcuauagaaaacugccucuugggggggaaauuugcauucuggagagaaucccaugcccuuuccaggucucuuuuuccugauccaggagagauuuaacuacaagucaccuuuuaaagucccauaggagacauuuaccaucuauucucucugaagccugcuuccuggaggccucauccacauaacgagaaucuccgcuuaucuuaacucaaacauuuuuuuaugcugacaucaacucuucagucagaaaaccuuucagucugccuaggaucugugagguccucacccuacuucuucaagauguucugggccaaaccaauauauaccuuacauguguugccuguaauuucugucucccuaaaacgcauaaagccaaccuguaacgugacaaccucaggcacagacuuccugaggcuguguccugggccauggucacucguauuuggcuuaaaauaaaccucuucaacuauuuuacagaguuuggccuuuuucgucaacauuugaaaaaucugaaaagaauucccaugguuugauucucuuaguucaaacuaauguugagaguuuguugacugcccuccaucaaguuaaccugagggccgguaugaauagccaugacucaaaggccagacgcaggagucugccccccacauggcuuuagaagcugacugcaauauagcguuacuccuggaggccaugugugugucguguacaauuaugagcaauuuagaaaugcuuuaagagucacuuuuggcaauuaggcgaauuggccccauuacuuuauucauuuuauuuuuauuuuuauuuauuuuuugagacauagagucucacuguguugacuggagugcagggcuggagugcaguggcaggaucucggcucacugccaccucugccucccagguucaagcgauucuccugccucagccuccugaauagcugggauuacaggcgcccgccaccacgcccggcuaguuuuuguauuuuuaguagagacgagguuucaccacauuggccaggcuggucucgaacuccugaccucaagugaucugccuaccucagccucccaaagugcugggauuacaggugugaacgacugugcccagcccuuguuacuuuauaguagagaauaguuuuggaccagaagcugcgcccuccugcuuggucacuaccuuguucacuagauguggugucgaguaauccucaaguuccaauuccccuucgauggcugaaggcauauuaccucuuaagaauuucaaaagguguuauuuuucaaggucuguucauacccaugcccccuucuccaguccuucccaauaucucaucccuauccgccccuaaaccuucagaucguucuguuuuucucugaugcuguuugcuuuuugccaccuggagacaagucacuucugauuucugcucuccuuccccucagaucugugaacucccaugagcaguaacaucagguuucucuggaaacacugcggggccaagaacaccaccuuucacguggcguacacagccuguauuugcaccccauucacuuuccuccuaacucucacagugacagcucccuccugccaucccguuccggcucaguauugacagaggccagugaaggaucagguccugggcucagcugaguugcuccaaggccugggagccuggcagacaugggggcagcacagucuuccugucucccuuuggccacauggccuccagcaggcugcuccucaccuggugucccggggcugcuugguccugggccagggcgcaggcagcaagggcaagugucuggcguagcgucuggcacacaggaggggucuguguucucuugcacucuugcuuccuggugcccucuggugugccuggccccagguucguggcucugcccuuccugcagcucaaccaccgucccuuccaccuucccaucccuuuguggcaaugucccuaggagcaacugucucaagugaaacccagcccagcugaugcugggaagcauaacaacaggagggcuugaauugcguugaaaaugugucuugagaagaugccugguggauggaagcagcugggagaccuagcagagggcccgggccacccugcaguggcagcugcuggaccugcaguccgcuggaccugaucugcagggcgaugacucucgugaagcugcugagucagucacauuugccuucagagggcccuucuggcuuuuaaugguguuagcccucugaggcuugcuugcucauuucaccgggcagagacuauguuccuccgcacccgaggcaugcccuccuguccuggaacuccagggcugccucccgcuccuuccgcuugucuuuggagggccugucuucccuucucucugucugcauuuccccaaggugcuugucugucuguccaggcucugccuucugugaugacagucuuccuggccuuucuggugagcacgguaucugccaucuguagcagagggcacugaggcuggcgggaccugcaggggcaugcagggugcuggccgcugggggcugcccggucccacuuggcaugguguccagcaggcugcuuagccccugugaccucacugggagggcccaaugcugccugcccugcccccaugcuggggcaggaagaccaggacaccucacguguagcuggccagcuuccacugguccgcaguuuucagugcuguuccaucucccucuccagaggguaguagucccugggcucugccagccacgugggguaagcggugguuggggcccugcauucccugagcagauauuucauucuccuucaccuccaguccuggucccaccagccccugugccccggagggcugugugaccgagacuggucugccccucccuuggcccacccuggcugaugggucagcuuugcugucucugauaccuuauucacccagauccuuucugacuuccagcauuuuguggcugcucucucaucuccuguguguguguuguguuggugugucuuucuaaacaauccacacacuguuucagcagaaucuuggagggauccugacaacgugauuguguucacucuguuauuuuugaccagaaaugcccuguggcucugaaaugccacccuguggcuggcaggugggaccgugccuccccacgcggcccaggacacugcugccugccagccccacccgugagccugccggccucacuuuccaacugguucuuucccuguccgcagugccugaggcagaaagauagaaaguuucuccauccuggguggacauuagauuguuuggguuaucuacauuuaucaccccccccauuacauguuacauuguuguuguugcugucgacccaaagauuucugaagagcuuacugucugcccuuagcaaggaacaugggugguaagaaagcagacgguuauugguuggggcgucguggagaauugggggugcugucugagaaauauccucugggugcuucuaaaaccguccacacauccacagcaaaucuggaugggguggagcuggugacugguuguuucucuacuuuagagggagagagaaagcuauguggcagucccagcagugccccucaaccguguugauacagaauacagagaaaucucacugaguaucucucagggaggauuccacaguucuaagugaugauugguuggaagaaaggauuuuuuuuuuccacugagaauuugguuugguuuguguauucggagugucacugguggccaaaaguauuauccaggaaugaauuuuugcaucaugacaucauuucugguuaaagggcuuuuuaucuuuuuucuuuuauuaccagcuuugugugcuuuaaggcuguggacuguaaaauguauccagagggccugcggagccccucaguggcaucuggaagccugugccgccaggacgagggagauggcucuuugccgacccuugucuguguuagggugucgcggugcagcugaaagggaguuccuucucagcagccacauuugacccuaaugucauguuuucgccguaccaacaccauguccccuaccagaggaaccugcccaucuuuuaaggaagguuuccauuucuggaccucacagcaagaugcacacacugucacacgugaugcagaaccaaacucaggcccucuguguuuccaaugaggggcuccgaggggccaucagagccaggugucugaccaggugagggaggacuggaggugucccuuggguagcaguacguggccacgggcgaggggaagaaauugaaggcgguuuagucaggcgccugaggaaggggcuggcacuucuuucaguucuacagcacccagcccugcgugggccuuccugggcgggccugcccuccccugccgaccugccuuccccgccuuccuggcuucccucuccugcucuugagcccagccaggcuccaccccuccauccagguguuucucaucccccccuggggugggggcacccugcagguggugggaguccagcuaugcuuuacucucccgcagaccgacuucugccuucguggaucugcucuuguggguguguucucuguuuuauuaauuccuguuuuaauagcuguucuccuuucucugcauuuauucggauaugcuuguucuuuuagguugaacauuucacuuguuaauuuuuagcccuucuuccuuucggauggaggcauucaggguucugugcugugcuucccuugggguucaaauggggcugcuuuggauaaguucuaauuuguauuauuuaauuuguaaagcauauuacauuaacacuucauaaagucuugguguuucucaagagaguuauuuugaaauuugcuuuuugguuccuuuuuuauuugaaaaaaugaaauauuuagaaguguuuuuuguuucccgaaagucugaauuuuccaagucaucuuuuuuguuauucauuucuaauuuacuccauuaugguuagaaauuacccagcuguugaauuuuacugagacuugcuuuguggucaauuuuuaugaaucuuuaauauaugugugagaagauuuugaauucucuaguaauugggugcuggauucuaaauaugcucauuaauuccagcuuauugauuguaaauuaccuacaauauuagaacaugugagaggcgagaaucgcuguggaggagagugagcagucaaggacuggggauucaggaggguggauuucugcguucaacucauucauucauucacucauucauauugauugggccuucuaaugccauccccugcccuuggcauauggaauacauguauuuaugauugacacagagaccccuauuucaugguacucauguuacccugggaggaagagaggaaacuaguaaaggcaaugaguaaacaguagagcagggaaggcagagcagggcucgggaguggaggggcugcgauuuuacacccgcuggugagggcaggccuccuuagaaggugagcagacauuugcaggccgaagaccuggucaggagaagagggagugggcggugcgggagacauaaaaggccggguuaaucaauuaggcauggcuuugagugacauggaggcuccuggagguucugagcagagaagcgacaccacgugacguaugccacagagaaugcaguggccacgugggacaggcaucggaggagcagggagacccaccagggucugggagcaacccaggcaguggauggggcucaguccggguagguggagugggaauguagaaaaugguacaaauucuagagauaucugacguagaugggauuuccuuagccugcagaugggcugugcaggaaacagaagagucgagggugaccucaggauuuuuggcuuuaagcacugcugauggaguugcaugaauucauggggaauguggguggagcagacccugcgcugggaugaggauuaguauggaucugugcagugcuuucaaaggcacccaguuuggaacacugagugguaggcguuggcgagccugcgcugaacgugggaggggccugcgcugggcauucauagcagaaagauacauggacaugaacucucccgggcaguggaucuccuccgugcaagguccacaaaguagacuuuguuucuuuucccuuuuuuuuuuuuuuaaacaauguuugcuuagugcuggcaugcaucuucuaccaaauccuacuuuguaaaguguuccugcuggcaagagaguuacuggcuccgggaucuuugcugggcagagagugugagcgcacagccuccacagccagcagcaagguccugcucaaagugggacucgugguugcuccuaauuacagcaaugaugaggacacugauggccacagguccccuuaccaaggccacccaucugucacucagcuacguaccguguguucauuggcauuuaaugccccuggggacaucacacaguaguuacugguucaggaacugaggcugggaggcguaagucacuuuuuaucaagcugcccaggugauuuuucuggacagaagucugaaccagcccccugccuucugcauuuccaccugccugcuggauuauuccacccccagugacccgcagcgcccuugaaagaugcugcagcccacgccggucuccagaaagccccggcggaauguacguugcugccuggaagaggccggcucgccccagagagaggggcuaccuccuucaggccucguccuuggugcccucucuucuucuccaaugguuucuauuuuuaaauauuucaacuguuacuguuaaguaauagugguuccuacuucggcccagcuguuaggugaaacacauaaccaaacguuuggagguugcuaagaaggaaauucugaaaugcguucuuauguaaacuugaucuuacguaacugagaaggcaagagcaacugcagugggauuuguaggcuuccuagaccacugaaacuauuuuuaauuuucagacaauauauuuuuauccauuggguuuaggguauuuggauagcuuucaggaguaacguguaacuugugcuggugugagcaggcuggagagaugggcugcagugguuucagggagguggugguguuccaggagguguggccaguuuugaauccaggugacaaugcuuacuggcugcaucucccgucugugauacccagguccccgcugggaccugcuucagggggcugugaggacgaaaggagaucacaaagcaaaaauacuuuaaauucgugcucaguccugaaacauuaguuuuuuguuauuguuucuauucaauugcuuuugcauuggaauuguagagucuuagaaagauuuuccaggaaugcuuuguccauaacgugauuguagcagcaucucagacggaugguucugucuguuauuucugggggucaugcuugucuuucauggcugcgcuucuguaugagaacuuaaagcacauuucaccauuuuuuuuuuuuuuuuuuuugguaugggguaaggccugguucuauuuauaguuuccaggaaguacauuugugcacuucuugaaagccaacuuaccaacugcaugccagguuuuuauuuucagcucuugcucaauuugagcuugcaaauauuuccaaaagauguuuuuuucuuccuggggauauagaacaaauuagaaacauuaaaaggauuuucuaaagagcuuuaaggauaguucugaaauagggagcagggaaaaaaucuaacacuugcguuuucauuaaauuguggaacagaagcacacagauggucuugcucccuccagauacagcccuggcugguacggccagcacccagggacucugcacacggaauuccacgagaauaacaucacgggcugccguaaaagccagggaagcgaagggaggcguuucugaucuguuucuggccuugcgcuggcacagggugucaucccuugggugggaagggucuuuggagccccuuauggcagcaaguuuacagccgcauuuggauuuaaugcuggcaaggaaggacuuuauuuucuguucgaaucaaauuuggaauacguuuuugaguaaagcuugcugcguuguugauacagcuuauuacucagaagaaaaaaagccuuuuaagugaccuguuaaggaaaguuuuauuuccucaaaguucgugauagcuucaauaguuucggcuugucauuuaauaggaccuuuugaaagaaauauucaccagaaaagaaucacuucaaguugugugugcauuauaaaaauggcucucguccacgaugacuggcugaaaaaugagauuuuugaguuugucauacauuuaggggacccuuaagaauguggacagauguggaaguagcuguucuucaguugaaggcugugugugugugugugugugugugugugugugugugugugugucccacucucagcgcacuuugaggcgcaacucgaggugacacaguugaguccaggccuugcggugagugcugaggacacagagaugggcaugggccguccuucccagcuggccacucuuaaccccuggggaggggcacagggucuccgaagcuccugccacacuccugucuuuuuuguuuugcuuugcaauucaguagucccugugggguaaccagaugcucuuagcuuuguugguuggagcugugauuuuuuuuuccagaggguuucccagaaugcucccaucuccuccccugauguggugucagguggcaccauggugucccccgcuccugugcacagaccuuggcuuuccucagcgguuuaugucagagaacgggccgauguccgcuccauccccuucgcuucucuuuuauucuucuaaaugguauucgcaagaacacuaauaccaucugacaggguucuccuucauguagaggaaucauuuaaggcgccuguaaacggggaagguaaagagagacagggcggugaggccucugugccucacucagcgggucacacgccaccgcccgcagaaugagcugaguccaagggcuggugggagggaggucuucguggugagggaguaccucgccuuggucaugaugacaacacgguaccaaggucggucccuggcuuuuuuuggcuacagaagguggaaccagugggggaaaccuggcggaaggguaccugcaaccucucuggacuuucuuggcaacuuccugugaaucuauaauuaucuuuuaaauucacaauauuagugugagaaaccuuuaauaaaauauauggcucguuucccaucuguuauccauuuaaaguugagaugugucauuccaugggauuagaaauaaagaaaaaaagauggauguucguagaugaagcugaaugacuaagguugaucauugugguagccggauacguggguguuuauuauauuccucucgcuaacucugugugucguugaagauuuucaugaugaaaggccgcugaccaguuccuaagagucuucuggcaccaucuucuccgaggucacugucuuccccuaccaagcacaaacuguccccaccauaggcuuuaucgcuucugccuagauccgcaaucugucagauuucuuucaucuuuauuaucuucuuccucuuuuucagugcacaguguaugcuuuaauuuucuaguuauuuuucuaacuuuuugagucuaauguuuuuauuuguuuggguuccuuuuguaguuacuuacauguaggcagcuauucauuguucucugagcucaauuuuaggcaauuccuacaauuuucgauaugugauguguucauuacuuuauaaauuuuuaccacuuucacuagaauuugaagcguuuaagagaaagagacucauuuuucccaugguuggauuuuuguuucuccugguuuuauuucugguucuguugcaguguguuccaguguuuagucuacacuguguguauuuggaaacuguguucuuuauguggcauugguuuuuguaaauguuucauggaggcuugcagcaaaaggcauacauggcuuaaugauaagagguucgaggccuaucuguuggcugaaguaagaauuguacuauucccauccucuguaugcacaccuccuguguguuugcucugccgugaguguacaagagcaaguucauaucuagugcugaccaugugugucuucauucuguguguucuguguuuuuacucgaagguacccacagugugugccucagacaguuccgucaucuuuguagauugcaugcuuuauacuuaggaaauggucaaauauguuugauauuuaguguuggauucaaucuuugugauaccgauaucucgauugcacauuucaauuuguuucuauuugccuuuuggggcuuuuuacccgucuaaucugagccuuacacuggauuuguuuuuauuuuauuuauuuuauuuuauuuuauuuuauuauuauuauacuuuaaguuuuaggguacaugugcacaaugugcagguuaguuacauauguauacaugugccaugcuggugugcugcacccauuaacucgucauuuacauuagguauaucucuuaaugcuaucccucccuccuccccccaccccacaacaguccccggugugugauguuccccuuccuguguccacguguucucaauguucaauuccuaccuaugagugagaacaugcuguguuugguuuuuuguccuugugauaguuuacugagaaugaugauuuccaauuucauccaugucccuacaaaggacaugaagucaucauuuuuuauggcugcauaguauuccaugguguauaugugccacauuuucuuaauccagucuaucauuguuggacuuuuggguugguuccaagucuuugcuauugugaauagugccgcaauaaacauacgugugcaugugucuuuauagcagcaugauuuauaguccuuuggguauauacccaguaaugggauggcugggucaaaugguauuucuaguucuagaucccugaggaaucgccacacugauuuccacaaugguugaacuaguuuacagucccagcaacaguguaaaaguguuccuauuucuccacauccucuccagcaccuguuguuuccugacuuuuuaaugauugccauucuaacuggggugagaugguaucucauugugguuuugauuugcauuucucugauggccggugauggugagcauuuuuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcgaaaauuuucucccauuuuguagguugccuguucacucugaugguaguuucuuuugcugugcagaagcucuuuaguuuaauuagaucccauaugucaauuuuggcuuuuguugccauugcuuuugguguuuuagacaugaaguccuugcccaugccuauguccugaaugguauugccuagguuuucuucuaggguuuuuaugguuuuaggucuaauguuuaagucuuuaauccaucuugaauuaauuuuuauauaagauguaaggaagggauccaguuucagcuuucuacauauggcuagccaguuuucccagcaccauuuauuaaauagggaauccuuuccccauugcuuguuuuucucagguuugucaaagaucagauaguuguagauaugcgguguuauuucugagggcucuguucuguuccauugaucuauaucucuguuuugguaccaguauggauuuguuuuuaauauaaugauuguucaguccuguuuuuuauccaaucugguaauuuucaugugacucuguguuauuuaugaauguugauaaaauggacauauuucuccuaaaauuuucauccaauuuuauauucuguuuaucuguuuuuguuuuuugagcuggggccucacucugucgcccaggcuggaguacaguggcaugaucauggcucacugcagccucuaccucccaggcucaagcagugcuccugccucagccuuccgaguagcuggaaccacaggcacgugucaccacugcuggcugacuuuuuaauuuuuuggaaagauggggucuuaugauguuggccagguuggucucaaacuucuggccucaaacgaucccccucccgccuuagccucccaaagcaccgugauuacaggcgugagcuguugugcccgacccuguuuucuguugugaaugcuucuuguuuuguuuccuauuugacuucuuggauaugggcuuucuuaccuuuuauuuggucuggugugugugguuucuuuuccuucuggugauuuggaaggccgugcucucuuuuuaguucuuauugugugaacucuuaugagcucauacgcuuucccuaaacugugcuuuccuguuccagcaccuucagacgaugugagagaguagcccgucggcacagacacuuucugccgucucuuuucuccaaccuucugauuuuguuacuugcaguguuauuuugaguuuuggugauucucuuuauaacauauaaauaauauauuuagacugacauuuaucaaguuauuagccuuaaaaugguuacugauucuaucacugagaaaaaugagaaaacagauacauuaaguuucuucccccaaauuucaguuucauuaccauuuccauuuaaaaugcgaggaauuuuagguuaaccacuagguuuuggaaaguuggguuugaagaucuggucgcuugauuauccaccaugaaggggagucgacgggccucuugcuuuuggagagcuuccgggagcgaugcugccggcuccuggagacccugcuaccgccugugcuguguucaggcucugccaccagcggguccccuuuggagcccugcggagguguguccuccugagcccacccuuaggcccagugcccgcagccugccauggcccagggugugagaaugucugccaaggaggcucccuuucuauaggagagcuguaagggggcucgggguuugggguuacacugggggaagggaaaguggcgugaaugcagucaccugucuuuugcuacuuacuucucuucugacaaaccagggacugugucauuuagaaauuguugagaauaguucgagguagcuuagucagagcuuccuuccugugcacauucugacuugccuagaaagaugccgaguauggcggguggaaccccugugcacccccuucucaccagacucccaucccggcacagggaaggggcaggacacacacccuucccggucaguccuguucccaggggcccaaguagcccacaggaggaaggagugcagcagggcagagugaaggcggagggucuggcagguggagcuucacccagagaaggaggcuguguuccuggaaggacauucaguucaagagcaaaggcucagauguucauaccauaaauauucagcaucacauaaaauuaaaaacucaguuaaacaaagccuucucuucuucagaagguuuugguuguuaguggucugcagcgcagcagguguggacagugagcaccuguguccccagguguccugagagggcaagaucagggcugguagggcgcccuccucaucgucuuccuccucaucgccaguugucuuuaaggucagaacaugagaacaucagcucuuagugccaagguuuuuuggagacuuuuucuuuuauuuuuuuuuuucucugggaagaugugugagaacauuucauuuuuguucuugaauggaaucuuccgcauaaauacuacauauacauguacauaugugaguaugugugaauaucuauguguguguguguauauauauaaacacgugcguuuuuauauucauugauguggaaagugcucacagugauuacuaggggaaaagcaugcauaauauggcccuaauuaaaauguaaaagcuauauacaauguaagcacauguacauauauaugcugaagaguauauauguuugauuuuuuaaacaaauuaggguuuaauguguuaaaaguaccuauuauuuuaaaauaaauuugggugcauucuaugaauauaucauaacuuuuaugaguccagccaauggcauaaauauuuacuuggggacuuuaacacacauuaucaaauugccuuccagagagguugcaccguucauuauuuauucagggugauuuuuuaugaaccaagauucgcagacccccagugccugcgcggaacugaugaccgcguccuccagggagcccggugcagaggcgcuggugcagacagcuuugccaguccacacuuucuuguuuugaaguuuuugugucuuguuucuguuuugguuaguggggaaggggugucugcugucuggagauuagagagagguguggcauuuccugcggggaugucuccuaguguugccgccauucauguuguugaccagagaagagagauggaguccaggugggcagaacucgaucucccugcgccuugagccagccccguccugagcccuugcccacuccagaugugaggagguuggcgacggucuuuggugcccucccuguugauuucaggugagaugagggagggcacuuuggccugcagggagcccagguuucuggggcgucgacccugcuucucugggcucccagcagccagccccugguuucgugucaccagugacucccuguugccagcuuccaugcccggccucagcccauggccucucaccaguguugacuugguggaagcaccuccuuaccacaccacaugcuccugguaccuucccccgccccggccaccaguccucaggugccuugguggguuuuucuuaucucuccagcaucaucacauccaagcgccccagggcuugucuccggcccacuccuuguuuccacugagucauucccuuggugauauccuggccucauccagucaaaucauagaucacaacaccaucuugauucugccgcucgaaugucugcucccgccuggaucucaccugccuuccagauccuagagccugcuugccgucgauccccagcugggcguucucagacucagcaaguuugaaagcaggcuccugaucuuccccugcaaacuugcuucucccgcggccucuccuacucagggcaaccuccgggcucaggaucccaagaguccccuugacuccuauuucucuccagucccaugcauggccugucagccagcacuggcagcugcccauuaaagugugugcagagggaagggucccagucaaaugugaaaauguucuaaaaucuugguaaaucuacuaaaagauuguuggauuguacauuugagaagggcagaguguaaaauauaccucuuuaaagcuaucaacacgugugcugagccuggcggcugcucacagcuccagcauugccacgcguggcgagccacaggugucacccauguggcuguugcaggugccuccucaccuggccccaauucuguucuugccccucuagucugaucucggccaaggagccagagugcgguugacagaauaauggaacccccgaaaugucccucagcuaauccucagccccugugacuguguaaccuuacccggccaaaggagcucugcagaugggguuguuacucacuggagaugaggagguuguccuggaucaucagggugggcccuuugucuucacgaggguucuuuaaggaagaaaucaagaggaucggagucagaggagguaugcagacagagugucgacagggccaugcaggugcugguguugaggagagaagggaccaggagccaggggacauggcagccuccggaagcuagagaaggccaggagcagauucuccccuggagccugcagaagaagcacagcccugcuggcuuucugacuuucgcuccguaaaccccaugucagacucuggccuccggaacuguaagauaauaaacauacguuguuucaagccauugaguuuauaguaacgugucacacacaucaagcacaagaagcuaacacccagagugagccugucaacuuuaugucagccagacucagcuuuucacucccaaccaugugaccuaggcagauuucucuaccucccugccucaguuuuccacaucugugaaauggggacuagcaggcgguuaggcacaugcuuugcauagcuuucugcuuucuugcgggucccccucauccagcuguguacucauggagggcaggcccugcccugugcacugcaagcgcuccagggagcuggagaugaaggcucacucugucccugucaggcaguguguguuccaugcuuuuauuucagugugugcugaaugugggcuguccugugcgucuccccuugguuuuucuccugggaacccugaugcuggguuuuccagcguaagcacaucaggaguuuuguugcuggaguuggguaguggcuccggccacucuccgagcuggaaaaacacaagcuggugugacuaugcagaugcaggcuuuuggggauagacaauagaugggccuccagaacccgagugaauuccagaugcaguagcaacagcagcaggcuuguuuguguaggguccagaaguuucuuguggagagcucaauccuccagugagugguugaacuugaguagcagucuucagcgagcagggaaugaggggcgcgggcaccgcugaguugugcuguuggguuuaaagaaaccucauggccguugcugagugcguucuuuuucagcauccgccacggcucacccuucagcauuccuccuggcuacccagcaucuguccuuguggcugugccccgcccgccccucccuggccccuacuuugcuguuaugggacugaugagcugugcuaagcccuccuccuccucauucuuguccuuccuuccagcaucguggccgucucauauucuggggacagcucuggguacuggcgggaccagagagagcaacccagaugccacaccuccuccagcuuugcguuuuccugggcgauugcagggaggggcagacaguaaagaagugaacaagucaacagacuggaacccacguggguacagaggcuagagggggccuuuguuuuggucugcuuuucuguuuuucaaauuagagucuuucccaaauguuuggugauccuggcuggccagcgucuaagagugagucucuaacaagcugggcggggcauguugacugcuuaucuuccuggccagguggcagacagggaccugaucacuuccuggugguccuggaugccacugccuguuguccuguucucuuagcccagagaggacccucccagcuccucccuggaguccaggccuggcucacacagccucaccccuuggcaugucagcucucacugccccuguuuacugcccaugcuggcgcuccugcccucagccugauagcaccaagccuggggaauucugggggaaugggguuggucccuguauggggggcagaagggaugaggggucacaugcucuuuauagcucagccuucccugggccauucuggccuucagaccagccuggcuucagcucucuggucagccagcccccgacuggcuuccagaauucuauggcugcugucugcuugugggaucuguguuuuuggagagauuuauaucuuuuuuccuuuuuucuucuuuuuuuuaaacugcuuuuagaaugggguugagggagucgggucagugcccuagccuguguucuuuacaggaagcaauucuuuaaaugucaagagggaaaugcccccugcccgcccagcucagccaggaggccguggguagaaagacccuuucaaccaagucucacaauuaagguuagagaugauuuuggcuccuaagaauacucuagaaaucuaaagcaucccaguucacaucacuuuuaucuguuucuuuguaaaaaugcuuaucauugggcuuacagauuaaaauuuuagugagacagaacaucguuuucccaaccuucccaucggucacauuagagcaaagucuucaagagcauuuuucacuuaagggauguuuucuaaaaagugacccugugcuuuugaugaaauagucagcuaaggagaauggaacccuuuguaccuucacgcugaagucuaaauucagcgucugcagggcacgggacugcucucgaggaagcuccucgguggcgcguggugccacuaccucuggauuguuuguuuuuguccuuuuuuucggggcuuauuuuugaaagcaaaggcaugaucaguuauagcaguccuugaagacaguuuaagaugcuggauucuggggaauauguuauauggcuuaagaacaucugacagcucagugaaagcaaaguggaaaagucacugccugggauuuaaaggugugucugcagcuucagcuuuugaaucauuggguuuagaaaccacagcccuugcuucagacaaagucccaagaauuggagucugguguuggcuggcaaccauaucauucaaguuaagccaagugaggugagaaacuaacggaauggcaauuucaaaugcagauuccuuugauguuucuuuuaucucaagauaaaacucagugcuggggauuucuucauccucauuugacuaaacccagucaagaugugugcaggggcccggaccacccuggggaccaucaccguuagcaaccaggacuuucggcccccaggagaagcacggggcagggcucucaggaagggcagagcccaauucuuuccagcauucuggaagcuggcuuuuauacugcuuagugauuuuguauugugagggcaacaauucuguuuauaauauuaaaaauaggaugaaagaaauaauauauuuucuucugucagacauuuuuguuuaaauuuuugaauagauccauuuaaaauggaauguaagugaaucuuuuugugagaaagugauuuucgaugcaugaaagcuaggugauuuuacccugcagucaggcuucugaucugcagguauuguaacguuuaagauugcuucauccagccuuucaaauacuguccaguaaagcaggacaggccagcauccaccuucuuuuaggauggcauguguaaaggacccucaguguuuguggaguguguuuucugugaucagguucaugccauaaauccccuuuaagaguuggccggcgaaggaauagugcuuuuucguccuugucccguggaaggugccgcaggagcugguugguuuucacucgagaggguucuggucucagccgcguuccaggcucagaucccaagcaggucauuguauaaauguucuuaucccaccuguugaguguccucugucaccaggaauucaggaugguaggauuuugugccgucacucuguccucuaaacuggcguuuccuccuuuauuaugauaauauaaaggggaccuugugucacaagcgagucacuuuugguggaaguggggcaagacauuucccugugcugguuuaagcagggccggucuccuccaagggagccccaagccguugugcucacaggccggguaauaaauguacacguuuguaguaaagccauucaccacuccccaaaacacaacgcugagaauaggguuuagcacugaguuacuuucuuuaaaaaacuaguuuugccguguaaguaugcuuccucagucagcauacgguuuggauuugcuuuuccgagcuuuuaauaaucgaaaucauacugacgucguuuucugcagcuuguuuauuuuuguuuuuguuuuuuguguuuuuuuaacucagcauuguuucuaagauucauuuacgucauuccacauggcugggauucguucacuuucaugccagauacaauucuacacucucaauauuccacuguuuaucuguugcucuguugauauuugggcgguuuguaguuaaugcugcuauaaugaauauccuuguaccauucuccuuguguagacgugcaggaauuuuucaaggguggcuguccuaaggagagggcuuguugcugggucacgaaagcgagauucggcugucuaugagaaagcccacuguucuagaaggccccgucucauucaugcugcugcugcucccacgcccccgcucccugccucuccacccguaguugggucggugggcguaaaguggggucuccaggggucugauuugccuuuccgcccucacuaacaugguccagcguuugauccuuuguuuccccugcugucagggucuucugugaccaacccauucauaccuucugcuguucuuuggaauucucuccuucuggcggcuuuauaggaguuacuuacauguuacggauacagguccuuugucaguugcuguguuaaaguagcuccucugagauucagccuuucacuuuuuaaggcugucuagugagcagaaaauuuuaauuuaaauguagucagauguaacaacgucauauuuugucguaagaagcacuuuucacaucuugaguuuucuauuccaaggauauuuuccaauagugucugcuaaaaauuucaacauuuugucuuucacauuugagucuuaauccacauggaauccauuuuggccuguggugugaauagggacgaaucccaucuuuuuguuccccguagaauaguaggauaaguguuugucccagcugcauuuguggaacacccuguuuuuuccacaguaaucugcaaaggaccugcaucuacccucuuugggaccaccucaacugcuucucaguucuucuuccauguaguuuuauauucagcuuuuaagaucaugaacuaccuugcacuggaccuguaguuccguuuggagagaaucacuaucuuuagaauaguaagucuuccuauccuugaauacgagcuaucuugccauuuauuuagaccauuuaaaaaugucuuucagggccaggcacaguggccugaucacaccuguaauccuagcacuuugggaggcuggggcaaaugaauugcuugagcucaggaguucaagaccagccugagcaacauggcgaaacccccucuuuaaaaaauaauaauacguaaacuagccaugcgugauggcgcgccucuguagucucagcuacuugaggggcuaaggugggaggaucgcccaggagguggagacugcgaugagccaugaucgugccacugcacuccagccugggugacagagugagaaccugucucaaacaaagaaaaaaagucuuucaauauauuuuauaauuuuuauccauaaaggucguucucauuuuuuguuagaaauacuucuaggugccuuguauuuuuuuuguuucuuauguuagguuuucugcuuguugcaguauguugaaguggaauuggauuucuauguugaucuuaucuaacaccguauuacauuuccuuauuagcucuauugacuucccugucauucuucucuuugcagguggugggggugggaggagcucaguaucuguagccuuggagucuggaucaggaguuguguucccucccuuugugccuguaucauuacaucagcuuuuucaggauucaccauuaaaagcaauauuugcugggaccuuuuaauagauaacucuuuuuugguuaaagaagcgcucuuuuauuucuaguuugcuaacagcuuuuauaaugaauagcuggauuuuaacauauacuuacuuucauucugaagaugaucauaauuaacggugaguuggauuuauaggugguuuguacauagguugcuuuucuuguguuuucuuuuuuuuuuuuuuuuuuuuuuuuugggacggagucucgcucugucccccaggcuggagugcaguggcgcgaucucggcucacugcaggcuccgccucccggguucacgccauucuccugccucggccuccggaguagcugggacuacaggcacccacgaccgcacccggcuauuuuuuuuuuuuguauuuuuaguagggacgggguuucaccguguuagccaggauggucuccaucuccugaccucgugauccgccugucucagccucccaaagugcugggauuacaggcgugagccaccgcgcccggccuuuucuuguguuuucuuguguuaaaacaccagguguauuggucugcugucuuuucuauagacuauuagauuaagcuugcucauaguuuauuugagauuuuugugacuguauuuaugaccaagacuguaauuuuucugucuuuuuuauacuuugcccaguucuuuuaaaaggauauuuauucuccccucauaggauuggcucaggauccugccugcccuuugcauucucuugaagaguuuguuuaaaguugcaugauccauuaguugaaacguggcugucgcugccuuuaaaaugauuuuugugaaaagauuuuaaaguauuaauucaauuuaguucaugauuauaggguuaauucuguuuucuauuuauuuuuugucaacuuuggaauguuuuucuagaaaugugucuacuucauguaaguuuuaaaacuuacuggccucaaguuguuccuuuguauuuuuuuauuuuuuaaaucucugccauaucugaggcuaggugauuaaacuccuaauguuuuuuaauuugugccuauucuuuuuauuuucuaaaucacucauaacagaaguuugucuuguauuggucuuuugagagaaucacuuuuuaaaauuauuuugguguauaugaguguauguaaugauuacauuucauuucauuuauguauuaucugcuuucaucuguuuucuuuggauuuguucuacuguugcuuuucuaauuucuuaaagauauaucucgucuuucaguucguauuauuauugucauaauaaguauuuaaggcuaccaaguuuccucuaauuauaguaaacagaaucuuacaagauuuuguauguauuuuuuucauucuuauucuuuuuaacuguuauggcuucuucuuuggcccauagauauuuagaaauuuuuuuuuuuuugaaauugaacuuucuauuguagagaauuacaggcauacccagcgguggggagagcagguggagugagcccuggggcguggucagguggcuuaggccagggcagucccuccaguacuugcguuuaggccucccucccauccccagccucucagucuuucagaaucagaccccagucaccaugucauuucaucaauaacauucuagugccuagcucucuaaaagauagggacucuuuuacugcauugaugauguacauauuuagacaagaugaaccauucuuuauuauuagcagauuuuuacccaauguugauauaucccugaugguguuuaaaaucacuuuuuuaguuugugguuugacuuuugguaccaggagucucuggguccaagcaguguucauacacugugauuggcaccugucaugaaguccucaguuaaucucuagguuucuucuuccuaccuuuuuuuuuuuuuucaguccuugagauuuaucuguugaagacacuguauuguuugucccacagaguuuuccuuccuagguucuaaauuuuacuugauuuuagcccugucaugucauuuaaaauguuccuuuguugccuggauuuccuauaaauuggcaguuagaucuagagguuugaucagauucaagcuugguuauuuuugguaagacuuuauagaugcaauggugcaccucuuuugggaggcaaccagccauacccaugugugugugugugugugugugugcacguaugugugcauguauauaacagccguauuuuaaaacauuuauuuaauuacuuucuuuuuuuuugaggcagguuuuugcucuuuugcccaggcuggagugcaguggugcaaucucagcucacugcagccucugccucccacgcucaggccaucuucccgccucagccuccugaguagcuggaaccacaggcaugcaccaccacacuuggcuauuuuuuguagcuuuuguagagaugggguuuugcuaugccucacaggcuggucuugaacuccugggcucaagugauccaccugccucagccucccaaagugugggauugcaggcguaagccacuggguguaacuaacagccauauucguuauccaacaaauuauuucuuucuucuccuuaaaauucuuucugauggauccugccccaaccugaccgcugcuuuggaggugaugugcuuuauuccuggcaguuaaggugaaacguuacugcaugagcuuaaaaugucuaaagucccuauuuuaugucccugaccucuacaacacguggguuacagacacuuuaacacugagcaccccuuccccauucaccucuugccguucucuacuauuuaaauuuuccuucacuucaaccccacaaguuagguaaacuucuuccuucuuccuucuuuguucuucucccucccuccucguccuccccuccuccuccuccuccucuuccuucuucuuucuucuucuuccuguguuguucagaugaagucuguuuagauuucucuccguagcccccaguucuuugcucaccuuuucuucccucccccuuucucugcccaccuccauguuguugauccuccccugacugcuuccuggugaguuuuuuaaacuuucuuaguuuucagccugguauauguuuauauccugagcuuucuugcagaauagcuucccugugaaugcgauucuagcuugacaguggcuuucucuuaguucucagaggcucacugguccuggcuucugugacugcauuuccuuuguuggauaacguugcccauauugcggggucuucugaacucugucucagcggucugcuguuucgcuuugaaguugucuugauuccauucugcuuuuucaugcaucguugugcuuucugugucuguagaugcaugucucccaccaguucuggaaaauugucagccaucuaucuucaaauauugccucuccagaguucugacaguauguagagguuugcagcucagaguacagacucuggcaccugagucccuggccuaaauguaggccuugccaccugccagccacgugggguggggagaccaggccggaaggaugagugccugcaggaguucagugcugagggacagaggcggcucggggacgggggaagguggggaggcccuagcaaucagcuuugaugacaggugggguagggaggagcacagacaccuucccugugacauugaguuagcucuuugacccagguagcagggguuagcucuguugggggcaauggggacccuaagaggcuuuggugucugaaaacagaggaaggggccaucagaggccccuccguggucucagcaccugcccugauaggagcuccagaggauagacuuggggugcccucuguccuggaggguuggaugcaggguugaaaccugacccauucccagggucuggcuguugaagggcgagaagcggcagacucucugugccaggcccgggacgccugguccaucccuaagcccuuccugagcacaccucaguggugcagcccuccacggacccucuuuucccugaaagcagggguucuugggccagcguaggggcuggcagugcagauggcagacuguaagggccgguuucacuggacgugauccgaaucagagcccucugcccauuucccugggcccaucgcagccugccugccagcuaccugccguuccugacauucugccugggaaaucguguuuguguucccgaacccuccgcaguacagacaccuucccuacggagcccuguguauucagggugccuuuucuaauaaagcccaggccgagucaccacugccugaacuggagggcccguggcccgggcacaggggccgcugcaucguggucagcauuguggucggcugucuaucugcagucacuacaccugcacagcauggggacgccgggacacggccggccagcaggaugcccugcgcagagaggagcucacagguucacagaagccgccaggcuagaugcuuagaaaugaggacuccugcuuuacacaggaauaugagguuuaccagaaucugcuucauuguucgaauucucuucccuucauucuccuacacuaugaagagcuuuuuauuucccuuggaagagagagagcucgauggaugcauuggacccggacuccuaaccaggagcugugggaagggcgcugaggaaaugaaagccaguguuucuuucucccucuucaguggagaacaaaucagcuccuauuuucuuggugccuuaugaagcgggaguguuucugaguccuacucgaauccauugaagcugauaauuccauuuuagugucgugucuguguuaguaccucgcagucccucaucuccacugcuuugcauacagaagguuuugcagacugaggaauccccagccagggcugggggugagggauggaggcugcagugaagucuuucccuacuggacuaugggucagggaugggcaacugucuguggucgccuuggcagucaccacggcagucaccacacccuccuuuuacagaagacagucagaccguggacguucaguucaugcauguuuuagaacccaagucuguuucaguuaaagcgguucagcuucgagaccacaggacucauacugguuagugauccuggagggagggaaaggcagguccuuugguuucuuucuuauauccugaaaguguaauuuuuguauuuuccaaugagccuucuuggcuucuaguuagaguaaaaaauggaauuuucuaaaucugagcacggucaaacguauuuuuauccuugacucgugugugaagcugacacugauuuugcuagaauaauucuauuauuaaaaagggacagggaggauucuucccaggugcaccuguguccaccuugucugugcugggugggcacccacuugcuggggguuuggagucuccagggcuaggcauccacacugggcuuacugagcucuuccccuugguguuucccgcucucuugcuggaccaguggacaggucaggcccuuggccuuuucgcgguagcuucugccugccacccuauggcacaggagcccugcagggcugugugccuguagggcugaggcuccacucagcgcugccagcacccaggagucugggcuugcugccugggcugugcugcaccccguagccuacauccaggugcggcgaucagucugcugcugcucaggcggcguggacaggcccuuccuuucuugucaaugcucuuugccuuccuggugcucaacuaacaggacaugccaaaaccugcagcccugcgcccuccuggacacacucguggcauccugaucacuggguuuaucacccugggugaugaaaagcuuuuucugggccugcuguuuugucccagaaguguguggagcucaugaggucaggggguacagcuccaucgaggaagccuugccuugucucuccuggacggugauucuccauguugcauggcccugccaccgccccucccgcguggagggugcauccugucccugugaugaagaccagccacacccaugccagcccuucucccagaguccuguguugaauaccagccacacccaugccagcccuucucccagagcuccgguugcccugcaacaagcagacauccugcugucgccccgauagauggaggccaggguaccuucuccagagucaccccgcugggucugaacucacaccccacccaagucuacgccccguccacugccccacuuugccugucuccagguguuaccuguuucuucucgugucuuaaguccacacuggaaauuuggagagaccaggucuuucuaucugaguguccugugagacaaccuaaaaggagauucuggguggagauuacucucauuaggcuuuccugacaaauaccauccugcagucugguacuggagacugcagagcuuccuacuauagguaguccccaucuuacgccaguguccccucaggcugguuccaagguucguggaugaggugagggcauggagacagccagcccuccagcagcacccgcucgccuucuccaucagaauguucucggguccagcagacccggagaagcccugggaugcuggagaugccugcagggggguggaggcuggggaaagauccugccaacugcagggaccacccuucucaguggcacagauuugggcugaguucauaccuuauuaugcaugcaucuacuuagacuuuuuuucugccaguaagaaagcaguuugaaaacguagauuuggaaggugcuuugaguuuggugcaagugaaagccgauuuacauaaaaacaaaaacaaaaagacaguggaguaaaaugcacaccugguauuaauuguagcuuuuuauuuuuagcagugaaaauacuguuucaggaaugugucguuuccaucucugugcucagcaggcugggcuuggccgggcuuccccucucgucaccuguuuuucuggugcuguugagaagggagguggggccuggcugugccucuggggcuguugucucggccuugagcagcuuugugggagcagaucuagguugcugccacagccccaggagcuuuuuaggaaaaagugacuuuauucacggagagcugugggcuguaggcucucagcaaauaguaauuacaggggggccuggccuuuggucaggaaugaaaccaaagcccaagccacacagagcaggccgaggggucgggcaggcccccagugcuggcuuuggaagaccaucgacuccggagcagaaguucugaggccucagggaugcuugggucucuacggcagguuaggacccaggcccucucauugcucccaaaucccuguguugcugaccacacccagccugaggcaccccccugggugaccugugagcuccccauaacacuccuucagccccugauguuuccagcaagaccagccuccucucacuguucagccagguuaggaugccaggguucugguuugcugugcacuaguguguggcccugggcaagucacuuaaaacugucuguacaucaguuucccacaccugucaagcggggugucccuuaaaugaauuaauacaucagcacuaaaggccgugggccagaguucaccccaggcccugugauuccccgguagugaagaggacaaggaggcaggggaaguuuccugugugggcccucucccaccuccugcucgagcgagcagucuccucugcugcaguucucagggagccugaagagcuccaccucccuucuuuucuagaaggcuaaagcgcagugccauccaggccuggccaugugcugcagcugccuucaugcuagaacucugcaccgagaacgccacuccgagcacggcgucgaaugcaaucugccugugacgcgucucucucccgcccagccccacacagagaaagccuccccugugcacauccauaaauaccacuguaucuucucuuugcauuuauuucuuuacauuuugauuucaauggaaagcaauacaaagcaccuucuucuugcaccauaauauuuuuuauucuuauuuuucaagcauaauuuaacuuacagugauuguuaacauaagcuuuugucuuuggcauugcauauauccaucuaaaugagagaaacagaaguggcauauaaaaacucaccuacauacgaagcuccaagguagggccacuuaaguuacauguuaucuacagaauauuuuuauaucuuuaccuuaaagaauacuucuacuuucucuaccucgucucuacuuugcgugcgugccccuccccaccaugguaaauacaacaguugcaauucaguuaagaacacugggggaaaaugacaucacauguaagucagcguuuggaaugggucucaguuaugaccguucaggcguuugaaugucagcuucagcgcgaggugcucuccauagcucugaggagggauggcaggucaaacacgcauguccgucccucaggaaauucacaaaaacgccaguaaagaucgauaguucguaagucccaacccaauaacagcgcuuaccccagucuccagacuguggucucuaagacuauuucccaagaaagggacccacacaggggucaagaaauguacaggaagagggcugggcgcgguggcucacgccuguaaucccagcacuuugggaggccgaggcagauggaucaugaggucaggagaucgagaccauccuggccaacacggugaaaccccgccucuacugaaaaaaucaaaaaaauuagccgggugugguggcuggcgucuguaguagucccagcuacucggaaggcugaggcaggagaauggcgugagcccgggaggcggagcuugcagugagccaagaucgugccacugcacuccagccugggugacagagcgagacuccaucucaaaaaaaaaaaaaaagaaauguacaggaagaccccaaagcaucugguagcagaacagggcgcugcucucagagagcacucacagggucuggagggccgcccgauccaaccacggggcuccugcucgucaaggacaggacugugagcauucguaaacagugaccggaaaacacacccuccucacugcucgaguuuggaggcugccacgagacccacucaggauuuucagacaugggcaaaccgaggaagagaaucaagcaugacacugccuuucucauaagcgcuguuugugagaguaacaagauaguugaucuuggauuccuucccguuauagaaaugguccugcuaacacauggagaggggcugaugggacucgaagagcucuguuuuuaacccugaugagagaaucuagucagugaucauuuugagccuucgcaacacaaaaaagccacccagagagcagggguucgccuuaggccuugcugggaagucuaagcugccucugaccaggccucucggugagcacccagcuuucagaagaacgggggacagagccuugcucgucagcaccaggguguaaucagcaaagugcagaugacccgaugucuucagcuaauaaauuaucggggugggggugguggggggcaggaagcaggaggucaggggaaggggucuuaaaagauacaucagcuaauuacaauguauuuggaucgugauuugaacaaaauauuuaaaaguguuuaugaaacuauggggacacuuucuggcuacuucauaauauuacagacuuguccauuuauuugcguguguugauggcauuugauuuggaagucuucgcagugacgacuggggccugcuucccugucaucuagaagguggggaagugguggaugagcagaggaccugagaucggcuugauuacacuauucuucaugcuuuuguguauuuuuggaauuucucaugaaagauaaaaauauauauuccagagaaaggucauaagcucacaaagauggggagaacagaagaggggcgacacgaaugagagccuggcaacugacagcaggugacagagucacagcgauucagcagacccaaaaaacagaucucagccaaccacgaggagcacugagaacucaccagauggaagcugcgcugccacaaaggggugcucuccagcgacuaugauccugagcgccucugcauggggacaggagcaagcugaggauguggguacugcagcaagaacggggggcuagucacuguguccacagcaaacacugaguagggggucccucccuugguacacugaaggcccagcucucacccucuagucccaggauggagaggcgccucucguggacaguaggccagcccuaggggaagguucucugggcacugagccaggggguuccugaugaugccaccuccagucacccuccaugaagccuggcauugagaaccagacugugcccacaguuggcaggugguuuucgugccuccacucacacucggcaacacauaaccaggggcaaccaggcaccugaggggaggcuuuugcagggacgguggagagcaaacagagacuccacagggaaaagaaaacuugucaccaggcuugguggcucaggccuguaaucccagcacuuugggaggccacagcgagaggaucaccugaggucaggaguuugagaccagccuggccaacauggaaggaagggaggaagggagagaaauuagcugggcaugguggugcacaccuguaaucccagcuacucgggaggcaaggcaugagaaucauuugaauccgggagguggagguuguauugagccaagaucgcaccacugcaguccagccugggugacacucagcacacacacacacacacacacacacacacacacacaaacuuuuagugagcuaucauuacuaucuucagagacuagacaagauauuuuaucuaggaaauaugaacaggaugacauuuuaaaaaaagaauauccaggguccauuguccucugaaaauggcuguuuuauuugucaguuagaaacaaaauagcaaaaaucaugaaaccucauuuaaaagguuagaauauacauuuaaggaaaucacacaugaagaagcguguaagacaaagacaaggaaaacagggaggauggaaaagacccaguauuguucugggagaucuccuacucaagggguagaaguuccagaaggagagaaugggaaaggggaacccuugaugaagugcuucagggagcccccuacgaugggagcacgggagcugccgucuccaaaggaccagccaggcgcccagcagugggugugaaaggucuucaccaaaccacacggcuucgaaauuucggaacgcugggggccuggagaagaccuuauagauacccggagagagacaucgagucacacucaaggugcagcaucacguggcgcccauuuuccugacaguacugggagaggaagacaacagaguugcgccuucagaaucccgaaggcgaaggauggucuucaagcuggaauucuauacccagccaaagucaggacgcgugaaggggagaaucgacacguuuucagaugugcagaacuuacucucaugccucccuuuuuaagacacagcuggagccugaguucugcagagugagaaaauaaaccaaggaagacgauggcugggacaaaggaagcgggagacuuaagguagggcagagacagagggaauccccuggaggaguuggacccguccaggccagcagcagugcagacagagggagcgccugcccggggugaguggcacagcuucggaggcagcgucugggccggccucaccagacugccugccucgcugccuaaaccugaggaugcaacacucagccgcuugucugugccugaccucuguugaccacauggccccacucucucuuccuugccccacugccucgauuccccgaggucacucauuucuccaagggggucuucugcccaguucccaccugagagcuggagguggccaccauggagggcagcucaccccccagaccacaccuucuggcaccugguucugguccacaugacugcccugccagauguuagacgggguguacuugguuuccugggggucacccguggcuucaccccagaagaagcucugguccccugucccagaagcugacggcagacucggacucgagacuguccugucccgggaaccaucgucaacuccuccuuccacugcacugguguugcugccuucagucuucagaaagcaaaggacguguuuucagggccacauauaugcagauguuauuaucauagcaaagcaagaggacacuuaacaaggucaggauguugcucacgggguagggggugcaugugguuugaagggacgcagagggugacguuugggccucauugaagcggaggaugcacuggugcugguuucauuacuguucuuuuacuaaacauacuuguucuucagcauggauggcacacugcacaauaaauaaagggugaaggacauuguagcuaagucaugcauuucugaugugcugucucccuccucuucugucccauccucucucuuccccccacccccacauagaggcaaaauaucaguguaagaggaaaucaugguuacauaguugaaauaucuauuauuuuucccuugauuugaaugagucauucuuuacuugaagagacccuaaacauugacuguguuaccuaaagaauagugccucuuuuucuuccauaucuguaugauggcaugaaaucgcguccugagaagaggaccuaagcaugucguggaaaaucaguaugcuucuuuaugaacauuuauuuuaaaagagcgagagagagagacuaacagguuuuucuguuugugauugagaauucauucacagcacacugaccgucucccauuggacucugaaugcggccuuugugcucucacugacgucaggagucugauugucuuaauauguuucucaaggcacaaccuauaaaagccguuuucugcuguaccguagaauauucaugagaauacagacuuuuuuguuuugaugcugcauucuuuaaggagagaagguuuuauuguuuucuucagggugcuuugggucaaaagcacuagcagcuucuguugggaacucguggcauuuugaaugguuuuugauacagaaauagcacaagucacgucugacacagccguaggcgcacgaaugcgugaaugcgauugugguucucaucucugcagcugguguguggggccgggccugggacagcuugggccucauccccacccacccggcucccaggauccucauuaggaagcccucaggagcccuggggugggucuccuugcccugugaacgcuccauuuguguuauugaauccaacauaaaugcagcauugucuucagaggugagcaauggccguggccggaggugcgcaugggaugcaggcggcgugugcugcuguugauuuucucugcucugcucuuagcuuacuuuagcagauaguggaguuucacguggcaguccgguaaaccaaggcagugugaacaucccuuccccacaaugagugaaaaugcaggaggugccguagugagaacagcgacagcauucugcgcauuggugagcccgacuccccagccucggugcccaccgaagcccccucuggcugcacugugccagugaguccaggcuccuucucagcagaagguggcugcucugcagggccccucgccucccugcuccucaggggacccgcacucuuccauguccguagggagacgcgcaccgagcuggagacacagaucugcgaggaguaacuugccucucucaccagcacugccaggggcggaucagcgccagcaccuuccagcaugcgcuaaacugcuggagaagcuggaguggcuggaaggagcccugccugccugcccuccuccuccucaguugcuggccuuggcagcucuagggugacccagcaggggccuggaggaguaggaagcagcuucccagcugcagucugcaucauccucucugugcugucacagaauggaagguuuuagcagaaaaaggaguuuguaagcgacauucagaagauuugggcagcaguuucuucccccauaggguccugucuuuugggaguggggagugcugggccaggcugcucgcuggcuguuucacaggugguggaauuuaagagcagacuugggucgagcugugaccguucaggugaugcacgcacaggagguucagcugugugccugugaggcgggcaggagcgucacccaagcuucagaagagaauuccccggcagcagcguggcgcucagcauguuccgugucugacuguuuugauugucucucaguccaguugacaaauuccuuuuaagaugaaauuugaauuaauuugcagaacuuguacaaaucuccaagaaaacagcuuaaggaacagauuaaagaaugaaugccuuaggaauuaaagcauuaauagcucuugaguagacuggauggaaagaugaguuguguagguuauccagaugaggcuacauccagggagcaauucuuaccuucagagggcgcugccuguccuccuuggcauccaagugagcgcaucuccuccacgcucaaugaugaaugcuggccggcaucccugugaggaaccuugugaucauuuuccauuucugaaaacucccagguggugggggcccuuggcccacaucagcauugaccaccccgggcucagaucuggccaggugccugcguugugaugggaauuucaguacacugaauuuugccucugacccugaugaaauagcuucgguggcauuugcaucaagaucauguuagugucaucucuauuagaugcuuuggagcaaacaugaacuuggguuuccuuuuaagauguccugugauuccagauucaggggaaucugagaaaaguuugaagaaagaaaauuccacucggccagccaaccuugggugugcagagccugccccgccuuccccacuuuguccugagaagcuggguccuccccagcaccagaguugcugcugcuuccccucgcgcucuuggcugcucucccggccccaagccugagugacacucuaggauugcagauggcaggcuggucucugggcucccccguccccaugacccuccaccugcacccagaccucuggguccuugcucaggcagccccugcccucggugagacgcagcccacugugggcccuuccccugggccugccaucagcuccugugcuccucggcgccccagcggcugcccugggcccguucccacagcaccuggcacacagcaggagccaugaauguucuuugggaacugaaugaggaguggaaaugcgggcaugucauguuuuugaaguuaauaaaaaaaaucccuuaaaaguuguuuuauguucgguuuuuaaagagauuaacaccagacguuuacaaugcugcccccucccuccaucugugagaaauuagaaauggagggggaugcgcuaaagccagcagcgggucaggccucugcccagcgccuguggugggacccuguuucuacaugggaccuugggugacagcagcacaucuuauaagcaggggucccacccaggccccccacacagggauaaaugaggcgagacguaggcaauaacccagcuuccaagaugcaacgcugugcaguuacuuauucccugugcuuauuuguucaagcuaaaaugucucuguuugaccaaacagaaagaauaugagagagaccaguuucaccuacaaauauagacaccagcauucuaaauaacauggucguuguugaugcuauuuuguuuuucuaacuuuaucccuuccuggagauaaaugcaacuuuguucuucuacauuauacaaguguaugccuuccccgauggguucacccaugggugcugacuguguaacuuagaagaacaaaguuguguuuaucccuggaaagcacgggcccgcucaccugaggcacucuaggaagucacugcagggcacuggucccaggagaaccgcgugccaaucacagccaugaacgcggaagagggaaccgcaaccugacagucauucacgagacuguguguucaggaaagcauuuagcaccgccgugcuugugagagccggacccguagcccccagugcccacagcagggagcccgccagcugagucuucuucaagaagccaggccccguucucuuuucuccgaguuugcgaguuugcugacuuagcucuccucccugccuuucauauauuuuauuccuuaaaagaaagucugaagcaaauguaggugaacgcugauguuucauaaaaccagcauugcuuacgcaguuuuuccauuuugcuauauuuugucauaaaaaugaucagaaaagggaagaaaggaaaugaauaggguccaguccucacccacauauggggugggggaguggguggaccccugcuuucugcuccugcacauggaacaguccucaccuauguguggggugggggguggguggaccccugcuuucugcuccugcacauggaacaguccucacccaugugcgggguggggggugggcggaccccuacucccugcuuccgcacauugaacacgcaguuuaugugcguagauucuucucacauaauagcaaaugaaaaccuuuuacugugucaaagucgacacccaauuaaaaacuaaauacaugcauuuuaaaaguuggggguugcacuucacugauuuggggaaagaaacagaaacagucagagaggaggauuucauuuaaaaaacaacaauaacaacgaggcagcccgugcugcgcuguggaaugugaucagauauauucagaagcuucugucaccuucuggguugcuuugugucuuuucacuguccaggaaaguggccugagcuggucuucguggccugaggccugggcacuccucagguucaagccaguccagccagggcagccagcagggccagguuaggagcaugauugacugcgguggggcaggggaggggugaggagacagugaagucagccagagaagcugagagcaccccucacccugggcaccaggagcucaggugacugcagcucccacggcuaagcggcaacccagggaucagaaccccaagcuccggccagugcccaggccucccccaaagcauuucccacccuuuucucaggagaaggcugaguccugggaccaggaccuccagugguuuggagacaaagccagugugggaccugcugccugggcagugacuguggaaaugcuuugcacccaggggcagcugccaccuaugggcuguuucacccaaaucgguggcuuugagacuguggagugcagguuuuccuaggaacugaguugcugacaaggccuggucuuaagccaguccagagacgggcugagugucagggugaacgugggugggcugcucucagggaugcaccuggacaaggucacgcccaaaggugcugacccugaggggcgaggagcuguuuucucagcagcccucuuguuggcccagacaccccucugagcuugagacccuccuagagggcaaggccccaccuccccacuuggcccaggucacaugaguguugguuauggggagcuuucugaggggugggccugugggaggggagcaggcaggcugggcucucacuuggacucucagugaaguuuucggcagagucgcgugucugagaagugacgcugggaugucccugggcugugccaggagcagugcuggcucagagugagugccugcacacacugcaugcuuucagaauagggaccugccguaaaaggggugcgcaggucgggcuguuugugauaucuguaauuuaaaccuacccuucuuccuguguuacuuuucucacuuucauuugguauugauuguaaggaaugaaauugauucagcuucuguuccucaucaaaauuacuuguagccuuuucucaauagcacauuaguacagggcagaaaauccauuucuucgcgaggugcagaaacgcaugcccagaggaacgcacuugugccaagagccaggagcacgucucguuggcugugucugguaaacauguuuuccaagggggcgcuugucucaccauggaaacgggcuccgggucucgagcgucugucuggaccacuucuggggcacacgcucuuguggcucucacagcggcacggugacuucgauggaagaggaggaagaggagcaggacaggcagucuuccuggcugagaccuggcgcccgcgcuuuuccuugaacagccacaaccuuuuucuuuauuuuucucauuauuggccucuagaaaugacgucagcaaggccucugggccuguagcgggguccucugagagccggccucccggggaggguggaggaaggaacagggauuguggagugcguccuggccugaccucccaugggcuuuugugguuuuugcccuugaggaaugggccccagaggccucugagucuugcauuuugaguuuguugggcaagagggggacagggggagagggguauccaauccucaaauggucacaaccccccccccgccccgugaagguggccaguguguugggugggggcucuggggcccagggacagcaaagggcggcagugaccggcucuccugcuuguuuuucccacaguggauguggccacggcgcugccucugcaaguggcccccucggcagugcccauggaccugcgccuggaccaccaguucucacugccuguggcagagccggcccugcgggagcagcagcugcagcaggagcuccuggcgcucaagcagaagcagcagauccagaggcagauccucaucgcugaguuccagaggcagcacgagcagcucucccggcagcacgaggcgcagcuccacgagcacaucaaggugaggcgcggugcggggcugcgggugggccaggccuccggcacccucaacucccggugacuccagcccugccuccgcggagugugcuggggccccaggcaugaugcaggguuccugcaggaggccuucugcguugggacgguaacaccaggcaacaaaccgcgggcagcacuugcguguauuguggaggacguggugcugagugggaacggcgguccaaagucauugaguggaagcauauuccaaauaggaaaaaugcuuaucgccuaauuucauccgaaacaugcucagaaauagaaaagcuaccaaagggaagaagcaccagaaccuuaaugaucguugcugggagguguauugacaaaucuguguuuucuuuuccuuaggacuuuucuauauuuucuauuuucucuacuaaccuuuuauaauuagaaaaagauaauauuuucuuuuaauuuaaaugcgguaagaaaaaaaagacuuuuuuugguacuuacugucuacaaauauuuaaucugauaccagauuuuaaaauuaaaucaauuggaaauauguacuagugauauguagcaaaguuauauaguuggcaggcuaguuaugauaucugugauuauaauaugcugucacugcauuuagaaccauuuagagcaacaccgucuaauagaaauauacaugaguauauuaaaauuccaccaguaauuuuaaauauucuaguggucacaguaaacaaagugaaaaaucccacaaaaccagacuaaguuaucuauaucuguguaacaaaauuaccccaacacuuagcaguuuaaaauagcaaguuuguauugucuugcucugugggucaggaauccuggagcagcuucgcugauggggucucccauuauguuguuauuaagaugucaggcagggcuguggucucaucugcaggguugacuggacugaggcgggaggagcuccauucaggcucacucacauggccgcaggcaggaggccugagguccucauccacagggcugcucacagcauagcagccagcuucccagagggagcaacccgagaggaagcauggccaacauggaagccacagggucucucgugcccugaucugggaaguggcaggccgccaccaacacugcugcuguuguuguucaugcuaagucuuggcaagccacugggucgcacguagggcaugucuccauucaggccagccgcauuucgagccacacgugguucguggcaacuguuggacagcacagauguagggcaucaaaagccuaugaccguaugcaaccuggugcuucugagaugcucacgugguccauggguagaaguuguucaccugaggucuuggcuaccuggcauuagcccacacacagauauuagugugcccaccuagugugcagaguagcuuaggggugcaucccucuguuucugcccuagcugauaauucucuugaccacaggaucccaguuucccuuccuuuauauguaagacacuuuguucagugucuuuauuucauaaucacugucgagaaauggagguaaaguaguaucaguugucuguagacuuaguggcagauugugggggaggcugcaucccaaagcugggcuggcccuggaggacaggcucagggacagcuccauguccccucucaugggugccaaaccauucugugagugccugugcuucaaaggugagcccggagagcucuguacucggcccccucuggccuugagggaacgggggcugggagguuucuggcuggacccugaggggcugcuugcgggcucugggucuuuggacuuggcaccguugccuuggcauuuguuggcuugggaguuguugcugcugcuuuuucccagaugcaugggccugcuaaugucaguguuugacaaaccaaggagaggacacuuuccugagcucuugaaguccaugcuuuaucguuuuugccuucagauuucagagcgaccuagcagccguguguaacaaacacgucacuugucccuguggagauuggcccaccagccuccacuggcacccuguccacuuuaacaagcacacucgaguuuaggguggggcaguugagagcuccacaagcaccauacccuuugggaucccugugauccugacacuccuggcaggugggacaugagagaggacacagucuucacuuuacugauggcaccacucggugcaguggacaggccagucuugccucccucacggcccugaccaugggcaacugcagcuggccucuguuuuucuggccugggagaagaguuuucaagcuggcugcaggaaacaggugcaugccaggcagaaggcgcggguccgggggagucacugcaggcaaucccugcagccugcccagggcuucagcucaccagccuuuccaugaucugcgaagagcagcccucaagaggccacucguuuuauuuaguuuuugcgccauaggcucacauucuaugacuccuagaaguaauuuuuuaaaaugaguaccguagcuccuucguauucugcauguuggcaaccccacaucaagcccgaggacucccugacagcagucuugacccaggcacugcccugugccucucagaagcccccgucggccauuggucccgccugccucggggacaugaggaccacucacucacuccggcuucccugccuuccugcaggccaacacagaugcuggcugaggauggccucaggggcuccugcugaauuccauuuuuccuguugucacugcacccuggugagcccugcaguccuugccguugauccaccuggagcauucacagugcaugauuaggaccccaccccgaagccgccauggcugucggugcagagcgagguuaaagagaugggauugcugaugucucauuccgugcugguugaauuuguagcuuuuacaagaagacgacguagaugagaagcugagaaguaagccuaagccccguguguuugacuggggcuccucaagguaguccuaggaggccagaagacauaaagaagacacuugaguuggggucagugcugccaucucagggugaggccaggucucaccuccagaaccccucugccucuccucuucuggugccccaggagcuggcuucacugcuuggaagagagcaccccgaccccaguccucacgucgcuccuacaggccaggccuucaggccaugcuccucauuccuggaggggucccugggaaagcccaccccaucacccucugagagauggccagagaccuuagaaccauggcucuggagccagucucugggccagggucucaaaagcacagaaagaaguucaagguugccuuucucuuugcauuuuaaucauuuauuucuucauuaaaauagagauuauaaaagccauuugaacuacauagugguuucauuacauuaggaggcuuuuguuuggaugauuuaaacucucuuuauaagccaucauauuguuuguuagugacauuuggcaauaguguuugucagacagauuucuugaacacaaaaucuaauuagugucauuaaaucaucagugaauuugaauagaguuuuauaauugaaaagggagucauuuuuaaaauauaacuuaaauuauuaauguuggguaaauaggaucuuuuaggagaauuuuaaugcucgugguccccuuggacuuuccgguuuccuggcuguuuguggugguuuagacacagccuugccucuccuucucggauggugcuuuuccaccaagaagcggaucccagguaagcguggaaguucucucuugcacuucuguguuuuuguuuguuuguuuuuugaggcagucucgcucaacuguugcacaggcuggagugcauuggugccaucucaguucacuucaaucuucgccucccagguucaagcgaugcucaugccucagccaccugaguggcugggauuaccagcaugcaccaccacacccugcugcuaauuuuuguauuuuugguagagauggguuuuucccauguuggccaggcuaggcucgaacuccuggccuuaagugaucugccuguaucagccucccaaagugucagguuuacaggcgugagccacugcgcccggccucucucuugcauuucugaucaaugccucccagaagaauauggagaggcaggacacaaacauggauacccagagaggguccaaggacaggccacgaagccauggcuagagcaugcuccaggcuggugagugauggagcaggggcaugugggagaccccaagcacaagacugggccccggcacccaccucagggugcaucucuccccaggaggcacagggcaccccccacacugugcaccucucccuaggaaacacggggcacccccugcagggugcaucucuccccaggaggcacgggacacccccacagggcacaccuuuccccagcaguuaggguacaccucuccccaggaggcguggggcacccccugcagggcacaugucuccccacgagacacggggcacccuucauagggcagaccucuccccaggagauacagggcacccccuuuagggcauuccucuccccagaagacaccgaggcaccccuauagggcacaacucuucccaggagauacagggcaacccccaugggggauacaggcaccccauggggugcaccucuccccagaagacacugggcacuccucccauagggcacagccuccaggguagucaccgagggacccacccauagggcacagccuccaggguagucaccgagggacccacccauagggcacagccuccagggcaggcacugagggaccccccccauagggcacagcccuccagggcagacacugagggauagcccuccaugauagacaccaagggaccccccccauaggacacauccuccagggcagacacugagggaccccccaccauaggacacagucuccaggacagacacugagggacccccccauaggauacauccuccagggcagacacugagggaccccccaccauaggacacagucuccaggacagacacugagggacccccccauaggacacauccuccagggcagacacugagggaccccccaccauaggacacagucuccaggacagacacugagggacccccccauaggacacauccuccgggacagacacugagggaccucccccauaggguacaaccuccaggacagacacugagggaccccccaucauagggcacagccuccaggacagacacugagggaccccccccgauagggcacagccuccaggacagacacugagggaccaccccauagggcacagccuccaggacagacacugggggacccccccccauagggcacagccuccaggacagacacugagggacccccccucauagggcacagccuccaggacagacacugagggacccccccauagggcacagccuccaggacagacacugggggacccccccucauagggcacagccuccaagacagacacugagggacccccccaccaccauaggacacauccuccaggacagacacuuagggacccccccauagggcacagccuccagggcagguacagggcaccuuuuguauguagguugcacaucgcccuccugcaaggcuuacccucucucccugcacugguguaaggcgugccuuuucuucccuaacuucagccuauucccagucgaaugcaugaagaguaaaaaucauuuacacacuguuuuaguggcaugucuuuuuuuuuuuuuuuuuuuuuuuuuuuacacuagcaaggcuggccucuuuuucgugugcuuguguguguguguguguccaugugacuugugcuauggagagcacaguggauaggagagaguuuucagagcuguuuaguugauagugugacucuuccuuucagggaggaacuaacacggaaaggaaccuaguuuucuggcacugggagcgugggucaugauccuuauucucuuuaauaccuggccgaggaaggugaagagauguugcccaggcccagcuuucuggucaccugaggcagcugucagugagcauuagagcucaccugagcugugccgaaugccugauccagggcucugcgccaggacaggggugcgguggggaggcagggggcaggagcacacucuugguuuggagcagagucccucuguggugccucugggugaagguuaagaauagacgggaagaccucgugcacaccuuugcuuagcaugagcugccucccaagcuaggcagaggcacaugcacguggcagugggcaguggggccaggugacacauagggcacgugggcacacaccuggagagccauggaugccguggcccuaccccagcuggucugcaccugguguucccauccaugggcggcagcuuaccguccguggcguccauucugccgcccuuuccuccuggccccugccgcuuuaugcgggcgcggcaucugcccacucuggggcuguuccccuggcaaguugaaaaagagacacaagaaagucaagaguuucguuuuaaaagugaaaaucuuuuuggguuaccacuugaauauuuguauauuaaauucugaagucagagucaaagcagcuaaauucuggggcuccuauauuugguucagaguucaguguacgcuuaacguaaacuuaaagucugguuagaguaauaggaucagcuaugauugguuuuguuuuugcuuuucuuagaagaaugaggucguagucaucuuauuuuaaauugcucauuauaguuucagucugcaaaaaauugcuucccaacagcccuugccccauggaguagucugacguguaaaguuagcgagggacuaguugcagacaauuuuagcuaacuuaaaaauaagcgcaucucaaaguccuguuuuucgaagccugaauuugguauuccagugacgcaccugcccuccagaagccaacugaggguucccauggagaauaaguaccuauucacgaugcuaggauguggggcaggagugaagaagagugaaauggccaucuucccuugugguuccagcauuuuccgagcaugccgagggcagagggucccugugucuucuuugaagaucaagaaacaggccugacgucucagcuugugcuaugaacagggaguguugaaauccaguuuguccugauggcuuucacuuugcaggcuuugcucuacagauaaucuguuauaaaucuaauaagguggaaugccucccuacaaguagcgaagccgagaucacacagcguugccgggggcagguagggaaucagucacuguuugugacugcugguuucauuaaaacuccaccacagucauguuucugggaguuuugccuuccugugaauuuuaauccccagcagccaugguuguugcuuucauucuuuuugaaaugaugguggaaagagcucacuuucccucuggguucuggcugacaaguagauacugugagacugcauuaggcugcaucuguccgcucugcguuuccgcccugagugagcucugagcagcgggagggagggagccaaggggcccugugcaggugacagccagaggggaggggcucgccaugacgaggagaucaguucaacaaaggacuguguuuguuuucugagcugagaagcaccccgaagcccuguggguuguauguuuauagguuaaccugcugguggcauucccaaucugcagacaguguggcccagggaugcucucggggcaccuuucccuguguacacagcuccggguccccagggcagaguccugaaucuguacaugcccagauguuuguccugguagagggacuuugcuugcauguggcggcaaggaacaccgcguuaggaaggugugcuccagguaguaucucccuagccuugagggggccugauuuuaccuuaggauauuuagugucugcaggaagucggcgucucuaggcgacaucuuucaaaagugacgguuugaugacaaucaggccgcacggaggcaagcccagaccagcucuucugaguguucuccccaugccaccucuuccaguccucacaggaacccuugggggcaggugccacauuuaacccagcacggagagguuaaauauuuaggugcaagugcgcuggcagcaagcagguggguggagcagguuuuaucagccaggcagccuggccugggcacugcccuccagccagcgugcuaugggccgccugugagucuucggaggccagcgcugcccugaugaaggacacggcaagagcuugcuuauguuuaucccaccauccccaagaaguucauuuaaguugguuguucggaauuaaguuuuugccaugggaaagauacaggugagaugcuuggugugugcagcuagcccugacggcccucccugccccuccugcgcacacgcugcugccgggcguggugggugcccccucucccucggcccacccaggccuccugccuugccugugcccacacaucugccaggagcagcaccccugcuggaaggcaagccugcauugcaccugccuggguagggucuugccucagccccuccucuccucccuccuuccuugggugugggccuaccuccugccaccucugcagcucuucuauccccgugcuccuggcuggaauugagucccaccccccuugugagggcuguaggugggugggcguguuuguggacagggcuuuucaucugugaggagagccggcagguccuguccccaaugucuggaugcugaucugcucucucugcugcuguaaauccuugcugugugugaccacaggugugacugggcagaccugccuagagcccgaggucccacugcccuggacuccaagcgauuccuguggggcucugccauccaggccacuuccgcugccaugggacaguggacggggaggcuggcugugggcugcaggcugcaaugacccagcccaggugggccgggaaagaccagcgcuguggucuccguccuggaggcuggggcagccucaguccagagcuaucugcuggggucacugcaauggggcaggcgguuucugccuggggacucuuccucggggugggccauggggggcagcggcccagcacacccuuccauccacauggggcacucaugaggggcaaucauguucauuuugcuuguucacugccagcgccaguuugagguugccgaaugccauuugguuggccaaugccugucucugucccuugucugggcugggggcuuuacuuacagaauggaagaaugaggaguuuuaccuuacaaaauuacacaguugauguuacguuuaacaucguggacacaaugugauucaaauuucacacaggucacagacaugcggggugacuggcaugucucaucuugaguaggaagaggcugugagcaagcugaaauccuuucuucccuauuuacaagugguucuggguggucguggaaaccggcugaguccucagcagugggaagcgagguccaggaacgggauugaugcccuggugaggccauuccucauccccugcaccgccugugaccaugaaagggcuugggccaggcuguuuuugcaggcuggaucuucccagaagccuagggguuggaaaggugugugugcugggugcccgggggcugagcuggaccuccaggcucucgcaggagagggugugguggccaccuggaagcuggcugugcaggggcagcaagggugugaagcuugccagucggcucgggccucucaugugaagaaggacccagcaagaugcaggagauguucccggacacacaccgccugcccccgucaccuugccaacgccgcugaagguuggcgcccacagagaagggcagcgcccuugcacgcucacaguuaccuggagcacacaugcucaaucccacgcgcucacucacauucagaacgcacacuugggugcacaagcacguugaugugcagguuccuccgugcgggcagcccuguugucuuggagcagcgagcccuguagcagaaggcuugugccgccucccacccugagcacgccgcgugggcucucaggcuguggcaccucagggacccagccccccaucccugcuggcccuacucugucgggguugccucugcccguccgauguaauccuuuucaucugcuuuccuaccccucagccacuuuucauuuuccuuuguuaucaccucuugcucugaagugaugcgcauuuguuguagagcggcaaucggucccgaccuuuuuggcaccagggaccgguuucguggaagaugguuuuuucuguggacaggggugggggacgcaggagaaugguuucgggaugaaacuuccaccaccucagaucaucaggcguuagauucucauaaggaccaugcauccuaaaucccccacacgcacaguucacaacaggaucacacuccugugagaaucuaaugccaccacugauccagcaggagcuugagcucuggcgggaaugcucccuagccugccacuuaccuccugcuuuguggcccauuuccuaacaggccagggacugcugcuacccguccacggccggagguggggaccccugucguagagggauugaagaauacacagggacgacagugugacguggguggcaucccaugggcgccaguccugcugugccagcgcagccacucauggagcacaggcauccaguggcugccucgcacgcacaccccacucuaugccucaggcguccgguggcugccucgcacgcacuccccacucuaugccucgggcguccgguggcugccucgcacgcacaccccacucuaugccucaggcguccgguggcugccucgcacacacaccccacucuaugccucgggcgucugguggcugccucgcacgcacuccccacucuaugccucgggcauccgguggcugccucgcacacacaccccacucuaugcuuugcucauccuuucccuggccugagccucauccuccaggaagaaucaccagcugguggaagccccacucuggagccagcccggagccccugauucacuaaauuuccuccacagaaaguuccucgggccacucugguugccaggaugccugcuuaucccguacccucucaccguccccucuuccuccauaaggggagcaagaccaacaaaaagcaacccaccaguggccgggugaggcagcucacgcucguaaucccagagcuuuaggaagcuaaggcgggaggaucacgugagcccagggguuugagaccagccccagcaacagagcaagaucuuguuucaucaaaaaagaagaaaacguaucugggugcaguggugugcaccuguagucccagcuacucaggaggcugaggugggagaauggcuugagcccaggaguucgagaccagccugggcaacauagcaagaccccuucucuacaauuuuguuuuuuuaauuaacugccaucuauuugggagucugagguaggaggaucacuugagcccaggagcucaagcuuacagugagcuaugauugcgccacugcacuccagccugggcaacagagcgagacccuaugucuaaaauaaacaagacacugggacaagagacaacugguaacggaacaaucacuggggacagcagacagaccaugaccgggacacgugcggccacagaggguggcagagaggcucucccaggcaggcagguggcagagcuccucacaccuguggaggccuggcacuucccccgggcuggcccagggguuuguguggaagccgaggaaagugugugcagacagaacccuggagcaugcgaacgagagcggagccaucucagaggagcggaaggacgugcgggagcccuggagccuggguugggucccaggacagaggugcucuggguuugcgggagucccucucagggcgucuggucaguugcaccuucccacacucgucagcgccaggccaaauuguuccuuuucaccuuuuccgauaccgugagugaaaugggaaguguucacuagugagcuugaacauuuaucccgauuucuuuuuaaacaguucuucugugcaucuuguucuuuucugcccaacguuuuagugggcugccugucauguucucauuaauggauaacaaccauuuauauaaaauuuguaugucauaaauacugcaguuuuucuuuuaccuucugccuuuuguuauuaagacaaacauuuuaugucgacgucaguuuuugaaauaugagauauaauuuauacucgguagaaugccagcccuuaagggugcuguuggguggcugugcccuucccuguagacagucaacaggucggacacuccacccgcuggggcguuuccuccggccucggcacccccaacccuaccucacccccgcagaggcagccuucuucugauuuucauccuugugcguuaguuuuuucuguuuuagggcuucaugugaauauagucagcccuccauauuuuuggguuucaccuccacugauugagccagcggaggaucagagccuggagacacugagggccaaccacccguauuuccacaccaggcugugguggaaugugcggaucuggagcugcaagugcagaggcucagcggagggucuuucagucuugccucuucucucugcucuuucacccucugccaacaccugcuguuuagcaguucaccuguguuuucuuguguacacguagguuguuguuuuuuaugguuaggugguauucucuuugaugaacacacaucauuucuccaaguguccaccuucgagggaacauguggguugcaucaaggcuggucugugaccagagcucccaugcacauucuuguacaggcuuuuugugggugugcuuccguguuucggauaaauagcuaggaaugggauugcugggucucggggcagaugugcauuuaacuuuauaaggaagugcccagcaguuuucugaagugguuguaccauuucacgcucucuucacugucuuugugucguucucaaaauagcauuuccaacuugcaagauaacauaacucuucuugcguauuuucuucuagcaagccaauggcuuuuguuuuuaauguuuuccacuucgaagguaagacaaugcccagagcccggaauggcccugacuucuuuuuuuggacugaaauagcagcagugcagggcagggcagugcccagggccacaccagggcagacguguagggccugggcugguuucuugggucuucauugggucucuguguguguguggagccugggcucugaccgucugucuccuccuuccacuugcagcaacaacaggagaugcuggccaugaagcaccagcaggagcugcuggaacaccagcggaagcuggagaggcaccgccaggagcaggagcuggagaagcagcaccgggagcagaagcugcagcagcucaagaacaaggagaagggcaaagagagugagugugggcacggaaggccaggcagagggagggaggccgggcagagggaggggugcgggcacggaaggcugggcagagggagggagugcgggcgcagaaggccgggcagagggagggaggccgggcagagggagggaggccgggcagagggaggggugcgggcacggaaggcugggcagagggagggagugcgggcgcagaaggccgggcagagggagggaggccgggcagagggagggagugggggcauggacuccggaaggugaggggcagaaggagugagugcaggagggcacuggggcagcacacggggaguagggaaagaucuaggggcagcugagccucaccauggugacucuugccacuuugccugugcuggguuucuaagaagcaggccaggaaugggacccccacccccugacagggacagugagugugacagugugucagcccacccaugguuagcucccccagugaaccagaguccauggauuuaucuucauccagggcugcaggauucaauauuaacaucaaagcaaggggcauucagcccgacuuuugguuugauuuaaacauuuuaaagacuauuuggcaggauuccuaauagacuuaaaaauauuaaaagccauaaagcaugccagaugcacagugaauuucaucugugaguucugcccugcauuuuucaaaguacuuuucuuucgggagcauuuuauaagugccuucaaagcaggugugagguuguagagugacccacggcccagugagggccagcagcgugcucuugcuaucugcuccuuccacucugaauuuugccuucugugggggcuguguuuguacaucuggagaccagcauggucuguuuucuucuaaggagagcccacacuucauacuauccaggagaacacuguauuugcuguuucccacuuuggacaguuagagggacgcaucuacugaggaaaagguaacagugucgccccugcugacugugggcugcugggacgaugacccgugggcuccucugcacgaggacggugcccagcgucgccagugugucugagcccuggcguguccccggggugcaggguccaccguggggcugagucagcucugagcauccucucagaucuucacuuaaaagagcccuuggcucacuguguguuuauauccuuuccauggacaacuucuuguuuuaagugacacagacagucaggaucuaaucaccagagugaagggacuuucauagacacuccgaguuucugcccaggacuuacaugcucaguuaaauuugucuguucccugguaauacugaaaaggagucgagguauacauuuuccucagguaacaggauuccagguaaggagaguagagggauuuacucuuguagggcuggcccaugagucagaagagaaguccuuaugcacuucccccuuccccaaagauaacuccucuccugauguuuaacauggaagauuaauuuugccugcuuuugaaauguauguaaauggaacccuuaauauguaggauuuuugcguuuugcuucuuucuguggacauuaugcuugugaaauucauccccauuuugcauuuagcaagaggucauucauuaucuauuauauauugcugcauggugucccauuuauaaaugcaccaauguagucauuucuucuaaaguuguuagauauuuggcuuguuuccuaaccagagcuauuaaaagcaguauugcuaugugcauucuuguacauguuucuugguacaugugggcaaaugugaaguggaguuguugaacuuuggggcaugcauguugucaguguucauacgugaugcccaaaaguuuucaaaguaguguaccaguuuacacuccuaccagccauguacagggguuccuguggcuccauguccuugucaacacuugcugcugucagucacuuuaauuucagcuccuccucaugcccucagcuacauuucuuugauuaccaauaagauaguuuauuuucauaaguuuuuuuugccgaaugaauauuccccuuuuugugaagugcuuguuccagucucuugcccauuuuucugaugcgaggucucccuuuuucuugauuuggaguuguucuuuauauauuauggaaucaacccuuggccaguuguacaugcuguaaaucucuucuuccacucuguacuuugccuguucacucucuuaauguuaucuuucaggcacagaaauucucccuucuaauacaguuucagucuuuuccuuuagaugauuuugugccuuaagaaaucuuuccuuucuucagaaucuuggauacauccucuuuaauuaucuccuaggagcugauuguaccuggaauugauacuagugggguuuuguuugugauugcauugacucugugguucaaauuaggaagaccugauauuuuuacaacauugauuauuuaccuucuuuaauuuuucuuaauaauuucuuaauaguuuuauguuuaggaggcuugcauauauuugauuaaauauaugucaagccauuugauggcuuugguugcuauugugaauggcuugguuuuuauaauuuugaaaagcagucaguuuuugaccauugacuuuguguccagcaacccuguuaaacucagauauccuaaucauuaauagauuguuuugaauuuucaacauuuagaauccugucaucuauaaauaaugagaagauugccucuuuucugauuggaauaccuuuuaugucuuuuacuugcuuauuauauagaaugggcugagauugccaauauaguaucaaauugugguccugauggcaggaacauuugucugguucccaguuuacuguuaggugccauguuuucuguaggggcuuuguauuuuuuacucauuugucuacuuguuuuugacaggugcuauuuaucagaucauggaaguuucccuuccauuccuuguuugcucgggguuucaauaugaauggauauugauuuuugucaggugcuguuucagcaucuuuugagaugauuguaugauuuuuuggcuuuaugugguuaaugaaguaaagcauauggauuuauuugaauauaaauucuaacuggcauuuuuaaaauaaccccagucaacuugauuguaauauauuaucuuuuauguagugaaaacuuggauuugcuaacauuuuauuuuguaugauugcaacuguguuccugagggagauugccaaacaguuuccuuucucauaauguccucgucaaguuuuggugucaugacugugcuggccucagaaugaguuaagcaucauuccucucuccuuuuguauucucuggcaaaguuuauuuaacauggauauuacuuuuuccauaaauaucuugugaaacuuacugcuaaagccaucuuaacccuaagauuucauuugugcaaagguuuuugauuacuuauucaauuuuuaaaauaguuccugggacauuuuucccccccggcucacuuuagcuaaguuguauuuuuuuaaaagaaauauaugccuuuguuauacauuuuuguauuuuugacuuagugguuuuuggugucauguccuuuucugguguuuuuuaugucugucagaccuuuaaugauguccucuuuuacacuccagauauugguuguuugugcuuuuucucuuuauugcugcuguuuuguuuugcuuuuguuuuucuuggucacucucuccagaaguuuaucaguuauucuuuucaaagacuagcuuuugacuuuauggauguuguuuguugaauaucgauuucauuaauuucuaguauuuuuauuucucuauguucuguuuucuuaggguguauugugguuuuuguagcuuuuugauauagauacauagagcauugauuucagcucugucuucuaacauaugcuuauauagcuauacauuuuccucuaaaugcaacuuuaucugcaucccacaaguuuugauacguaguuugacaaucuuugucuuucaauuaguuuggcccauuuacauuuaauguaauuauugauauauuuaugcuuaaaucuaucauuguacaauaugaauuauaauuaucucaacuauucuaaugcacuugucuugccuuuaguguauguuuuuagugauauauauauauauauauauauauauuuuuuuucaccagcuugguaaucacuauuuugcuguuucuuuacugauuaucaguaggauuucaacaacugucuuuaaucuaucacagccuuaucuaaauuaauacuuuugccaauucuggcaaaguaagggucugggauacuuuaacucuuaauuuauauacuauuuugaccuguauuuaacucuaaacuuaucuuuaacaucacaagacauuguuguuauuauuuuauauagucaagauuuacucauaaauuuauccuuuccacuuuuauuaauuucugcaugucugaacuuucaucugugauauucuuuguuuaccuuaaugugggucuaauggugaugaauuuucuuucuguucaaaaugugauuucagguuaaucuuugaagguuauuuuugcugaguauagaauucuagguuuguauuuauuuucuuucagcacuuugagaaugccauuccauucucuucugacuuccauuguuaaucuccagaaaugagcuguccauccuauuguuccuucuuuggaaauaaucuuucuucccuagcuauuuuuaagauuuugucuuugguuuuuugaaguucuucuuuaaugugcuuaacuguaguugcuuucauuuuaaugucuucuuuuugggauuuguaauuccuaaaucuguuguuuuauacuguuaugaauucuuagaccugauuauucucaaacuucaccucaacagauacugacuuugccccagucucuccauuuaaucuaucugggauuuaguuauacaccuguguuggauuagcuuucaguauccccuaaguuucuuaaguuauuuuugugucuuuguuuccuuuuucuuuugccucaguguggguauuuucuuccaauuuaucauccacuucccuaauuugugcuuuaccugcacaauaaucugcuguuaaacucauccauuggauuuuacauuuauuugguuuucaguucuaggauuuucauuuggcccuuuuucauaguuuuccauagacuuucuugaucuuauuuuuuucugcacguagugcaguuauuuuggagucugacugguaacacucucuggcccuguggcaaggcuuuccugccuguuguuucucucauuuuuuuuuuuuuuuuuuuggucagauuguguuuauuucuaugguuggauauuuuagguugcaugucugacuuugcacuguugugaugaugggggaccugggauggugacacauucuuuucgaguggacuuuguuuuccuucuugcaguugaccagaaguggccaaguuucuuaagcaucugaaugcagucaggucuggagcugauucugaguuggguuucaggccuucaaaggccugguggauuucuggccaucguuacucauaaggcauaucccuuugagguccuacgcacaagcucaugagguuuauugggguccuuuaauuuuccucaguuuuuguggcccuaucaagggccucuuccgaaacccacuguugagucuagagaacaggcuacccgagggugggguccugcuccccgcggucccuguuucugaccucggcccugguguuccaugcugcccuaguuguucucugugccuucacacagaaggcuagggugcuuugucuagaucuucugaccauuuccaguagguuuaauugaauuaccugaauaaaaauucuugaaguuacauuauugaaaacaccaugugcuuggaguacuccagguuuccuaaccuguucuuuauacuguuuauguucuucguuuugucuggagugaaaggauauguuaauauuugguguguuuggugauuugccuucauauaauuuuuagauugugaaauuggcauuuugcuuuuaauuaaucugcacuagauuugaaguuuuuccaaauaggacauuuuuguucauuuguuuguauuugaaauccuuguguucuaaaaagaauuaaauaacuauuaaguaaauucaguuuguaaguuuauuuuuaauguaaugaauguuauaacuaaugcuaaauuagaauugggauauaaucuaaacuguauuauuaugccuauauuauguuguacauuuuuauaaauauuugcuauuucagacuagauauauuuuuccuaagaguacauagcuaaugcacucucugaguuuuuaguuuauuccucuauuuagcuauuuccaaguucuuaguaauuguuuuuguccauaaaacuaacacuuuuaucaauuaucacagcauuuuacucuugaaauaauaaaugcacuuuaaauguuuuuucacuuuaacugguagaauuucaagguagaaggccucugaggaggguuuauauuccauuguaggucuaauuuuugcaucaggauuugaaagugaguaccaaaucugccugauggcccuggcuccuggcacauugauuagauaagguggugacuuaauccccagggauugcccacaggggagcgcuuccagacauggcugcagaggccuugaggagacggggcggcauaggggagagcuuccagacauggcugcagaggccuugaggagaaggacccugcagacagggcugcacacacgcacgccuggucuuugcaugcagauccgggcccucucgguaguggacggcugugcugugggucucuguucacuccaggguguucugccaaacugaucccaaguggaacccggcuggcaguguucuugcuucugaagcugccuagugcguugccuggguugaggaccaggagcgcagcugagcccucuggcuucacgugugaggaaucugaguaucuuaggggcuccacggccugcugggcggggcccacccugugggguugcuuuccacuuuagaaagcugccuuccguagacaauagcacgcgguccccgugggagcccugugcgcggggcuuugacuugucuggccugugcuggugacgcugcagugcaggaggcgugcgugggacccacaucgcgggugugcgccacgggcccaagcacuggggccucugccugggguccggccuccccuccacgcuucugugguucgccgguagcccaggguguauccuauguauuuuucuuuggaguagggaaaauaguugcuuaucaaagaauugaaguuuaaaauuuaaauaucagcugggugauuugugccacaacuaaccaacaaauaagaguuuuucagauugcuaaaaagcagcuuggucuaaauuacuuccucagaguuuaccagacucuuccaauaaaaauaccaucuugaggcucacagaauaugaaaagacuucacuucagaaaacauuuuggauccguuuaccagcccaaaacaaucccugcgcugcauccgaagcgccguccacccuuaacuggagcucuggaauguuccugcuccccucuagccccgucacaggcggccgucccggugguuuucacugaggauuuggguggucagauuuuauuauuaauaauaaacuguguacaguuggguacuuggcaagcuugugucggcucugcagcccucagaguguggucuuguggugaggacgcagggccgcaggccccugugguggacgccacucgggggcucuuauguaagcggggcccaagccggcgucuucccccaugaaggagguucuugucugugcaggcuggaggagcaguggcgggccggcgcgggggacacgaagcaccgccagcaucuaagcauuugaaaacacggugcacagcaucuguuuauucucuuggguuuuuuuuaagugaauuucuuauugaguaucuaauaaauaucauuacacuuauaaacauuuacauuacuuuuaauuuuaaauaauucugcacuuuuauuuauugauaccaaguaaugcaauucauuugacagaacgguggcaguuuucaucauguuuagcaagaacacacugucuuuaaccagcuagguuuugauuuagauuaacggcacuugggaaucuaagacacggcucuucacauaagcucggggaaggagcaggggcaggcuggacucggcccgagcaguguggagcgaauacagccccgcuuucucucacugcgguccacacgcgcagcccugcagggaauggagggaggucacugagcaaguccuuugcucuguguaaaaaugacgugaaaggcugauccugaaagucauuagguguccuuuccaugaaguugugccuuccucagaggcaaggggguggagagaaaaaggagcacuuucaggcagaagccaagcagaaccugccacagcucugucgucuggacucgccaggcccaggccacggcccuccgggagcacagccgucccuccccgaacacagccgucccuccccaccugccccgccccgccccacccagagcugcuguccuccucucucugccccgcucagcuguugcucgcucauuccuuaggucucgggugcacucucugcccccugguaugggaagaacuuggccucuuuuauccaccgcuucaucucugcuggccagaacgggcuggcaucucauagagccucuguagaagccuccaugcaggggaugagugauacucaaugugaauuaagaaaaaaaaaaaaaaaguaaaaguaaaaauuagggagaucugcuauccauuuguugaauggguuuuuucauucuagaacuuuaagugagaaaccuguugacagaugagcgugugcauaaccagaagugcagaaacggggugggggucagaaucagccccucauuuugaauacucuccuaguaaagucugaaagaucaaaagaagauuccuuggugguuagaaaggucaugaaucgaagacuuaccuuccucguguuuccugcuggccaggccuaugcugggcauggguggggugugaaccccagucaugucugccccccacugcauggggcaugaacgccagucaugcccagcacccagcccugcauagagggagccaggcaggacccaggcuuguggccaagucacccuuugccaccgaaugguguuugcagaagcagggagaggacgugggucauaaaguggguccuguuccuggagugcgcacccucccccguggagggccaguggauccacaguaacagcugucccugggaacugguguuuugagcagguaaggcugacugcacugaguuugggucuacuggaaaguguugagggcguccucgucccgcacaccgagaaccugcuucuuguccugcucugcugccuccacucaaggacggccauguagggggaccugcagggcaguccccuccaacaacuggccaucuggguccucauccucacugucgcugucaccagcaucauuuugcgguuggacuacuucccugcacugucagcagcauggguaguacccaaaaaaauguuauccguguaaaggcaaaaaauugaaguuacccauuucacuucuuauuucuuuuaucaguaaaguuaagcugauuuaacauacucauuggcaaauuugccuucuccuuuugaaauucgccuucuguguucucugcucacuuaucuuccccaccgcccggccuuuccuuuuauuccuaguuguggaggcaguuuguauauuuacgagguuaacucucugguuuaugucugggucuguuuuuccaaaguuagcagccuguugcugauaaucuuuuaggaaugccagugcucacaugccugggaaugguagaagcgaaugguuuccauaagugugugaucuucugaccaguccccuuacagacagacaguucagcuaaaagugcuucuaagugauguucgagucuaacgccgggugcccugaaaaagcaucccuccuguccccccaccgccacccuaccuggggcagugcucaccgcagucacaacuuaggugaugagacaucuucagcagcaugagcugggggacgucacaggcacagcuugacucgggcaaugacaugauuuucucagaccgacagagagcccugagccugaagccucaugcaucacgguggcccuucccggacucaugcugguggucguguaguuaaugucuuuguguuucccuggcuuggcuagugcaggccccaccacagccuggguagacccuguuuccaggcgucucauugcugacugacccuugaccagacauuaaaguuccaccuuaauguaaugggagugggguucugccguagggaacacagaaugagccuaacuaacaaaaacuccauuugugaguggcagcaaagacauuugguaugugaugaagguggcaaggaaaagacaucuuucuaaugauauuaaucauuuauuagcaguuggucagaauauccauagagccuuauaugccaaauccauuucugagccaucagagugagucaugaaaaaauuuagcaaauaaccaaaugaaugaaaacccagcaccagaaccaaggauaaaauuaaaaugauggcuuauuaaccacugaaaggaggaacaauggcagaguuuuaaggaaagggaaaacucacaaaggaaaaacuaaaauagacuuuauaaaaacaagcauuugaacauuuuacccaaauuguaaaaggaaacaagaggcaggguaaaugcacacacacacggagcagccgagagccacgaaccagggcguccaugagacuugguaacugagccaaccucaccugaggcgcaccuggccgccuuuguguucuccauccacagucgggggaugagaauaccuauuuauagcucucaugcgaggccgaaccaggccagggcuggcauauacuaggcucucgauacagccauuaucauaagaaacccacgcaacuccaguggauacaaguaugaaacacacacacacacacagacccacaacaccacugugcacaucgccggaagauucuaagaacacauaagccaaggacaugaauuaucuugcaagagaggaaaucggcgcguguccaguggugcucaggggugccucacagugaugccugcuggcuuuuggauuugggcaaauggugauuugaggaccagcaggaggagcagcugccccugcugcagguggaugggugguucagggggucagcguguagagaaguuucguuuuucuuuuuuucuuuugagacagggucuaaacucgcauugcgcaggguggagugcaguggcacagucuugguucacuguagccuggacuucccgggcucaggugauuaucucaccucagccucccaaguagcuggaacuacaggcacaugcuaccacacucggcuaauuuuuguauuuuuaguagagacaggguuucaucauguuguccaggcuggucucgaaccccuggggucaggcagucugcccuccucagccucccaaagugcugggauuccaggugugagccuucgggccuggccuauguguagggauauuuuggacagcaauuuaccaagaugugccgaggguuagaauaguaaguuuguuagauguagucacuuugccaagauguccuaagcaaguaauucuaaagguagucaguguuacccacucauaaauguucacugcagcgugguuucuaacaaccaaaacugucucccagucgggaagugguuuuguaaacaugcuucacucaccucaagguguguuuuugaccauuacaaacgcuaucugaauauuaugcaacacuaggaagauacuuaaggugcuguaagaaggauagaaguacugugugguuagauuggagaucugaggcgagcagccuccgugcuaacaggccuuguguucaggcggugagaguggccuuuuuugccaguucccuuuaaugaggcuuugaaaaagaaucaccgccacggaagaaaaccacaguuucgacuucggucccacuuggugcagucacucugccugagucugagcugccaagcuggggaggacaggcgcugcccuuugaugcuguuggaagcagagccggccgucaugucggcgcagguguagaaggaagcacgccugccugugagacuggcuuugucccugcgugaugcauccauuugcacaaagccuucucucuuagauucugcuuugcgguagcaagaaugcaaccaccacgcugccacugccuaauucagaguguucuuuuauguaagaauauuaaaacuuccuucagaaguggguuuuguguuagcuaacaauaagucuuucggaugauuaaaucugcauuuuaaauagaaugcaaugauguaaaaucuugaugggaagaaaaccucucauuaaaaccccucccggccuugguucuuugaggaagcgcucaggaggccacagcguccugaaggugcauagccguccccagcccuucccucccucuguggccccgcugcccugcauugcugcuguagggcagagccacacuucacccccugcuaugcuuucucccacgccaggugccguggccagcacagaagugaagaugaaguuacaagaauuuguccucaauaaaaagaaggcgcuggcccaccggaaucugaaccacugcauuuccagcgacccucgcuacugguacggguaaguguggguguggggagcaccccggccuccucucugggggcccagaggacugucugaucgccgguagauuugcauggagccagcucuucaccggaggcagggaaggagggugaggaauugaaaccccaagcacaguggugcucggaugugggugacguguucuggggguacacucgugcggcagccguccucacggaggggcccaccuccagagugacauggucuggggguacacucacacggcagcugccccugcccucacagggggacccaccuccauagugacguggucuggggguacacuuccacagcagccauccucacggggugggccccccuccagagugacguggucuggggguccacucacacgguggccguccucaugggagugggccccccugcagagggaccgagcagugcuccggaggcuggugccugucguuacucuugguaauguugugccauuuuucagccacaauaagagccacuuaaacuggaacucuugucugaauccucugugcuccgacagcgcucccaccugacguuucaauaauucuuaggcuagucaggaagcccccgugguacuucuauuauuuuauacuaagaaacccugccagggcccacgcaauugacagagaccacaaaaggcuuguucgucugaggacugaagagagccgaccugccaugcaaaagaaggccuucgggggagaguucacagagcacagugcgagcgaguggcgaggugaugcggcuugaaacagugagcaagggcaacagaggaucgcuuugaaauguaguuuucugcugcucucaagguucauuucauuucuagaaaaaaaucccauaagggaguuuuuguaaaucgaaauaucaguaauuucguuggaaaaaaaauagcuauucucaagccucaaaauggacagcuauguguagugagacccccccacagcucagacgcgaucccccuuguuuccguggaggccgcccgcuaccccgacacaucccaaaagguguuuccagcacagguggcccacguccuccacucuggcagccgcugugcuugccaguggcacauaagcugcacucacggcagacacaccgucuggauuuggguaacucgaccagggacacacaaacuugcaaggaggagugagaccggcguccaugggaggcagcacgugacagcagugacccacugggaccugagagaggagguggcuuccugagaaucgcuggcaaccggcaccugggagcccgcuuugggggagaccccgaucugugcccccagagccaguccacugccuggacugguuguggagaaacuccauuguccuacuggcuggggcagggcgugggguugcagggcagaaggagcaagggacaggaguguggaucgugguucagauggugccccuggggcccaagcuggaaagggcaggaugaggagccaggggcagggugggccuggggccuggcggaggauggagagcuggagugcagagccugcuggaccagggcagggccgccuugggucccccugugaggcagccgagcaagcgagcuuugagaagacagugauaggaguggggcaagcacgggcagcccuuucugaagaggagcacagagucugggaggcugcagcgggaguuggaggacuagagcaguggggcugcugggaagcaggggucacggugagcacagggcagcccccagaggguggccacggcagcauggaagaagguggggagcuggcgcccccucgcccaggagucaguggacaguggacggggggccgaggccagcaggaauagaagccgggcaguggccuggaccugaggggaggacggagcagcaggcccaaggaaaggcugcaccugcagucaaggaggccacgggagaagaaguggccuggggcagccucagggcgcugagggacgugcugagagacgggagauggggggcuuccagggaggagggguggcaaacagaguggcuggggcugggaggacugacuuuuccuggaacucccugggugagcuggguguucaaggugagugucuuggccuggacaagggcggcgugcccuggcuuuaauggcaggggccggagguacuucuucucagagggcucuggggaccuucaggcuggagggggaaggacuugaucucaagucagccauaggacagguuuguuuuccuggagccuggugguuuucuuguuuugccguauuugaacccugaacuuaaacaucauggagugguggcagaaacuuugucagaaaaccggcucuucauagggaaagaacugaaacccugaucccagcuucacaccacgcaugauuaguucagaugucauagaccugagccuagacgcaaaacugaucaaacuggaaggagaccuaguagaaacuuuucccaaccuugauggggagggggaggcaagauuucuuaggucgccaaaaucaucggcuagauaccaaaaacccaaaacaugauauuuccacaaacugaaacacuucugcucuuucaaaggcaccauuaagaaaauuaaaaagcaagcuacagaauggaaggaaauauucacaaugcguauaucuuacaaaccgcuuguauccaaaauguagagcucguuccuauaacucaauaguaaaaagacaagccgcccacuuaaaaauacggucaaaagguuugaacagguaccucacaaaaaaaggcauggggauggccaguaaguguggaaaagaugcucaagauggcuggucaucagguaaaugcaaaucaaaacugcggcaagcagccccuucauaccuguggggauggccggagugaaacaggccgggugcuggagcagaugcggugucccuggaccucugugugcugccuguuggaaucugaaucacacgugggaaaacaggcaggcaguuuccuacaaagacaaauacccaccaacccugugacccagcaaugcuucuccguauuugcccaagacaugaaagcaagcaacacgacgagucgucaucuuacggucacagucaccaaacaguggaaacaaccaagcuaucaacaggggaacggccgcgcaaacuggggccccugcacacgcuaccgugcaaacuggggccccugcacugcuacuccgcagugacaaggaacggaccgcuggcgccugcagcagcuugggggagccccagaggcacggugccuagacaaagaggccacccccaugacuccacugaugggaaauucagagucagcaaagugaaucgacugugagagaaagcagaccagggcugggaggcugcagagauggauggugcuguggcuucaucagggcguggacucuguggguguuuacgugagucaccgcuuccagcuuuaagacuguugagacaagauggcaccuuccaguguggcugccacaagccacacguggcucccgagcacuugaaacguggcuggguccgaccaggacaugccauagaugcagagcauggaauuucagacacuuggucugaagaaaggaccuacggugucuuauuaauauguuuauaucgauuauaaguugaaaggaugguuuuuauaaugguuuaaucgaauacuaaaauuaauuccacccauuuauuuuuauccauguuaauguggcuacuaggaaauuguaaauuucacauguggcucccaucaugguacauuucugcuggaguauccuggcguaugugguuccucguuguauuucuuggaaaucacugguacgaaucugaugaaagggcaaugguuuggaacugaaaugguugaguuuguaugaagcuuuauucuacagucaagccaguguuuagaagaaaacaguauuugcuuuuccaucuuccuccggaagacaagguuugccuuuagguguggcauccggguuggccccagggccccgugggggcugcaccucggcuccuggcccagcgucugugucccauccccaggcugcaggaaaugaaagguugaaaaaucggaagauaauuuauggucaggugagguagagggagcagcucuguagguucugcccucagggcuccgugggguggccagugugacugugugaguguggaguguggccggggugagugugagugugggcuguggccgggguuagcuuaguguagggugugaaugggggaugugggugugugcagugggugaggugagugugggguaugagugugaggugugggaaaggugacaggugugagugugagaugcgggugugugugugggagguggggugugggugggugugaggcaugaagugugggugugugggguguggguggggugugcguguaagugggugugagguagaugggugugagugcgggagguaggcaugaguuuguguaaggugaggggguguggguggguauagguugugaggggggugugggugugaggugggugugggguguggaaugugggugugaguagugugcagugcaggugugaguguaguugggcgugaguagugaggugaggugugggcgugagugggugugaguaguguaggugcgagcgucaggugugaaaagugagaugugggugugaguaaugugaggugugggugggaguagugugaauugggggcgaguaguagugaggugcaggugugaguaguugggugagcugcaggugugaguggguguauugugaagugcgggugugugugugugagguguggaggugaguagugagaugcagauauagguaugggugaggugugugugggugugaauagugugaggugcagguaugggugggugugaguagcgugaggcaugggugugaauaguugugugaugugcggaugugaguguuaccaguugugugaugugcggaugugagugagaguaauugugugcggugcgggugugauugcagcagggauagagcuucacuucugcucgcccugcuggacgcuucuucgcggagggcacgcgugugcggucuggccugggaccaugugaccagggcugggcgggugugaccugcccugacggugagggccgcccucuccuggugucuggagggcgggugcgcgguggggcgggcucugcauggugugcuccuggcggugagcugggcuaugcaggaggugaggucgcuccugugaggucucuggauccaucgaggugguccagcggggaggcgcuggcaguuggggggcagggcccagccccuccugcaccugcugcucugcucguuuuaagguuugacaggaaaguggggauuuuaacacugaaagcaccucaagagaucagaauaguaagagaacgucuguuagaucuuaaaccaauguaacuuuugcaacuccuacuucacuguaagcaaauccuaccguucaaauauaauaauuuuuauuccauuuauuuaaauuuauuauuauguaaauacugaucuuuuuaacucgugggaugcauguacaagucacuccguguuucccaugaaggaaaaagugaacgcggaaauggucccagacugucaccugguguugaagaaguuuggaaucagccaagaucacauuccccauaggauacaaucugaaaauacuauuugguagagaaagaguguugcccccagaccuuuucaugagauugugagacgagggguagaacuacagggaagagaagggaggcuugcacaaggacguggucccacuuggaggccacagccccugcacaggugcagacaggcgugucccagcccugcaguccgagccugacugcaugguggaauuccccgggaaacagcgagaagcugcuugggguuggaggugugcccugagcagugggcgggguuggggcguggccugaagcugugcaguuuuccggagcucccugagcuccuccugugaugcacggcccagcaccccacugcccaggugccugggcucggcuccucaauuuugucuaugaguucccuucagcacauucuuugcacuggugugcucucaaauauuuaaauauacaccuguacccauuuacaagcucccauucuuaauucaaauaacuccaggugcauuggugugccauacuauguauucaaauagucuaaccaauuccaaauaaguaagucggcaaauuuguuuguagucauuaagcagauuacgcaguuuaaagacucagaauuuauuccacucagcacaguguuuugagcaagacugagcugucagugccgucaaaaaaggccuugcugauggucauccggguggcagcccacauccccgucccggcccagggcccgccuccuccccauguccguccuccggccauucuccuggcagacgauuccugucuugcugccuggaggguguggaguuguacccagcuguucauacaggaagucccuuucguaggucagcucccugggcacaggguaucaguagcugccauccuguuccucccccagagagggaggugaccagggugaguuuggugaaggcacggaugacgaugggugccuucugagagacagccccaugggcuucuucucuccagguggcagagagagucccacacaucacagcguuuguucuuagaccguuuuuugccccgucucagcugccuaugaacucaccuuugauuccuuaugcagcagccuacuguuuuccucuuccucuccccaccggggauaggcucucugaguggccagugguggcccugguagcgaacugacugggcuggagccaucugagaggacagggccagguggagaacagccaccaggaaaacggccagaggugcugcccaucccauccccaagcacugcuggucccgcagaggaggaugugggcaucggauguuugcuugcuuguuuagcauccuguuuguuuccauuuaauuucagcuugacccuagggaaaaggugugucuguugagguggggcugagguuucaagggaaagaucaucguguguggcuucucggcugcagcaugccuggggcagugcgcuggguaaacuaaaccaucugucuuugccuucucuccaggaaaacgcagcacaguucccuugaccagaguucuccaccccagagcggagugucgaccuccuauaaccacccgguccugggaauguacgacgccaaagaugacuucccucuuaggaaaacaggucagugcccaggcaugcugugggccgggaggucuccugcacgggcaccuuccacgccacaagccacgcagggcccaccgcugucuuccacuuagagaaggaaucaccugcagauuuuuaaauauuuucuccuuucauagagcaucguuuuuaaaagauaucccuaaacauuuccuuauuauuuauuucaaaagaaaugaaccuaacgcauguacaccacugcugaacacucaaacucacuuugaaagcacacucaguuuaguuuucuuucggugguguguuagauuuugccacacugaggggcguccccgcaguggucacagggugaagcaaguuccuguuggugggccaugugccgucugagagcaggugagccuguggccuucagggauggcgcugggcagugccagcagcagggccuuccagguccccagagugggagggaaaucuuuaugagaaagaaauucgcuauguccugcaggggauaucccagcugggcucagaguuaugugccacaguucuguccuaagccaagggagaagggcauuuaggcacaagcaggugccuggaccaucuuagaagcagggagaggcggcugcagcagugucuggcaagucaggacggacccucugugacuuucucaggggccacggcaguggcuuuagauaaugauuaggguggcugugggcagugcgcugggguagcaagaagggcaggggccagggagugccuuccagaggcucugcccagagaauuggugagggcaggagcuggagcaggugcugagggcgggcagugccucaucccagauguggccaguggauccuacaaacugcaagacagugugggaaaucccaaggcguccucccuagggggcggcucuuggagaugagagccuaggggcaccgcuuuuuuuugcuaaacaaauucucuguuauccaaagguuuuggccaguucugggcggaaacagugaacguacucagucacacaagggcuucuucacuggaacaaugaggcuuugugaggggcugcugggagccgugucaggccagccacaucccuggagcagagggucauaucaggccagcugugacccuagaggaguaggccauaucagccagccacaucccuggagccgugggcuguauugguccagcugugacccuagaggugugagcuauaucaggucggccaugucccagguggagugggccaugucccagguggagugggccauaucaggccagcccuguucccaauggagugggcucuauuaggguguguugaggcgguggugucccagguggagugggcuguauugggcuggccaugucccagguggacugggucauaucagucuggcccaugucccagguggaguggaccauaucaggccggccauguucccaguacaccuauuaggguuuauugaggcgguggugucccuggagcagugggccguauugggucagccaugucccagguggagugggucauaucaggcuggccacgucccagguggagugggucguaucgggcuggccaugucccagguggagugggucguauggggccggccaagucccuggaggagugggucauaacaggccagcugugaccucagaggagugggccguaucgggcugguggagacccugcuggagugggccauaucagcacggccauguccucuccaagucaagaacccugcaaacaugggcgcauuuccauuugggccauaaaccuuuauugggaaaagugaaccuagagcuucugcugcuuuguuucaugggugugagccugugguucuuacugaugcuucuacugagaaugguccuggauuucaccuggagagcgcccuaaagcuugacagaaagaacggauuuagagaucaguauuuuuuccagaaagaugugcccaguaguaucaggagagaaucugugggcugauucuuacaaaucgcccuccagguucccuuucuggggacugaugcuauuauuaaucaaauuccaucaacaaaaccaaaguccgcggugaguggugggcccuaugcugggagagagacccggggaauggggaggcaaggaacaugccuacccggaagaacccugcccuagaaacuggagcgaugccgaggguggagggugggagcccggagguguugucaucaagugcuguggguuggaugugugcucauucauguaauagcucugugugcccugaaacaaaugccuuccguuccccuggccuccauuuccucaucagcacagugggucugcccacacccacauccucacggcuguggcaugcacccauccccagagucuccucuuguccugggagugauggcuguggcacucagacuccagagccauggacccaggagggagcuuccagcgagagcaccaagcccagcaagucggccucauguggggacgugccuucccagaaacuccccauuuggagccuuuccaccaagggccccaggaaaggacagcacacaccacccaucccaucaggccccagagcaguuccucagcagcuccacaccccaacucgcaacagaacagcagggaugggggagcccuaggagcuauuugcacuggcuccucccccaucccaaaugucagcacuaccuggggaucagccuccuguucuaagaaacagaaccagcuugaguacuucauagcaaggaaggcuaucagcaugggagacggcacacugucacggcccugcccugcuguucaccaucagaggccuuucucccauaggcagggcccgcgccaucucucguagauuccguggcuguuggcuucccaugcugccuuguguuucucuggggaugauuggaagcaaagucuccaacaccuucuacugugcuucuaaccuugugauagcaccacccuccaacucccugcuuucuugagaacggaagagagaauucuguuuucacacuccgggaaauguuauuuagaauacauagugcuccagaagaacuuaauuaagauuugauugcauuaucaguuuuuuaaaaagucaucacuaccacauuaauaauaauaacauaaagauuuccgagaaaacguuuaaaccacuuaagagaauaguguguaguuacacacccuguaucacccuugacaucuacuuucaaacacaugacaucgcucauucuaaguaaguuauaucugugcuuuucugcaguaauugguaauaugaaacacgucauuaaauuuuaguuaugaaguuccuugaaugaacugaaauagucuuuaauaauugugauguagacuuaaauaauuauaugauuuugauuuuacauuaacuuauccugacccggcacacaguuugcccauuucugcaucucuaaagggcaauuguaugaccugugaacaugugaaaagcuuugucacugucuugugaauuuugucgucaccccaugcauuuuuugcauguccuuugcuggcucugcugacagguaacgccuguaccagcucaaacgucugaccucccuggugaaagcaaugcagugacuccuauucggagcuugggcauauucugggcauucacaucgccugcaccugugggcaggaccaggugccugaguuucuacccagcuccuucacccgccaccuugggaccuggggaagcucuugaaccucucugugccucaguuucgucaucugugaaauguaccuuuaaauugcuucucuccuggagcuaucaugagaugugaauuaauuaauauuugcaaaguccuucgaguaggaccagaucgagguguuuucugcucuuguuucucuacgcuguuaggguguuuuugauuuuuuucuccauccaaugacugguaacugccagacccagcauccccccaccuccuugccuccaugccuacaguucagguagaaaccagcaggagccacucaccuccacuuagagaaggaccacaaggaugggaacaccaagauuuauacccaaaaucuggccagaagggcccaucuugcucuguuggcuuuucagggcucaucuccucgcuccuggcuugccuucaccugagugccaucucccaggaggagccuccaccgcugggcuugagagucagagaccucuacccagggccucagguccagcucuuccugccagaggccccgccccuuuccugggagauuggcagcaggggugucuccacuucagaggucuucaccucccgccagauuucggcccagggugaggugccuggucccuucccaugucugugcagccucaagugucacccugacuuuggguuucugcagacuugugaagccgccaaauguguauuuuuaaauauagucagaagagacagaacuguguggaucacugucauggacauaggacgcuggaucuuuccugcacugugugggugucagauggcuucaccagaaacugcauuuaaacagagccuuugaguccauguucacgcugaggaauggaggcuuuuccacuuuuaaaagcaagcaacguuuugucauuuugaugauguugagggaucuuaguuuuccccaguaacaucuucaucgugaucuucuuaaagauauuagucaccguguauuuuuuauaaugacucuuaaauuuuccccucaugugacugcugauagaugaaaggaggccaaaacaacuaacuaacuguuguccagccagcacaguucguucccauuugucagcagcuucuugggccugagcacugaaaaccgugcacuccacagcacuccuuguccagcauccucaugugucccugggcacaugguccuagcagcaaacacucuccccagcauguguuggggcccggcugcuggccugggcuguggcacugccauggauuguccuggcucuuuuaaggaagcaaaaucccagagcucacguuuggugagaaguugguaacuucagccuuguuccggcauucucuagccugccugguagggcuugguccccacaguugggugugaauugggaggaggcugggcugguccuagggaccgaauucuguuggccccuguauggaucauggaucugggcagucagucaaagguccugggcucccucugcacuugccuccauggucaggcuugaaaaguguucaucuagcucugcccuccucaccuggggccuucugaaaccagucacucaaggucacggcugcccaugggaaacauccauccauugcuuagaugugcagauaggguggguuuuccuccauuuuggggggaagcugucccgcuuggugaggaagagcacagggccuguggccaggcuggcgcccacgacaccauauccugggcagacuagaugaccucccguuguguccgcaggucugcaagguggggcggugggcauccacuucauggcuucaugguucuuucauuagucaagucccacagcucaucaauaggcucauggcuuucgcccuguguacuagugaccugaauaaaguuacaaguguuuguucuuaucuguguguagaguaggcucaggguacugugaaauaggacagaguguguuuuccacccucacauucaucccugaguuugggaaggggcucucuguuugccucugaccauugcuugcugucccuuguucuaaugcaguuugcagaaacugcuggagaggggugggaccaggaagaaaugggcagugcccacacuuccugcugcuguauguaaagguguaauguaguacauacuucaggaggugcaguguggugagacuuccugcugcuguaugugaaggugugguacauacggaggugcagcauggugagacuuccugcugcuguaugugaaggugugguauauacuucaggaggugcgguauauacuucaggaggugcagcguagugagacuuccugcugcuguaugugaaggugugguacauacuucaggaggugcagcguggugagacuuccugcugcuguaugugaaggugugguacauacuucaggaggugcaguguggugagacuuccugcugcuguaugugaaggugugguacauacuucaggaggugcagcgcggugagacuuccugcugcuguaugugaaggugugguauauacuugaggaggugcagcguggugagacuuccugcugcuguaucuguguuuauguaccuguguguauaucuguguguguaccuguguguguaucuguguuucuauguaucugugugugugucuguguuucugugugugggguguguaucuguguuucuguauaucugugugcguuucuguguuuguguaucuguguuucugugugugugucuguuucuguguaucuguuucuguaucuguguuucuguguaucuguguguauaucuguguauguaccuguguguguaucuauguuucuguguguguaucuguaugucuguguaucuguguuucuguguguguaucugugugucuguguguguaccuguguuucuguauguaucugaguugucuuguuaacaaaaauacccauuuugcguuuucuccucuaccuuuauuuuuaauuaauauuauaugguggccauuauuccauuuuuacguaugaagcucaacgccuuucucucaaguagucuaagacauagauauaaguuggacuguuuucugguuaccauuuugccagcaacuuugagcaccuuuccucacuguguuaguauuucuguaggaaagguuccugaaaauggagcugcugguucagaguauguauauuccaaaacauugagcaaaugauacccccuccccagcagccugagaguccauuuuccccacccccuccacgagcaggcgggaugguguugcaguucauucuaggcaauguggccaguggugaagauggcgagccuguugguguuugagugagcagugccgucaccgucagucaagggcgggcauggcugugugcuugcccccuccccaggagcacgugagcaacgugcuucaaagucgaggguggcuggugccccggagcugggcagcggggcugcccugagcaggcucugucuucagagccacccugugcccagcaucuggagccacgcagggcacgugaggcgguuccaucagugcugaauggagguugcuuagcggcagugcguucaccuguucuucuguggggcaucgucuuugcuuguuccuuuguaaguacuguuuauauguuguuugcaaugcuguguuuucauguauuacagaaguuagauuccagucugucauuugucuuuuagaauuaucuuuuuauuuauuuauuuauuuauuuauuuugaaacggaacgucgcucugucgcccaagugagacaaccuccgccuccuggguucaggggauucuccugcuucagccuccugaguagcugggacuacaggugccacuaccacaccuggcuaauuuuuguauuuuuaguagagacggguuucaccauguuggccacgcuggucucaaacuccugacuucaggugauccaccugccucagccucccaaagugcugggauuacaggcaugagccuccaugcccggccagaauuaucuuuuuauuuucaccgaaguaaauaaacguacauuuacauagacccccaugauguucaugauaggagaacggccgucccugacugccugucccgccugcguuauuacagcgugugucacguucacagcagaaccagaguccaccuggacugcauucaccucguagaaauuuuuccggaaguugaucauuuuuuucauuugcuuaguuucacaccugccugcuaucaauucaggcccacauuucagcagaccuaggagacccuccucugcacagcaggccgccuggugcuucuggccccacugcccggugcgugugaacggucugcucucccggccuggcccccgccuccucucccgggcuccguggccuccuuucugcggccucgccaucuuggucaugcacgucuuccaguggcucuuggagaagucgugcauggagcaugaguuuuuggaguccucauuugcugguaaaucacuuuauucugucgcacucuuggaugaucaguugguugggacggguuuccugcaggguuuucaggucaucgucuugcccucgauguggcuguugccaaguacaaaacuguucucaaggccgagccuuuguccccagagcucugaagcaguuugggaucccgcaggugggggauucuuggccuccguguccagcuccucuucagcuggacaaguaggccuggaauugcugcucaugauuucuccacccugcugauucucucuucuccuggcguuuccaguaauuuguuguacgaccuuugcacucccauuuuucaucuuuuuauccuuuuauucccccuucugacaauucucaacuuuuucuccagccccuuccuucugcacuuuaguuuuuguccucuugucuuuauccucuuuaauauuuccuuuggugucacuuuaggauuucagggcagagcagcuggaagcaggugccuccuucucucugcaguucugccugcccgcccugucccacggcgauauugcgugcauucucugaugcuacaucaauggguucuuuccucgcuggccgcuggacauugcaucaggcccacaaagaaaccgcccuccacacuggugccaggugcacgccuguccccucuguaaacccggccccuaagaguuaaagcguuccggcucugagagccgcuucaccugcagcugacucucaggauguuuaaguuggaggagccagccugugucuccaucagaauugcuucuggcagaaggaugaaggcaccugcuaggcauugggcacugcguugaauuuuaagguugugauuggaauguuguaucgccuuaauuagucauuuacuugauuggcuucaggagaaacaaucccaccugcucccuguucccuaaggagcagacacugcauuuggaaguacaguuggcauccuuccugcccucacccacgcuuggugggagcaacucuuccaugaggccuccggccugaugcuuugguucugucaauguaccugcagcccucuuaggggugggauccaguuucugcaguuccuccaccuggccacaucgugccuggaaugaguggaaggcccgcgagggcggugaaggggcugcugcacugagccaguacacgugcagccucgacccucacagucaccaggugccggcuuaccugcaucuuccacuuuggcugccuuuggcagaauuauuggaguuacaggcauugugcaagcuuuaagacacaugcauuugaagggcugauauuguaggucccuaugucuuaagucaaucuaugagaugcccggccuggaaguaaugagggagggcaggaagcaggaaggcuggccacccugaaagcaggcagugagccgguccucgugguaugcggcucccccggcugccuucugcccccuagggcuucucuguucuccccaggaaggccacuucaugugccccggguggucuccagcaucccccuucucuccugguccacgugcugcugcucaauccccuccccgagccccgcauccaaaacccugcuugucugauagguucugcgggggagucagagugcugaauagcccacggggcagggacgagcggagggccccagccucaugccaugcugucccuggcagugcuggcaugguguccuggagccuccuggucagcugcagccacccugcaggcagagucgaccagggacgugcagucggcuagaaucagggagcccaggcaggugugcaggcugggaggcaggggguaaacaggugaggggacagaagaauuccagauggugagaaggcugcugugaggaagacagggcaguggggcugugaugggggcaguggggcuguggggggucagggcagccuugggaggggcguggagcagaggccuguggaaggggagaggagggaaggggaggggaguggagggaagggguggggugaagcagccaccaugggacucuccucaagagucucuugcacaaagagucuggagugcccggcagggcuguggaggaucugccgccugacugaugaccugguggcagcgugaugacccccacagggccugggggaggcggugcacugggcugcaguaccacagccaguccaugguagccuggagugaccaugucaugcccgccucccgaugccacgugucccacucuauguggcagggcagccacugaggaagaccuuucacacagggccagggacccugugcucuucugugggcacacacagccccugccucucagaaguggcuccugucccaggcccggggaaucccugcagagcccauguggguuucaguggagaucugguggugagagaagagguacuguuuucuugccuagucaucaguuggguuuuuuggcuuguuuuuuuugguuuuguuuugucuuuugaauaauggcaagaaacccagcguggaaauagaaguggagcuugugaaucuacgcuugccucggucgguuguguuaggcacagaagugugcccucgucaguagcccguggagaggccggcuuguggcugaauccgucaucugucgucauccaggucccccgugccacagcacagaggccucgcucccugcagaggcuuagagucugguaccuucucacagcgccucucugguuucucugggaaggcuguuuuagggagcuugcuucucccacauccuuccaagaccugcagaaaaacugucccugacucgaagccuuuuccaaaguggagaagguccugggcugucugcacgucccaaagagugaagucauguugguccccaucgcccagccacaucaguccugcuuccaggagaaacuccgucucauuccuuguugcucuggaggcggugcacugccuguuccagaaagauuaagaacagcaggagugcugauucuuuaagaagagguaaaaucucccuaaugugcaaaucuccaagugguagaaucuugaaaguagccaaguaaaaccucagaacucaaaggcuugugugacacacgucuccguggcgguauucuuggcucuguucuggacucugaaagccgauaaccucucccggguggguuuggggauuucuuugacuccggucgcugccuuuagaucccuagugcuucccaaggcgggccucgcgccggagguuuggguuccagaugcagaugaguuggggaccacggugggcugaaagguguagauucgcaaauggcucuguccacacaggcagagcuguucacagaaaccgacccacgcccaguaccuucacccuguggucagaugaaaggugaagccggcgcagauguugggaugggcucugcugagccuccccaggucgggguggggauagcagccucacgcucuggaggccucacugacugacacagcuggggcgaugcaugggcgagcaagaaagugugcaacguggacaccauccucacaucccugggcccagccucacaucccugucagucuuucucugauuuuagagcaacacagcuaugaagauagggguguauuaucuagaagagcauuaguuacgagacaucgccauuaagugacuucacaccucagcagccuccugccacgcccaguaaaucagcuugucaguccuguuuccaucuccugguaaacagugguggccugauucugugaagacagugccagcgcuugcauaaugcuguggccacagaaauuuauccaaagcaccagauucguuuuauucauuauuugggacugaugaaugggauuuagaauccccugcuucgugagcucccugcgcucuccccugcagcaacacagcaguguugagcaaauauuuacucaccagagugcguauuuuuaaaaaaccaccaacaggauaaccuugagccaguggugucugccuggcuguaaugacaucuccuuuuugugcagcuucugaaccgaaucugaaauuacgguccaggcuaaagcagaaaguggccgaaagacggagcagcccccuguuacgcaggaaagacgggccaguggucacugcucuaaaaaagcguccguuggaugucacagguaugucggcugagcagguacacccgccccgcugcccucucugccaggccuuccugccauaggcgauuucucucaggagcuucugaaaacccacgugucugccucacgcugucaacccccagugugguccuguucccauggcgcuggaagugccaggcccaggggaccagguuugaugacuccggcaugucuaagccgggcccugcuccuggcauuagugacucagagcugguucuaggugggcugaggugcacaagggugccccagcuuggcacugcgggagaugcagucaggagcuugaguugaggcuccucugaaggugggucuuaaccagucccacccuaguaguggugaaucgcaugcucugcccuguuccgcugccccugagcagugucugaaccaccggggcauuuuaacgucuucccacgccagagcacccaucaacugagcagggagggaagcaaggagugaaguugcuucagcuuggcccuagugacgugucacgguuggccccaucuagugguggacacgcagaaggacaagaccgagcagacccccauccugaaggcucacccgccccucuugaggguacauccccauccagaggaccacccauucccaaccaccaccaggguacaccccucaccccaccacuccugaaaucacagcaccaggauaaaggagcugcuugggcauggccuggauagaggggaggcagcggacauguuugcacaacagaaaguguucaacuugaaggccaaggcucaugguagguggucugugaaaggcacaguuccacugagcaggcuguugaccuagggaagccggggaggggcuccuggugccaugccccgugugugcgagcauuggcaucacacagggacucugcuucagcagugaggugagagccagaccuacccgcuaaauacagggcccugccuguuucucgugcccuguccccucucuacuugaggaguuccuaaccacgguguaagggucugggucugaauauuuguggauuucuauuaaaaaguaucugacaucuucaugcccaggggaacuccauaugugucauuucugauguagguuucuuuccucuggccauuauaguacacacagaccuuuucuacagccaucaagaaauguuaugaucuaaaguuucacuaagucuagcugacuggggaagauucaguugaaacgaggaaucaugugaguuaaaagcuuucaaacuccaaugcagccuuuuuuccuaugagcagugccuugcuuggccagcucuaauggacacgugaaccuuugcguuuuuuuguuguuuuuuuuuuaaagugugcagugggugagacggagucuucagcaagcuucuucugaguguuaaagcugguguuccuguugucacccagugacuacugagugcuguuuuugagucagcacugggcugggcgcaaaaauagugagacagaguccuucccuggaaggagcuugugauguaauuugagcaagcagcacaucacacgugagaccauccaggagccaugcgugacagggcgugaucagugcugagcucacccaggagucaugugugacagggccugaucagugcugagcucacccaggagccaugcgucacagggcgugaucagugcugagcucacccaggagucaugugugacagggcacgaucauugcugagcucacccaggagccaugcggcagggcgugaucagugcugagcucacccaggagucaugugugacagggcaugaucagugcugagcucacccaggagucaugugugacagggcgugaucaaugcugagcucacccaggagccaugugugacagggcuugaucagugcuaagcucacccaggagucaugugugacagggcaugaucagugccgagcucacccaggagccaugcguggcagggcgugaucagugcugagcucacccaggagccaugcguggcagggcgugaucagugcugagcuguggcauaaagggagcccgugccgaggcaccuaggaguugggagaucagcacaagccacucuaagccagcagagcucugcagaagguggcauuugcacugggacuuggcgggugaguggggcuggggcagagaggcagaggguugugcaucuccuggccggcacugguaccagggagcugccacgauggggaggcugcucugaguggagcugauuuucagaagacagguauuaggaguucuaggcgggguggucccacacggaggaguggagccgauuuccagaagacagguauuaggcaggguggucccauauggagcgguggaggcagucgcgguucuuggcagaaagagagccagguggauacucugcuuuuucucagucacuaauuaauugggugucuacuguagagcacaaagaagaaaaugcauucccauacgcacucuguccagagugaauccugcucacucugcacauucccgcagcccguguucugugccuuccucacaccugaguucucucacucugcacgccuucccgcagcccauguucugcgccuuccucacagcugaguucucaccaucuuccugcgccauccugcaucccucuccacucaauuucagccacacgccuuuugagcaccuccaaugguguucccguuuugcugaucuaaguaauacuaugaagauuaugcauuuauaugaauuuucuuagaccuauuccuggaaguagaaugcaaaaaaauaaaauuaaccucguugaguuaaaaguggguggaaaguuacacauauaauuuuuaccgccccaaaaaguuguccggacuccccaggcacaugcgugaggguauuuaucugacgacacagcugggaggcacccauuacagggaagaucugcuggaucuugguguguagcuggagacagcuugacaucagagagcaggggucuagggugggcuacggugggcugcagguggggcagagaugggagaguuggaggggccuggagaaggcggguccugcuuucuugagugaaaugcaaacacuggcucagcccagguggcauucucagaaugcccacucacagugcaaauaacauggccucggcagcgggagaagccuaccucuggaguuagugucugguggaagugagagggugagagggccagggaaagaaagaggaugggguagggucgggacccaguccuguauucaugcucaaugcccaggacagugagcugaccccacacucuuuugagcuccaagagccauggggagcggcugguguagggcuucuggguggacacccugguuugcccuugggagguuuagacugcccugcuguugagggcaagauguucccaggguguuccuggugggcagcguggucaacagaggaggugcgccuucaccacccagcuggguuaacucugguaugcagacgcccaugacaguucccucaagccacguggccugggacgagugauguugcugcuccaugccuccaucuccucuucugggaaacggggucauaauggcaccuuccucaaacagugacugagagauggaugagcuaauaaaggcaaaguuuggaaucaggucugccagguugggggagcuguggguggcuuuaccuguucccccacccuccucauccuccucacuguggcucggggcuauauuugcagagucaccaccuccagcaggcguggauaccacgugagucagcaugagugggcaccugcguccucgugggcuccaggaggacgcgggcagcaagcagaccguggaggaggcuuugcuggggauggcuccguugaggggcugcuuggggaaaacaucccuuaaccuccccuccagggcccccaccaugucccuuccuucugaccuguaugcgcugcgcauauagguuggggcgagguucugagcacccagagucguugcugaacagcagacgccuagaguucucgaggcaaaugggucacauuguguuuucuuuggaaagcuuuaaccagaugaugccauuguuaaaaugccguuaaacuaaacauaugacaagccaaacaaauccuugugugaauaucgagagccucagcggccucccacgguggaugugugugcccaaaauagcagcagaccccuucagaggugaagggaucuuuggauuggacguggccccuuuuggaagucacauucagucagagcggaaccuggucucauuaaccagggucaagccgcaccgaugguuaaagauccucuaagacuguccgagcguguguuuuccaguagcacggauagaucucaggagacacuggcuauauuuuccccuggaugcuugcugcuauguagggaaaaugagaggauucagcucagagugaacacuaauaguagguugcuuuauuuugaacuaagcuuuuuauagugagcacaggaaagcugaccuuuugcuuuucaaagucacuuagcuucugcauuuucuggucuucuguuguuaggucacuaauaaguguuuaaggauuuaucuuuuugguguuuaaaauugucuugaaaaucaaacgagguauaaaauugguaacguacauguccuagaaaaagugaagucaguggcaaaacuggaaaaucagaaaucagcaucauacuuucuuuuuugaaaccauggccauguucuuuuuguugggacuucugccugucgcaagcuaacgagcagguccguggaaggcaccgggcauucgggccacaggucagcacggcccucccuccgcauggaguaacacucaccaggguauuucugccuccgcagacuccgcgugcagcagcgccccaggcuccggacccagcucacccaacaacagcuccgggagcgucagcgcggagaacgguaucgcgcccgccguccccagcaucccggcggaggucagugcgaagcguuuguccuguguccuacggcuagagucggacucgggacggaugagcuugaaaugaccccacuuugcacuugcccuucacucuucaccuuccaauuuggggugagggaaaguggccugugagccauccuaaaaaggacgcaguuggagguuacucuccugccuuccucucaucacagacaucuccuuucauuaugaacacgcuaguuccaggcacgucggggacagcccugagccugguccuuucuccugaccucuuccagagcagaugucacuagauggugucccagcacaagcccacgcauggcaggugcucuagguggacaggaucccugcugcccagcucgcuguggucgccagugcucugaggguggcugagaggccgugggcacguggguauaguugcuaagugagacuuaacauuuuuuauuuuguauugagaaauacacaacacgaugucggccaacaaacuaugugucagggccgacuggagcgucacccguggucagcauggcagggccggccaaagccacagagcggggaacuuuuccaggcaucacgggaaccaggcaucucagaccgcagagcucagcaccccugguccccugccuucaucagaccccaaguggugccacagucugggagggacauuggcaagcuagagaggagucaggggacgcuuggagucccuaggugggaaagaugucagagacgcaggagcugaguggcaaggcagggaggaguggcgcccaggcuggccgagucgcacacugaccauacucggaggcuuuccagggcagcagguccgaggaccucgcuccguguuccuugagcuccuuugcgcccccugccuuuaucccacacgugucccgagcgccuugugccaggcccagggacagaaccaggcaggcagcaaggaccugccccacacuccacacaaugccccacugacaaggagaggccacccccagagcacggggaagaagagagaggcagagagaggcagucccgcaggcugaguggugcccugggccugggugggccugacugcagggcaggggugggagggguacgcuuuagcagugaguuuucugaugaguugagcuggaaaugcugugucugcuucauggggcagaguucuacugagugggagguucuuucugaauucucuccaacuuacagaaggcuauaauuuauuaaauauaguuauugacuuuccuucuuaaauauuuagaaaugaauccugcccuuccaaaggauuggcaaaucuuagcugggauacagaggcaugaguguuuagcauuuucauuucaaauuucaagaccguuuauguauaaacauuuuuagagacuagaauuacugcucagaacgaauuuugcccuuugucuccaggcugcuuaauccccaauuucucuuacucuuucuacuucauacaucgauuucuuuuauuaccugucuucuucagccugccaacuucaguacuuauuuagaugauuagaaguuuuaacaguccucuguauggcuguggucauagcugaggucuaccaguaauaagccuuauaaugcaaccuagaaauuacuuccugcccugagguuaacacugguugcaucuuguugauugugguccuagauacauguuuuuauuuaaaaugaggcacuuauguacaugguaguuaauauuggaacagugccuuguuugggugggucugcaucauuccaguucuguguuaauuuuuagaaaucacgauacguaaaugaagcuacuggaaauuaauagaacauguagaaggaguuacaggaaauaccaagaggugccauuguucauguuccacaucagauguucauuagagugggcacgggcagccuuugcauguuggaucacacccaggcgcccuuucuggguuucaguaucucuagaguuggacgggucugugagaacaccugugcuucauggccaggggcuggcucuccguucucacguggugcagaguguagugagcuugcccgucagagggggugucucgaguggaugaggauguggggggagcaggggccucccagccuggcucucagcacugccuuuucuguucacccuggggucccuagaaacacuacuguaccuugaaggcccccuggacccagggaagcccagugugccgggcaccuccuccucuacagugccagggaggcccagagugccggcaccuccuccucuacaggccagggaagcccagugugccggcaccuccucuacagggaggaggcagggcucagagagugagaggaagucgcccaggugcguaaggggacagcuccucuguggccgcugcugcuguuauuuacacgcgugccuggaugcucugaccucaggcccgcggacuuucccucugagcacaugcugagaugcgguccgggggcgccagccucagaaugccucccgcagggcucggccccgaggcagcagaugccagaacgcccugcgauuucucagguggaccagucggcaucuccaaggaacaaauucucagaagccuccuuuaguuccagaaaugggcuuaaaaaaaaccuugcuuacaaaggaaaugaaaacuuugcaaacauuagaacgucuccuuauuuuguucccaaaugauaacacaagcauuuccucuacagcauaacuuacugauaauucuuuaacuuuugacaaaaaaaaaauugccuaggaaaaauguuuuccucaguagcccuuuaaucauuccuuacacaauguaauaugugagcaaaucuaaagggaguugcaggguuuccucuggggcgaggugcgccgugaguuugcuccuaagugagaaggccgggcuuucuguucuguaggaacagccugaguguaaguguuugucaggagaagcguuucuuccuauccccaauggccagucauaugucuuuggggaaaugucucuucagauccuuggcccacuuuuauacuggcugcuucagguuuugcuggugaguugcuggaguucccgcauguucuggauacugcucccuugucggaugaauggcuugcacauguuuccccuucccacaggucgucucuucacucuggugauucucuuccuuugcugugcagaagcuuuuuaguugagcagagucccaguugccuguuuucguuuuuguugccugugcuuuugaggucuuagccauggaucuuucacaauagccaagaggucgaaucaaccucaguguccuucaguggaugaauagacagagaaaauguggugcuguacacaguggaauaccaugcagccaucaaaaaggauagaacccugacauuugcagcaacauagauggaacuagaggcccucauguuaagugaacuaagccaggcacagaaagacaaacauggcauuuucucauucaucugggggagcuaaaaacguugcugucauggagguagagaguauaaugaaaucuguuaucuauucauuauuaacguuagcuucuggcaaggggauuucuaucugccaaaccccacuaacuagcaugauuacaacaacauuuuauuccuucucuuuguuugcccauucauucagcagacauuccuugaguagcuacuguguaggggauauaguggugauaaacuauuguccuuuuuagcaaaacacguucauucuacaagcaaaaagauguuaaauaucacaguaguucaaguccuuggagacuguugcugcugacucuuccuguguggccuucuaaucuuuacuccuggcuuguguuugcuuuauccaagcccauucuuuaaaagguacaugaucuauaaccuguuuuucuaacuuaauguaucauaaacaaguguccaaguaaucagcuagaucguucccaacccccagagcaucccggugugcaaugccccuccguucuguuaacaccaaggugucggggaagccgcauagcucugccaugccugcugggugcucggcccugcagcggaggcuucaugggcaucaggccaucuccuuauuucuuaacguuacaucccaagaguggagcuccagcaucaaagguuagacagauuuugaaggccuuugacauagauugccaaauuguccugcagaaagggugccacuaacugauuugugauucacccaacaguguucgccguuccucuaggccaagaugguauuaccauguuucaaaaguguuugccaauuuguuggguuucagaauaccuuuuuugaugaccaugauguguuuuccugagcgccuuccccuuccugagcucugccgucacugguccucaccgcgugcuuuucucacuguuaguuguuugauuugcaagcucucugugcugacccucgucugccucauacauggccaguauugucaucauugcccaccuuucguagaggcaguuguuuuaugauuuucucuuuauuuuuaauuuuuguggguacauaauguauauauuugugggguacaugagauguuuugauacaggcaugcaauuuguaauaaucacgucaugcgaagugugggauguccauccucuccggugcuuauccuuuguguaacaaacaauccaaucauacccuuauaguuauuuuuaaauguacaguuaaauguuauuuccuuuuuguuuucugccuuugauguuaugucuggaaagacauugccaacuacaaaaaagcauuguaaacuauauuauccuagaaacugcaaaacggcauuguaaacuauauuagccuagauuuccuucuaacuguucugugguaaauaaucaaacugaauagaaaucaacgagaugaugcuggacaaggugacagaagaagaacucguaucgggaggaggaaacuggaguggugaauugugcuuucauguuguggcacguguugaaaucucaugcucucauugcugucucauuuguuacauguacguuuacgcucauauaucagaauucagugcagguguuuucaucguuguuuuucuugguguauauugcugauguuuggccgugacagacugugauggucaucguguguucuguccccagacgaguuuggcgcacagacuuguggcacgagaaggcucggccgcuccacuuccccucuacacaucgccauccuugcccaacaucacgcugggccugccugccaccggccccucugcgguaagucagcccccguggguccgugugguguggggugguggugauggguccuuccacccgagcauccuggcugugcuuuccagggcacggcgggccagcaggacgccgagagacucacccuucccgcccuccagcagaggcucucccuuuuccccggcacccaccucacucccuaccugagcaccucgcccuuggagcgggacggaggggcagcgcacagcccucuucugcagcacauggucuuacuggagcagccgccggcacaagcaccccucgucacaggugagcacaaaugggccugggugcagccaggcucugaggcugcccacgcucuggauggugccccgccuucgccugccuuuggaggagacaggaaugcacgccugucccacccccacaguucccaaacacacauccccaucacgugauguagccaccgugacugcagugaaaauccaugccucacucccagagucagguagauggaguggaaacagaagucacuuccccuuucucaccuuuugggagaggccaccggcucuugcgauuuggguuucugucuggaccaagcugagccagcgcuggaagcccagaaccgacucuuguggucaguuuguguuagcgaacuuuuacaaaugugcacugucugggggagugguuacauuuagaaaaauacaauuuagaggaaaaugggaacguccuuaugaaauuacauagcaacagcaaugugaaagugucacuucagaaaugagggcacaccggccggacacggugacugacaccuguaaucccagcaguuugggaggccgaggcaggcggaucacgugaggucaggaguucaagaccagccugacuaacauggugaaaccccgucucuacuaaaaauacaaaaauuagcugggcgugguggcgcacaccuguaaucccagcuacuugggaggcugaggcaggagaauugcuugaaauuggaaggcagagguuauagugacccgagaugguggcacugcacuccagccugggcaacagagcgagacuccgucucaaaaauaaauaaaugagggagcagcuaccuacccccuugccgugcgggucaucguuguacaucuucauagcuuuguguuuggcuuccuggaaaccuguuguugccaauugaaagcugaaauacccucagagcugcaccugugaaacucuggcagugaacuuggugaaaacucaggggcuuggcguguuguaggaggcugcgcugcaggaugcguggggcuaggggcuggcuugggugggcuugggccucuggcuugacuagucugguggauuuugguguuuucuuguuuugugcugcccaugugucucuguuuagacagagaggauuccuucuuauuccuucuuugcccagaagccaaauggcgcaaucuuuguuuugugccugagccccuuucuguuuguuucuccagaagcuugaauucgugucccugccuguccagagcagaggagcccgugguguaacgagggagggggcagcccucacagugccucucugagcugcggccacaguggcaggcacgcggaucucucuggaggaauguaucugagguugcgucugagucucuuggaugcucuagaucagcuggcacgaguguggguagugaaggacaccugaguuucucgccugucuuuaaaaacguaaaaugugccugaucuucaggauuccugggauucacuucgucagagauguuugucacuuaucuucuuuccuucucuaaaucaguuuauucugcacgauuaaauagcaugcguaaucuuguguaucagguuuuuggaaaacagccuuuuugauagaaccuggauaucgagugugcaugggucucaccucucugagaaacgcacugaacucggcguugcuucuucccugugugcgcucaucccucuuuuccucccaggugcagcuugcucguuggcauggggaccugcccaccgugcccugcccaggcucugugccaccagggggcccaugcaugguugcccagcuugcucuggccuugcuuuacgccugugcccagcaagccccuccaguccuaugccgccaccuccaaaacccugcaagccccuucucuccugcacagccuccccagguugccagcagcucauccugcaaacccccuggcagggagccucggagccagugucacgugugcagcguagugcagccacacagccgccucugucccagcuuucuccugcuccaugacccugggaagccgcuuaugcucugugugccuuguuuucccaucuaggaaguggggauacuaagcgguccgcccccgugagccugaugaggguuaagugggcugugcacucaugugccccugcagguguuggcaucauuguuguagucauugccuuguucuuaaccugccaccucccaugcucucucacucccccagccagccccuguccguccucagugucucaggggcccucccccagccccgccaugagcagggcccucauuuggaacccgcugggauugccccaucuucuugugggaagaagccuccugugcagguuccuccccuccggucuguccuccuguauccaccggacucuccuugaaggccuggaggcccccacgcugucuagagcaguacuggccaggucaggagccaccagccacggggagcuguuaaauaaauaagucagaauuagaauucaguuucucagucacaugugcaccacauccagugcacggcccacggcuguccccugaauguucucauugucacagaagguccuggcagggcggcacuggccuggagugaagucccagcuugugagcaggaacuccagccuuccucuagaagccucguuucucuucccuaguccgguacagcagccaggccagccggcucaaugcuggaccagaccgcagccagcccccagagccagggcucuuucccagggcccuuuuccccaucaggugugguucgucugcccccucaucccaggcuuccaucccugccccagcccugccuuguugcuccuucccuggaucacacugcaucuucguuuccauguucugcccuuuccugcaguuuuugacgaacucuugcuugaguuggucuccuggacagcagugccuguguuuuccuggcccacagacagacccaccuuaucgcugguaaucguggugcauagguguauaggauaucaaagcuagaacagcccuccagccacaaaugcuuugaaacagaggccucugugggugaggucacugucagagaccagaggggugagccaugguccagggucucccagagcugccuccuacacgccacauaccuccagucagccccuuuccgcaccgcuccgggcaguuccucgccagucacaggcugggcgugccucuucuaugucccuguucaugugcugcuccagugcggcacuccgcacguggucacuguggacucagaucuuugcagagugucugguacauccucggagauuagucuccgcauaacuagcugaggcggggaguggagcucaggagcccauucccggguaagaaggaaagugucugugcagagcccugugcugcugcuuuaguuggacgcaaaacugugggcaugauuguugccuggacagcccagcuaaguccuuuaugaugcccguguggcugagaagcaggacuuugagaaccaugcaaucugcugucaggacccgagagacagggccccccaagacccaggaggagcuugguaguacaggcauguggaggagaaggcuggagaccagggcugugccgcaggugggccuagggaaggcuucccggagcaguggcgucggagcugagaucucaguaggagcuugcaggcggagagggaagggcacagguggagggagauguguaugccucguggagguggcccugucacagaucuuucuagcauccugaaacagagcaugccaccagcgucuuaaggacagguggagggagauguguaugccucguggagguggcccugucacagaucuuucuagcauccugaaacagagcaugccaccagcgucuuaaggcuacguagccuuccugagcuggcaguggagacccacugucccgcugucacaugcugaguggagggugccccuggcuucuguguuagcgauggcaugcuacuguuuaggccucauuuccccaaaaaacagcgagucccaggaagggcuugagcacagcuggccgugguucauguccuauaauuggcacgcgaggcugugguccucagcccuggccuggccucagcuccauccccagaagcucaaacagaugcugauugguccaagcgaauccagagcacccacauuguucccuugggcggccgggauugcaaacugugaguuggaucuaacucuugccugguuugcuucucaauggaaggauuuuaaagaauuuugcagaaaaagcaauggaauacaccagauggacuucuaaggacucaggcacccugaauuguucaucucaugugaauucaucaccuaaacagaaucccagugugugcagacccgcucuucaaaacuggguccggaacuugagagcaauccagucuuucaccuucuuuuuucuuaaauccccauaccugguggggugugucuaagugaugcauuugcacacucacuaauuaguuuggguauugcugagcaggguguucuaaacuuagacccuggauggcugggugcauuccagcaugcucacucgggaacugucauugcaauuauugugauuguguguuagaguauggacuuccaggggagcuggccacugagcacaguucaggcccagccccaagugccuccaggaggagcaggagccggcagccauagggacacagccguccagcaccaggagccagggucagcucaggagccagggucagcuguugcccuugcacugggcacagggaagggcuucugccagugcucagggcagaaagagcagaagcuggaaaaacccuggcuaagaugcccaggggaggagcccagagcagggggccacugggaccacaggagccaggcucugccccacaccccgcccagcaccacacagccagccccugcagcugggucaccgaccacagaauuguguccugauggacuuaugcucaaaagucccugacagcauauccugaagaccacaucauggucugucaucagaagcucuuguuaaugaucucagggauccaaauuggaaaccacccugccagcaaauagcauugcuaugcagaggucagggcgcugcuuuucaaggauacccagggguagggugucccuguguauggcggcccuggguuuugcacccuggaggcagcagagugaaauucugagugggcgagauaggcugagagagagugaggggcugguccguggggagugcaacuggaaaaggaacagggccggucugcacaggggucucugcucacaccaguucugaaaaugaagcccuguuccaauggggcguaggcuuguguccccgugugaagcugguggccugggaaauuccugggcccaugcggaggauggcgggaggcagagcccuggaccagaaggagccugggagcgcuguguagcccccacucacaccgcuggcucgagucgcuuguuccuuaccgugugucacaccaggaagcugaauccuaugaaguuggcguguccuucuccucugcagagggucaggccugggcaggggacugugcagcucaucaccgccuccaccccugaauggugugcacacugaggcuuugggggaaaacaacgcuaaggaaaauguauuucagguucccauugcuuuccgaggagagaccuuuccagcaacuacguagccuuugcguccccugaaagcagcuuugugugacugacuuccuuauuuccuccgugaaguaguucaaucccacguaauacacacgucaacaauugaaaaauucugaaaugccuucuuuuuuuuauuuuuuuuuugagacagagucucguuugucgcccaggcugaagugcaguggcauuaucugggcucacugcaaccuugccucccagguucaagcaauucuucugccucagccuccugaguagcugcgauuacaggcaugugccaccauacauggcugauuuuuguauuuuuaguagagacgggguuuugccauguuggccagucugaccucaggugauccacccaccucggccucucaaagugcuaggauuacagccaccaccgcgcccagccugaaaugccuucuuuaggaugguuuaccuuuuucuuuuuuuacguuuucagggaaugauucugaauggauuuuuaguuauucacuguaauuuaauagccaagcauugaugauaaaauuuaagauaacaugucuuuccggaaaguugugggguugggugaaaagggauggugguuuagagaacacuagugaauaacuuuugaaaagguagugaagagcagccuugcuggggucuugcuggguuuagucugucuggauguguccuuuguguuugcauaucacguaguauuucuuaaauuuagaaauagccccugcaaagggacuugagaagcacuaagcagcauggcucucacugggaggcuuggacuccacuaaaccugaugacacacccagcugcccugcgagcccuggcaucaguguccugggggagggacaggacaggagcugccacuugccggcagggccaccuugguaucccuggaggucccguagcccuugcagcaggcauguagccccgccuggcagcaggaacagcaggcugccucaggcggaugccgaguuccaaagagucccccaccagggccuccaagagcuggugugguuacuuccuuugucauuucacccggucagaugcccuugagcgggucagggucauuuuuauccugagcagcauuguuuaguuuaguguuuaccccacucagguuaccagaggaacagauauucacagagcaggacagaggguucguuagauccuuuugcccacaaaaccauggaaaaauguuaaacgaccuaaaccaacaauuuauauauaucucgaugaacgcaugcagaaggaaaaaauguacuucacuagguugcauuguaaaucaagauacagaugccaauuaaagcaagaucaucuaucaaaauggauucuuuuaaucaaaacauacaggguuggugaagugggcauccuccacucgcuggcagggauuagccagaucuuuucagaaagggguuuugacaauaugcauaaggacuuuuuaaaauguuuacgccaucuuugugcauaaaaucagugcucgaagagaccuuaaaacgaugucaacccuaaggacaauuguuuuucucacaacucaggcugucuuuggaaauauguggaggcucccagaaccguggcagccuuccucagcacacugguggcccucucuccccucccaccgugcuguucagaccaaaacccacuuuucuagggccuguggcccccaggaacaauugugugguagccacucuggggaagggcuugcucuuugaaaccugccacacaggacuccugacguuuccugugucgaccugauuuucauagaaaauugccuccaaauuaugguuccuauagucccaaagcaccagcucacggcccccagccucagcuggaaggggcccaguuagcgagccagcucuggggcaccagggcagaacgccugggcuggcgggcacagggcgcaguugucuccaucacuuacucaauagcccucucucccuccucucuucuuccucuuccccucugcuguuucuuccuccaauuaucuucagacugguaucuuucaggccugggagcacugccccuccacgcacaguccuugguuggugcagaccgggugucccccuccauccacaagcugcggcagcaccgcccacuggggcggacccagucggccccgcugccccagaacgcccaggcucugcagcaccuggucauccagcagcagcaucagcaguuucuggagaaacacaagcagcaguuccagcagcagcaacugcagaugaacaagguggguuugccggcucagcgcucccaggccccagggcggcugugugcugugcgcuucagccucaggcuucagcacuggccccuuucugaccuuaagggaggccaggaggcagaaagagggaaccgaggaggcacaugcucuggcccacagcacagagcugggcaggggcaggggcagaagggaugcugcugggagcuugggcucaggaacaguucaccugcagggagugggacgcgcagggccagugcccucucccaccagcccgugugaguuccguuggaccagugcccucucccaccagcccaugugaguuccacuggaccacguccugccuguggugcaucagugccagcgaauggaauagucuacuugggcaacacuuuuuucuuggguuuccuaaggccauuuaguaaacauaccuuuaaauaaacuagcaacccacagugcccaucucccaggccauccggcacuugcagccugccugagugcaugagcagcguacaggguaagcagcguacagggccggggggcccgggugcaguuguacaggugcagaacuccagcaggaagucgaagggacacugucagagcugguucugggccccggccagcccacagaggucugcauaaccuacagacaucuugaaagucacucagauaaguccauuuucaggaggagguaguaggcaaggcuagcacugugaugcucgugaagaggaaaacuaacaugcugauuacguguugaucaaaugcuggcauuugacauagagcaucuuuaagguaagagaugagaugagcugcuaugaacauaguccagcaguuccucaaaagguuggacacagccaccacauggccccacagcucugcggccagagaugaaagcacacaucuacacguaaacucacucaggcauucacagcaaccugagucccuguuucaggccauuccugcacugcuguagagaaauaccucagacugcgugauucauaagaaaagaggucugauuggcuucugguucugcaggcuguagaggaagcgugguguuggccucugcuucuggggaguccucgaggaaacauucaacugugguaggcgaagggggagcgggcacaucacuuggcaagagcaggagcaagggguggggagaggggccacacacuucuaaccgaccagaccucaccagaacccacucauuacagugaggacagcaccaacagacgguguucagccguucaugccaaauccacccacaugauccagccaccuccugccaggucccaccuccaguauugggggcuaggcuucagcaggagaugugggcagggacacagauccaaaccguaucagucguaauaaccguaucagucgugauagccacauuacaugggaacagcccagguguccauccugugaugcgcggccacacgccggcacaccggaaugucacauaacauggaaugucauauaacgcggccacacgccagcacaccagaaugucacauaacguggaaugucauauaacgcagccacacgccagcacaccggaaugucacauaacauggaaugucauauaacgcggccacacgccagcacaccagaaugucauauaacgcggccgcacgccagcacaccggaaugucacauaacguggaaugucauauaacgcggccacacgccagcacaccagaaugucacauaacauggaaugucauauaacgcagccacacgccagcacaccagaaugucacauaacauggaaugucauauaacgcggccacacgccggcacaccggaaugucauauaacguggaaugaugugcggccacaugccggcacgccggaaugucauauaacguggaaugacgugcggccacaugccggcacacuggaaugucauauaacguggaaugacgcacggccacacgccggcacgccggaaugucauauaacguggccacacgccggaaugucauucagccauaaaguggaaugacacugacaagcggcagcacgggaagccuuggaagcaggaugccaggcacgagaggccgcgugugguaugauuucaugcacauaaaacguccccaacagacagacucacagagacaggacacagacucgugggagccaggccugggcugcugcgggcagauggggagcauuucuggggaacagcgccucuucuuagggauggugaaaauauuccaaaauuagauauggugaugacugcacagcucuguaaauauacuaaaaacaacaaaugauaucauuuaaaagcgugaauuggaugguaugugaauuauaucccaguaaagcuguuacaaggaagaaagaggaugaguugaugggaggggaacguggagaaaccuuuggcagauuuggcgacagacggaaucauuucuccguuuauugucucuccugugaaagugccccccucacuccaccccacccccguugcuucccuggauuucaggaccgguccuggguuguccaccuguccggaggcucagggucuucugugguuuuccugagggugaaaaauugggguuaggacuggggaggagauagacuuuccuagcacacguagacaggaguuggaaagugaaauaccaggaucccagcaagagcagagguaaagccguggggagagaccccuacaccaccaacacugcugccucuucccgcagcccugaccuccugauaccauuagccccuccugccugccuggucccaauuuccuucucucaagccccacaguuccagcccagaagaggagucagcucagcccuggcgcaguggucaaaggcuuugauugcgugguguccgguccaguggggcugagucggggaaggccccugggagauggcagccggcuguggcccaaauccauccuagugugugagccaucauggggcugcaggcucaggauugaggagaugggccccuuggggccuugcuccaggguggcagccacgucagaccagaugcccagcacaggccacagccuggccccugcugcccacuggacaccacaaaauaggcucaccacccccaccccacaugccccuccacccccaagcccucaucagcggacagcagggaacgcaucagaaauggauggggcacccagcaaauccccucauugggacgggaagggcacaggcugugggcgugucgggcgccugccaggcaucuuuacucccaggugucaaaagcacuuucacauccgucuuccuaaugccaacuuagguuuguuaauuuuauuaugucauuaucugagugaugggguaggagguuugaggaagacaggaaacaccuauucacaugccguauacucuugaaggauuuagaaaccggguacucucacuggaguuuguucucugauugauuuacgggagugaaugacaguugauugaaacguuuagacaguguuuucccaggaugcccaggaagacaagaaucuugcccagggccgccuaacacugacgucccggcccuuccucuuggaggaugacguccccaggggcuuguucccugagggcaucugcccagcucuggcagcugugaacccuccugucccacugcgcugcuccagccuacauugggguugcagcuggggccggcuuggucugccccuccuucagccuguaccuuagagggcaguuguuuuggaaacaucacugugaauaaaaaagaaagagaggcggcccgugccuagcccugguguucccugcagccauauguagccacucuaguuuucccgaggccugcagccugcagagcugccccuuuuggcugagaaaacuccaccagguggacaggaucgaccccgagcuggcucugcucuccucuccccagccuguggucgggaugguggcagauguuuuccaacugugucagcuucuguugcccgugccuuguaugcagugguguuuauaaggguuugcugcaugaaggaacuuucuggagaacgcacaccaucagagggcgaguggaccuuggaacucugcaggugaaacuggcccuccguguucgcuggccacguccggacuuggccucaguuaugucugguuugcgagcagugggugauguguguccaggcgaaauaccucuuucuauuaaaagaggacguucguuggaagguguccuccaccccuacagcaagaagccuugcuucucaaggugguucuucccaugguuucuggacucugcacaagaaccugccuccugcagagcggagggccucggguguguuucccuuuaacuugacauccucgguuuugaauaugaaaacuuggacucauauuuuggguggucuaauuacgaguguguccgauuguuuuaaaauacuggcaguuuaccaguucgguuuuggccgugaacuccagccugacuuuuuaaaaauguaauuauuccaaauauggaggugcauuuguucuuccugaauugaugaaaggggcucucaguguccccaaggccuucgggcugcacagagcugcuucaauuguuugcccgcguccggcucaccucccaaagccagcucugcagugcagccccagcccacagcccagccagugagacucagaacugaaugucaaaggagagagagagagagaagcaggcuuuguuugcagccauggcccagggaggugacccacaggcgccugcgucagugccaaggcaaggggccuggccugcgucacagagggcucugacguggcaccacugccaaagugacauccuccucaggcccugccugagagcccucgccggaggcccacgguguggagaugaucccuccuccaggccgaggggcgugcggcagcgggggacacuucagaggcuucauccucgugaaagggaggaaaaagaccugggaauguugucacuaaaggacacuaaagagaugcggccccuggcagcacacgccauccgcagccagccggggaagggccauccaagagcccuuggaacaguggggaggucuccugaugcacagcacgguagacgcggcugccgaaagccucaggcaggcagguugcaguggccuuggggccccugaaacagccccccaggaagagaggcugacccccgcuaugacccccacuaccuccaccgccauucaucugugcauaggggaaggacguuugagauuuucuuacagaguucuugaaguuuuucuuuaaguuugaaauuuaaagcugggcaugguggcucacaccuguaaucccagcacucugggaggccaagguggguggaucguuuuggcucaagaguucgagaccagccugggcaaccuggugaaaucccgucucuacaaaaauuagccaggcaagguggugcaugcuuguacuccccagcuacucaggaggcugaggugggaggacugccuaaugcaugacugcacuccagccugggcaacagagcaagacccugucucaaaaaaaaaaaaaaagaaauuuaaaggaaagcaucagaagaaaagucuuggagcuucuguguccaccgaguccucccugggccgucuccuuuaaaaggcaaacagacaaacccuuuuccucgaucagccuggcuuccugggaguggccauuugcugcaggaaccccuccccuccacccucagcugccuuguccuccaccccacccuagagaagggaccugccucuguguccucuaugggguugcugcccuccaucacuuuuauccacuucagaauggccccugggcugcuaaagaaaggcaggcacaccacuucggucauugcugggauggggcagccccacaggguccccucuaagguccuagccuuccucccccaccccucccccuauuucccuuccccgcccccccauuucccucccccaccuuccuccuucuccccuugcccuuuccuggcauuguacccacccuucugcuggcccucuggucuccucuccuugucucugugugccugugccuauguguauuuguguaucuguguaucugucucuucauguguauauguaucugcaugucugucuauuugugcaucugucugugucugugugugugugucugugugcgucugugugugccucugcggguauauguaucuguguguguauguaucuguaugugagccucuguggccucccugcuucccgacacccuaccacuggucccugaggccucaucccuguuucuucagcuccccagcucugcguagcuccucugugcucccagcuuugacuuuauuccaccugcguacugcuccaguucugaucugucucccaaaucccagacucgaaucugcacuuucuugcuggauuucucagggccccaccggaugcugggauucagccucucugagcugcccucuacccaccuccccgucccggggccagcaccuccucugugguggcccuucucuggcacuuggccaggaguccuggugccuccugcucacucuccuguccacgggugguccccacugccuucucuggcacuuggccaggaguccuggugccuccugcucacucuccuguccacgggugguccccacugccgcuggacccagccucugugccagccucugcccggcccugcugccucugugcagucgcuucucugcaggcauuccccugcccucgcgcugacucauuagcaccuuccuguggcacaggcaggaccaugcaccccucggagagacccgcagccucuccugcccauccacugaugagcaaagcccacauugugaggagcccucugaggcccugaacaccuccucagcccugagcucccaucuccguguccucagcccuuaggucugguccccgcacccucagcccugagcucugagcucccaucucugcguucucagcccugagcuccguuccccuuagcuccaguucccgcgcccucagcccuuagcucugguccccacacccucagcucugagcucugguccccgcgcccucagcccugagcucugguccccgcacccuuagcccugagcuccuguccccauguccucagccuguggucugagcccugucuccucauccuuagccuguugcuuuuccuuccacaccugcagccuccaggacauucuugcuuccugaaggcccguccuggcugcugcucucccuccucccgaaucccuccugcuccucauccagggcauuguccucagcgcucugugccaccuucuuagggaauuguucugcuuucagauucuuuguucuuugcucucccuccggugcaccgagugauaagggccccgcucucaagaaaccucccauacaccacucagucagucacaucccguuacacaucagacugcaccgggcccugggggagcugcaggaacugagcguaugggugcccucuugaugaguguccugaaagccaagacuuggaugccaucuucgagguccccugugaaacagcgcugcuucacccggcgccccugcugcaccuggcaccccugcucacagcgacagcgguaccgccaggcucccuguucucccugccccccacagggccucucaggcucucagugugcaggaagaagaugggacugagaaaccagaagcaaucacagaccucaaaaucaucaagugaaacuaguguugaaacacaugcuuuuuuuggucaaccacugagaaaccugucagagcaaauggggacaauguugcuagauuccuuaguugaacuuguuucuccccggcuuugugaaagucuaaccggaaacagucgcauguauuuacagcguacggcgugaugauuugauacuuguaugcguugugaaaugaucgccacaagggaccucauccaugcccccuuggccucacggggcucucauugugucugugguaagguccgugaauaucggggccaccaaacugugcaucaggucccggaacuuauuccucucccaacggcacgcucacccguggacagcacguuccuguucccgacgcgcggccacccaccgcugcacucuccucccugcgaguuuggcuuucugaagcugaguuccuuacgugccacgccgccuacugguucccacacugccgauggccggcccgccccgacacccacgcugccugcacccggcuggaccuggcuccauuucccugugccagguugaaagcuuuucugaagaaaagcugccuucgguuuagagauaaacaauggaucugcguuuucuucacucggcuuuuacugccguacuuuaaacugcucuuagaaagaaaguuaagggaugaucaaucauaaaacaaaccccccgcccaaucugaagucucugauguuccacagugaggcacagcagggcucuggaggcugaaaacucaccauguugugugugugugagucugcgucucagcccugcugcguggggaccggugucgucugauacggcugaccccugggagcaagcggacacugagugcccaccaacccgugccccguaguucaggcugcuggagaggccgccucgcgugaguguggagcagcaugcagugcucuaaggguguugaaaugcaagggcucgggggauuucaggugucagucuuccuugcacaccucaguuuccuucuggaaacagucggaugcggugccgagauccauccuccacgcgcuguagcuccucucucugccaggaacucggcuugucccaccgucccucgaaucugcccuucaggccguuccccacggggacagaugaaucgagcauccggagagaccccucgaucugggacuuugggauugugggacguucuuucacagucugcagaggaaugcagcucagucagugccuucuucugagaaacucccugugcgcccuuccuagucuaacuccagacccccgcccucucuccugagcuuuuuuuuuuuuuuuuuuuuuugccacuucccgcaucccucucuccccucuuguucucaacuccagccuuugcucugcucacauucaucccuuuucuggcucccagaugugauggggcagcuccauugcccaaaacgaaggaguuguccuggccacccucucuugccucuccauaugcagucugucccugggccuagagcugcuuccuuuuuggugucauggaaaccuguucuuucucccaugccuuagccagacguggggcuggccucacccuuucaaccucuggccugucugcagcagggcaugcuucuagaacgugcaccugcuuguuuucagcccagagugcccuucccacagccccaccucgucuccggcacccuguguuccuguucucuggccuuccacgcugcagcccugcuggcuucccacagcucccagagcgcauugaggucagccauacacccuguuccacuuugccccacuacgcggacaccccuugcauuugccccauccuuuuagugaaugugcgaugagcaaugccugugccacguggaugagucagaaguggucccuacccuccugggaacugcagacugcaggaaagauggauacaugaauggcaaccacagaaaagccagaggacuggggucggggggugcuggaggagggcacauugcccuaucaggaagaucagcugacccuggaaaaggugacaugcacgggaggcucacaaagccucuuggaguggcuggaggccgaggaaggaaggcaagcagcgggcuggaggcgaguguggcaugagggaugcagagccagcggcguggucgggagcaggguggcagggaggcugcaggggcaacauggccacacgauggaggggcucuucagcagaggcaggauggcagaagagcacuugggggacauucagcaggggagugaccagguccacuggcccguuugaaagcgugcccucacugcuacaugaagaagauugcaaagcguugacgcuggaggugggggccucccaggagccaugcugucauccaggcaggagaggccagguggggcaaagcaggaaaggcaggaggucgaggcuggagagaagcagcaccguccagaggcguuucucgugagcaaugcaugggcagugcuuggcggacagaauugggagcuuggggugugacuggacagcuggccagagagaggucccaauagccaagaacagguccuagagaagggagaggcuuggaagaagcugcccugcguucggcauuggaccugcugugcuggggcucaugggcacucuaggcuaagcugaggcgucuggcaggccauuaggucuggagguaaagagcgaguuugggcucagcaccaccuuugggagucgcugauacuuggaauccagaauggggaaaugagccgaggagcaggcccaggacaaaccaagacggaggagcaggcggggagcaggagaggagcaccugccgccuguuccgcacugagaggccggggagggagaccgagaagcguccgugagauccaacaggaaaagaggucgggggcaucuagggagucccacaggagggaggauguugcgguucuuggggccccauagcggggcaggucauggagcacccauggaauccugcaagaaaggaggucauggugucccugagauccugcagaaggggaggccguggcaucccugggauucagcaggaagggagguccuggaguguucccaggauccggcaggagggaggucauggcacaucggugggauccugcaggaggggaggccguggcguguuggugggauugggcagugagcauuguggacgugguugucuuccgcugaguggguggugggcuguuucucuuagcaguuguggcugugaggucagcauuggccucuccccuucacacucaagcucuccucugcagacucuguugacaccugcagcuucuuuucuguuucucggugccugacacagaagaggugcuuaguaaaccccaaauguuagucagccuccuucccugggccaggucaccuugacccugggcugggguccuacugggcauuauuuucuuaggcacucaggcaccccagugccuguugggagauaaaggugccugcuggccuguggcagggugauaaggugcccugagucccugauugucugccccagagggugggguuugcagcaucccuucuccugucagaugagcucagaggacccagcucucugugcuucauguguuaccuccgccuugcagaucauccccaagccaagcgagccagcccggcagccggagagccacccggaggagacggaggaggagcuccgugagcaccaggcucugcuggacgagcccuaccuggaccggcugccggggcagaaggaggcgcacgcacaggccggcgugcaggugaagcaggagcccauugagagcgaugaggaagaggcagagcccccacgggagguggagccgggccagcgccagcccagugagcaggagcugcucuucagacaggugaccgcaggcggggagggcaccagaaggcuggcacgcacagccacccucgguccccagguggcaucuucuguggugaucacgggggcugcagggcauccuugcgcggucacuguccagugucucaccugucuuguccuggccagugagggagguugauguggcuuccauuuugucccagccguuccuagggauacgagauguuugcccccugugggugguuacguaacugcuuuccagccaugcgcaggccccagagaauggauuuccuuccugucuguaggcuguaaaugaacacagaauccauguguuagugagauacagcaugcuuuuuaaagaagugaaggaacuagagguauuaauugaucaaaaaggcaggcagggccugaucagaagucaagaccuuuugugacccagaggugcuaaugagcagcccugcagauccagacagacgggugcgauuguggcacccagagccaguaaggcuucagggcacugacacccaguaaccaaacucacaggagacugaugaagaaggccagugaaugacugguuaauuuccauugaaacauuaaacuucugagucagcagaaauaccuaaggcauuugggcagccagcuggagccccguaucugcagcuagagugcccucaggaaaguggcuuccucccuguaggcaggaagccaguccgaggaaccacagcucuguaggauuugauucuauccuccagcagcagagcugcugccucggcugcaggagccacuggcucguucccucccuucucucuggacuccaugccggccgugccguugagcaccuccccagcuuccugacugccagcuguguggccagacgcugcaucuccacccccagcagcaccuuggaagccaggagcaggacgcccugcaguaaacuguuccccuuaauucucagcuacaguucuuaaaugcuugccacugaaugaaucaguguggggccuuguaccuggagcaccuagacccaagccugccacacacgggaucagugcucaguggucuccagaggcuucugggucaggagcccuucuccaccgagcuucccccaguggcuggcauugggugcuauuucuccuucuuguucagaggggggccugucucuaauuucugggccuucuuaauuagcaccccgggcacuaaacacuacaaagcccagcagaacuaacgcuuggcaaagacagagagagaaagccccgggccucucuggcacacacacggugcuucauggugaacacucguccacagguccuguccgacaggcccagggugggggccucuuccuguggucgggccuuguaaguugaugaagaucugaaauucagugugcuauuauuaggcugauaagaaaugggaaacuauuuacauuaauaauuuuuagggcuaguuucucauagaucagccuuuacuuugagaaaaagaggcuuguuauauuccaagcaugagaugauuauuagaaacacuuauuuucuguucucucuggagaguaauaggcagaaccccuuaucagggaaacgucguaguacacggagcaauuugccgagguaaacauaaggcggggcaccuccagcccgcgucggggaggauugcuuauuaaccacuuaaccgcguggggcccacggcaaucccagcugaauuuggucagcagcagacugggggccugugggugcuggcuccugcuccagcuccugcugcagcuccucccacugucucagggcuuccuucuucucugcucccuccuggcucugauuccuuuugugugugugugugugagacagagucucacucuguugcccaggcuagagugcaguggugccaucucagcucacuacagccuccgccuccugggcucaagcaauuauucugccucagccucccaaguagcugggauuacaggcacccaccaucacgccuggcuaauuuuuuguuuguuuguuuguuuuguuuguuuguuuuuuuggagagaugggguuucaccauuuuggccaggcuggucucgaacuccuuaccucaggugauccacccgccucagccuccccaagugcugggauuacaggcaugagccaccacgcccagccugauuccuaaaggcaggacagaucggagccuggccggguagcucugguuucccccagugcuggcagcacagggcugggcucugccuucauacaggagcugggauguagguaccugguuuuccauguucacaggauuuguucaucaaaacuaagacaggauuggcgcagagcucccagcaaggaggcgcccggcuuucuuugugccucggccuggguggcagguugcugugcucucccucagcugcugucuggggagaggcuuggcagcugugaccucaucucugcccugcucccuccacuccacucugccucguauggggguuugcaccucagccuguucccagaaucccucagggugucccaggccccuggcugagugccccccccacacacagagcccagcccagcuccaucucaucagagaggcacauccccaccagcaggccugcucuaggccccaaagguccugggugcccagaagcugaugggcuguuacugcuuuuagccugcacgagggugugugggaugugagaccagggaggggagcggcugcagaugaagcccaguuggcacuuucaagucugagagccgauggugcuuucucgcccaaguuuggcaugcagauucaaugcuguuggucagaacuaagacccacaaacccaacaaggggguugggcuucgugcccacucaccguaugugugugguauggcagaguggacgcugugguccccacaucuacauggccuucgcauaucccccagugaaaccagcgagggccaggcugccgccccagcaagagcuucucuccacaccugccaggcccuacuccccugcaccugcuccaggcugcuccuggcucagcaccuccucagagaagcccuccuugauaccccauacugggccaggccucccugggacccccugacucaaccuguguuauccuguuaacguaacccauggcaggaucccacguggacagccugccuucccuagagagaccguccugggaggcagagccugugcuggccucguucuuggcucugggcccacucaggcuucagggcacucacagggaaggccucuccacgcagcuggccucccggcauccuuguggcccauguauggccugugcguggacgggagacuugcaagagagggcaaccccuagcccugcagcccaggggcgggagacauccgcaaccgccaacacggccguuucuuccccgcagcaagcccuccugcuggagcagcagcggauccaccagcugaggaacuaccaggcguccauggaggccgccggcauccccguguccuucggcggccacaggccucugucccgggcgcaguccucacccgcgucugccaccuuccccgugucugugcaggagccccccaccaagccgagguucacgacagguaacacguggccuuugugcagccugagggugcaacgcgggccacagugggcacagcgcggggggcucuucccggcccagcucugcagaggcugaggaggggcugggcaggcacgagggccacgcuggaugguggggaccacacaggucugucacagaggcccucuccccgcccuacaccccacaccuucaguucugucaugcuggggaccugucacgggcucacuugcccacuuuccugucccagagacccauggucuccuccaagaacaguccacagcccaugcccguggggccaugagaaccuacagcuucugguccggcucaggaaucaugagcccacgcuucuccgcuuacucccucacacuucgcccacguccacagcguugacgcugaggcuccagugacagggcugugaauggcuggcggggggcugugauuacacgagagcagagcccgggaccccugggacacgcugugggagccacacguccucugucugugccaucccucauaccauccucaccccggggaggcgaucugccagcagggguccuugguuuucccucacaagaaggaggcaaguaaggcguccaccacggcugaggaggcaggaggggccgggcccuggacuugucugccuggagcuagccagagccggggaggagacugcuguccugggccgccccgccacccagccaccccugcaggggagaggagggaaggagggcuggcuucuggcagggcuugccucugagacaagcacagaggcaggagcgcucuucauguuguuaugaucuaauauuucuuguuaaugacgcacuaagaaaaauguucuguaaauacagcacggcuucauucuucagaugauucucaucacguggcuuaguguucugcagucugcgagguucucacucucaggucuuagaaggaugcuauucauauucagagacaaauuuccagaguagguauccagcaaguaaaaugcugcuucucagaaagaaaaccauggaaggucacaggagcagccagaugacccacuccacaaguccugggcagcugacugcaauaaguguguucuugaaagaaugcagcucagacaagggagaccccagucaccgccaccaaggagaauccucccacuaagcuggcccacccuggcuggucccaggagacuugcagggagucccgcuucguugguguccuuucuuaguuugucuugauuacuuuuuaaacaaauuuauaaaacaguacauguucauuguaaagaaaaacaugauagaaacccacaggaaaugccguuugcccguaaugccacuccccagugguggcagguuguuaguauuugcuuuaaaccuuccagaucuauuucugugcauagccagauggacagauagacacaaacauaauuuguuucacagagacgggacucuguugugucugaugcuuucuguuaguaccucacacucucagccaucuucccguguccgugcacagcgacgcagugcguuccuuuagccacguggucuccuggcuggcucugccacccucagcugugugggcuuugccgcuucuccaucucucuacgcuccagcuuuucugucuguaaaggcaguaaagcaggugucugccucguaaguuccagccgugugcuuaguaaauauuagcgcacgugaccuuaucaugaugauuccacuguaggggcaguccccauuccuuguauccgugagcaacugguuguuucugcacacacacuuacguauuucacggggcaguguccgucauugccuaugugucuguguugccauuacaaacucccaagcacagccaugcccacacacaguguacugauugugaguccuaguuucauugacuccuguaagccugcaccuacccugaugcuuuuuuuuuuuuuuuaccagaagucccaucccacagcacuguugugcaaguaccuccagaauuccucaagugcaggagacugacuccuguuagccugacucacaagaggcugagccaggaaguaugggaacuaauaugcaccaaguguauccuguagcuggacccugcaaacacuggaccaccuugaaucucagcuccccuuggcuggggaugcugccuguguucccaguaauaggaacacaaguggggagggccgcauccugggccagcacacugaagcaauagagcaggucugucugggcagcuugcccaggcucuucaccgugcgccccgcccuuaucagccuggaugaacccacauuagcacaggugccccuggccagugaccugccugcggaaggcgucuguucacccagccuggccuucccuuuguuaaguccuggaagaccaggugugugcagcacagacaugucccggcagggccucggggcagcccuccugccaggugucaccaggggccaaggccuggugagaaggggccggggcagagcugugccccggagggccaccuggccuucccucgcaucucuagccucugcagacaggucagauacucuccccuucacagcggucccacguaugcugacugagacaggguggcauccaacacggguucaggcacauugccuuuccugcugcagagccccaggcugccggcccaguugguucuggggcccccaccaggagccucuucuguggcugccgcacccugggggcccguccaugcugagcucagugcuguggugagcacauggcuggccucuuuucacagucagagguuaaguagaccuguguacauggguuuugcguguguuuucuagcauauguguuccagucccucuggaaguuucuaaaggcagagcucgaaucugguguuucuuuggaaucucaaguaccuuggacaguucuccguccagcagaacuggaguuacuauugguccaggaccaggcagacuuugaggguagggggcuagagucgccuccuucuagaagucagcaccguccuccccagcacaagucccacauagagcucaccccugcaagguccagccacccagggcagaccuccucaucacuguuuucuccucagccugcugcagcagggcagcugcgcacgucccugccuggguccuggggcguuacugugagcaugagugacaggcaggcccucccacccgccuggccucugcauucguccacguucucugggccuggccagucaaggagucuuggcaaacgugguauuuuucuaaagaaccgucccagcuuccgucuccuucuagggaaguggugguuccgccaccacccgggggcagccugccaguggguggucggcucgccccuggaugugcgcugaucuuggccccucugccccgccccaggccucguguaugacacgcugaugcugaagcaccagugcaccugcgggaguagcagcagccaccccgagcacgccgggaggauccagagcaucuggucccgccugcaggagacgggccuccggggcaaaugcgagguaacgccgaccggggcaggugggcagcugcggcuuugggcaccauuagaggggacccucgugggcccgcgugauucaggguguugguuuugcaggugguucuuugggcuuacagccccgggggaagggccacaagcaucuucacugucugcauuugggcgggcagcuaucugcugagaagcccggggcugucucccuggagucccguacccucccugcaggaagcugcugccucugucugugaccuuuccugauguuucgcucccaccucccaccuagcaggcucuucucaagguccagggcuguugcuuucugccuccgggucacuuccccaaggaaaccaguucccaccaugcucccccagggcugccaggaaggagccacggggagauccgauuauaucucagaucaggccuguuggcuuuuuguuaaaauaauuuucucuuuuuuuaagauuuugaaaagcuucuucgagaacacagggagaccucaggcccuuggggcccuccucagaguuaaggugcuggcgaggcagugggucgugaagggaauggagcugcaggcagggcccuggccugguuugaauucagcucccuuauguggcugagucacacgaggaggcuucggggaugcugcagcucuggcugugccucaguuucccuggccgccaggcgauggcagcggccucacuuguucucauacaaggagggcccggccccgccuccugauaggaaccagagcccugccccgaaucuggcugcaguggacucccaggcccaaggaggcaagaaggaucagccgauuaacaccugagggcaggacgggggccgcacuuuggugaggcugucccagcuggugcucuucacccuggaggcagcugucacaggggaucuugagcucuugacagggaggaggguguggccaggcccugcugauagcgagggcaggaagagaagagacucccgucugggagcuggugaccuuggacaaauuuccauuucuuugucuguagagaggggcuggcaacacugugcagggucgcacaaggccccacccaugccagggcccaccaguagagaccugcuauguccacuccccacaccaggaaucccaccauccuacagauagcgcacaggguggacaggaacauccacacccaccccuccaacaguccuggacacccgacagcccagggcccaaguggcuguggcagagaugagugagcacguggagcuggcguggcacggagggccucuggucuccuggcuuaguuucugcagggucccgcccugcagguucgccugcccuccuuuagaagcugggauauuugugaacuuuuaaucugugccucaucuuaccccccguuuccuuuaccaguuuuauuggugauacauaauuuucaggggggaauucucuaaaagucaggcccaggacccucuccugcagugcccucugggaggagggaggaggaaggcggggaggagccacuguagaggcucuuggcaccugcuucagggaucuggucaggacggcugugccacuggagggcagcauugcccagcagacacuggcugcaggaaacuccuuccccacgucccuucccuccacaggaccagacagcuguccugcugccccuucuggggacugcccaaggccuccugaggcuuccagagcuccauaaccugcuuccuugucccuccccuacaugugcccccacccccaggagguuccgcugaggccaggggauugggagagggucucucagccagaaaagcaaagcaaaugcaagcaagggagggaggagugagaaagcaaagacccuggaagaaacagcccgcuccuccgcccgcccucagcuccuccgcccgcccucggcuccucugccuguccucagcaccaugggugaaggugccagccacgacugggccaggggcuggcagaggguccccagguguuggggcugugggacaagaccugagccuggcaggaucucagggagaggagagcuggagaaagacagguggcugggagacagccacagaggcgguggaggccauacucccuggacagcagugccuugcucccacacguggggcagcucuccagugcgggugccccuccagguucagagcgagcagugugcuaacucagcccagggggacgugacgucacccaccagacuuccagugccagccugccaggggucacuggccuccugagauggccgagcagaggggccauggguacggggcaugguuagaguggguacccgauaggagaagaugggguggauggggcugugacuuccccaguccgcggaccacuuggaggccacagcaagaccgaagcccaggcccgagggcagggccucagagucagcaccccuucucuggguagacgacugccuggaggccuggggggugaggcccuccccucacacugcugaguuggcuucgcguggugaggaaggaugagagugggcugggagauacuuucugcaagcuugggacccugucgauacuggcaggccggcccagcaagacguggcucccagugcagcugucucgcucccugccucacuccagagcaggccuugggaagcugccucacacguucugagcagucggggguccucugaguauagccaugugugugugcgggccccgcccuccugcagaggcuucccgggagccagaacagcuccuggccaauuugcuugcccagcuugguuuguccugccuccaggcacgguguccaggaaggagaggagaagugggugggcuggaagucagaugccacagagaccagggccaccacugggauuugcacccugccccaagccuguguuugcuguaaggagcaaagacuccuucugucuuauccuaggaauuaaagggagacagaaauaacgaggucagccucccaagaaagcaggaaggggccaccaucaccaccgcucccagaguggcucuggaaaagccucucaggugcucagucugagccgucacaauauugcacgcuacagccugagccaucgcggugucccgcacgcacagcccgagcccuugcggugucgcgcaccugcagccccagccgucgcggugucgcagagcuuuuggggcuuugauccugugucuuuucuguguccauuucauguguuuguaaggagaggguuuuucuacuuuucuucuuugccuuauucuaacaucaacuuuaauuugugaauuucauuuguggucuaacgucagaucucucuuucugcaauucagucucuuauccagugggucgcuuuugaguggggaggacacacauggcuacccugccguucuuucacccaaaguccacacuacaugaccugccucuuggcaccgcagggcacagccugugguccccuacggggaccuucccaagcgugggcugccuaggcccgucuguccagagggaacuuggcccuggccacagcugccugugccuguacacacaugugggcuuccugaagucauuagaaaugagaagcccuggccaggugcgguggcucacuccuguaauaccagcacuuugggaggccguggcggguggaucacaugaggucaggaguucaagaccagccuggaacaacauggcaaaacuccaugucugauaaaaauacaaaaauuagccaggugugauggugggcaccuauaaucccagcuacucaggaggcugaggcaggagaaucacuugaacccgggagauggagguuacagugagccaagauugcgccauugcacuccagccugggcaacgagcgaaacuccguuucaaaaaaaauaaaauaaaauaaauuagaagcccccgcagccgcccagggccccaacugcacccugaccccuacccagagaguacgucccuccugccuggcuuuccagggacaugugacuuauguccccaaaguagaagcagcacuagguuauguggaugggaccauagagucguuuuuuaccaccggaagccgugucacaucuuuucuuuguuaaacaagagaccuucauagaggaagcccgguuuuguggaauuguuguucaugagaagagaacccgcagagcauccgucccugcccagcgcaccugcccucuggaggucucuccccugugggcggggacugaguucuuggcuccgccccuucuuccuccacccugcauggacaggacccccaggugcaaugcguccugcaggaaggcugugugcuacggcuccugguggucugagaggagccccaggugcugggcuggcauagagagcccucgagcuucgcccaccacaggucucacauacaggguggacaccgaggccugcaggagcucagcggaugcuggggcagggcugcagucgggagggagagagcagauccugcucaggccugggggaagcagguaacagccacaaccggggccaccugaguggcgucugacucauccugugguggccuaacccucugagagccauuuccaugugaaauguuaacucgaaucucauguccaaagccaucguccccuuuaaaaggcuaaauaaauguagcucaacuaaagaacacuaauuuuccugugaauuucuggagaaaaucugaauuagcccagggaucucaaucugaagaauuuccaaaccucagagagacgcagccggaugccagcuagccauccaggacagaugccagacccuggcagcuguggccccgggcgguccaaggaaggcugcuucauccuggggcucagagacuccgggagcgcggcugggguuucccuugaacgugagggagcucagcagcucaccucuauuuuaagaccagacccuggcagcuggaaagcaaaguaauaauuugaugccaagucauucgugcgacagugaaggguaaugcauugaaggcuggaauuaucuuuuaaaguguuuuuucaaagcuauaauuaaguguaagcccucuaaaauauuucuuaaauauuuuaaaauaucacguugggugauguugcuucuucuuuugcaguaaccaaauaacaugcuuguuuuuguaucaaauuaaguuuccuuuugggcaaugguuucaguuggaguuucugucuguggagcugaagcagcagcuucugcagaacgugugaguguccucucgccuguccccacagugcauccgcggacgcaaggccacccuggaggagcuacagacggugcacucggaagcccacacccuccuguauggcacgaacccccucaaccggcagaaacuggacaguaagaaacuucuagguauuucaggaccuuccuuuccucccauauuggguuugaaguccccugagguuguguuuccagcucucaaccccuugugucuggggcaccugugggugucgccugccagguuauaagguaaagggccugaaagggaaccuuucacccucuguucacaagccacugguuguugaugaacgugccagguagcagguguguuuguguaaaaacugggcugagaaccguugguuuagaagcaucuugaaucagaguuuagguuugagaggcugauuaggaacacagccagcaugcugcccgcccugcccugcagggagccugaaguuguuuugagcuccgcuuuaaggcccaucagagcaagaccaggaggaggccuagggaguguccacugcuuaggggugaaaggcugcuggugucuuggcucuggcugaaagcaccugcacaggugguggaggggaauuuuagccucauggagagaacuuucuaaugggcauccucugcccggggagcuggugagaggcuuuccacagggaucuucagcagaggcaggugaacucccagccagcuccauggggcuuccaguguucccaggccacagaacccagacguggggccgggggcuuccagggcgcagaacccagaccccgggccgggggcuuccagggcacagaacguggaccccgggccgggggcuuccagggcacagaacguggacccggggccgggggcuuccagggcacagaacguggacccggggccgggggcuuccagggcacagaacguggacccagggcugggggcucccaggacacagaacccagacccugggcggggagcguccagggcacagaacacagacccggggccgggggcucccagggcacagaacccagacccggggccggggguguccagggcacagaacccggacccggggccgggggcucccaggacacagaacccagacccagggucgggggcuuccagggcacagaacccagaccgagggccaggggaucccagggcacagaacacggaccuggggaugggggaucccagggcucccuuuguuccucgauaacgucuuucccugccucccagccacccugaaccaggacagucacugcccacugguuuucuuccccaucuucugugccuuugcccugggaagagcauauuggcucuucccugagcaggacccuaggaaggcagagagggagaacuaggaaccaugaacgcagggguugcaggggcaaggagagggugggccgugccuggcucguugacugcauuuggcagggcacacguugcaggagguguccuccgugccaggccugugcccggcagacucagccucacagagaccugcacuccuaguccuucaugcguucacucacucacucgcucacgccuucauccacucgccgagggcaccuucuguacuggaugcccuguagguacagacggggucacagaccauggagccaguagggcugugaggacacgcaugggcucuggccugggguggcggucacgcugcuuccggaguccccccugcccugugguauggaggcuucuaaaaggacagaagccucaaguuuggggaaagugagaagggagugaacagcaguaggaagcaggugggccgggguguggcugagcagguucacgagguggauccugagcuagugccggggacaagggccaccgacccaccccacagacuccgacagcucaggcucagcaacugcagaggcuauggacucagggaggcacucagucaagggccugggccaaagcugguggaaaggccucugggccccgacucccuacacagcggcuucgccugcugcugcucuagaagggguacagcacccuuccaccgucccucuggaagggacgguggaagacaggggcuuccuggacuggagacagcugcucuagaugagggcauggaugccaagccccuaccccuccccacugggcugccagcaugcugaccuuuaccguccaagcagacaggagaccccucuguggauuugaccagccccaaagaagcugacaucagggguucccaacaaauagccccugagaucccuuaugcuggcacucacggcuaaucacccccugugggcccagagcuuccacccagccguuggcacuucccccuuaggagcggacaaccaaggaggacccagggcccgaggaacggcuggacagggaccuggagcuggagccacacaggggaaggaggcugggggcagacagugugaggcacuaacccagcugccauuagcacccucagagaggaugccacauccacguaacguggacaaguucaguggaaaaggggaaagcacagaacguucagagaagacaaaaauuaaacaccugaccgcagaaaaagaaaauccuccucagacuggaagauacggugaugucaucucccagaaacuggagcaaaacgugacagcucugggaaacugggaagugagaugauggagaagaaggccaaagcucacugcagugugcaggguccaaacagcaggaguucccagggaaggcagaggccaggaggaggugucuggaauucagaaggccccaggccaaaggcagagucucugggcugcagggacccaccagggguaagaaagacccucuuagggagaaacagcagagccucagaaugcagggacaggugagagccagggcaccugcagacuccauggggccugcggccaugccaguuuuaagggcgccucauugcccuccugaaguuugugucccgccaaacugccgggugaguaggaagguggcacagaggcauuccaggcaugcaagggccagagcuuucacccuccagcuguucuuccucaggaagccaccggaggacacgcugucccagggcaaaagaacauugggaggcccaucauggaggccggccucuacuggguggucugugagaggguggcggccaggaagucugagaucgcccugcagggagaagcugaugcagcuaccccuaggaagggggcacgcgcuccuuggggagaagauggcgcauggauuguggaguaccuagcggaggcggggagcaccgcuggggcuggggaagggagcccuagagggcaagggcggcagagagggcaggcggcuuucuguccgggagcuggguggacaaaggccaugcaucgaggcacugaggcuagagugugcugucccucaggauucuccaguccuuaccaggaaacgucacugccuccccauguaacaccucagcuucuggccggguucuccagcaugggaggggcugccugugggccccaugaggggacaagaucuuugccucgaugucaccggggcugccacagcaggggcuucagcaggcgugggaguugcugagcagccucaaagcaucagcucaucaggccguguccugcacacacgcaguucugugcgcccaccuccacgccuuucagaauggcggcugcuccugacaccuucauccauuuucaaaggaccggcuguugguccauccccuaccaccuucagucuuucaaaccuguggaauucagugggcggaggauggaggcaggaccagcuccaccagcagaaggaugaaggcaggcuuagcuccaccaccuugcuuagguuucuaagcuaguuucaaacaaaguuuaagagagaugaucaaaaaggaagaccccuuucuuguuuuugguuucuuuauugaagugucucugcagcaucccuuugcaccauuccuguucuccgaaggcaaccauucuagucaguuucuuuuguuuacaggaagguugaucauucuauuucuuguucuuuccuggaaagcuuugugcuuuaaaaucuguucacauuccugugaggaugccucucccauuaccuucucacaacucaagaucgauuuuugaauuuccgacaauuguccuaacccagaaacuucauuaucaucagucuaaguauuucagacaugguaauagcugaugauuaucuugaguuuugugaacauaacccuaaugagguguuuaaacacuacugugugauuuuuuuucuuuccucuuuuaauggaauccacaagccgcuaagccgugugcaagggccuucauauuuccuuucugauguggugagaugccacacauaaggcguggcugaauuggcucgugggccugaggcaggcuggccgcugcccuaggcgucacugaaagucacguggcucaucugcucaugucagcuggcagggugcugcauccgggcagagcugggccccuggcgagugggugccggugaugcucaggguagggugcggcaggaaaaugacuuggcacagcgagggccuccucccagccagggagcaggagcagcagcgagaggauggcuggagccgagccuucccugccccaggcacagaacgccugucugccagcccgcggcaaacagacaaguaguaaggcuggucguuugcagagcuucaggcccugucaccaggcuggaacguuucguggccugggcuuggugauuguggcuccaaaccacaggaggccgcugggcuccucacaacugucaccaaaacucugccuauaacuccauuccuauacgcaugcauuuggaugcauaaucguguacuuuuucuuuguuguuuuggucuuugcuagauaaugagcaaacucaaaacagucggaugacuugugguuuuaauguagacaugguuggcuaugauuucaaagagauucagucucuugcagauaccuggacacgugugucuacugugaauucauauagcugagcgcgugcauuauuuggaaaacgagcucccuaguuucuggcagugucuuucccgugcguuggaguagucagugauggaaggacguggcccacggagccacucccagccccagcuacucagccacucaccaaggccaugaccgcccuuccaaggcagcacccgcccacuguggugagguuggcauuaggugaccccacuacagacgacgggcagcaagcaggacagcagguggcuuggcaccuuggcacccacgcccuccuccuuuuucagucucguuccaccugcgcacuagcucucuugcccaccacaucccgccagcuccugcccagccccagcaccucccaaagggguccggcgugcaggccgcuuccccgcauggucagccccacguccacuacuugcugucaccaaggcacagaggagagcagggccaacaugccugcggggaugagggcugaccaccaugagguucaggcgagaaguguuagcugauguugucccaugugccacgcugacauguggacacgggaaccagggucaggagccacgacuccaggcaguggcggguccgugagccauggacacggaggaaguaggcccaggacagcgcccaggaaggggaggcaugcuggugcugcugcccucagugggcgugagggccaggacccagaggccgaggcaugccugcugagcgcugcagggagagccagggccgacugaagccccugcuggcucaaugccuuguacagcccaggcagggaggagggacaaggcgggcacagacccugcccuuggagccaggccagguggagaggagcgcgggcucccuccgacacaggcuggcuccuccgagcacguaggccuuugucuggaaaacgucacagcaucugcauggcgccugcgccccucagcuggccgggcccuccuagcagaugggggccgggccuauccucccuuugccuggggggccugggagccccugagccccuucugaaaguggcugcagcugcugcccccugccuccugccuccugcccugcucccuguuggcauggcagcuccccagccccgggccguggacguggccauucuacaagccuccggccuugaugcagaucugugaccuccacagagugagaagagccugagucagcucugugcaucgggccucacacuagggccuggcuguggcugucugugggacaugugggugucuguggggggugcugguguccguguggauguccguggggggugcugguguccgugggguggggugggugucuguggggggugcuggcguccauggggggggugggcaucagugggggaugcuggcauccaugggaggugcuggcauccguggggggugcagguguucguggggggugcagguguucgugggggguguaggcgucuguggggggcgugggcauccgugggggguacuggcguccaugggggguguggguguccaugggggcggggcggggggcgggcauccauggggagggugcagucauccgugguggggugaugggggugcagucguccgugguggggugauggugcaggcgucuguggggagguugcaggugucgggggggguugcaggcaucugucgguggggugugggcguccguagggggugcgggcauccgugggcuaaggcaagcaggccucuguuuagcuucucgucugugccagccacucuccugcagcuuggggccaucgcaguugcucuucccagccaggcacgcuguucccugaggaaggguuccucucgugcuaaccgggccggcaagcccuccaggcaagaggcagacaggcccuaauggaccuauggccaacuccuuccuauggcccccggcagccagcccuaggagcguggaccagagcacacagaguggaggcuacuguucuggagcaggcugagaaugggagaggagccccacagcgggggguacagcccagcugaggccagaaaguggggucccacguuggauaaaggagccuguuacaucaagccagucucccuggagcaugugagaugucacuccagcuccagcccaggaaggggccgggggcugcggagagugagggauuggggcccaggcagccgcuaggaaugguaggucccgccccugguuagugggggucucuuguccuccacagauggguuuuaagcuggugacgugcauucagccagcacugggucaaacaggaaaaagacagcaccccuguccugggagcacuuucacugccggagcaggcgcgggugccagagcagugggguggggguuucgagggccccgauuuccaugggaggaggccuggcgugcagcugcagcguccuuggagcccucagucagcuguacacgcuccgccugugucgcagggaggggcugucgcugcauacauucccgaggaucucagggucuaagaggccucaggacccauguuuaaucccgggacuugccccuuguuugccaugggagggggcugcuagacaagcccuaggagcucacugaggagccaggcucgggguccuggagcaggauuugcuguuagauacagccccucaggggcacgggcugcaggcagacgcccaccagggguaccucgugcuccccaguggcuuggugccucuccugggccccugacaggcugaugccacaacaauuugagguguccccaccagggucugugacccagcucagcccucacaggagucaaggcaccucuaagggccagacacugacccugcagcagggccacagggugucacaagggggagcaguggccccucguugucccacaaaugcccaagugccacugaagaccccggagugcgcccagggccugucgagcaccuuggccgcgugcccuuggccucucugaccgucucccucccccccacaggcucgcucgccuccguguucguccggcucccuugcggugguguugggguaaguguuccuuuaauguguaaauaauguccuguuucuucucgagucccaguggucacagaaaucgcagccuugcuucccucaaagugaauaauugcugccagguguuuuccauacgcaggggcugcccaugugcggcuucaaaggccgugugagccgagagcguuuugaucgccgacucgggcaccuuucucuggggaagguugucuggcgcagguggcuggggcucuggggugcaguggcucucgcuuuaagaaacaggauccuguaugcagccagcaucucauccccuucgaagucuguggcaguaaucugcucacaucaggccacgaguauggugcggguaggaugcgugcuucuguauucuguaccuaguuuccacccgaagcuacagguggggcucccagugcagugaccgugauacucaugggccacguggagucuguagggcuacucgcugggcugugcuggcuucugugagcugaugauauggaccuggccugggcauaugaaucacuggucugugccagcuucuacgaacugaugauauggaccuggccugggcauaugaaucacugggcugugcuggcuucuacgagcugaugauauggaccuggccugggcgcauaaguucacaaggacuuuccagucugggcaucugcccauccguccacacaggaagggucaggucuugcaaucaaacuucucaauaacaaaagaguucuccccuggccccugaccuccuugaugcagccugggcagggguggcaauagcgagggcggccaugagaagcugaggcggagcguccgagcagauccgggccaucaugguccugcagugccgcgaaucaccacagacgguuacaggcagggaggacgggagccgguggacagcaggagccgcugcagccgaaacggugcaguguguguguaaucacugaucgcagggugaagcucaaggucuggauucuguuauggaaaugaaacaaaauuguuuucuuccugaguuuuuauaaaaaucacugcuuugaaaauuaucccgucagaaagagaauaaacggcauuuauucauaccaccaccaagcccuccuagaguuauuuuauuuuguauuguaaauaggcugcaaucucuuaauuuggggcauguuuuuggccagacuugaaaaggauugaauuugcacugcccugcagccagcacgccugugcaaggcagaauuuaucauuugcaaaugaaagcuaagugcagacucagagcugagggggugagcccagcagccccucccaaguguuaaauccagaucugaggcacagcagaugagagcugcacccucacgucugggugugcagaugcugauggaaaagcuccccacguggacgcgggcagagaggguagccuguuggcaugggcagggaacagugcaggccguggggcuuccugagguacagccaccggcaggauguguuuucuucccauuguuuuccaaaaggaagaagacagacaggaggccggugcagaccccugcccuggugugggaugcaccugcugucgcuggcacagaugcagcucuccugagccucaugucuccuccagagccaggaggggccagccuccuggggugucaggaggagcaaaguagaccucgggagccgaagugugggcacacagcaggugcucuugucagggagggcagagcaggugagcagagccagccaccuuccccgaaagcagcugcaaacucucccggaggcagaacaguggggcuuggaacacggaaaacucaccacuccucggcgcugggaaaugggagcuguaaagugcuuugaccucuuuuucaaaccagaucagcuccugcguugcuccucuccagugaccgcaaguuucaacugggugaggagcuggugucccugcucggccucgcccagcggaguccuggccugcucucguacgcccggcuccccgcggcuccucugagcuucccaaaggccucccagcccugccagcccucggcaugucccuuuuagacuccaugggauuauccgugggaagcuuucuccauguuuccccccgccuuuuuccugucuuuauugcgaaagagagagaaaaggagaggagagaagcgagagagagagaaagaaaggaaaagaaaacaaaaaaaaaaagaaacgaaacacagagugagccauuugcuccuuccugcauuagcaguugcggccgccugcccugagccaggcuauugcucagugguggcgcugcacgccugagccaggcucccugcaagaggccuggagcuccaggcuggucccugggagcuggagccgugguccugaagcaggcgaaggagggucucuugaguucucuggggacugggguccugcaguuuggcuggggcuuuguccuucacucugugcaagacuccagaagcuucugaaccccagggucccaugggagggggcacagacacaggcaccugguagaccgagcagcuccuuggcaccccaggugugcagaauccccagaagacccuucagaacacggguguaguacacccuccgcucccugcaguguuggccuaaucccaaagccuaguucauuguauguuggagagaaaccaucucugggugcuguccccacaggggcagccucggggccuggccugucugggaccccgccucugcuggcugacacagagcagguggcagaaucuugcccugcccagcucucacuccugcgaugucaccuuggauuuuuuuuuuuuuuuuuuuccucuuuggagacagagcuucagucuguuacccagacuggagugcagcggugcauucauggcuaacugcagccucgaccuccugggcucaagugaucuucccgccucagcguccugaguuguggggacuacaggcccaggccaccacaucuggcuaauuuuuguuuguuuguuuuugagacggagucuggcucugucgcccaggcuggagugcaguggcgcgaucucggcucacugcaagcuccgccucccggguucacgccauucuccugcccuagccucccguguagcugggacuacaggcgcccaccacggcaccuggcuaauuuuuuuuuuuuuuuuuguauuuuuaguagagacgggguuucaccguguuagccaggauggucucgaucuccugaccuugugauccgcccaccucagccucccaaagugcugggauuacaggcaugagccacugcgcccggcccacaucuggcuaauuuuuugaaaagaaaaccaucaccgaauacacuucaggaaaugucuucagccccuugaaaaugcauuuuaacucaccuugcuuugaugaugaagcuucaagaccgccuggaaagaaauccucccuccccacauaaugagcggugucuaucaaguggcaagucugccuggugguggacaggagcccucgagggccuggucuggggaagggagaggcaggguggacacgccuggcuccugcuuaggagccccaaagcacucggcgcucagaggggcucaguuugagaaggaggcguccugcaauggaccugcaaucgcccuggucagcaccguguggaagcugagcaaccuaugacacggcuucuaagaccuccaccgggcugggcacccccaaguccccgguguguuaccccacagcagcuugcaggcaagggacacacuuggggacagaugcucagguucccuggggccagcccaagggcuguguauuucaucuuaacaccucccuccccuggccagacucccauaggagacugcucugugcagaacuggcuguccaggucucugucugucgacuuuccuccugaauugagccagggcuguaagaaauuucuggugugccuaaauaaauaaaugagccaacacacaaucggggauuguugacguguuugugugaaacacguuuucugucugaaguggaaaaggccagcgggcugacuugcugguguccaggcagagccguguaccgucacuagggcagagcagggcagcucuccucacccgcccacacggccagucccgcuuagcuacgcuggucaacauguggagcuuccaguuaaacucggcacaggagaaagucacuauuggaagagacuggucgugauuccccuuacauuucauuuugcugcuaauuauuugacaggucgacuaucccuuauccgaaaugcuuggggccagaaguauuucagaguuugguguuuuucagauuuuggaauauuugcauuguacuuaccaguucagcaucccuaauccaaaaaucugaaauccagaaugcuccagagugcauuuccuuugagcgucacguaagcgcucaaaaaguuuccaguuuuuuuuuuuuccuuuuuggagacagagccucacuguguuacccagacuggagugcagaggugcauucauggcucacugcggccucgaccuccugggcucaagugaucuucccgccucagccuacaaaaugcuuuuguaguauuucggauuucagauucucagaucagagauacucaagcugaauaacucucuuaacuacaguuccaguuaaaaaaaaaaaaaaaaaaaaggaaauagaucaccuugacaucauuacuuuuagauggaaguauacugaagcaauugagggaaaggaggaugccucagaacaggucaggacacaugcaucuuucuucugguaaauucucuuguauuuuccuguuuaaacuuuuuggcaugucuuaaaaagauugaaggcugaacgugggcugcagcugcccuggcucugguaggcccugggguuucagaagcagagcccacggaaccugagcugcucugcccagccagggcuggugaugacgguggccugggagggugaccucacugugggguguuguuuccacagguggacagugacaccauauggaacgaggugcacucggcgggggcagcccgccuggcugugggcugcgugguagagcuggucuucaagguggccacaggggagcugaaggucagucggggccuggacagugguggcccuccaggaggccugccauagauucccaguguggggaggggccgcccacuccgucucccucucaucaggcugggaggcggcugugauggggaggcguggaccccacucugucagcacagccucgcuauugaaucaaagagacauugcccacauuugugauaggguaugugcauaguacagagauucucaaugauuugggucuuaagaacccuuuauacucuuaaaaauuuauacucuuaaaaaaaaaaaaaaagcuccaaagagcuucuguuuacaugaguuauauccacaauauugacucuauuagagauuacaacugagaaauuuucaaaauguuuauuaauuuaaaaauagcgaccgggcacaguggcucacaccuguaaucccagcacuuugggaggccaaggcagggggaucaccugaggucaggaguucaagagcagcuuggcuaacuuggcgaaacuccuucucuacugaaauacaaaaauuagcugggcaugguggcgcaugccuauaaucccagcuacuugggaggcugaggcuggcgaaucgcuugaaccugggagguggagguugcggcgagccgagucacgccauugcacuccagccugggugacagagugagacuccgucucaaaaaaaacuaaaaaauuaaaaaguaauaaaaaaauaaaaauagcacuaaugucuugccuguggacagcagcugguucucacaccugcccggcgucauucuugggacauguugaaguacaugaaggaauccuggccccacacagauacguaauuggaaaugggagcaggauuuuaauagacuuuucagagguauucuaauuguggguauucuuugacaguauaccaaaaauucagcaagugguagugucuugaaaauuagcugcaguguggaucugaaaucaaaucguggccuccucccccuccguuuuguuuaacugaaccauuagcccuucuuggagaucaaaucgauccuucguucaugggugauugguagcaccgugcguuggucauuuggaaacuuagcuucacggaguuacauggaucuuccauauucugacccauacaguaucaaaaaagucauuaauuuuugaaaccauuaauaucacccccaucucaccagaagucuuauaaguagugagagagccagcaggcucacaggggcagagccguguguuccaaacuuguaauuuucacuggaaagcucacaguuucucacgcuuccuucccgucucuuuacucgggauguuaaaaggacguguuugagggcggagaucuacuaaaaugucugaauacugcuucaucgagcacauuguuaagagaagcugcucacacacacacacacgcccuggugcuguucccugcccgccgucuacccuccggugcuucagcaccaucggcgcaggugucagggcagugaaaagaguacauagagccucaggacuacguggacuacagacccucagcaggggucgggaccgaggggucugcagccuacacucggaagcacugagugcagaaacgcagggaggccagggccucuugagagcguuugccgccaccucaugggcugcccucgccccuuccugagccuggucccugcggcguccggcucaccccguccauggcauugucacucaugguuggccggcacuuuuuuugaggcuucauuacagaccuugaccacacaguguccuguugcuggugagaccaggagaggacuggaauccauuuuuauggcagcaacuacagagugguuugcagauggauuuuugacgcagaagugauggggcagaggacagcguuucugcccagugugagaggagcuguuucgugggcugcccacuugcccgccauccugagagcugaacugcaguaaggacagaggcagucacgugaaggccaagcugggacacaacgucucugccccgcggccaaguccuugaguggggccccuucugcuucaucuuccuccaguggccaccuagcggguccuggucccgagccgacggggagugagcacauccuuuccacaucaccccgaccccugagccaagggcaccacgccucaccgacaguucugagagugggcaggcacccaccuguuauccuagugacugcguuucgggggaaccauuaguagcccccagaccucuuuaggagaagggcccaggcuucccggaaaggcucccagcuggcccugcauccuguccccaucacuguggccagggugcagcaagaaacuguccuccuguguagcccaacucugcuaaaaguugagugugcaaccauuuucccguggcuacaaagugugucuuuuguugcucucuccuggcugucuggugucaccugcagaauggcuuugcugugguccgccccccuggacaccaugcggaggagagcacgcccaugugaguacacgccgcagccccgcacagcaggggaacccaggucuuccuucccucccuuagggcugggugggugugugagugacugcggggagcugggcugcuguuugcuggccacccaggaugugccgcaugccggcuuggcuccagcuccuggguguggagugcagaugccaaagucugcgagcaucacugcucgguuaugacggagacagaucagaggaaaggaugggaaagggucuguggagguuaguccagagaagccucugguuguugaguaguugucaacacuugggagaggaaacaccacucacccucaagugagucacugcagcacuugcuugucuagaggacucaggucauuuugcgcauggccuuuuagcugccugccgaaugccugguacugacgcagcaagccacagagccacguccaugcaggcagcuauccugaugcuguuucgggucuuucagagacugccgacgguccauacagcugaggaucugggcaggguggcgagugugggguguggguccucccggauccaucccuguguguccagagccaguggcaggacagacccgcagcugucuguggagugccuugcagccuggguggugaaugaaugaucuaucccgucaaagagcaugcugucuccugggacgguagccgcucuagugaggagggguggugcuagaaagagcgucuccccaugcucuggagauggagaaggcgugccugaucuugccagcuucggugaggaggagguggcauagggcucugccuuggagaguuggagcagcaguuugucagauggcaacgcaagaacaagugcagauacaaguucacuaucaggcuguggccaggaagcagucagaacaagacagaaccgcaggggcccgggaaagggccucccugucaccccugggaagucaggcguccacggaggggccggcaggacgugagagauagucagauccgcguguuagagcagaaucuccuucacguacagggaggagacuguacgugagagauagucagauccacauguuagagcagagucuccuucgugugcagggaagagauuguacgugagagacagucagauccgcguguuagagcagauucuccuucauguacggggaggagacuguacgugagagauagucagauccgcguguuagagcagauucuccuucauguacagggaggagacuguacgugcgagauagucagauccgcguguuagagcagagucuccuucguguacagggaagagacuacgugcgagauagucagauccgcguguuagagcagagucuccuucaugugcagggaggagacuguacgugagagauagucagauccgcguguuagagcagagucuccuucguguacagggaagagacuguacgugcgagauagucagauccgcguguuagagcagagucuccuucguguacagggaagagacuacgugcgagauagucagauccgcguguuagagcagagucuccuucaugugcagggaggagacuguacgugagagauagucagauccgcguguuagagcagagucuccuucguguacagggaagagacuguacgugcgagauagucagauccgcguguuagagcagagucuccuucguguacagggaggagacuguacgugagagauagucagauccgcauguuagagcagagucuccuucguguacagggaggagauuguacgugagagauagucagauccgcguguuagagcagagucuccuucauguacagggaggagauuguacgugagagauagucagauccgcguguuagagcagaguguccuucguguacagggaggagauuguaaccgccagggagggaugcuuguuggaaucuuuguagcuuuaccugaaaaccacguguuugcuccacaucccagaacagucacuugggcaccaggcuuccuguuuguuucauuucucugaaguuucuuuucuaauuugaaccugaguuguuggauauuccaaauaauaaaccucagaggagacaaacgaauuguguuuuguugcagcucuucgcugugcuccccgugagccgcugcaggagcucagcgucuaggauguccuggggcgugugggcuuccccaugccagcccggauucugaaaacaaaacaacuaguguuucuccguuucuguggucauucggacaaagggaauuugagaucaagaagguuuucguuguuauuugaaucacuuucauagcuuguuuucuuggucucuugaguaagacucucuaaaauuaaagguaauuuauguauuggaauauaggaaggucagcaggaagcaacugagaugaacggcugccaugucuccuggggcguggcggcagcuccugagaggaaggguuccaggugaagaugagggaaauguugguaacaugugaaauaggguucccuaccagaggagcgugggggaccuccaagcaggagagugugugugugugugugugugugugugugugucugucugucucaguauggaacuguggaugugugugauagguauaugcuuauguguauaugugugugugugcuuguaugugucugugguuugugugugugugaguguuucuguaugggguguucauguguaucugugcaugugugucuacgugggggggguggguaugggcguaucuguggggcauauauguguguagggcguuugcauggugugugugucucuaucuguggggugugggguguguguggggugugugucuguguggaguguguguggggugugugucugugguguaugggcguaucuguggggcauguauguguguagggcguguugcauggugugugugucugugugggagggugugucucuguggugugugugucugugugggguguacgugugucucugucuguggugugugugucuguggggggugugugugugucucugucuguggugugugugucuguguggggugugugcauguccgugucgguuagccgacccuauggcauuggcuaagauuccccaguggcuuguuugggagcugugugugugugugugugugugugcgcgcgcacgcgugugagugugucugcaugugggguguguacgugucugucuguuaaccgauucuccggcaucacugaggguucccugcgacguauucaggagcucugcacucacagagaccucuuaggucugcguggaccccgaguggcucucuggcgggccguggagaaacuggccaccgcccaccugcgcuucgucuccagcgucaguucucucccgcaggggcuuuugcuacuucaacuccguggccguggcagccaagcuucugcagcagagguugagcgugagcaagauccucaucguggacuggguaagcagagccgccuuggccagcgcagcucagguugcuccuuugccguccccgagcggacagcagcguguggacagaggagcugggcucuuggaugugggaagcuuagguuucuggaaacggucucaaagaugcggagaaguaaagccccaaaccugcuacaagucauuguacagcuuccgucagccgacccuggcgaaugggguccuggcgugucuaaaaaugugccugugggugacggcagcggccagggccacccucgacgagaucuucuuggaagacagguguuggggaggaggcuguguccacaucuacuuugcguguguggccugggagccugggaggacccucacccuggucgaaggcggcagucugcuucucagucaccccagugaagcccgugccuuccugcugcugugugggcaccugguccugcuggaauggggggugccacugcccccaaaagagucaucucuuuuuaaauaaugcuauaugauguccgaaucugaauuccacgaauagguauacucauucuuauaccggaaauuaauauucaagauauucaucuuauuacucuuuuuaaagccagauauauacauauuuaguguucucuuugguauuuaugauuuauuucauaauuuuuaagggaaaaaagcaggcccugucagguaggguuaugauuugaauuggagaaguccuucugaguuuggguaaagaaacaauauggcacagccaggacagccaugcuguuucggagaggcaggucaggggaugcggcagagcagcgggucccccacacccaaggaccugcgagccgggagcccucccucagcuccuccuaagggagcagguaggagugccugggaagagagcagugugaggucgcugauggcuaaagacuggggacccauccccaaaagagugaagcgcuaggacacgcagacaggcugcguagacccuguguggcgugcucccugcgcgcugagcugugauauugcccauguacacaccaugcggacagggucaucucagugugaagccacaugucgggaaagccuccaugugcgucuucacagcgauuaccuacucugugggguggaagguucuuguccaucgcuccucaccuguagcugcccuuccgccuuuucugugaugagcacagauaacggagcagcaaguucucgugcugggaacaucagggcugcaugcugucuucucaggcacacagcuguucucagcggggccacccccucgcccgcccauccuggugaccaccugcccuguggcccggggcagaacagccacggucaguaaagccccaggcugccugugcucucugcugcaucugaccuguggguuuugugauuaagaaacggugcuugccauuugggcacaggggccuggaccccguacugugugugccugucacucacggacaccugggacuugucuccugccgaacgcccugccuggcauggaauuggcaccucccacgugccugcaagcgggcaggccacagccagugaccuccuuccugacagaggcugaggaaguggcucacuugucagagacacggcagguguaggaaauugaucagauggcuucgucugggaaaugguggccucuaggccuggcugaacuccagccccaucggcugcuggagucaggauugugccauggcgcuaagggcgagggaaacagugcugcagacgcgaacauuggcccuuagaaccccugcgacccugcaccacguagcccugacccacacagccccagaaucgcgccugccggguacgggcccagcuggaggguaaugucauuccugagcaggagccguugucacuaagcacaacugggguuggggacggcccucaggggaggccacccuccaauaccugccucagcccugaaguaguugucccugcucuuuaaggacgugcaccauggaaacgggacccagcaggcuuucuacagcgaccccagcguccuguacaugucccuccaccgcuacgacgaugggaacuucuucccaggcagcggggcuccugaugagguaggugggguauauaagggccucuggggggaaagggggacugcggggagccgcugugggggcacggggcagacgguccacagcugcccggcagcagugagugcggccuucgugcucacuuaagcccagacaguaacuucagucagacgucagccugcaucguaucgcgugugcacagguggccuguguuuugucugaaguacaaaugagaggcuggauauuguuucugguucccauccaggcagacagagguguuugugaaggaggagguguguggugcccguuuuccuccgggcagggcccaggccacugucuuccacaggacacccuccggcaaggggcucuguccacuguccuuugcccggcgcggggcugcauggcggccccaggaacggcaggcccagcggcuccuugacaacgccccagguccccguucagagccugcccacucugaacagaggcuccaacagcagggcuuucauccaggaagacgcuccgucugccucuggauauuauuuuuuuagaggaaguaggaaaugacaggcucaucggagacacuuucugcccagagagacccaggucugauucccugauguaacacacggcacacaacacagggcggcggguccgcagaaaugucagugcagggccuuggugugccaagggcagggucggcgagagccuacagcagccaggaaaagggcccccuugcugaugucagugugccccugucaguggggccccuucacacgcgucuuaaugaauaugcaccaggagaucaggacacgugggcucuccccaggggcccaccaaggccgagcccaucccggugccaccugcaucaggcguuccugucagacaggucccgcucgggguccaugacguguguuucucuccuucuggccacaggugggcacagggcccggcguggguuucaacgucaacauggcuuucaccggcggccuggacccccccaugggagacgcugaguacuuggcggccuucaggugagccucccggcuucacaugacaccugaaguagcagcuuuuccucugugcacacauuccaggaagcacuuguuggagaugagcgugucugaaacuggucuguggcugaacggggcugugggguccggaggagcugucucaguucauucuucagugccaagcguggaaucuuggcgacuaucuucuuaccaucagcucuuagugcucccuuuugugcaugaaauaaaaccaggagcucacuuugggucgauggugagagagugauggagacagaggcagggacuuuugugcagaguguuauguucaugagaaacgaaggcaaagaccugcagggucucaugaucuccuaauucuucuuccgcaaaccuccugugaugugauguccaauggaaauaaguauuucuucuuuauuuauuccuaaaaaucaaaggcaguugucgcccucccucccauuuccuucguguggcugugacccuucagcauuuagccgcagggcgcgccguuuaaagacgcaguguuugcuuuugucaucaagcgguuccuucuccuuuggucuaggccagauuggggucauuccugugacccaaaaugggaugcugagcagcgcagguuuucuugucaucguuuuaaaauggcagcuucaccugccgugguggagugacgggcguccagggcagcagcccacagcccacaucgguucccagagccacgugaggagaaggguuuuauuagcguggcugagccugacaugccgugucucuguuagaaaacgcugucaguauggugucaaagccccauacagucuucagcgcuuuucucuuucucugucuccauggucuuguucugauuuacauacauauaaaacgcacgugugcagacgugucuuugugacgugugugcaugugucuguguauggaugugagugcacgucugcauauguguguguccacgugcguguguguguuugugugggucgguguucaucugugugugugugucuguguggguggguguucguucaucugugugugugucuguguggguggguguucaucugugugcaugucucucagugcuugugcaggugucuacagccaugugcaugucugcagguguguguccaugccuauguguguuacacacaucuguguggguguggaugcaugucugugugcaugcaguauacgugugugugcauaucucugaggacacacccaugugcuugucuuugcaugcacaugucuuuguguguauaucgcugugugugcacaucuguauaugaguacacacgugugcuugugugucuuugcaugcacgucuuuguguguauaucucugugugugugugcacaucuguauaugaguacacacacgugugcuugugugucuuugcaugcacaugucuucgugugcaccugaguaugcacgucuccggcaggugaggcccuucacaaggacauguguaaacgucuuguguggacucuaccacaugcuuucuggggacggugaauaagucacgagaccccucucagugucugcucacucuucucuaacugggguccguugcccuccuuggaaagguuguugagaucugguaacauaaaggcccuggcccaggacacgugggccccccuccccaggcacucagugguucccagagggaacagaccccaucugacggagcccaggcugcuuggcugcuccggcagugagcccgggcugugccggugggaguucaucugcuccucaguggaccugcccugaucuguaccugaaccacuuuuccccugaucucaucgguuugauuuugauguuucuucuuacucuugaucagauuuaauguaauguugacagaugcccugccuaauuuaagagagaaggacgucccccaauguguaccacuuccgaaaaugagcucauaugaaaucggaccccuggcgugggcgugucaccaucugcucauggaaugugcucccguugccccucacuuaguugucaccccagagaacuggccccccuuggaggcuucucugaaagcaaagucucuggccaccauaagaggugugcaugcugccugauggacuuccugccugagugaacacuggugccacccgggggacccagggcccacuguggccaaauucccgugcagagagagaaggcagggcuuuccugguggacggggagaaagggggugcugcccucuuucaggucaguggucccaggccagguuuugauggagccacccucaccccauaggcguuucucaguggugccuucggcucuuggguccuggggugaaacccucaccccguggcaucccugcuggcgggcaagcccaggcccaaagcagcaaugggcgucugccgucagggucacucccccuccccaggccccggccggcccagccagccuuuaggaugaacgugccuuucugaguugcucuuggcgugugcuuuaaucuccugccaaguguguccgugauaauaccuuaucaagugaacuuuuuaaagcuuaaauagcaucuuugaaaaggaaaauuguuucaggguuuuuuuuuuauugauuuuaauguaaaauagcacuuugaaguuuacaauuuaugguucccugggcauccgaugauggggaagaagggucagaaauugguuuuccccuuucuucugcucuucucccccacgggggccccccggggacaaugcaugccuuccaggcagcaccuuguuauucagacccguugccugccacauugcauuuucaggggaucaagccuaagacgaagaaaagauaagaaaauugccccuaaugaaauccagaagcagccggcacuuucuccucaggcccggagacucguaggagaaaagggaaccuuaauucaaaccagucccggugccagacgcggcuuugaaguugcugaguaaagucugagccgcugggggugggggcuuguagggagaugacgaugacgaugaagauggugcucuguaacccaucccucaccugugcgcggggacauggggacucuuccgucagggaugagcgccacauccagaugcccgugguucguagcuuagauuccacugugauauuacgaaguuuaucaaagaugucucugaaacuggaucuucucaagcaauaacugugauagcuucacgaauuggcauuagccuugaaauugagcaacugggcaaagcuauuucacuuuccccaaacuuucaaguaagacgggaaggcugaggcucuugaauguucguuccuuccguaagcuguguugcuguguugcugcuguugcugccuuuuguagacagguguguuuuaggagucgcagcgccugaugucugcuguuuucaccauugcugaguggcacccgcugcacacaccacgcuggucccuggguuucuugccugaggaagucaggguuaugaaguuuucauacagaccgugccaccuucuuuucuaaaagcaauuaugucucuuuaagugcauccaaguauuuuccuauguagaaauuuaucugagaagcaaaaagaagcaaaagcauauaagcuacagccucagagcugagagagcucguccugcgccagccuucgcucgccuguggggccggcccuguaagaagcgaacaguggagccggcacagugccugcccuggaggauagcgggggacugggaggacaagcucuaggcaggcccgguaagaccucaggggaccugcccacuugguggggccaaggaaguuucuggaggaggcaagcccccagcugaguccuggaagaacgagccuggcacgggacauuaugggagaagggccgucccgaaggaacagagcccgauggugcaaacccgcucaccugggcugcauccacagagccagaccuuggcccugauggcaggggcucuaucggggccucugacuguggaaugaagaagcaucacggccagcucugcauguuggacaggcccgucuuguggcagcuuaggugacagacuuggaccuggcaaagagcauuccaggguaggaucugggggccaguggacaagcccagaaaacagcggcagagauugggacagggccacaggcuggugagguggggccaucucaaagagguugaagugagaugggauugaggggaguaggggcugauuuugggggagagggcacuuggugaggucucgaggugcuggcuuagaggaggcugaagggugcugggcagagauccagcgggagaagguucagguggggguggaugaggguucaguggggacgcuuuugcuucagucuguuuucaggaaaaagugagaaaguguccauccaagugggugguugggagcaucuccaccuggaggccccuuaguagggagagccagugaggagccaguuuguguggacgaugccccagggcauuuauuggggcagaacggcagccagaaacucaagcauggcgugccagcccugagcccaguucccacggaguccccagaggcuugccggcuguggguggccacaggacugcagccucuuggccccauaagcucgguuugcucugaggcuuguguugacggaagguguggugaguuuuguuuaggguccuacuaggggaaugaacuggaaggucauuucuuuccagauguugaaacccagcuguuaagugaauuauugcauuuagaugcaguuguggcuuuugaggaugguauguacaggccauaauuugaugguauguggugguuuagagcuagacgugccccgugacacagccccuugcgcagagcacagcugggaggcugcacgagcgauggccuuucgaggaagcagaguggccggcacccugccugcugucccgguccagcucuguucccccugggaagccgaggggcguggccaacacccgccugcuguuccaacccaacccagcucuguuccccugggaagcccaggagaguggcccggcacccgccugcuacugcuaucccggcccagcuuuguuuccccggaagcugaggggaguggcuggcacccgccugcuacugcuauccuggcccagcuuugucucccaggaagccaaggagaguucgcuggcacgcgccugcuacugcuaucccagcccagcucuguuucccaggaagcugaggggaguggcuggcacccgccugcugucccaacccagcucugucucccugggaagccgaggaaaguggccagcacccaccugcuaucccggcccagcuuuguuucccgggaaaccaaggggaguggcuggcaccugucugcugucccagcccagcucuauucccugggaagcugaggggagaugucgucuucaggcugcaggugcagguuggcugaugaccgagugaagggugcagugcugugucgguaacgaaggugccagagaagccacauugaggccacgggaaggggaugcguggcaccccacggcuucacacgggaccucccuaaaugcagaggccaccgcgaggagaagccgcucucuccccuuagcaccacguuucccucuguacgugccucacgggcacaggcacccucugggcaccacagucauggcuucccugggcuugccggccccaggggugcaccuuacaggcauuuguccaccuucucuaaagauccccucuuuccacccauuucuccugccucuugagcugacgaucaguggacgaucagugggccuacugccuugggaaacugcgagcccaccccucucuccccucagguugccccaagaaaggccaaaagugaccucauggaaauacucuccuuaaagugauggcuugagaggcccacggcaaacaucucaaucuuauuuuuuuagagacugaguucuuuuuuuuuuuuuuuuuuuuuuuuuuuuugagacggagucucauucugucgcccaggcuggagugcaguggcgcgaucucggcucacugcaagcuccuccucccagguucaugccauucuccugccucagcuuccugaguagcugggacuacaggcacccgccaccacgcccagcuaacuuuuuguauuuuuuaguagagaccggguuucaccguguuagccaggauggucucgaucuccugaccucaugauccgccugccucggccucccaaagugcugggauuacaugugugagccaccgugcccggccgagacugaguucuuuauuaaaaguuuaauucugggaauaaaaugugaguccaguuucccauuuuuugcagcaucuauuaaacagggacauuccuucagcuuccucuuguaggaaagucguggaggguaagcacaguccugaagacacagggagugccaugcucagcuuccuuuuuacaggcaaagaagucaugucccauggaggagaagggacguuucuuagucgcgccacaaacgggugcugaaggugcacucaugcaccucacguucugaccuucuuaugucuagcagguguuugggaucacaaccuagaggguguugagcccaguaaaaugaaaaugagugugugggcacgugcauccgacugugccccacgcagccucacguguggccgacgugccagugcccacgagccugggcucaucuuucccauuuuguuuugacuggcuuugaggcaacaccacacaccaagccuagacagcagagacucucuugguaugaacuucauuuaacggcgauuuucacaggacuucuuuuuggagggggauuagaaguaaaauagcucagcagcacuucaaaguggggaaguaaagccuccacgugcgcucgcugcaaagcagcagucagagugccucgccaaggacacagcguccacacaaaacgccugugguucucauugaaaaaggucuuggcuuuaaaauccacaccaaaagcauggcuggaaauguguuuuucuguccaaagaaaaagguuuuaugacaagaacuuuauuaaaauaauuagaagcgagucuccuugggaugauguggacaguugaaagcagagggcggcccccucaguccugcggccccccucaguccuguggcccccucaguccugcuuccccacucaguccugcugccccccucaguccugcugcuccccucaguccugcugccccccucaguccugcggcccccucaguccugcggccccccucaguccugcugcccauuagguuggucagagccauggaggaagccucggaaugucggucagaaaggacuguggggccagugccuuccaguguccagggcagggcccuggguccagcaagagucaaaggacuccuggauuccaaggcauucucuccauccugccacugacuagacugauuucuccccucccagcccugcggcgggagugccgacaccaacuccacgcacgcucugaggccagugcgguguuuccuguguuguacaccauguuugcgaaaucgccaugcuuugugguggggucccaguaggugagaagaaaccucucacucugggaccagaaucaugcauggaagaauguuacagaaguuguauggacaggaccagagcagagguuugggcaacuccagcuggugggccaaguccugccgccugugcucuuggcacaguguuaucagagcacagggacgcucgcacgccgaugcacugucuguccugucuugggcaccacaagggcagcaucacgugguccuggcagagaccguguggcccacagacugaggucaggugccuccuaucugacccguggcaggaagcucgcugccccugucuagauucaccuuguuuccucagccccuaacgauggcccucggggcacagcuccuguguccuuggaaagcacuuucuacagcugccgcagaggcaggucuaggggaaauuguguggacuggcucucuucagaaaaaagaacagaagcagacugcucagaagccacccagggucuccugugacucccaucuaaguuccagaagugaguuucuuggcgggcaaggugccuagguguggauuugacgcauguuuggagggcagaguuugucagcacugacuugaacaggcugaagccacacagucccacgcaucacucuucucccgucugagcuugcucaugggacgcggggcaccaggaucaggcaccgcgugcucccagcauugagaugggcccucccguugccucagcgucccugaugggacucaugacugcuggcccucuagagaguagcccgcgggaucuucaccugguguuuaagcccuuggggguugugucccuccaccaccagaaaucagaggaacuuuucaauaagauucugaucugcggucauccccgaaaaggggucacauugaauuuucagcauuuuuguuucuucuggucaaaguugauacuuucagugacaucaguggggaauuucauuuguaauaaaagcugaaugaaaaaguuuuagggccagcccugcugccgucugccgugauguuucuggaagguccuugguggugggaagggacacugggcccggugagugcauuuuuggcugcccccagggaggggccucugaaaauccauaugaagggaggcgcccaucgggugaugcacuuggcccacacgcgugugcuggggaggccguggggacacagaagugugcuucggugcaggacaggcugggcugagcagcuccaggaaguaggcgguggugaaacccuaaaacauggaccuacucacacaagggcuuggugaggggacccccagagcucacagcacaagugggaaucgugcaaacuaggcuucaugguggaaauaccaggagacuuuuaaaaguucguagaaaaugcauauuuugaaaaaaacugcauggguuucaaaauguuucugcaccaaaauaaauucgcacuaacguguuauaucuggacaggaucuaguuugaggcaccaaggauaaaacgucaguuugaaaagagcccuucucagagcaacgugaauucugcuaaaacugaagccagaacaaacagcaaguuuacagugaagcuuggguaggaagaguggugaaaucauugauacuuuaugaaaaguuuauggggacaaugccccaaagaaaucagcaguuuacaaauggaugacucauuuuaagaaggaaugugcaaugguguugaagaugaagcccccagcugcagaccauccacaucaauuugugaggaaaaaauucauccaguucaugcccuaauuguagaggacccacaauuaacagcagaagcaacaguugacaccaugggcgucucaaccggcucagcuuacacaacucugccugcagaauuaaaguugagcagacuuuccagucagugggcaccaaaaccacagcguccagaucagcugccgacaggagcagagcuuucgguggaaauguucaacagguggacucaggguccugagugucauaacaggagauggagcacggcuuucccaggaccauccugaagacaaggcacaaccacagcaccggcuaccgagagccagagguggcccagucacagcaguagcaggcuggucaagcaggaguaaaggucaugacagcagguuuggggaaugcccaaggcauguugccuguucuggaggaccaaagaaugauaacaccugcuuauugugagaguguuuugagaaaguuccucagcacuuucacagaaaaucacugggagaguuucccccgagagucuuuuuuuguuuucugagguggaguuuugcucuuaucagccaggccggaguucaguggcaugaucuugacucacugcaaccucugccuccuggguucaagcgauucucucacgucagccucccgaguagcugggauuauaggugcaugccaccacacccggauuuuuguauuuuuaguggagaugggguuucaccauguuggccaggcuggucucaaacuccugaccucaggugaucugcccaccucagccucccaaagugcugggauuacuggcgugagccaccgugcccagcaccccucccuccgccgccaccaagaguccuccacaacaaugcuucugcucacuccauuaaacuagaaaaccuuugcaagagcuuugaagagaaaccauuaggcauccaccuuccaguccugaguuggcugcuucuucuuuccuaaucuuagaaaaaccuguaaagggcacuuauuuuucuucauuuaauguaaaaaaaaaaaaaaaaaacaacagagacugcauugacaugguuagauucccaggacacucaguccuuucgggagggacuaaauggcugcggucaccauugcaaaagugucuuggacuugauggagcuugagaaauaaaguuuauauuuuuuaucuuuuaauucaauuuuuccacgaacuuuuugaagccccuuuuuaaaggcuccacuucuguuccaccguccucaccugcacaggccccuugcaccugggccgucauugcaggaagacaccagaccaccugucucaugagguccuugcuguccgccaggaaagggaggcccugauucugcuccccucacccacagagggagugaaggagacuuugaaagucagugguggugauuaacucaggaucgaaggcggcagccuaaaggagacaugaaacugcugaacuucccuacucacggagagcacacauauggauucauagcauacgcauggauucauagcacacacugauaagaucauuagacuaaagacugauaaguucuuuuguguuaaggagugcuuuuuccccuuuccaaauagaauacuuuccuuauuucccuaauauaauuuaaagaauuucucagugguucugucuuuuccagugaauucucuuacauuugucaucaguuuucccuuuaaagauucuuaagugucuuguguuguaauucccuuacaccuguguguguugguguuccagggugaguaaggaacacgugggcucccccagcagggcuggcaagggcucuccgcccucucggccacacucagucccagcacuaggggcagugggugacugcacgugucuucagugggagcuguggaaagugcauugucgcagcaagagcagccugauggggcgaguggagcugacccagucucagaagagaggaugggcagggaggaccaggacagagaggacgggacagggccagggugggugggcacggggccaaggagggguguuagugggacagggagcuggcuucacucccccagguuaaugcagcuugucccauggggguuacagaaauuauacagaaaacagcauaccaagaaacagcaaugcucucacucucacuaagcaagugcaguggggcuugcuggcuugcaccgugacucccucucaccaagcaagugcaguggggcuugcuggcuugcacugugacucccucucaccaagcaagugcaguggggcuugcuggcuugcaccgugacucacucucaccaagcaagugcaguggggcuugcuggcuugcaccgugacucacucucaccaagcaagugcaguggggcuugcuggcuugcacugugacucacucucaccaagcaagugcaguggggcuugcuggcuugcacugugacucacucucaccaagcaagugcaguggggcuugcuggcuugcaccgugacucccucucaccaagcaagugucguggggcuugcuggcuugcaccgugacucacucucacuaagcaagugucguggggcuugcuggcuugcaccgugacucacucucacuaagcaagugucguggggcuugcuggcuugcaccgugacucccucucacccagcaagugcaguggggcuugcuggcuugcaccgugacucccucucaccaagcaagugcaguggggcuugcuggcuugcaccgugacucccucucaccaagcaagugcaguggggcuugcuggcuugcaccgugacucccucucaccaagcaagugcaguggggcuugcuggcuugcaccgugacucccucucaccaagcaagugcaguggggcuugcuggcuugcaccgugacucccucucaccaagcaagugcaguggggcuugcuggcuugcaccgugacucccucucaccaagcaagugcaguggggcuugcuggcuugcaccgugacucccucucaccaagcaagugcaguggggcuugcuggcuugcaccgugacucccucucaccaagcaagugcaguggggcuugcuggcuugcaccgugacucccucucaccaagcaagugcaguggggcuugcuggcuugcaccgugacucccucucaccaagcaagugucguggggcuugcuggcuugcacugugaagaugugaaaugagccuggaucacacguggguugauucccuucuaauuaagcguggucgccagauuccagccugcuguguggagcccucagcccgccaguggccgagggggugcggggcaggcauuaucaaugccagagggaaccuugggguuuugugaccgucccgucccucuuucagcugacccaguaacgccuucuccuguccuuugcagaacgguggucaugccgaucgccagcgaguuugccccggauguggugcuggugucaucaggcuucgaugccguggagggccaccccaccccucuugggggcuacaaccucuccgccagauguaagugguucugcauaugacugaggagccgguucugcucauguccaugauccgcuguguuccgcgugucagguccccuuuuuaauaacgagauaaggaagggcaccuuuuuacuaaugaccaagguucugaccguacugggaaccaguccauuugggaggccccagagagcccagagcaggcagcgggagcucagacccaggcaccucgggcacucuuugcccaggaagggccuagggcacacgaggcucccucucugggaugcgggugccuagggaccugcaggccaccuccaggggcagguccuggucccaccaagagcugagaugugccccaugccgcuucucuggcaggcggugcuccuuggaacuguaaagggaaguugcugggggcacaguugaguucagaguuggaugagggagcccaggauguguguguccucucaggaucagcguuaggggccaugcugucaggaugggaggagggacugcccagcagugcuccugcugugccucagcaacucacaaggagaugaaaaccuggcgcacacaaaggccuggccgccucccccacccuggaguccccgaggauccuggagagccucccgaggcccaagcauccuguggccuugguccuagcccuggugaugcccucaaggccccagcguccacaguguauggcccuccccacuccugucggcacaggcggccaaggaggggcccgucucucagguccuugcguggggaggguguggcucacccaggagaccugaggcagcccucgguggcugugcuccccuggggccucccacaguccaccaggccgugcagccuaguggccagcaaagugaccagacagagggcaaagagcuuccacugugcccaacgccccacagcacccggcccggagcaccgcggccaccacauccucagcuuccuccucaguccgcacagcugccucgaagccccugucacuguuuccaucagaugggaugaaccgaggcuuugggaaguuacggccucgccagcccaugaucggggccacuaauuagcggcgcgugguuccgggcucucuaaucagcaccggccuggccuggcugaggguggugauuacccucauccaccaggcauucccuccuggggugagugaugugggugcaguggcgggacuguggcucuugaucaaagccaaacgcucagaccuggacgugggagaacgcuucaggagcacaugcagccugugcacauguguacacauacauguuuggagcaugucagauaaccagagcccgcugggccacggccacaagagcauggccauagccccucugcgggggccgaagggcagguggccugcagccucuggguggggcuggcugcccucguccccuaaagcagaugauuugcugauuaaaaaucaaagcauugaagccauaauuccuccucucaaacagaucaaagaggaaauccaaagccgaaacucuucagcgaauuuauuaaacgaaacccggccuggccaugugucucgacaccccagcccccagucuucuuacgaugccaugagacgcguuucugggcugugcuggcugcgguccucccccguucacacugcagucucccguuucccguugcaggcuucggguaccugacgaagcagcugaugggccuggcuggcggccggauuguccuggcccucgagggaggccacgaccugaccgccauuugcgacgccucggaagcauguguuucugccuugcugggaaacgagguaggaagaccccagagaccccacaggaugcuccacacugacaggcucgggguuguggccuggcugcccgagagccccagagcaugaaaaagccagugggucucugaccacguggaugcuugcagcuccgccuugcaccugccccccacccccgcauagcucuaaauguggcagaaccgugacgauggcuggaagaggugcagggggcaggacuggaaggagcccucuugucgugagaagauggcucaggguccucugcggugcgacugcacccuuucaguucagggucccucucuccauuacguggagcacacugugaccagagguuuucuuuuucuuucucucuucguuuccucuguggacagucagcuucucuagggaguccucauguggguuucggucaguggccccaaggcaggcuggggcucuucugcccagcaggccugucugcugcucugagcccccagggacagggcucccugcugugucccuaccaacaccgccggagggagucagagacgcuguggucuguacagcuggccucugagaccugggcagagaaaaagaauguuccacgggcucggggugagagcgccaccugcagcguuccauuccagcaugacgcuggggcccgggccucccugcucccagcagggccuccaccaggcgugggccagugagaugggaggaggaggcagugccacagcuaccaaugucauauccaccuccaagagugucugaagugugugacacaaaguggagggguaccuuucauucugaguuucccacaccugcucuuccugagccucugaacccgucuacaggguuuugggugugaguccagauccccaagacacgacucagucgguggcuuccccacgcagagcucugccuggcugccugcgcuggguguccagugcagguccggagaacagccagcuggcacgugggggacucaagggccauguguccagaucacuugaccacaggaagcggagggcagggcagugccugaggcuccagcacaccagaugcagaggccuugccagggggcagggugggagucugccuccugugcccucugggacugcccuccccagcccggcaguccugaggacagucucaguagagucggggugacagggcacuuuaguggggguguccuggugcucagcgguuugcaggaaaccugcauuuucacccccauuugaugcucagcccccacucugggggacuucucuggaagcagcauccucauuuucagcucaaggaaaaggcagcacucuaccauccgaccucaccugucuuuacaaaaaaaucuccccagucccuuauguuuggggaaccagugggacagcagcucagaugcccucgggucagugcuggcuuuugccugccugugggugcuccagaccaaggugcuggucccaggcccucuguucaccagacaggcggucacacacuuacaggugccuugcacgccccuggguucuggugucugauggcucuuacugacaggcgcucuggccuggcauuguggggcgggcagagggauggcagggacugcagccaucccaggacacucugugcaagccucccccgauggaaagcuggcccugcucacuccaggacgguccgggugccgugcaacuaagggcagcgcccagaggcacucgaggucacgagcgguggggaaacgucaggccgcacaggaggccacggaccccuguaguuaagcacggcgcucgcggggucuggugugcaggcaucguucgcauuguucuggaaaaugcagagggaggguccacucucuggcccacugucugugaguggccucagcaugcgcagugggccucgagguggccagcacacagggcaccucgcagaggacgccuccugcacaugggcgugggugcuggaauucucauugugagcguuagaacaaaagggugucuucuucccagugcaaaccccauuaugagaggaaccccacuggucacagccaguucccaccuccaccaccucugccgucugucccugggaagcagguugcuuuccaaacgguugguaacucgcugcuaacugggugcugcuuuagccgaggaagccguacguuccugaccugggucugcucuugagagcagggucuuauugugagcagucaagacccccaccuuucuagggccccaggccgccacagcaccagaaccuuccucccuccccuucuguugaggccgaugugaggggcagcaucagagacggcggaggugggaccugggacugcaggucccgccuccagccaggggcacuccagucaggggucucccccugcgccagaagugggagcagcacagggcauccuccgggccccucccccgcccccagcagggcugcugccauggcuuucccagaaaggccagcacuguaauccuaaauuuugaaagauucacucugagacaaaccugcuuuauuuuccaggaaaggucucauucagacacaggccugaaggccaagcacaccagcaauaucuccaggugacacaaacugcccggcacagcaaggggagcuuuuccaggccagggaagccagggcggugcgcgucagcuguguguuccuccagcccuugccauuagagggagaggggcagcuuccuuagaaccuacgaggcuccgucucucugcagugacuccugaucuaagggccgugggugaggccugcagaugaucggcagggcucagugccuugccccggugaccaugcgcagccgcugagggaggcccaggaccggcagcgcugagccucggcucacccaaaggcugccauggggcccauggggccuugacccagacuugggaagccagggagcuggcggucagggaagugggcacuggccaguggucucccagacaggagggagguucgguggcuugaagaaguagaggacgccaagggcagggugacccugggggucagugagagcccagaagugcaggcaccucacgggaggacaguugggcucucgcaggugugggggaggcugggcuggccaagccaagagcacgaggcagaaggggaaaggggagagagggacgcauggccaggccugagguggucuguugggccccacugaaaccccuggaucuucugaggggugggcgcauacguccccuugcacaccuccgccgacagcugacagugcugccuuaaagaccagggcuggccgggcgcaguggcucacgccuguaaucccagcacuuugggaggccgaggcgggcggaucacgaggucaggagaucgagaccauccuggcuaacauggugaaaccccgucucuacuaaaaauacaaaaaaaaaauuagucgggggcaguggcgggcgccuguagucccagcuacucgggaggcugaggcaggagaauggcgugaacccgggaggcggagccugcagugagccgagaucgcgccaccacacuccagccugggcgagagagcgagacuccgccuaaaaaaaaaaacaaaaaaagacugcagggccacggcccggcuugggaggaugggggaugggaacgguuccaugacccacuacagagcaagaccccugggugcgugaccccgggacagcagaccuggaguaugcgagaccccaugugugccaagccccaagggcacaagacuuagccggaggagcgacagcaggcaauggccaaggucagggccuuggcggggucaggaccuugcaucgccaaggggagccccuugggaccugcagccugggccaucgcaggggccugcgccagccagaggggugccgagaggggacaugggcaguggcugcagguaccaggacacgcccugccuucuggccaucuuugcuggucagggaugguguucauguuaacauaaaucacaaguagaucaaagauccagguggcaucccugcagcgggugagcuggccagcgacaggcuggauaaaagaccgggcugcuguuuaaaauguccaaagcacuuuacagguccuuucuucacaucaaacagucuuuucccccuuuuugcuccaguuaaaaggcaacugacguauauauucuaccaucccgaagccuuaugguucuucuggcuaguuauuuuaaauaacaauagggaacuucgcuuucagccguggccuguucuugcuuccugaugcguguuugcgcuucuaacaagaaaauguucuuuuacuuaaacacgucaaaaaggaggaagcacuaguuuuaucaaggucucuuuaaaagucucuuuaaugcacaagaguuggccugggccccgccccucugcccggcagccuuugaugaagguugauauacagugugccaggcgaucuggcacacacaggcggggccgccagcugugacggcaguggccugcggggacccuguugcugcagaaguggcugaguuauagggugugcgggacaggaagcgcagaggggccuuggcguccccgcuaucagagcgaccccucugucuucagcgcguaggucuggaggccugugcuguucccagcaaccauuuuauuuaauaguuuccauguucaguuaucugcaacugccagugacuaugggcagugaaaaguucccuacgaguguugcauguugcaguguagaugggccguggagucgugugggcgcagcaccgagucgggccuccagccaacuuccaucaaagacccugcaccagacggccacggggaucuguggcccaggcccgugcccccgggagguuaggaaaggaccgucucuccugucugagaccaugcccaaagcagguuuuugcuugggccaauuuucuacuuuagucauggggcauuucaggguuaaaaugccaccaucucauuuaacccacuccaggauucguggaagacauucguggagcaggaggguggugucguguggaaaagguuuucccccgggaguuuagcuuauuaguuauguccugaugcuuugugaaaggugugguugugaaacagcucuaacaaaguaacgaaaaccaagugugugugagggacugaguuggauuaaccugagagcuggcugccugcuuccagucacucuuccucucacacugacaccccacauggccacccucuuguacacacacaccacacauaggcaccacagucucacaugcacgugcauccuugcucaugcacaccacacaugcacacccacgcaagcaccagucacacgugcacacacgugcacccucucaugcacgcacacaccacacauacgcacacccacacaggcaccagucacacgugcacacaccacacacccucuugugcaugcacacaccacacacacgcacacccacacagguaccacagucucacacaucacaugcaccacacagguaugcccucuugugcaugcacacaccacacaucugcacacccacagaagcaccagucucacaucugcacgugcauacucaugaaugcaccacacagucucacgugcacacacacaccacacacgcacacauaccccacaagcacaugcugucacgcacauucauacacaugaaugcuuacacacaccacacacucacacucagucacacuccccccgugccaacggugaauguuuuaucugcaugcagccgauuguggcgcgcacaggguccacgucgugugucccgcuugcuccucuuuccauccgggcugccaaagccuuccuggccgacuuucagcaagacagagcccagccucguggccuucagaguugaaggagcuguggccacacacagcggggccgucccucugggcccuguuaccuggguguugggauguaagggacaucucagcgcucccccuucccuggggcccccucuguaaaggagccugcgugcaucccacacgggcccgggccggggcaggugcgggcugcuccggguuugcuugugacagacagaguuacgcugaacuuccgggcaaguccccaauacaccuagguggccgugucuccgguaaacguccaggaggggagauggcccaggauguguuuguucaccuuuaggagauaacaucaagcggcuuuuuaaggguuaaaacugucuucagcaguggcgugaccagaccucagcagcacuuggcauuguugcccuugaccuuugccagcuggacggggguaaaacuggccccucugcagggcuccagggucccuuccucaugaccgccacggcagagcagccccgcaucugccuauuggccaccugggcuuucccuccuugugaaguucaugucaacccguuuuucuauuggauugucuuuucccuauuuguucuuaguggggugaauuagacagauggacagagggagagaaggagagagcgguggugugaagcagguucuccacacauuggugaccagccugugugaguccagggagacaacacccacacacacauucugugcagcagauuuacuacuuacagacaggcagcaggggacggcagaagcccagggcaccaugagccagucccccaaggcucagaaaugccccaguggauggagucccaucagugcgcuccucuaggaaacagccuguccugaauuuuguaccccgagugccaugugacacacugagcugaagcacugaagggugcccuguuuccaccggcggaggacugggacagagccaggcuggccagcccguguccuucacaucucaggcuguguugcccagcacaguccacggucacucucgagaacuacgagugugacggacguggguggauccaagggcccccggagagcucuccugcaggcugguggguggguccaaggucccccagaggacuguccugcaggcugguagguggguccaaggccccccagaggacuguccugcaggcugguggauggguccaaggcccccaggagagcugugcuccaggcuggugggugguagcuggcucccuaggaguguucucccuguccucuggaggaguggagguaggaucaggauaaucuguuccuugacugggagaacucuccuaggccgcagguuuacuuugggugaaaauuuuaaauuacagauucagugacuuuaaugguuauaggucuauugaaguuuccuauuccuucuuaauuuugagaaguuacauuuuaccagaaaugucuccauuucaaccagaauuucuucagauuucuuggcaagaguuaaguguccccaguuuccugccuuucacgucucugcucugccuguagccggggcccccuuucaucccugggguugucccuguguacccccccgaacuuggguuuccuccgucaguccugccggagccugucaguuuacucaagcacuuccgagaaucaguuuucaacugcagcauccuuuuuucuuuucagaauuugucugcuuucccaucuaucuucuuuccuucuugcuuuaggaccacuguguucucuggcuaacuucuuacauuggauauuuauuuuuagucuuuccugaugugugcaguuagggcuguaaauggcuccaacauggcauccagccgcaucucacaucgugauagguagcacuuuucauuacuuuuuaauucucagcauuuccugaugucuguuaugauuucuucuuugagccaugaguugguguguuuucuaauuuccaaacauaaggacucaugguucucuuuuugcuaucaauuucuaacaaauugcacugugguaagaaaaggaagugugguuggcauuuauuuuuuuguggcgacuugcuuuacgggccagugcguggucagccugcagagacauuccacauguguuugggauaauguguccucuccgucuguuucccagaguucuguuuguguucauuaaacagaacuugcuaauuguauuguucacgcuuugguuuuccugaccgacgauugucugcuggaucugagaaagacauggcaaagucucccacgauggugggacacacauauucuugucuucuuuccauugcacccauuuuuacuuagacauuuuaaagcugcuuuacuaaauauagacauuugacaucauuaugcccuuucgugaugaauugaagucuuaucacaauaaccuguauauccaguaauggccuuucccuuacaucuuuugugccagauauuggagcugugaccccagcugcccuuuggccagguuugccugccuagcgucaguuuuccuuugggacuuuuagccuuccccugaaguuucagaugugucuccuauaaacagcaaaagccugggcaauauauuauuuucacguccuauccuguggucugugcuuuaaguggaaacgugggucauuugcuguuaguuugaucccuuuuuucagaugccuucuuagcaucuuauucauuguuuguccccaguuucuguggcucuuuccuuuuucucuuuucucgccuucucuugggguaauugaggguuuccugcauuccauuuguucccucuacugaguccaaagauaugcaaccuauuuucuuguuuuucauucgucaucuuuaacaauuggagcauguauugucaacacagucagcauccucacucccaccuccaugcaaaccaaagcccggacugggccagccccaauuagggugccagaguagacacagagcacccagguggguauccuuccacugcaaaacuacuuguuuaucagacacugaaauuuaaccagggccgugaaugguuuuguuuguuuuuguuuuacuaaaucuggcagcccuagccucagugccccaucccagguuauaucacugacugguguuucauuuccuucuuucuuuuguuugauuucacugauaagacaccauuauuauugcucuaugucaucccuguucauccaggcuuuccuguacuuaugucauuuucuuggcucaucauuccuucucauuucucacacugucuucuaggauuauuuucauacugccuuaaguauaauacauccacuagagugucccuugggaaaacacucauguggucaacuuccccagcucgcguuugugaggaggcaggucuuuaucucacccuuguucuuggaugauaguuucacuggauaaacaauucuggguugacaaggauuugcucuugacacauugauuggcuuaagauuuuaagccacugucugcuugccuccauugcuguuaaggaguugguguguggcuaauggcuaccucuuugaagauucuguuuucucuagcagcuuuuagaauuuucuuuuuguuuuugauguucugcaguuuuacucugauguaccuaggugugcauuccuggguuuuuuugccccuggcuugggucucacaucuuccaugucacguucauaaaucucugguuguuucaucauacagaaaugucauuuauuuuuaauacauacucacuauauuuacuuuuuauaauuuauaacugaucauuucaguaacugcgaucuuuaaggaucuaaucaauuaaaacuuauuaaaaguuaauaaacuuuuuauuuuuggauagucugagauuuacagaaacauuguagagaucguguacaaguuccucauauccccccucagaaaacgucuucuacugugaacaucuuacuucgauaugagucguuugucacaacuuagaaaccaaugcugguccaugacuauuaacuccagaauguauuuggaugucaccagcuuuaccacaacugcccuuucuccauuuuagggucccguccaggaucacacgucacauuuagucauuucgugucuuuuuucucagucuuucaugguuuuucaaggagcacuggccagagauuuugcagacugcccuucaguucauguuugaguuucuucuccugguucugugcuuuggggaggaagaucauaggaucgaaaugccauucgcuugucagaugugcugccagcacggcucacugaccuugaucauuugcugagagugauguuugccggguccuuccaccaucggguuacgcuuuuaccgccuuuccaaauguauuauuuggaagaaagucacagugcagugcacacucagggggacagaguuggagaggccuuaagccccaccuccuggagaggggaguagauacgugcauuauuugaaaugcucaaggaguugucucugcuccccuguguguguauuucguuauuuauucauaucccggugaacuccuguguaucugucuuucuuacacuuugggucaugcuucaauaccacgguguugauuuugcugcccagcugguuccugcucuggcccuggggcaccuuucagacuggcccugcauguccugugauggccccgucccuugaccuucaggcacguccugauuucccagcaccacgaggugcuccaggcucucgugucuuguauuuuccccgccccagccuuggaccgagcuguucuccaaggagccugcuucccuucauuggagaaugggauugggaaccucgcucaucaucccuccugacccaggcucgugcugacucacuuccguguuguuugggguuuuuguguuugggaacucaugcuuccuggaaguuaaccggcugugcucauuugaagccugcuguggguaugugugccuccaaagaggcccugcugugguuucugccuggcgcccuggccuggcggagcugccacugucgauaguagcuguccacucccagugucuagaagcaggcaaauucucagggucacuuugucuuuucaccucuacccagaagccagaguuaaaacccaaacgcuccuucccauggccucuguuugacacgucgucgugcgucuguccucgcucacccguccuguccugacaguggucuuuccagccccagcaaggcuggcuccaggacaccuggggacaugggugcuuuggccuucugacucagguccagcuuuguuccagacccagcagguuuccccugguuuugugggcucuuccaguuauuuaaagguucuugaacuguuguauuucuauauuuuuauaauccauuucaaccuuuuuuuuuuuuuuuuugagacagggucucacucuguugcccaggcuggagugcgguggcacaaucuuggcucacuacagccuccgccuccuggauucaagugauucucaugccucagccucccgaguagcugggacuacaggugcccaccgccauaccuggcuaaguuuuguauuuuuaguagagacagaguuucaccacguugcccaggcuggucuggaacgccugaccucaagugauccacccgccucggccucccaaaguacugggauuacaggcgugagccaccacgcccggccagucaaccauuuuuaauuguuguguugcaaaugcuuugcccuguugcccugucauugacuuguaaacuucuucccugcuuuuaucugcugccaguacuuagggaaaaacucggugugaaggauucccucugagagaucugacuacuucuuccauuucaucucccccgaccccaccuuccgcugcccuggaagaaaaccaagaucaggggauauucagacauucuuacuuauuaauaaaagacaaaggaaagaaaagugaugaaguaagcgucacucccccucauggaacccuguggcgucgauggcagauaccaaguucacgugcaggugccagccccacuccuggggacugucuuucuuccugcuacuuguaggaacccacaaauaucuuauagcguccuaaaaaaaaauccacuuuuacaaaaaaauuauaaauaccacggcacauuuggcuuuuuaaaguuauuuuuuucuacucugugggcaaaugcaccccacaagggucucugugcucaggaaacaguugcagucucggaacacccgucuaacgcacguguggauuauauuggcagucuuuauauucuuaugcauuuucuuccagcuugauccucucccagaaaagguuuuacagcaaagacccaaugcaaacgcuguccguuccauggagaaagucauggagauccacaguaaguugccuggcugggugcucacaggggacacgccccugggggugggacugcaccacaccccaucccugucccccuauacccccagcucuucuccaucccacugccggcugcuuccccaggccugcagcagaaggccuugcuuucagcugcauuucuugagcugguagagacucacauuuaaccccgacuggauuucccccggccugcugggaugguuccaucagcccaauuuguaagucuagagaaucaaggcccagacagucucaguguggagucacuugcucuagguccccagcuagcagcgggggccauggcugugagccuguacccuggggacuccggccucuucccuggaccagagaagcccacguccugaccucaaagaacccuuggcccugcagagaggcaggguguaggcccucugaguucuggcaccgacccucaagcagcagguccugggugcaagggcguggcacgcagccuaucucagaggcgccucccacacccugucauugucgcaagcccagcuugucuugccuuugagaugacccagaugguugagacuguccacagaagcagggguaguccagagcucagcuccccguuucccugugugagggaguccuggcuucagagcccugaagcugacccugggccaggcccagcccuccacauacacccccuugcgccugacgcaguaccccuccacccccagccucugugagggcccaggcagaagaccccucagccccagcgacaaucccccagcucaccugcucccagagauaggaaggcucaacccagcaggcuggcagcccccugcccuggccacccagggcagaaaggggcccgugagcguggaaagccaggccuacaggagccucccucugcaguccuaggugggccugcuccuggagggacucgagccacucacaauggggaaacauuuccagagauuuuuugggucuuugugaguuuguagccaugcagucuucugcuucgugucucuucaaagacgggugcuuuuaaaaucauaagggaucaaucugguuugaggcucagggucccgcaggaccuucccgggccucagugcauccugcuaaguuguagucacugagcgacuuuccucaccccaccaccccaggcaaguacuggcgcugccugcagcgcacaaccuccacagcggggcguucucugaucgaggcucagacuugcgagaacgaagaagccgagacggucaccgccauggccucgcuguccgugggcgugaagcccgccgaaaagaggugagcaccugcccugccgcccgccugcaggcucacccagccccacugugcccacugacacacuauucagggucagaaccuuuauggcacaugcccugcccaacagacuagagacaggccaguguggcccccuccuuccagugccaaagccccuuagagacgcaugaggagcauuagauccugaacagauggacccggggcugccaggccagggcuaggcuggcggguggggcagcacacagccuuuaacccacguucuguucucuccucucuguggugcaccugccccacgcccccaucuccuucucuugcgggauccacagaccagaugaggagcccauggaagaggagccgccccuguagcacucccucgaagcugcuguucucuugucugucugucucugucuugaagcucagccaagaaacuuucccgugucacgccugcgucccaccguggggcucucuuggagcacccagggacacccagcgugcaacagccacgggaagccuuucugccgcccaggcccacaggucucgagacgcacaugcacgccugggcguggcagccucacagggaacacgggacagacgccggcgacgcgcagacacacggacacgcggaagccaagcacacucuggcgggucccgcaagggacgccguggaagaaaggagccuguggcaacaggcggccgagcugccgaauucaguugacacgaggcacagaaaacaaauaucaaagaucuaauaauacaaaacaaacuugauuaaaacuggugcuuaaaguuuauuacccacaacuccacagucucuguguaaaccacucgacucaucuuguagcuuauuuuuuuuuaaagaggacguuuucuacggcuguggcccgccucugugaaccauagcggugugcggcggggggucugcacccgggugggggacagagggaccuuuaaagaaaacaaaacuggacagaaacaggaaugugagcugggggagcuggcuugaguuucucaaaagccaucggaagaugcgaguuugugccuuuuuuuuuauugcucugguggauuuuuguggcuggguuuucugaagucugaggaacaaugccuuaagaaaaaacaaacagcaggaaucggugggacaguuuccuguggccagccgagccuggcagugcuggcaccgcgagcuggccugacgccucaagcacgggcaccagccgucaucuccggggccaggggcugcagcccggcggucccuguuuugcuuuauugcuguuuaagaaaaauggagguaguuccaaaaaaguggcaaaucccguuggagguuuugaaguccaacaaauuuuaaacgaauccaaaguguucucacacgucacauacgauugagcaucuccaucuggucgugaagcaugugguaggcacacuugcaguguuacgaucggaaugcuuuuuauuaaaagcaaguagcaugaaguauugcuuaaauuuuagguauaaauaaauauauauauguauaauauauauuccaauguauuccaagcuaagaaacuuacuugauucuuaugaaaucuugauaaaauauuuauaaugcauuuauagaaaaaguauauauauauauauaaaaugaaugcagauugcgaaggucccugcaaauggauggcuugugaauuugcucucaaggugcuuauggaaagggauccugauugauugaaauucauguuuucucaagcuccagauuggcuagauuucagaucgccaacacauucgccacugggcaacuacccuacaaguuuguacuuucauuuuaauuauuuucuaacagaaccgcucccgucuccaagccuucaugcacauauguaccuaaugaguuuuuauagcaaagaauauaaauuugcuguugauuuuuguaugaauuuuuucacaaaaagauccugaauaagcauuguuuuaugaauuuuacauuuuuccucaccauuuagcaauuuucugaaugguaauaaugucuaaaucuuuuuccuuucugaauucuugcuuguacauuuuuuuuuaccuuucaaagguuuuuaauuauuuuuguuuuuauuuuuguacgaugaguuuucugcagcguacagaauuguugcugucagauucuauuuucagaaagugagaggagggaccguaggucuuuucggagugacaccaacgauugugucuuuccuggucuguccuaggagcuguauaaagaagcccaggggcucuuuuuaacuuucaacacuaguaguauuacgaggggugguguguuuuuccccuccguggcaagggcagggaggguugcuuaggaugcccggccacccugggaggcuugccagaugccgggggcagucagcauuaaugaaacucauguuuaaacuucucugaccacaucgucaggauagaauucuaacuugaguuuuccaaagaccuuuugagcaugucagcaaugcauggggcacacguggggcucuuuacccacuuggguuuuuccacugcagccacguggccagcccuggauuuuggagccuguggcugcaaggaacccagggacccuuguugccuggugaaccugcagggaggguaugauugccugaccaggacagccagucuuuacucuuuuucucuucaacaguaacugacagucacguuuuacugguaacuuauuuuccagcacaugaagccaccaguuucauuccaaaguguauauuggguucagacuugggggcagaaguucagacacaccgugcucaggagggacccagagccgaguuucggaguuugguaaaguuuacaggguagcuucugaaauuaacucaaacuuuugaccaaaugagugcagauucuuggauucacuuggucacugggcugcugauggucagcucugagacagugguuugagagcaggcagaacggucuugggacuuguuugacuuuccccucccugguggccacucuuugcucugaagcccagauuggcaagaggagcugguccauuccccauucauggcacagagcaguggcagggcccagcuagcaggcucuucuggccuccuuggccucauucucugcauagcccucuggggauccugccaccugcccucuuaccccgccguggcuuauggggaggaaugcaucaucucacuuuuuuuuuuuaagcagaugaugggauaacauggacugcucaguggccagguuaucaguggggggacuuaauucuaaucucauucaaauggagacgcccucugcaaaggccuggcagggggaggcacguuucaucugucagcucacuccagcuucacaaaugugcugagagcauuacuguguagccuuuucuuugaagacacacucggcucuucuccacagcaagcguccagggcagauggcagaggaucugccucggcgucugcaggcgggaccacgucagggaggguuccuucauguguucucccuguggguccuuggaccuuuagccuuuuucuuccuuugcaaaggccuugggggcacuggcugggagucagcaagcgagcacuuuauaucccuuugagggaaacccugaugacgccacugggccucuuggcgucugcccugcccucgcggcuucccgccgugccgcagcgugcccacgugcccacgccccaccagcaggcggcugucccggaggccguggcccgcugggacuggccgccccuccccagcgucccagggcucugguucuggagggccacuuugucaagguguuucaguuuuucuuuacuucuuuugaaaaucuguuugcaaggggaaggaccauuucguaauggucugacacaaaagcaaguuugauuuuugcagcacuagcaauggacuuuguuguuuuucuuuuugaucagaacauuccuucuuuacuggucacagccacgugcucauuccauucuucuuuuuguagacuuugggcccacguguuuuaugggcauugauacauauauaaauauauagauauaaauauauaugaauauauuuuuuuaaguuuccuacaccuggagguugcauggacuguacgaccggcaugacuuuauauuguauacagauuuugcacgccaaacucggcagcuuuggggaagaagaaaaaugccuuucuguuccccucucaugacauuugcagauacaaaagauggaaauuuuucuguaaaacaaaaccuugaaggagaggagggcggggaaguuugcgucuuauugaacuuauucuuaagaaauuguacuuuuuauuguaagaaaaauaaaaaggacuacuuaaacauuugucauauuaagaaaaaaaguuuaucuagcacuugugacauaccaauaauagaguuuauuguauuuauguggaaacaguguuuuagggaaacuacucagaauucacagugaacugccugucucucucgaguugauuuggaggaauuuuguuuuguuuuguuuuguuuguuuccuuuuaucuccuuccacgggccaggcgagcgccgcccgcccucacuggccuugugacgguuuauucugauugagaacugggcggacucgaaagaguccccuuuuccgcacagcuguguugacuuuuuaauuacuuuuaggugauguauggcuaagauuucacuuuaagcagucgugaacugugcgagcacugugguuuacaauuauacuuugcaucgaaaggaaaccauuucuucauuguaacgaagcugagcguguucuuagcucggccucacuuugucucuggcauugauuaaaagucugcuauugaaagaaaaagaaagcgaacaguuuuuguuuguuuuuuuugccgugugugcuccauaguggaggcgcuauuuuccaauugaugagaaugacaaacauauauaaucuaucuaucuaucuaucuaucuaucuaucuauacagggggcuugaaccuuacucacccaagagcuucuuacggaaugugguagaaaaccaaguuguaacgacacuguaaccuaccugaugccuguucgcgcccgccgugagcugcgcacuggccguggccaccauucaccucuguaauuuaauccguuucucuuggauugucuggacgugcccgaugguucuuucuuuugcucaguggaguuggagguuuuguguuugguuuucucauucuugucuuguuuuguguggguggauuuucaccgaccaaugauauccucuucugacggucaccuucuuuccacuucacuggaguccaguauucuguaccacaucacgcaacguguuaucuugugguguaaauaaagacugcguuacuugcccuccca

SEQ ID NO: 191129 - RNA, 33097 nt, Homo sapiens
gagccaggugcaaacauuucccgucaauuggcagaaaacaaccuugaggaaccuugacgaguguccggaguuuagaaaacuuagggauggguaagccugcuuucagugucuugggccaaaacaugaaaauuuaaauuucuugcaggaaauuuaaauuuuuguuuuuguguuuugguugagauuucaauaaaagaaaaaugaaaucagaaaagaaaugccuagaaaagccugucugguuuauuuaaagagguggaaagugacaaauagacuagguccuuuauaguauuuuuuguuucauguuuaaauuuauuuuuuucuaaugaaguauaauuuacagagaguaaaauacacagauauugaggucacaguuugauggaucuuaacauauaucuaggcucaaguaaccugauguuuggauucuaaaauucucuuacuggucguccucacccccacccaugcuucagugacaacaaggagggacaguggcuaggcugcugccacguuccacgcggcccgaagugguggagggugcagggggagcggccccaggagcagguuaaccuggugaggugcaguguagacagaaggaggcgccgccgcugcuuguuuacugccugaccuguugucccuguccaaauuaaacuccauuaagauucagagcaaauaacagcaagccaggagggcgacaggaagggaaguauuucucacagccauuaguugcucacagccguaagccuccaucuaguugcuuagccgcgugcuccuuccuuuccagucugauguuauuuuuucugcucaaaagcguuucuucugaauuucagagcuaucuuagaauucucuaguuuuuuaaaaagaaauugccacauaagugcugcguccuguccuguccccaaguguggugugggcccugugccccugaagcagcagccgccugcaggguagcuucucuccagggcccgcgggacuugcuucccugaccuggcaugcacauagcaaaguccacucaaaagcucacuuuuagccagaauuuuugaggcagccucucccuaccuguucuuaccaggacaccaucccccugcucaggugccacugcuuacccgcucuguggugggccucucugguccugaugccagggcucgcccucagcucucgugcgccugcacccgcccuucucacugaugucacgggucgccuuccaagcugccagcaaugccagcugcuggccaucuccagcccacccaucccucuuaucucacucucauuuccaucucccuugggcuagucgucgaggcagaaagcccgggccacgucccuccuacguaaaagguucuggcccauccaggcccacuugggggaauagaugguccaguucaacuugaccagacuucagauaagcccaguucuucugaggagccagcugugcucaccuguccuugccagcccccugacugaguucucccaggcgucuuguggcaggggcucugggcugcuccagcugcaggacuggggcagaguguguccccaugggcgcccuccuugcuuccaggccagccgggcugggccugugucuagaaccagcuccccagcauccugaggaacgcgaaaccuacucagaaacacggcugagggcggcgaagagcucuccugaugugucgggaaccgugggcuuggggcacggggaugugcuggguggcugccaguggcguccucacucccaccugggagaagagaggagugaagaggagaggugggaggugagaggcaccgggcagggcgcuguguguggcuccagcccucucuggcccucugcaccugccccaagguaugcgacucacaccacaguggugucauuuguuuuaauuugaacagauguuuagaaauugggauauuuuagccuaaaaucagcuucuggcuuuucucgaaauauuagaucugcaguaggugcugcagcuuggauggcagcagacccuggggccaggagccaaggcccugagcugugaggccgaccucacuccccaccacauccccugcucugaggccacccagaacccugugcugcaguaacauaguaaacacucuugggauaaaaugcuuuuaguuuuuuuaaguuuucugcuuuuugaaauauuaauuuguuuggggagguuuuucuuuauaacauuuuuauugagguguaauucgcauaagugaaacacaagcuccuagguguucccguggugaguuuuggcaggugcaggcgcuugugcagccacacccacguccagcgguccagguucuccuuugcacuccccuccaagccccuccccgucaccguucagauuccccacccuccauccuuucugccuggucucgaauuucaucuaauuggaaucauagaauauauacguuuuugucuggcuucuuucuuuucgcgcaguguuuucaagggacaccugauugauuuucauuucuagucucacugcauugugaucagacaguagacuucuuucugcuuucuggaacuuacaggcuuucuuugaccauuuagaaggccaguuugcaugacuguuccagaggaacuugaagaaggcauuccuuaguuuuguuuuuguuuuuguuuuuguuuuuguuuugagauggaguuucgcucuugucacccaggcuggagugcaauggugcaaucucggcucaccgcaaccucugccucccaguuucaagcgauucuccugccucagccucccgaguagcugagauuacaggcaugcaccaccacacccggcuaauuuuuuguguguuuuuaguagagacgggguuucaucauguuggucaggcuggucucgaacuccugaccucaggugauccacccacuucagccucccaaagugcugggauuacagucgugagccacugcgcccggcgguauucccuaguuuuaagcuacagaguucaauauguaucagucagaacuaccuuauuaauuauauuauuugggaauuuuguuuuauuuguauucauucagacuuagaggugaauugcaauuucauuuaguuucuuucucucgacaucuucgugugucaucaguaauuucugcuuuauagauguugcugugcuuggugcaugaguaucccucacgguuacgucuucauugugcauucugcccuucauucgggagagccauucuuugucuaguuccaugcauuuuacgugaugcuaagauugggaagccugcuuccuuauugcuuauugcccagcuuucuggacucucucucugaauugcuuuauuuuaggugcaucucucauuuacagcaaaagaggugagggucuugcuuugugguccaaucugaaaagccuuuuuuuuuuuuuuucucaaggcagggugucucuccaguugcccagacuggagugcaguggcgcgaucuuggcucacugcagccucaaccuccugggcgcaagugauucuccccaccuacccucccaaguagcgggggcuacagacacgcaccaccaugccuggcuaauuuuuuuguauuucugguagagaugggguuucacuauguugcccaggcuggucucgaauuucuggacucaagcaauccacccaccucggucucucaaaguuaugggauuauagguaugagccaucaugcccggccuugaaaagcuuuuucauauguaaguucaagcauuuuuagucuugguucugucaucuuauuuuauauuaugcuuguuguguuuuacuuuuuuuuguuuuguuuuuguuuuguuucugagacagggucucgcucugucacccagguuggaguguagugaugugcucucggcucauugcgaucucugccucccaggcccaagcgauccucccaccucagccuccugaguagcugggacgacaggcacgugccaccacgcccagccaauuuuuuguaguucugguagagacaguguuuugcuauguugccugggcuggucucaaacuccugagcucaggcaauccacccuccucggccucccaaagggcugggauuacagauaugagccacugcaaccggcccaguuuuuaaaaugaaaucuuccacugcuacuucauuuguaagccucuguggugucagcucucagggacaagaccaguggggaguucugccccuucaaggguccuaugaguugagugucaugccuguacgaccaggcaucuaccaccuauaaccaguuuuuuuuuguuguuucuauaaccgcuuuuuuuuuuuuuuuggcuuaguacauucaguguuuacggagguuucuuuccgcaucauuucccuauugucuccugaugacauccagcugcugguaauguccucagggagaagacauagaaacaaagcuccuugggugccaaggguugaaaacuccauuccugcacugucgaaaaggucuagagagugagucucuuauguaguuuaauauuuucuaauagcuacauuaaaaagguaaaaagaaacaagugaaaucgauuuuaauaauauauuuuauuuaacccgauauuaucuaaaaauuauuucaacaggcaaccacccauacuauaagauuauugaauuauuugaagacuuuuuggacugaguuuucggaaucuaguuuguagcucgcacucacugcacgugucagugagccagcucacgcgccugcaaucuggaaggaucgcuguggccagccguagcauccuugccacucaccuucccuccucaugcgccuucuacgugugacucuagcgucuucugccacagaacgcagcuguggagaaacacugacccacguucugucucuguagauguguguguucugcaccuuucacagaaauggaauugcagaauaugugcucuuuugagccugauugcuuucauaugguguguugucaagggccauuugaauugcagcuuauauuagugcuucauuuuuauggccaaauaacauuccauugucuggauauacugcaguuuguuuacucauugguugacggacaucuguguuguuuccacuuuggggcuguugggaauggugcugcuguaaacauucaugggcagcguccuguggggacaggugugucauuucugcugggagugcaugucuccaggaguggcaguccugggccacugcuccacacuuaaccucucaggcacaugccagauggucuucacuaggcugugccaguucacguccccaucagcagugugccaggcguucccguccuucuaacuuuguuuccauuucucuaucuuuugucuuuuuuuuuaacucauuucuguccucuguguuccgcuguguuucccgguguuuguuucucccugugcugcuuccaaucuccacuucauuugggugguggcuugauuuuuuuucuuuuacuuucucgacuucugccaggucauguuucaccuucuccucuuuccuugccguuucucuccugaguucuuacauguuuaguuaguggucuuucuucauggagcagcuucauucaacuacucgggaggcugaggcgggagaaucacuugagccccaguggucuaggccgcagugaaccguauucaugccacugcacuccagccugggugacugagcaagacccuuucucuuaguuucaccuuugccccaucaacauuuugcaguuuguauguuuugcugcucuuguucacacuuggugucuugucaccuuuuguccaucucugaacucaggcagugucuuagaguccauuaguccauugcuggagaagcagaaggucuucaggagcagcaugccuuucuuucuuaauuuuuuuuuuuuuuuuuuuggagacagagucucacccugucacccaggcuggagugcaguggcacaaucucggcucacugcaaccugugccuccgggguucaugccauucuccugccucagccucccuaguagcugguacuacaggcacccgccaccacgcccggcuaguuuuuuauauuuuuaguagagaugggauuucaccauguuggccaggcuggucucgaacuccugaccucagaugauccacccgccuuggccucccaaagugcugggauuauaggcgugagccacugcguccagccggcagcaccccuuucuuucggaguggcgcauuacuucucuauggcgggugguggguaacccugcauggaggccagccugggccuucagcaccugggcgaacaccugggguguccugggcagacgcguggggugcccugggccugcuguuugcaggagcucccuguggcagagcgggggccagaagagccuccaggcuucccaaguccagggcuccccacuccgccccaggccucugagccaggccagacccugaggcuucucaggggccacccccccagcucccagaggccccuccuguccuccagcgaggcacugacccaccacuucucacagcauccguauguguguuuugguggcuguggguuguaucugugaccuauuuucccucaaaaucaaguucagggaaaagguuuuuucguuauuuuuguuuuuuuuaauucuugggagggaaggugauaauauuguuacuuaccugagagucccccucggagacccccagaagcugguuuuaagggaagaaagaguaagaucccuuucugugucucugucucuggccccgucucuggccccauccccgugucucucuggcccugucucucugucucugugucucuguccccgucccgucucucgcugucccuggcucuguccgucuuucuuccccauuuaaggagcgccuccucuccgguccccucugaggagcgcuggauggaggacagggccucccggagaggacuccacgguggguggugggagggaaagaccagggggaggcagaggcugccggugagaggcgucugccaaguagaugaggggccgggagaagaccccguggcuggggaagcaggaguggggagggcggggccuccgggccgaggggcgcggucgcuguggucuguggaggggcuggcgaggcucccgccucugcucuugcuggagcucuugagugagcccugugacgccugcuaggugagguggcagccagugagcgcgccccaccgcccagcgccgcccagccuccgcccugacuccucugccgcuccccaaacagggcgcgguggcgugacccuggcgcuggggggcgagcgcggcccucccggucccgcaggcgcaagagagggcggagaugcggcgccugaggcggggcugcgcuuccggggcggggccggcggaggcuggagggggccgcccgggagcagaggcaggacuugcggcgcgugccccucacccuagcccggggcuguccugccucguggggagugugaaggccaugcccggcgccgcggcccuggugccccuguuccacugggacccuggggggcgccgccaggccccuuggccucuuccucggggcccucgggacccaggggccggugguggccgugccggggacucgggcgugagggguggagaucgcggccccggugcagcagcucagaaccuggacucuggaucgcugcuccccagcgcccggggugccgcuucccacaggguucagcucccaugcaggcugcgcucaccaguggaaguggguccacccggucccaggagagccagagccccguggcagucgcuguggggugugcuccgcacaggccagagagccggcccaaaaaccugagguuugcaaagccucuuucuuucuuuuuuuuuuuuugagaaaacgucucugucgcccaggcuggagagcagugacacgaccucggcucacugcaaccuccgccucccggguucaagcaauucuuguaccucagccucccgaguaacugggauuacaggcgugugccaccacgcccggcuaauuuuuguauuuuuaauagagacagcguuucaccacguuggccacgcuggucucaaacuccugaccugaggugaucugcccgucucggcaucccaaagugcugggauuacagguucagugagccauugcgcccggcccaaagccucuuucuuuucagugcugagcuggauaaagucuaccaaacugaaaggucuccaaggcuauagcuggcugucugagaaauuaugguguuuguuuagcccaucuuaggacuugggcuaucccaggugacugaguuuugcuguuucacaccucccaagguucuucucauucuuccuuuucuccauuaaugguaacuugucuucucaauugcucaggccagaaaccuccguuaccaucuuuucuuacguguuucacauccaaaccaucagcacauccggguggcucugccuucaagauagauccagaagcuagguccuuuccacugccuccaccacggccaccuggcccaggccacccuccucugccacaaggguuuuugccauugcccucccuggcuuccugugguugcagucagagaccucgucccucccacucagccuucucgagggcuucugucugcucagagucaaggucacggcccuuccgaggggugaggaucuccuuccccuggccacacuggccuccuguuccucuccagcaagaccaggccuacguacccaggaccuccgucucuggcacuuccaccuggucugcucuucuccaggguagcugcagggacccugauccccugccuggucugugcacacuucucagggaggguguccuugucccuuuuggguagguuuucacagugccccaacagcccugucucccuuucugccucaucuccuaauguacauucaguucugcaucauucacucauuucuuguguauugucugcccucgcuaggauguaugcuccguagggauguaugacuguuccgucagcuucucccuggaagaguguccagcacguugaaugaugaaagaauugaucagcuaugauagaucacaagccucguuccagaggccacacauuggauucagaagcuucuauuccuuaucuccgugaaagauugcaacgaaaaucuugauuuaaaaauucucuuauugucuaauuaggaaaguuuuauugaaguccaaauauucccauccucaccuucccacuuuucaccgggagucugaggaggaaauacugauauaaaaaauuuuuaaaucaucauuuaagaaaaacaaaaaaggaaauacugaaagaccacaggccagucuggaaaaggagcggacucucccacucuccugcuucaggucaccuauguuugcccugugcagccagcaggcagagugcucauuaccugcucuccacccucgguucucacucugggccccagggcucggccacugggccaggccacaugugcggcccuccuugguuccaagcuguucuuggacguggucuccuccacccccagagccuuugcuuuccuuucccccgaucuucuuuucccagacuuccuggaauuuauaauccaaagguuguguaauuucagaagcugcgaugguuccaagaacuccuguccccgucaguccgucuucugcuugcgcgggccuggaggagacacugggggucaguccugaucccguccccaucagucugucuucugcuuuugcgggccuggaggagacgccgggggucaguccugauccuguccccgucagcugucuucugcuugcgcgggccuggaggagacacugggggucaguccaauccuguccccaucaguccgucuucugcuugcgcgggccuggaggagacacugggcaucaguccgauccuguccccgucaguccgucuucugcuugcgcgggccuggaggagacacugggggucaguccugauccuguccccgucaguccgucuucugcuugcgcgggccuggaggagacgccgggggucaguccugaugugcaggccggucucugugcuugggcaucuuugggcuccguagaugaggcuugugcggccacagagcugcuucugucccugcugcugcuccugggugucaguguccguucugucaauugaagcacugagacuugaggguuaagcaggccugggaagcaggucuuugggauugccucuggggaucaguccuucucuuccagcgccccugauggguagcaugcaguggggcuuuccugugguccccgcacaggucucccuuagaaaaugaguaagagcagggcccgugcauccagccagggugagggucaugugagugaauccugaaaagccgcucgggagcacccaguccuugcugagcgaggcaggaagcaggggucccuuugaguucgcccagcagaacagccaacccagcggccccucccugcuguccugucacugcacccccaccucugaguuccaggccuguggugucauccuucacacuuagugggaugagagacugaaccccacaggagaccuucuaaaggggucuccuggccacuacacaggcugcugugaagccccagccccuccucagggaagcggggucuuacuucccuuuuaaaccccgccugccccugggcccucacacucuggcugcuccgagacccugcauccccuuucauuuucucccugaugcucuuugucuccuucacacacucuucacgccagggcaccgugccucccgugugagcugcuuucagccuugcuguaggacauggaggaccccugagcuauuuggggucacaaggaagcuguuaguaugugguucucauauucuuaacuguacaagaaagcaaaagccccuugaggucccucaguaucccuucccaccaccugcaccccacagguggagaaauugccugcuuuuagggagauagcaguguaggccucuuugcuugcgcccugccuggccccuguuggaucucuuuucucugcaggaacugcagaggcuucugaagcuggaucuuucacuaugacauuuacaguugcuugaccauuuucucccgcucuugacaggucccccaggauuagcuguggccaccagaagcaagcgucgauauggaacgugcauucugcuuaaagcucagcaaggcaugguuggagggaggccacugauagucucauucuuuuguccucagagccccccaagaugaacccagugguggagccacuguccuggaugcugggcaccuggcugucggacccaccuggagccgggaccuaccccacacugcagcccuuccaguaccuggaggagguucacaucucccacgugggccagcccaugcugaacuucucguaaguugucucccuccaccccacccugcuugacucaugggccgccuaggucucugaaaauaauuccagacugaucaaagacaaaggccaagcaggaagguguaaaaggaacuuguccaucuauuucagaaagguguccucuugccugaaugugcaacugagacacagagugguaaaaaugauacuuucugguucuguuauauuuuuggagauauuaagcugaccaccaaauuacaggcuuguuaauccaaacauaaaaacaaaugcauguacuuaauuuauguaucaaaauuaaucacccuggccagugcgguagcucauaccuguaaucccagcacuuuagaggcugagucaggaggauugcuugagcuuaggaauugaagaccagccugggcaacauagugagaccuugucucuacugaaaaguauuuagccagguguggugacacaugccuguagucccagcuacucgagaaacugaggugggaggauugcuugaacccagggagggccaaggcuacagugagcugugaucauaacacuguacuccagccugggugacagagugagaaccugucucaaaaaaaaaaagaaaaaaauuagucacccaauauuacugaaaauaauagugcauguuuguauuuuacacguaccccugagcuauuuggggucacaaggaagcuguuaguaugugguucucauauucuuaccguacaagaaagcaaaagccccuugaggucccucaguaucccuucccaccaccugcuccccacagguggagaaauugccugcuuuuagggagauagcaguguaggccucugaaguagaggagagccaccagggauggggagugguugaaguaucuuuauuuuuuaauuauagaaguaauacacaguuuuuuuaaaguuuaaacaaaauauaaaaagcaaacccucccuuagucuccauuacacaacuauauguuaagaaucuuauuaaaccaacuugguacuauuuguauaaugccuagcaguuucagaacggggcugggcaccuggcucucagacccccagcucugagacccuccauccccuuuuagaagaucucauuguuuuuaaaaauaucuccuaccuuuuuauauuauuauugauugaaugcaugaggucaaaguaauacaucugcacauaaaccaaaaggugagaauucuggguaauacaaaauaacccagaacccaagcagucuuuuuuaaacuauagauuauaacccacgaaaaggucagaaagucaauuuugugacuagcauucgaagaaaaaugaaccagaguggaaaauauauuucaguaaaugugaugguauguguguuuguguguguguccuagaauaugguauaaauguauuucuuugucgggguuauguuagugagcauguaccauucuagaagguguagcaccaucacuagcccaacagaaauuuaucuuggcccagcgcgguggcucgugccuguaaucccagcacuuugggaggccaaggcggguggaucacuugaguccaggaguccaagaccagccugggcaacacagugagacccuaaaaaaauuuguuuuaauaaauaaauaaguuuaucuuggccaggugcgguggcugacgccuguaaucccagcacuuugggaggucaaggcagguggaucacuagaagucaagaguucgagaccagccuggccaauguggugaaauugugucucuacuaaaaaaaaauacaaaaauacaaaaauuagccggguguguggcugggcacaguggcucacaccuguaaucccagcacuuugagaggcugaggugggcagaucaccugagguugggaguucaagaucagccugaccaacauggagaaaccuggucucuacuaaaauuacaaaauuagccgggcaugguggcgcaugccuguaaucccagcuacucgguaaggcugaggcaggagaaucgcuugaacucaggaggcggagguugcagugagccaagauagcgccauugcacuccagccugggcaacaagagagaaacucugucucaaaaaauaaauaaauaaauaaauaaauaaauuagccggguguggugggcgccuguaaucccagcuacucaggaggcugagacaggagaaucauuucaacccaggaagcggagguuucacugagcugagaccgcgacgagccugggugacagagcaaaaaaauaaauaaauaaaguuuaucucuaagaaucauagagauggauucccuauagaaacucauaagguuggugaaaugauaaaugaggcuuuuuuuuuuuugguuugguuuuuuuguuuuuauuuuuguagaaacagggucuguguugcccagcccugucucaaauuccuaggcucaagagaucuacccgacugggccccugaagugcugggauuacggccuugagucaccaugccagcgaguuaguuuuuaagccgugguuuugugcccucaguucaagaugcaggugccugucuuuuacuguugagaauuugcacuaaugaugaagggugauaagaaaccauaccauaacucagcaccuguucuguuuuuuaccguaggaauugauuagauucuuacacaagagcauagcucaaaagagaaagauuguguuagggugagguuuacugcaagggagugcugagggcugacacugugugaggccugggcuaacgggcccagggcaaggauaugcccugaggugauuaagaacagugcugucuucaggagcugagggucagcaggcaagacagacacagccaaaaugagcaaggugguggagggggcgggcaggugugcggguguggcuggaacagcccgucuucaggagcugagggucagcagguaagacagacacagccaaaaugagcaaggcgcuggagggggcgggcaggugugcggguguggcuggaacagcccgucuucaggagcugagggucagcaggcaagacagacacagccaaaaugagcaaggugguggagggggcgggcaggugugugggcguggcuggaacagcccgucuucaggaguggagggucagcagguaagacagacacagccaaaaugagcaagguggugguaggggcagacaggugugcggguguggcuggagcagccaccuggagggcacccuggacaguucuggcauccacgcagcccacgccaucuuggaggccagugccugggcuucucaacuccaacuucccguccagguucaacuccuuccacccggacacgcgcaagccgaugcacagagaguguggcuucauucgccucaagcccgacaccaacaagguggccuuugucagcgcccagaacacaggugaggcccagcuugcggggcgggagggcuggccaugggaggcugcugccugcauucgaagcaggggugcagggaugcccaugugcaacccugcugaggcaugugcugguggggaccguggggauggcccugaguguugagagugguccugggagccugcggggccgacuguguagcuguaggggccuccggcacacagguugugugcgugcagcccccugaccaugagggcccguuuacccagugccacgucugcagaaauggccaucagcugugugcauucauuaggaauugcuggaaaacagguugggcacaguggcucacgccuguaaucccagcacuuugggaggccuaggugggcagaucacuugaggucaggaguucaagaccagccuggccaacauacugaaaucccgucucuacuaaaaauacaaaaauuagcugggugugguggugcaugccuguaaucccaagccacuugggaggcugaggcaggagaaucacuugaaccugggaggcagagguugcggugagccaagaaugcgccacugcacuccagccugggcaacagagcgagauucugucucaaaaaaaaaagaaaaaaaaaaaaaccagccugcgugacucuagaucaguguuucuuccuggacguccauucccaccugcgacuucugccacuguaugugcuaggggugguucugccaggcugauugguggguggaggugggagggcuggggcccagucuggagaggguggccuuccauagagcaccugccuguucugugaggagaguuguggcuuucccuccguauccacagggugaaguggggaggaggagaaauaucguugcuuccacagcugcagaguuggggccuccuguggagucccggcuugcaggcaaggagagucaaggcugccucucugcaagccgagcagcugcugggugagcugacugcccuucccuugcaggcgugguggaaguggaggagggcgaggugaacgggcaggagcugugcaucgcaucccacuccaucgccaggaucuccuucgccaaggagccccacguagagcaggugagcccagcccugcucccagcacgcuccugucuucuguuugcagcggucuguggagucagccucuuccucuuccgugagguagugcgugucuugccacugugucucacaggccugucuucacugucuccuucuuuucccuucucggaccauccaggguggauguucccuaaauucauugcccccuccucggcuggucaguggugugguuuuuuugagguuuguuguuugucacaaacauccuuuugcauuuggguuguccacguuuacagauauauccauaucuauugauaaauuuuucccaguuaaauugcuggaucaaaggacagguacauuuuaaauuugauacacacuguuagauuguauuucuucaugauuauccucccacuaucucuugcaugagggcagcugguucccuacuccuuaacaacaugguguauuuucagaauuucgguccuuucaaaucugagaaauaaaagaugaaaucucacucauguuuugaaucuaacuuagaagcaggagggcucauuccccaugcucacuggcuguuuacgcuucuuauucugugcacuugauauuuaaagucuuugccuguuuuucuguggauuguucuuuuuugaggcggaguuucgcucuguugcccaggcuggaaugcaaaggugggaucucggcucaucgcaaccaccgccucucagguucaagcgauucuccugccucggccuccuggguagcugggauuacaggcaugcgccaccacgccuggcuaauuuuguauuauuaguagagacaggguuucuccauguuggucaggcuggucuugaauuccugacuucaggugauccacccgccucagccucccaaagugcugggauuacagguaugaacaaccgugcccggccagauuguccuuuuuuuuuuuuaaagauuuguaggagcuuucuguaugccauggguuaaucuguugucugcuuuauuugugacacauacuucccuagucuguggccugguccaugaugggcugugccccacaggugcucagcuuuccuguuguugccucugggcuguuuccuuuacaaugucuggauuuggguucuugcuaaggaaguuguuguccacuccaaaaugauaaaaauauucucucauuuucuuucuuuuuuuuuuuuuuuuugagacggagucucacucugucacccaggcuggagugcaguggagcaaucucggcucacugcauguucugccuccuggguucacgccauucuccugccucagccucccgaguagcugggacuacaggugcccgccaccacacccagaucauuuuuuuguguuuuuaguagagacgggguuucgcuguguuagccaggauggucucgaucuccugaccuugugauccaccugccucggccucccaaagugcuaggauuacaggcgugagccaccgcgcccagccuguucuuucauuucuuguauucuuacagcuuuccuuuuuacauuaccaccuagaccuuuaaucucucucacauuuguuuuuugagugacgcagcguauaauucuaacucuuccagaugagugacccaguagucccaacaccauucaucgaauuccauccugacuccacagauuuggaaugucauacauacauuaaagcacauccacauaaauauaggggucuguuucuuuuuuucuuuuuuccuuuuuuugagaaggagucuugcucuguugcccaggcuggagugcaguggcacaaucucagcucacuguagccuccaccucucggguucaggugauucuccugccucagccucccgaguagcugggauuacaggcaugugccaccaugcccagcuaauuuuuguauuuuuaguagccauguugaccaggcuggucacaaacuccugaccucaagugauccgccugccucagccucccaagugcugggauuacaggcaugagccacugugcccagccucguuugucuuucuucgucugcuuguccacuuccuuaccaguaacacauuuuuagcucucacagcuguauauuacauguuaaugucuaagggaacguuucccacauuuuuucuccaaauuuucuuacucauucuuaagcauuuccucuucuagaugaacuuuugaauaaacaucucaaggcuuauaaaauguacaucaagacugcauugaauacaugaaugaauuuggguagaauugacauauuuucauggguagcaauaugcagcgugacaguguauuacggugacuuuaggucauguuuuguguauuuuaguauauagaaaagcuuuauuucuuuauaguuuuaauuauacaggucuuguacauuucauguuaggguaaacucaaguguuuuaucauuuuuguugcuuguaaauagauuuuuucccauuuaaucuucagauugauuauugauaauuguguggacacuucugauuucucuguguugaacugggccacugguguaacuuucagacagccaggaucuuaggcacagcauggauagaacaacaggcgugaauguuuguugcaugcuugucccugacucuaguggaaauaguucugugugucaccaccuguaagaugcucacuguagauuacuuacugguagauaagaagguagcuuuuuuuuuuuuuugagacagagucucaaucuguugcccaggcuggaaugcaguggcacgaucucagcucacugcaaccuccgccuccugaguucaagcgauucucaugccucagccucccaaguagcugggguuacaggcaugcaccaccacacccagcuaauuuuuguauuuuuaguacagaugggguuucaccauguuggccaggcuggucuugaauuccugaucucaagugacccacccggcucagcuuccuaaaguguugggauugggcaugagccacugcgcccagccggauagccuuuuuuuuaguuguaaaauuuuucuacuuuuuuuuuuuuccagugcaggugcguaucuugguaaaggcagucuuuuucagguuaagaagauucaguuucuaguaugccaagaauuguauucagaaaugaauuuugaauuucaucaaaugcuuuuauaaccuguuggggaugaaucuguuuuucccccuugucuuccucuugaagcuguuaaugcaguccucacugcaggaggugaguggccagcaggugagugggcaugaccuccugagcuccaccuccuguccaucagguggcagcauuagauucucauaggagcacgaacccugcugugaauugugcauaugagggaucuagguuuugcuucuaaugagaaucuaaugccuaaugaucuaagauggaacaguuucaucccaaaaccacccccacccccacagcuguggaaaaauugucuuccaugaaaccaguuccuggggccaaaaaguuuggggacugcuguaauaaauuauauuaauagcucaucaguguuggaucaugguuguuuuugggggauaacccugaguugucaugauauguuguuuuuagacaucauuguccauuuugguauuggaguuauucacaggcuagcugggagcuucuuagcuuuugcaaauguucucuggcaaaggguggccccgugggaguuggucggccucucugggaagguaucugguaaccagaccuaagcugugcuuuuacuuuguuccgugacugcuugucucuccacguucuuacuuggcuccaucugcaaauucauguucuccugcaaaaguguccguuucaugagauuuucagaauuuuuggaagaaguaauagauacuguuuucucuugaugugcuguucuaugucacuucucuuuuacugauguuuuguguguguuuucucuuuuucuugaucauacuugucagagguuaucuauuuuaucaggguuuuuuguuuuuuuuuuuuuguuugcauguuuauuuuugcuaaauaacuagauuuggguuuuauuaauuuaacaaaaaguggcucuuuuucugcaaauagagggaggagacagagacgauggaguugcgaagccugggcauggcgcuuaggggaaggcucugugccaugcagccccugcacccugggggcuuuggggaccucuaccgagcgacuuaauggacagaagcuggaagcacaaccugaggggcugggccuccccauuggguugacaucagcaggacugaggaagccaggaagcacacacagaaggcagggaccuugaggcuagaaggagagcaggaggcaagaagagcugggucuuggagggccaguccuacuaggcuugugcgggggugaaaggagcugucccuguuauuacaguguugggggaauuuccugggacuuuguuuguagccaaauacaaagucaguguuuaucaucuuuccaauauguauugggggaaaugugucuuccuuguuagguucagaguucuguagcuuuaugugcugcauaaagaaguuuuccagcugggcgcaguggcucacaccucuaaucccagcacuuugggaggcugaggcagguggauuaccugaggucaggaguucgagaucagucuggccaacauggugaaacccugucuuuacuaaaaauacaaaaauuagccaggcgugauggcgggcgcuuguaaucccagcuacuugggagccugaagcaggagaaucgcuugaaacugguaggcagcggagguugcagugagccgagaucgcgccacugcacuccagccugggcgacaagagcgaaauuccaucuuggggaaaaaagaaguuuccuucagugacggacugacagaccccacuuaugauggucaggccauaagauuguaauggagcugaaaaauuucucacuucaugagugaaagaagccaucuaauguagcacaauuacuuuuuaaaaauaaaaauauguuuauaaauuuaaugcagccuaacuguacuguauuuauaaagucuaugguaguguacagucauguccuagaccuucacauucacccaucacucacucacugacucacccagagcaacugccagucccgccagcuccacucauggugccugccccagacagguggacuuuuuguuguuguuguuguuuuugagacggagucucgcuuuguggcccaggcuggagugcaguggugcagucucggcucacugcaagcucugucuccuggguucacuccauucuccugccucagccuccugaguagcugggacuacaggugcgcgccaccacgccaggcuaauuucuuauauuuuuaguagaguugggguuucaccguguuagccaggauggucuccaucuccugaccucgugaucugcgcaccucugccucccgaagugcugggauuacaggcgugagccacugcgcccggccuuuuuuuuuuuuuuuuggagacagagucucacucuugucgcccaggcuggcaugcaguggcaugaucucggcucacugcaaccucugccucccagguucaagugguucuccuuccucagccuccuaaguagcugggauuacaggcuuaugccaccaugccuaccuaaauuuuauauuuuuaguagagacgggguuucaccauguuggccaggcuguucucaaacuccugaugucaggugauccacccuccucagccucccagaaugcugggauuacaggcgugagccacuaugccccgccccaaguugcuuuuaauuuuauguuuguuuguuuguuuguuuugguucuggauuggaucuuauaggccaccuuuagaugucuggggucccuuggaccacccccagccagguucacugggaggccucauaggacguggcaggagcugacuuauuacagcggaaggacauggagcacggucagcacagggcagggcacggggcagagucuggaggaaacaggugugagcuuccagcauccuuuccacgugcagcccacgggacgcgcuccauugcccagcaucgcauuguagcgacaggagugaaaugucccaacuagggaagcccuucagaaccucagugcccagggucguuccggggcuggucuuacagcagccucugccugguucuugcucccagugucugggcacagcugaggcccagauucucaugucacccucugcugguagagggaggcacaguugccucgguacggggagcuggugguggaagcuggggagugacugcugcugccuuguuuguguccauguuuguuugccauauaccugucacucagcaugucucauguauuucuucuucuuuuuuuuuuuugagacagaguuucgcucuuguugcccaggcuggagugcaguggcgccaucucagcucaucgcaaccucugccuccuggguucaagcgauucuccugccucagccucccgaguagcugggauuacaggcacgugccaucaugcugggcuaauuuaauauuuuuauuaaagaugggguuucuccaugguggucaggcuggucuugaacuccugaccuuaggugauccgcccagcucagccucccaaugugccaggauuacagaugugagccacugcacccggcugucucauguauuuuuaacagcucuuuaaagauauaaugcagggcugagugcgguggcucacgccuguaaucccagcucuguaggaggccaaggugggcauaucgccugaggucaggaauucgagaccagccuggacaacauggugaaaccccaucucuacuaagaauacaaaaaaauuagccaggcguggugacaggcaccuguaaucccagcuacugaggaggcugaggcaggagaaucgcuugaaccugggaggcagagguugcaaugagcugagauggcgccacugcacuccagccuggcgaccgagcgagacucuguuaucagaaaagaaaaaaaaagaucuucacauacuauucagaucgcucacagugugcaauucugugguuuuuaguauguucacagcacuguguacccaucacuacaguuaauuucagaacauuuaucuucuguggcacaaucauaacucacugcagccucaaccccccuggacucaggugauccucccaccucagccuccucaguagcugggacugcgaaugcgcaccaccacaccuggcucauuuuuuuguuuguuuuugauuugggguuuuucuuuaagagagggucucauuccaucaccuaggcuggaauacaguagcaagaucuuggcucgcugcaacuucuggcucccaggcuugagcgauccucccaccucgcccucccaaguagcuggggccacagguaugcaccagcaugcccgguuuuuguuguuguuguuguuguuuuguuuuguuuuguuuuuuguauuuuuaguagagauggggucuugccacauugcccaggcaggucuugaacuccugaacucaagcaguauacccaccugggccucccaagaugcugggauuacaggcaugagccaccuaaugagcacggcuacuuuauuuguaguuuuuguagagacaagcuuuugccauguugcccaggcuggucucgaacuccugggcuuaagcaauccuccugccuuggccucccaaagugcuggaauuacaggcauaagccacaaccccuggccagaacauuuuuuauaccccaaaaagacaccugguacccuuuagcugucagccccaacuuccaucucccccaaccccuggcuaccacuaaucuuccuucucuguagauugccuguccugagcauuucauagaauuggggccauagacugucacuuaguguaagguuuccagaguguauccaacuuggagcaugccucaggccucacuccuuuucaugacugaauuauuccauuggugaugugcuguauuuuguuuauccauuccucauugaugggcaaguuguucguuacugaaucuuggcuguuaagaagaauacugugccucgcgugguggcucacacguguaaucccaacacuuuguggggcugaggcaggagaucacuugagcccaggaguucaagaccagccuggacaacauagcaaaaccugguuucacaaaaaauacaaaaaguagccgggcuuggggaggcaugccuguaguuccagcuacuugagagggugaggugggagaaucgcuugagccugggagccggagguugcagugagcagugauugugccacugcacuccagccugggugacagagugagacccugucucaaaauaaauacaugaaauaauacugaauugccucugaaacacauuuucaagcaaaccugcuguuuucagccuucauccacggccacugguagagacacucaggccacgccacggagcuuuugugggguguuaaggcaggcuguucgccuguccccagugcugcauucagccucggccuuccugggucggcugugucggguccccgugugcgucucauuuccagccccucacguucuguggcugugugccgccucccaucuuucuccugcggauucaugcuguggacagcauuccuucacugccauuccagucgggggcuguugcaggagacacagugcuguccucacccgggaggccucaccucagagcucugugccggcuugcugggugagcaagauuuucaucuacauuuuaccguuuuuuuuaauuuuuuacuuuuuauuuuauuauuacuuuuuuuuagacagagccuugcacugucgcccaggcuggagugcagcagugcgaucucggcucacugcagccugcaccucgugggcucaagcgauucucccacaucuuccucccaaguagcugagacuacaggcguuuaccaccacuccccgcuaauuuuuuguauuuuuaauagagaugggggacucacuuuguugcucaggcuggucucaaacucauggccucaagugaucaacccgccucagcuucccaaagugcugugguuauaggugugagccaccgugccuggccagcuuuuccuuuuaagaugcaugguauuugggauuauuguuucucuguagugugagguagcagucccauuuucccuuuuuccccguacagacgucccguggcccuuguuaggcacuguggccccgcugacugcuguuuggggcauuucccuccuuggcugucaggauugaugcugccggccauagcgucagacacggugucugcauguggaugcagaagcacccgguuuuucccccucgcucuggaggagcgggcuggaaccucucgaagagaccgaggcuuauguuggggaagugaggcuuuccuuuagcugcuccguggcaucugggggaucaggcugggaugggacgugugagugucuuuacuguuuguguggguguuggugggcauggcccagacugcaggccccacagaggguagcaaugccucaaugagcuguguacugagccugguggagccugugagcugccgagggucccuggccagcuugccccagggacagcuugucacucauguccggugacugagcagugguggcacaccccaggggagaacugaguguguuggaagaggcucgugugacucuuuuugggagggccugagggguccccaggcucccgcugaccugcacauucccugugcugugugugucugugcuuuguaacuucagggccccaugcagucuguguagcacgugccuugcagcagcccugagacgaggcagguccaggccaggccccauuuuacagugaggcucagagaggcccccagccuggcagagccuccccgcuuccugccuuauguggguggcucuggaccuagcuuugcagccugggcugccaccggugaccugcgagcuugagcaucuuuucacgucguugcugggucauccuccagcgaggugccuguucaggucuggugaccauuuccacugugccuuuucuggcugacaugucagaguucuuuauaugauuugaauaaagcucuguuagcuaaauguguugcaaauagcuuuuucggucugugauuaucuuuugaguuuuacaaauuguuuuugaagaacagagguucuggauuuuaugugguucaguuugccaaucucuuccuuuauggauucuguuuuuaaugucuuaguuaagcagucuuuccucacuaacaggucaaaauauguauucugaauuuuucuggaagcuucacaguucaaccuaaaaucuuuccuuuaggucauuaauccaccuggggcugaguuguguguauagugugaagugcuguccccucuccuuguucucagaugagggccagcuacccugcacccugcaugaagagcccggccccccuguucacccaugcaacugcccccugagccccucaguauccuucaucaggggucugcuucucacccucucucugguuccagguggucuguuugucagucccugugccaauaccacacugucuucauuaucauggcuucuacuuuuuaaaaaucaccucuauugagguauacuuuauauggaauaaaugcauacacuucaagugugcaguuugauacauuuggacaagcauauauaaucuuguaacgcugcgccagucaagacugagaacagucccagcacccuagaaaguccccgugcuccacaggcaacccccgcugcccucucaagcccccggccugguuucugccacuguagaccgagcagcucugaguguccuagugcccaugaucaucagccgagcaguucugaguguccuagugcccaucaucaucagccgagcagcucugaguguccuagugcccaucaucgucagccgggcaguucugaguguccuagugcccaucaucgucagccuggcaguucugucuguccuagugcccaucaucaucagccgagcagcucugaguguccuagugcccaucaucgucagccgggcaguucuguguguccuagugcccauuauugucagccgagcagcucugaguguccuagugcccaucaucgucagccgagcagcucuguguguccuagugcccaucaucgucagccgggcaguucuguguguccuagugcccaucaucgucagccgggcaguucuguguguccuagugcccauuaucgucagccgggcagcucugcguguccuagugcccauuaucaucagccgagcagcucugaguguccuagugccccucaucaucagccgggcaguucugaguguccuagugcccaugaucaucagccaagcaguucuguguguccuagugcccaucaucaucagccgagcagcucugaguguccuagugcccaucaucgucagccgggcagcucugcguguccuagugcccaucaucaucagccgagcagcucugaguguccuagugccccucaucaucagccgggcaguucugaguguccuagugcccaucaucagccgagcagcucuguguguccuagugcccauuaucaucagccgagcagcucugaguguccuagugcccauuaucaucagccgagcagcucugcguguccuagugcccauuaucaucagccgagcagcucugaguguccuagugccccucaucaucagccgggcaguucugaguguccuagugcccaucaucaucagccgggcagcucugaguguccuagugccccucaucaucagccgggcagcucugaguguccuagugcccauuaucaucagccgagcagcucugaguguccuagugcccauuaucaucagccgagcagcucuguguguccuagugcccauuaucaucagccgggcagcugaguguccuagugcccauuaucaucagccgagcagcucugaguguccuagugcccaucaucgucagccgagcagcucugcguguccuagugcccaucaucgucagccgagcagcucugcguguccuagugcccgucaucgucagccgagcagcucugaguguccuagugcccaucaucgucagccgagcagcucugaguguccuagugcccaucauuaucaucaguggagucacagcacacaacucauuuguuuccggucuccuuuccucacugaaacgcucucaagauucagcaguucugcugcaugugccacgucugcuuguugcuguguggugguccaccagugagcuugucaguuuuguuuauccuuucuguugauggauguuuauuuuauuuguuuccaguuccgggcuauuaggaauaaagcuguaagcauguguagaccuaacuuuguguggacacauguuuuuuuuccucuugggugcauaccugggauuggaacugcuggguucugugguaagcaccaaucucuuccagaguggcugucccccuugacaccccagcaagguugucccacagccucgccaaggguuggccuuugaguuuuauccuggccacuacagggugguauuuuauugugauguuaauuugcacuucccugcugaguaacgaugcugcucaucuuuuuguuguacuuauuugccacuuguauuucuuguuuugugaaaugaacauucagauuuuuugcccauuuguuuaaguguuuguguuauuccugaguuguaagagccuguuguuuguucuggguauaaguccuuuaucagguguacuugccaacacgauauuccuauccugugccuugccuuucuguuuccuagacaguaccauuugaagaaccaaauguuguuuuuuuuggugggggugggggguuucuuuucuuuuucuuuuuuuuuuuugagacauuguuugcucucguugcccaggcuggaaugcaauggccugaucucagcucacugcaaccucuaccucccagauucaagcgauuauccucucucagccucccaaguagcucggauuacaggcucccaccaccauggccggcuaauuuuuuguauuuuuaguaaagacgggguuucaccauguuggccaggccggucucgaccugacgucaggugauccacccucguuggucucccaaagcgcugagaugacaggcgugagccaccaugcgcagucuagaaccaaauguuuuaauucuguuaccauuuuuuuucucuagucagugcuuuuuguguccugucuuaaaauuuuucaccuagcccaggcagcaaagauuuucaccugcauuuucuucaagaaguuuuauaguuuuaagauauaugcuauuuggaauugcuauuucuagaugguaugagguaguagucacguuuuuuccauuuuuccucauacagauaccucguuuccagcaccauuuguugaaaagagaacccuuaauuuauuaaaguaugcagugcuuuugucgaaaaucaacucacuuugugugugugguucuuccccaggacucucucuucugucccacucuucucuguuucggucuuuauacuguuaccaugcugucuugaucauuguagcuuuauauugaaucaggugauagaaguuacccaacuuuucuucuuuuucuuuuuuccaaaauuguuuuggcuauccuaggacccuuugcauuuccuuaugaauuucagaaucagcuugucaguuucuagaaacauuuucauuggaacuacuugaauuucuaaauuaauuugggaagaagugccaucuuaggcaaacugaguccuccaauccagugccaugguaaggugcuccauuuauuuagaucagucucauccuauauuuucuuguaguuuucaacguauugguuuugcacacauuuuguuaaauuuauuccuacauauuuugugguuugggaugcuauuauaaaugauuuuuuaauuuuccacuuauuuguugcaaguauauagaaguacaauuagcuguuguauauugaucucguaucaugugacuuuguuaaauucauucauuucuguaguuuguuucuuuauuuuucuucuuuuccuucccucccucccucccucccuuccuuccuuccuucuuuucucuccuuuuuacuuuuuucuuucaauaaaaacaagguauucuguguugcccaggcuggaguagaguggcuauucucuagugauuuuuuucuuuuuuuuugagauggaguuucucucuuguugcccaggcuggagugcaguggcgcaaucuuggcucacugcaacccccaccucgccaguucaagugauucuccugucucagccucccgaguagcugggauuaaaggcaugugccaccacacccggcuaauuuuguagugauuuuuuuuuucuuugaacaggguuauuuagagauauguuacuuauuuuccaaauaauugagaauuuuuuaaauagauucuauugcucaggauuuuucauucaauucuauaaggcccagacaacauacccucuaauauuuuagucuguuaaaaaauguuggagacuuauuuuacgccccaguauauggccuaacuucaugaauauuucauguacacuuaacgaauguagcauucaauaguuauaaaaguccccuccacaagcuggaaacccugggaugccagugucauggcucaguccaaguccaaaggcuucagaaccagggaagucaguggugucacucuugguccugggccaaaggucucagagcccugaggagagaggaggugcuggugacaucugggaguccaaaggucggggggccuggagguguccaaggacgggggaggaagaguguaucccagcuccagcaaacagauggacauauucgccuuaucuuuguuuuuauuuuaucugggcccccagccuauuagauggugcccacccucauggaggguagaucuuccucaccuggucagucaccucuggaaacaucuucucagacauacucaaaauaauccuuuaccggguuucuagguguuccuuaaucggucaccuuugaccuuugacaccuaaaauuaaccaugacacccacacccaccucuggcugcuuucaaguuucuauuuucuugccuuugauuaucagccaaaguuuugcugugauauaauuagaauuuguggcuugauauauuuuguuaggcucagaaaauuggccaugaucuuuucaaauauugcuuguguucuguugucuuuccuaucuucuucugggucucugguuacacauguguucagucuuuugcaauuuucaaugugucccuuaugcuuucauccauauuuuccauuauucucuaagcuucaauguggauauuuccuacugaucauuuuccauuuuacuaauccuuucuucaucugugucuaauuugucuauuucauuauuggggccuuaauuugaguuauuauguuuuucaguuguagaauuuauauuuuaaucuuuuugauaaauucugauuaccugcagaaauucuccauauugucuucuaauaacuccaguauugguauccccugggugagggugggggaggugucuauuuccuguuuuuucuuuugaucuuaucuccuaguaaccuaaggaguuuuucuuuuuuucuuggauucuagacaauaugugugaaaaauuguagagaugacuugaggcuuccuuugauguuauccucaccaaagagcaguucugugcuucugccuguuggucaaggauggacagcucguguucaguagaggcugagcugguuugaaaccggacuucccagccuguuucugguuaacucuuacuccugggaugggacccuucagggaccccacccaaagcuggggugcuuuuuuuuuuuuuuuuuuuuuuccucuucagauggagucucgcucuguugcucaggcuggagugcaguggcgcgaucuuggcucacugcaagcuccgccuccuggguucacgccauucuccugccucagccuccugaguagcugggacuacaggcacccgccaccacacccggcuaauuuuuuuuguauuuuuaguagagacgggguuucacccuguuagccaggauggucucgaucuccuuaccucgugauccgcccgccucggccucccaaagugcugggauuacaggcgugaaccaccgugcccaaccucagggugcuuuuuuucuuucuuuuucuuuuucuuuuuuuuuucuuuuuuuuuuuuuuuuugagaaggagucuugcucugucacccaggcugaagugcaguggcaugaucucggcucacugcaaccuccaccucuuggguucaagcaauucugcugccucaacuucccgaguagcugggacuacaugugcauaccaccaugcccggcugcgccucuccuccuagauggacacugaauuccaguguuugucccuccagcuccaugagucugagaaggccccacuuagcuucucagccucuuagcuaccacaucccucucagccuccaccccuugaaccccuugacuuccgggcagcaaaagcaucggggccaguugcuccaaauugggucucaccuccacacuuccuucucuuuggggugcugguccucgcugacuuggugguucucugacaccuuuaaagaaacuucuuaaaaccuggguuguuaucugcaggaggguuggucaguuacagaguagucagccauggccauaagcagaacuccguuucauccacuucuggugccccccaccccacaugaccccccacacaucuggggcacuagagagauagugcccaucagagaauugucuuuugacaguggucacucucacaauuugccggcaaacauucugggcauauagggcugacucauucgggacuuagcugccauaggcuuggauucuuguuggaaacagcugcuauaauuuauucugaugaauuacuguuccaaagaugguauuucugagcuuuccaagaacacacuggacaucaguucuaguuacagugaaagugggaggcaguggagaagggaagcacuggaagcucagcgcuugucugaucagguauaugauuuguagagaccaaaaaaaggugacuucucccauccaaguacuaaccaggcccgacccuccuuagcuuccgaggucagacgagaucaggugcguucagggugguauggccgucgacaaaaaaggugacuucuaaauaaacaaucccuguguuccccugguggucuucuggaggcagcugaagggcaccuggauugugacaugcccaggggcccugggcugugugucuacccuccucuggcagggccacugccuggcucacagcccgugaugaguguguggcaugcagugggcgcacaggcauugauugaaucuuuugaagauaaaacuaagcuaucuuuguuccauucuccugcucagaucacccggaaguucaggcugaauucugaaggcaaacuugagcagacggucuccauggcaaccacgacacagccaaugacucagcaucuucacgucaccuacaagaaggugaccccguaaaccuagagcuucuggagcccucgggagggccuggcuacugugccucaacgguucggcuccucaacagacagucccugcggcagaaguggguguggccgugagccucugcaggcucaagaguguuguccagauguuucuguacuggcauagaaaaaccaaauaaaaggccuuuauuuuuauggcugaggauuuugaauauua

SEQ ID NO: 191130 - RNA, 36245 nt, Homo sapiens
gcgccggcacaccuauuggcccccgcggcgucccgucgccgcgucgcguugcuggcccgucggagcgacgccgcucgggucagucggcggccggacugggaagauggacgcaggugaggaguugccgggggucggucuuuccgcaggaggugcucgccuuaucauuggccuccccugcucgggucgggcugccgcgacucgccucggggcacgccggugcgggccaggcugggccggggcggcgggcgcugcgggagcgcggggcgguguugguggguggugggcggugggagcgggagggggacggcggcgcacugcgccgcggaacccgccgucgguugcgcuggagcuucugcuuuuccggucccguccggagcgcuccggagguuguggcugcacaggcccuugcgccaggucggccguggagggcggcggagccugccgggcggggagaggcgcggcggcgaacggggcggccgcgguccgggccggggacgcgagcggcgggcgaaagcguagccuuuccgcagcugagcgugaagggauggaagcucuuuaacuuuuaugaaguuauugguagguuggaggagagaaacgugacguguucaucacaguauacguaucuuuuuuguuuuugucuucaauuuaguaaccaguagauucuccaagcugcuuuuccgugacgagaaagagaaacagugaauuuguaucaucgggucuuaguuucuugggguccuaagagagagagaaagagaaggaguguguguguguguguauagggaguguugguuuuuuuccuauccuuucaugcuuccgcuccauuuuugcuagcaagauuauuuuaagucagcgccaaacccaucgcuagcccaguagcccuagaaauauuuuuacacagaaguuuuagcucauucauucuuugugggaacugauuugccuuuuaccaaguaucccccaucuguaaagaaagauuuucaucugguuuaauucugucauucugaaugggauuguuuuuacuuuuuauuuuucugguagcuacaacauaaauuuauuaagaucugaguuggaaaacuguaauguguauugccaauaucuauuaaaaugauuuguagcagcucaccacuuaaaugugguagguggcuggaggaaacaggagcccugacucccuaaggagcauguugaccagguguauaucuugugaaguuugucuuuuagaauaaccgucauucacgguugaacuauuugcagcuguguacuauuuguuguuuacuauuuuacaacuguuguauuauaucuuuuuagguguuauuguuugugaugcaggauuuuucucagccacucuggcagccagagaccuccggcuggcgaggccccugcccaggccuugcuuggguccaggcucgccgcaggagauaccccaucuacuugguccaccggugggcaccugguuugcacuauggcacggauaccauggccaccaugacuguaugcucagccccuggcgggagugggugugugggugagugagugccgggucccgccagcuguuucaagcgcaggcaccagagugggcucugcagagcuuacagcuagacauguggcaagcaacucccacggcggacuccagcguccagacaaagggacaguggauucugguguccagacaaggggaagguaguggcgcccaagcaggggugcuuacaacccugaagcccaagaggggguguugcagagugucagcagcccuguuacucccauugcccugcuccaggcuauagcucuggggcuggcuccguccccgcugcuucccuuugcugccuccugucacguggggugucacaguggguggcugcccuuugccggcagagggcccagggccacaguguuacagccuucuuuguacuugcauucauugggucccuaguucuugucccacguccaagaagaaugagacuacacuuaacacugacaaucgaagggugaggaggguggagaauaguuuuauugagugaugaaacaccccucagcagagaggggacucaaggguggucuuccacccaaagucggguggucucccuugguguggcuggguccagggcuuuuauaggcucagaauggggagugugugcugauuugucugugaguaugcaaaaaagguuaaaacaaagucacuacucaaaggugggcacaacaguguaauaaaccaauuagagaaaaguagguauauguaaaauaggugaaggguggggauuaauuagaggaaagcgcaccaaacaggaagagagguucgcaauccagucuguggauuuauccgagacucgucgcuuggcuuucaggcuuuaaacuguggcuugaagguuggguuucacuggugacccaccccucucugccuaggauuugucugccuccugccucuaucauuucgauaccuugaggcuggaguaucauaugagagacuuggcuaaggucaaaaacacgguucagugucgaucauaugaccuaaaaugugaaaaucaucauguucaaguugggagaacaguuauguuguuacauggcgauacuuuauuuuaucuuuuauuuucccuugacaacuguguugacauggugauacuuuaauaggacacuggauguugcugcaugugggaucagaguagaaaagguguuugcauuuaaaggucucuguuuaugcugauaaaaacguauaugauguuuguaggauaucauggggaauuuuccuucugacuugaugcuguauuuccuuucagagaugauuaaugaucugcccuccuuugaucucuagaguucuugaagauucugccuuccuugaccauguguaauacaguuucuguucugauagucauuaauucaauacacuguuuguuacugacugucagauauguguuaggcauuguucuagacacuaggacuagagaaguaacaacauagaugaaaaccauugcccugggguagcuaacguucuagacaugagaccagcauuagcagcgaagugcguggcuccugggggauggugauuugggccaaggaugaggaggauuggaauuguagccaggauggccaggaagggucucacucugaagguuuaaguuuugacgaagacuuaaagcaguguaggaggaagggcagguagcaagagccugguguggcucaggugcagcggguggcggugggagaagcaggagcugaggauagaaaggugacuuaggcucaguguaguggggccuugccagcucauagugaggacucgguguuuauucugaacaggauggcagcucauagugaggacucaguguuuauucugaacaggauggcagccguuuggaagguuucauucuagaggaggagucacaugauagacuguguucaacaggcuugcucuggcaucucuuuugagaauguacugcagaggggcaagggcagaggcagcgagaccagcuaagagacuguugaacaagccagcaaggagaugccaguggauuagcucaggguggguaagagguugacuucugcauguguuuuggagguugagacaauagaauuuguuuguagauuggaaguugggagagggauggguagagagggaggaguuaaagauggccccauaguguauggccugagcuaagcaacucagauggaggggggcgggcgugguggcucacgccuguaaucccagcacuuugagaggccgaggugggcggaucacaaggucaggagaucgagaccauccuggcuaacacggugaaaccccgucgcuacuaaaaauacaaaaaauuagccgggcauaguggcgggcgccugugaucccagcuacgcaggaggcugaggcaggagaauggcgugaacccgggaggcggagcuugcagugagccaagacugcgccacugcacuccagccugggcgacagagcgagacucugucucaaaaaaaaaaaaaaaaagaaacucagauggggaagacuuggggagguccugucuggugggaagcuuucuguugcgaguuuggauuuauguguguugaaugugagguggauguuagacauccuuguagagcaguguccagugggcuuuugggucuacagguuuggagcuaaaagaauaagccugggcuggagauagacuggaggucacaucagaugaggucacccagggugugaaugugggugggaaagaaaagaggccaaaggccucugcggguguggagagguccaggagguggcaggcagaccacaguguggcuguguucuccaccagucccuagcacugucccuaaaagcaugcuccccauucagacgacuggcaggugccagcacuuaaauagccacacugcccauuccuugaggacagagcuggugucuugugcuugcauuucuagugcaucacuugugucuggcaugugguugguaauaaaaaaaaaacagaacuugaauuaauaauaaccuacacauuccccuacuaucaaagcuuucaguuuguagaguuuaacauaaauccaguauguuagcauaacauguaaugaaugcagaggcugcuggggagugguuuuuuuuuuuuucuugagauggagucuugcucuguuucccaggcuggagugcggugggcgcgaucuaggggaguggguuuuaaugugcgcaaucugcccagugugugcacugaaacaguguuuucuagcuuucugauguagcuaaauuuggaguuccuuucucucuuucucuguuuucauucaggacugaacuacuagcauucucauguaaacucuuggagauuuaaaaaaaaguaguaaucauaugcaaacuguuaucuuaaaccuaagagcuuucuaaaggaaaagaagaaccuuuguugaauuuauaaaauauaaaucuuuuggaaaauaacuucuaaguguuuuaggaagguuucuucgaaaugaagugguuuacaguaagcucuuaaauuuacucguuuuuuuuuguaguccucucugguugaaugaaguguaauugguacuaaauggagagaaguugguuaaauucauugaguacaauucccuacauuucugccugucagauuaguaguacuaagucacauguuuuuucugauggaauuacuauauuauuaaaaugccaucugcccucuucugcuugugaucgcagaagucccagggaagagggcguggaaaaucaagugucugggauccagccgaccaaaugggagaacugcuucuaagggggacucuuucuuaagguguacagcaccucuccguccuuuuuuuuuuuuuuuuuuuuuuuuuuaagacggagucucacugucgcccagacuggcuggagugcaguggcucuaucucagcucacugcagccuucgccuccuggguucaagagauucuccugccucagccucccgaguagcugggauuacaggugugcaccaccaugccuggcuaacuuuuuuauauuuuuaguagagaugggguuucaccauguuggccaggcuguucucgaacuucugaccucaagugaucugcccgccucggccucccaaagugcugggauuacaggugaaccaccacacccaaccuacuucuucaucuuguuccuccugcgugucaucuuuuuuugaggcagggucucacuucaucgcucagacuggaguaugguguugcggccucagcucauugcagccuugaccuccugggcucaagugaucuucuugccucacauuccucaguagcuaagacuacagauguccacgccuagcuauuuuuuuuuuuuuuuuuuuuuuaagagagacagggucucccuguauugcccaggcuggucucaaacuccugggcucaagugauccucccaucuuggcuucuuaaagugcugggauuacaggcaugagccacggcaccuggccuuacaugucaucuuauuucaaauuaauaucauuaccuggaagucuagagaugggucuauauauuuauuuauguauauauguacauauauauauaaacauauauauacguauauauacacauaaauauauacacauauauguauaaauauauauauacguguguguguguguguguauguauauauuuucccccccccccgucguccaggcuggagugcaguggcgugaucucggcucacugcaacgggguuuugccauguuggccaggcuggucuugaacccuugaccucaggugauccacccaccuuggccuccuaaagugcugggauuacaggugugagccacugcacccggcgaguggauauuuuuuccgaaguuugacuccuuuucuaucaggagcuacaugaauuaccuuauaaaucacaugauguggcacgggaagaugaugaaauuaugacaggggcuaugaaauaagacaagggaaccucuccauggcgaauugcugaggcagcuggugucaggccuaaguggaucucauacaucugagagucagugaaggaacaagugugguggcucacacuuguagucccagcacuuugggaggcugagguggguggaucacuggagcccaggaguuugagaccagccugcuuaacauagggaaaccccaccucuacaaaaaauacaaaaauuaggcaugacggugcaugccuguagucccagcuacucaggaggcugaggugggaggaucccuugaggccggaagggggagguugcagugagcugagaucacaccacugcacuccagcuugggugacagagccagacccuugggugacagagccagaaggaacguuugggaauggaaucaucguguuggucgaucugcagauguuagugauugugagcguuaguuuugcacccauuguggguucucaccccacuuggaaaacugguggcugugccccauuucaugggugaggagacugaggcuggaagaaguccaggccugugucuguccuguagcuaucgaccaggcucucagacuccagaaacaaaccucaguaggaaucagaaguguuggccgggcgcggucugccuguagcuaucgagcaggcugucagacuccagaaccaaaccucaguagaaaucagaagugucggccgguugcgguggcucaugccuguaaucccagcacuuucggaagcugaugugggcggaucaucugagaugaggaguucgagaccagccugaccaacaugggagaaacccaucucuacuaaaaauacaaaauuagccaggcgugguggcacacaccuguaaucccagcuacucgggaggcugaggcaggagaaucgcuugaaaccgggaggcggagguugcagugagccgagaucgugccauugcacuccagccugggugacgagcaaaacuccaucucaaaaaaaaaaaaagaaagaaauuagaaguguuaauuccaaaaaaguuaucuuccuccauuauaaaguaagaucuggaaggucagggaggucuuuguaccguucugaugccucaguccauggcuccucauugugucuuccucuucagcuggagcugcgaggguguccaggaggggugaguucugcucggagggccugccgagggcauuccuuccuguccuccagcaugagagggacaguguggggccccuagaguacagggaagaccuccucauaacugaagagaugcgagucugagagucuuuauuggcucuuuuguaggaaucgcugcaggucucuuugguccuuggagccagcccgugaggccgggggcaggcucuugcucucuaaaugcagucacucuuggaggaaaggacguuauguuggauucaguguuaguaaagagacucauguuugguugggucucuguugaccuuguacucugugcugcaccucugcuuacagaauaccucccauccaugccgguucgugacugcucacccguuucagugaucugagaaggcuggcccugaaagagugguuacugcucccgugcaguuuagagcuuuuccugcaccuugacuuguccguuucacagugaggacaccaagucacaagaaggucacuagccuguaagguugcgugacugcucaguggugggcucagacuucugacuccacagcuggcgcuccagcugucaggaacgugcuccaggugugacguguggacacuccccacuugcagcguccuccacaguaccgagaggagggugcaguguggugggagaagcaagggaucauguuuucagaguguccgccacuagcccuaggggaauguaugacucgcucccaacagagggcaggauucucggggagggccggagugcguuucucuggacggaggagcagagcagcuuggggcacggugugggagcccuccuuagggaccucaugggucacguucgccguggcugcgccacuccuguucacugccaagcaccgugauugcuccuuggauuugcuccccugggguuuccuggucuccuugaugguuuauacagugagcaaucugaggccacacaccuguaauuuucacaguuauagcuggagguguggugguguauuugaacuuaauggaacaccucuuauucccuucacucugaaguuggcuuccuugccuauaaaguuuggugauaaaccuaagaaauacaccugcugugcauuuuacugcguccgugaugaaaaucccucaacuucacagccgcucaggccucgugacccugcuuucagagggagccuuuuuccuuuucuuccuuaucuauacuucucucauuccuuuaccauuuauauuuuuaauaugggaaacuagacauccuagaaguuucucagcuuccagauucuguuacugcagacuguuacugauucaacaauaugguccuuuuccugaugacauacgccacauucuucugaaguacagauggucuccaaacuaccaugguuugacuuacaauuuuuugacuuuacgauagugugaaagcaguaugcauucuauggaaaccauacuugacguuuugaauuuugaucuuuuucugggcuagcaguaugccuccagauacucucgagaugccagauagcuccucgucagccacaucaugagaagggggaaugaccccugcucuacagggcacuguguugccagcugaguuugcccaacuguaggcuaauguaaguguucugagcacauuuaaggcaggcuaggcuaagcuaugauguuagguagauuacguguauucaaugcuuuuuuuuuuuuuuuuuuugagacagaguuucacucucccaccugggcuggaaugcaguggcgcgaucucaggucacugcagccuccgccuccuggguuuaagcaauucuccugccucagccucccgaguagcugggauuacaggcaccugccaccaugcccgaguaacuuuuuguguuuuuaauagagaugggauuucaccauguugaccaggcuggucuccaacuccugaccucaggugauccacccgccuuggccuccccaagugcugggauuacaggcaugagccccugugccuggccucagugcauuuuugaccuaaguauuuucaauuuacaauggguuuauuggacauaaucccauccuaauuaaggaacaucuguagucuacaaagagauacuugccaguguucauuuagcucugcuguacuuuaaauaaaagauauguguaucuuuaguucaaagcuggugccuuggaacggugucaaacaugagaagaauguuccaacagcaagauggaaucauugucuugcaguguugaaauuagaccggugguggccaggcgcaguggcucacgccuguaaucccagcacuuugggaggccgaggcgggaggaucaugaggucaggagauugagaccauccuggcuaacacagugaaaccccgucucuacuaaaaaaaauacaaaaaauuagccaggcgugguggcgggcgcuuguagucccagcuacucaggaggcugaggcaggagaauggcaugagccgggaggcagagcuugcagugagccgagaucgcgcuacugcacuccagccuggugggcgacagagugagacuccgucucaaaaaaaaaaaaaaaaaaaaagaaaagaaauuagaccggugguguuuucauccuuuuuccuugagaauaaguuuucuggauuuuagucuauauauugaauaaagccuacaggucaaagaauaguagggacuucugaagauucaggaguggcuuuagagagguagcagggacaucaugauguuuuucagcucuuuaaaaagauaggagugggccggaugcuguggcucacgccuguaaucccagcacuuugggaggccgagguggguggaucacuugaggucaggagaucgagaccagccuggcuaacacagugaaacccugucucuacuaaaaauacaaaaauuagccgggcaugguggcagaugucuguaaucccagcuacucgggaggaugaggcaggagaauuucuugaacccggaagguggagguugcagggagccaagaucaugccacugcacuucagccugggcaacagagugagacuccaucacaaaagaauaaaaaaaaggcauggaccuuaauucauccuaauucaguuuuuguaaucaugugcagaaacaaguaacauauauauaaaaaggcaggagagaauguaaacuuggacuuuauuuauucacagucaccaagcaguuugguugauaaugucucugaaagcauggacaagugaaauauguaagagcagagcucuugggggccaggugcaguggcucaugccuguaaucccagccuucgggaggcuaaggcagguggauugcuugagccuaggaguuugagaccagcuugacaacaugauuagaccucaucucuacaaaaaauacaagaauuagcugggugugguggcacaugccuguagucucagcugcucaggaggcugagaccggagaauugauugagccugggaguuugaggcugcaguaagcugugauuacaccacuguacuccagccugggugacaaaaugagucccggucucaaaaaaaaaaaagaaaaaaaaacaggagcagagcucuuggacaaagcccugcuguggaaagcuugcuucaucuggcugcagccgcuccacaacgcccgucaucuugcucaggaagccacagcacuacucuaggaaaggggcagagaggggccugggucucccacagcugagaauccuuuaaacagugccuguagggcccucuauuguggauuugguaguucugccugcaccgagggagaugcuugcaggugcuucugaacccuguguuugggaauuagcugcgcauacaauuaaggcuuuuggguauaguaaaauuugugugccuuugacccugugguucugaguccucgauguuaaugacagagcggacauugcagcccuucugucugccagccagcaccucauuggaaguguuucauugaaacgucacacccauaugcugaggcuguccuguuguuaucccauuuuauggaugagggaacauucacacuuagaaguuaagugaguggcccaggaaacuacaguuuaccaguacccaagcugggcuuuaaauucugacugcccccugccuccccaaggggauugugcacagcacagaaguucacacacgaugcuuuuuaguaucagcuuagguggagaucuguguuuauguagaaugcugaggaaaccacaggcauaguaugauuucacguacgaaccugugcauaaagacuucuggaaagagucauugcugggcaacgaggcuucacgugauuuguguauuuuuguagucuucagaauuuuuuaugauuagcauaugucauucuuauugaagugugggguuguuaucaaaaaguaaauuuagaugugggagaaauucauaugugauugauuuucaaaagauugcuguaaaguugcuggugaaggaugagugaucagacaccaucagagcuggagaggcagcagaugggaauuguguguucccaguucccugaagagcagcuggagagagaugccucuggugccgccccagaauacgcaaugggcaucucgccacauggguguuugggcuggugcauugcugcuggcuggcgccuucuuuucaggaacauugugggacauggguauccucagccacaguucuguggacaggaagacccugggccucucuaguuucuuucuuucuuuuuuuucuuuuucuuuucuuuuucuuuuuuuuuuuuuuuugagauggaguuucacucuugucacccaggcuggagugcaguggcacaaucucagcucacugcaaccuccaccuucuggguucaagugauucucuuggcucagucucccuaguagcugggauuacaggcgcccgccaccacgccuggcuaauuguuguacuuuuaguagagacggaguuucaccauguugaccaggcuggucucaaacuccuggccucaggugaucugcccaccucggccucccagagugcugggaucacaggcaugagccacugugccuggccuaguuucuuaauugaaguaaaacagaguaagauggcaugcagggcuaaucauuagcccagcagguaagcaccauggcucugcagccagcugccuccuuagaaagugggguguugccccauggaagugguggcaugcucuucugguagcauuguugaaaugaaaacagguucaguccuugaucacuaggcuuuuuguacccggguaccucuggggacuuggcagagaguuugaucucucaguguccagggguuaacuuucuaccugagaguagcaccccaugcuucuccagcaccugcuccuaaccaggaaauugggguagaccagaaccccagucuucccagcagcucaguguuucuugccccggagcaucugccuucaucacagugacucugaacacgcugccauggugacaucugguaaaccuuaggauggccauggaaaacgacucuuugcccuguuucuucuuggcuucccuugcguacaaggaugaaggaggugguuuaacuuuauuuuuguccuuuacuuuuuaagucuaaaguaagugcuugaaucggguggguuuucauuuuuuugcuuucucaccccucagguuggccccuaacuuggccucucacccucgugucagcuguuagacacugacucaguggcucagaauaugaaaggcucaggaaguagcaugcuggccccaccucccuguccccauaccuuagcagagcagcugcccagcagggccuccuucucuuuccuaagaguuuacuccauccauggugggugucuugguaggcccgagauacgagagggagugcugcuguuacaagaauuuacaguuguucucuucagcacagaaaugcuguaaauggccucuuucgauacuaguuuaugaaauuauaagugucugaugauugugcaucuuugguuucaacagcuacucugaccuacgacacucuccgguuugcugaguuugaagauuuuccugagaccucagagcccguuuggauacuggguagaaaauacagcauuuucacagguaucggccaugcuggagcccacccuggucugaccgcuuggccugcagaagcauuuugugaucacuguucucugcuaacucugccauaacuugugacuugcaaacuuaaggcguuguguguguguguuuuuuuucuuuuaaacaaccucuagaaaaggacgagaucuugucugauguggcaucuagacuuugguuuacauacaggaaaaacuuuccagccauugguaaguacucuguuuuauuacaacgcgggacaaaauauguuuuuaggaaggaggaaaacuuacgcuuguagauuugacuucaauaugccacugacuucauuugaaucuucacagcaauccugcuuaacugaauuggccgaggccucacguguaguaguggcaaagcuagaauccacggcgccugacucuaggcuaguguguuuucaacugcaaaucccagcuuauuacuggagcuggaaaucaguaucaugaguuaugaccaacguuguuuuaaauguaggacagaaugucauagaaagcgguguguguccgccacgggcacgcagcauggcgcuucagggaucuucguuuucguuugcauguuugaguguguguucugggucacagcuguacaauguguuucuuacuuagguccagaauguuuggaagccauucucuguagcccucaucuuuuuuaguauuuuccacacuuaaccuguggggagauuugaagggccaggugaaugugacauguuuuuauguaacacuaaggugcauucuguuaaaagccauucaucauuguuguauacccuggagcuggaaggagauggggacugguucucagccuugccucucaccggcggagaacugaggccggaggugagggccgggcuggcgucaugcuuccucagugccaggucaggguuuggucccucuucuaggggugguuucauucuuuauccugaagugagguggaagucaaauagccacaacggcuggacauuggagaacacugacgcguagggacauacgacagugucuccuuagguugauauuuaaugauacaccuugugagauguacccugggaauauugauauguaaugauauauuuuaaugacauaccuugucagaugugcccugggaauaguugcucauuccacaguuuccgcuuguuucgcagcugcgcugaaccugcucucuuggccgccuuggaugcagguuuguccccagccuccaucuccuucacagcuacccugccgcgugcugggaaggagaacaggacuggagcgaagccuuucugguuuggcagaggccuuguggaggagguagaggcuggggaugagccugcacaugaagcagcccugucgcaguucugaagggcagugugcuguguuuccuucuuagccccacggagauaauuuuuuaaaauuauuacuuucauuuuuuuaauagaugggguuucgcuauguugcccaggcuggacuugaacuccugggcucaagcaguucucccuccucagccuccugagugucugggacuacaggugcacaccaccacgccuggcucugagauacguuuuuaucagcaguagagcgaucagcaguggagcgagggugaccaugggcacugcugauuggguuguuggugggugacggccaccacuaccccaagacacaggguuuauuguccgugccagugcauggagaagcugccggaagcccagaggugggcacagggcgaaccuuguggucugaccccugaaucucugcuucucacccuggugugcagccaccuagcagccucuugucugcugcacagguggcccucucuguugucacagcugugcaguggccuuccacuggaccccugcuaugggcuggcaguguuucccacgugccugucacaugccgcgcaguuccauggugcauguuguccaucuuucugggccccagggaguggccgugagggcagggcccaggcaccugugcuggaagggcugaguugcugcccuugcggcccuuccugugcucucagcagcacuggaugucaucaagcguuugaauuucugccuuucugauaauuggaaaaugcguuguuuuguuuaacuuugcauuuucuggaugacuuacgggggucagugucuucauauguuugucagacauuccuuuugcuccgugacugacuuguucauguguuuugcccauuuugaggagguugucgggacauuucacucuccaguaaauguggcccuuggcguuacugaguccuaagagguguguguugccccagguggagcugauggaggagggagucggugccuguggugugggacugaccggcugccuccugccagugggcuuguggccuguggggccaucuggccaugagcacuucucucucugucugccacgacaggggggacaggccccaccucggacacaggcuggggcugcaugcugcgguguggacagaugaucuuugcccaagcccuggugugccggcaccuaggccgaggugagucacagcccuggggagggcgcauggccacgguguucucaggaagcaaaggggacuguggggucagggcucuuuagagcagaccacagguaaaacaguaaguagaacuuggggguuucuugaguaaugagccacuuguuuuucuugauuuaaaaaacugacuuuaaagaaugcuaauaaauccgcaugggcaacauggcgagaccccgucucacaaaaaauacaaaaauuagccaggcgugguggcuccugccuguagucccagcuacuucggagacugauguggagaauugcuagaacccaggagauggaggcugcagugagcugagaucgcaccacugcgcuccagccucugcaacagaguuagacccuaucugaaaaaaaaaaaaaaaaaaaaagaagaagaagaaugcuaauaaauguuuuaaauuacugaaacuguuuucuguacagauuuguuuugauaacuuggcguauauguauuugaaauccuggagaacauggguuuuuacuuuuaaaagauucugggcugggugugguggcucacgccuguaaucccagcacuuugggaugccgaggcgggugggucacgaggucaggagaucaagaccauccuggccagcauggugaaaccccaucucuacuaaaaacacaaaaauuagcuaggcuuggugacaugugccuguagucccagcuacucgggaggcugaagcaggagaaucgcuugaacccgggagguggagguugcagugagccgagaucacgccauugcacuccauccugggugagagagcgagacucuguuuaaaaaaaaaaaaaaaaaaaaaaagauucugaaaaagguuuggaugccaucuguaucuuuagugugaaagugaaaacuuguuucucauauuuaugguagagcugaccuguaauuuuuuuuccaauagauuggagguggacacaaaggaagaggcagccagacagcuacuucagcguccucaacgcauucaucgacaggaaggacaguuacuacuccauucaccagauaggugggaggcugcagaaugugccaggccccacccgggcugucuggagaggguggaguggucgguuuccccucagagcuuuucuggugucgugggauguggagcaggaggcuguaaaccuguaaacacugaccucugaccaucugugcgcugcugucacaucacccccgugucaucccacaucacccccgucccacccaggcccagacccugggccuugcccuuccugcuguccaugcggcuugcagugccuggugcucggcacagucuggggaaauuggccucgccccaucagugaaucugaaugcucagauugaaguggagugaguaaagaagaguuggccuuucuugcaagcaaggccggcuuuugagcacuguguuuucacuuauagaaggaaguggucccuucauuuccccuccuuuucuaaguucauagugaaggacagucccugagaccuuguuugcccccucaugccucccccgaucuuguuggggcauccuuccgucuggaggcugggucgggugcuguccaggccuuccugugacgugucuccuggcaccacgugccaccagaggucagggcugggggcggguguguguugcuaauguguaucuguucccugcagcgcaaaugggaguuggcgaaggcaaguccauaggccagugguacgggcccaacacugucgcccagguccugaaguauguacugcgcuuccacugcugagcauggggcagcagggauguucccuggggguuaaauucuccuugagucuucauggcuacaggaaauaaggggucucuaauuauuuacuucauggcccucagaagguuucucagcgaugacuguguugaggucuugugaauaggaauuuauguuuucuaacaaaaugaacaccguaguccacauccuggcuggcacauuggacccuuguucuuugcugcauggauccaccuguaaugguggcuucugauggggugggcagcugaagcuagucugcagccaucugugcgggugccgggcccuuccaccucugcaggcuuguuggaggcugcccuccgcgggccuugccaccugccuuucucacucuacccggagacucccuguagccucgcucaccuucccauacaccucagcgucugaaagugugcucugcaccugcuccgcaccgcuuccuuucgcaccucacucagccccauugcgugcccgccccccagauuccucugagaugaccuucccugcaguuccagaaacuugccugugguuucagcuucguguccacucuucacuccucuugacccauccagggucauuuggucugauuccauguguccuggcaucccagcauuuuuggggaggcucuggccagaucccccaggacuuguccccucagggucuccuccccacuggucugagggccagcgucuccccagccugucuucagccacggcccccuugaagccucuccuucugcaucugccuguucuguaucccacucaaggcccucaggcaucccacguuccacauuccugaaauggcccugucuccccucacccacagccugcuccucagcauggcagucacugucuccacccagcuuuucugucagguucccugggguccugcacaaguccgucucugccacaucccacgucacccgcgucccacgucacccccgucccacauccccagccugcugcucccucugucuccagggcccgcccuguguuuggcguggcaccugcucagucccuacugcaugcccuucagaguccucuguccagcagcuccccagcccccaccacacccuuccacucacacuucucuugcugcugccuggaguggccccaccaagucagcgcuguuucucuggaagcaccaggccacucgccaugcucgcuguuucuccugguccccugccugcuccccaccagcccccgccccuguugcuggaugauccuccccaaccugcaagugcuguggcacucaggcacauggacggcuuccagggcugauuugucccuggacuccaagcucagguccagcugcuuauucugcauuuccaccuggguaucugugugcauggugaccugacagccagagcccgugcuggccccagccugcuucuccuacagugguccuucaggugcucaaaccaaaaucugggauuguucuagaccccucuuuuugagacggagucucgcucugucgccaggcuggaguguaguggcaugaucucugcucagaaucccaagugauucuccugccucagccucccgaagugcugggauuacaggcgugagccaccgugccuggccaggacuccucucuuuuuucuuuuuuuuugagacagucuagcucaguagccugggcuggagugcaguggugcaaucuugggcucacugcuuccuccaccuccugggucccgguucaagcaguucuccugccucagccuccccaguaccuggaauuacaggcacccgccaccaugcccagcuaauuuuuucaauuuuuaguagagaugggguuucaccauguuggccaggcuggucuugaacuccugaccucgugauccaccugccuucgccucccagagugcugggauuacaggcgugagccaccgcgccuggccaggacuccucucuuucuuuuuuuuuuuuuuauuuuuuuuccgagacagagucuagcucuguaguccaggcuggagugcaguggugcaaucuugggcucacugcuaccuccgccucccgggucccaguucaagcaauucuccugccuuagccucuucaguagcugggauuauaggcacaugccaccaugcccaacuaauuuuuguauuuuuaguggagacaagguuucaccauguuagccaggcuggucuugaacuccugaccucgugauccaccugccucauccucccaaagugcugggauuacaggcaugagccaccgcuccuggccaauuccucuuuauuucagugggcccauucaaaauaucaauuccucuuucuuucagugggcccauucaaaauauguccagacucugaccaguguucauccuuucacucccugugcuggucccagccccaucuucuucuuucuuguugaucuuccuucucucuuugucauccuagagucucuuuagcaaauaacagcagagccaucugcauaaaacauauuggccacugcucugccuugaaccgcccuggcucuucacugcugacucaggcggggcucuacccgaccucccuggcaugacacguugugcuccugggacacaccagccucagggccuuugcauguguggugccuggcacuuggacccuguucccccgacaccugccuggguugcgccccaugucugcccagguacccuuuggcaccaaggucuucccuguggcuacguuaguagugccacuccccguuccugcguuacuguucucugcaguguugaccaccggcccacguggcugcugcuuccuuguuugcccuccgccaggucagcuuugccagugcugcugugucccuugugugugggugcgucuucggcacugcaucugggcuagaggugggaggaggaagguggugugggaguggggcggggaagcaggcuguccucccaucuucagcacugcagcugggcuggagaugggaggaggaaggugguggggcaggggggcaguggggggcaggcuguccucccaguguccccccugggcuugugcauugggaggggcucuguguggucaccccaguccccugcuccacccccacccagcuccccuccacaggucuugcauucuguccccgggagcaccaggucuuugcugccucagggccuuuucuauuguuuuaccuuuuguugagguccucugaccccaccuccgccagaccugagaugagaucagagucguguuagacuuuuggcugcagaaucugcccuucccucagaaggggaaauccaaggccaugguuccuccucacuggcgugcacagucgugcuucccacuaagcugcagauuucucuauaaggacucagauuccuugguugucagcucagcguguuugguggaggggagagcagagcagagcgugaaggugcugggaggccugccucaaaguuggcaaaacccacagcgucucagagcugcguucauguucuaguuccugccucugugccagugagaccagaaaaccaggccacucaaaagccucuugcgugugcucucuaugaauggaggcuggggcaagggcaggaccccugggccucaggcgagaagaagcagauuuacccucagcuuucuuccugucuguggcauuggcugugccccggauuuuaggagccuuggcccuucucauccgagaagcaccucuaacgcgaacccuccuucgcgcagcuauagcugcaaagaugaaccgucuuugaauuguacaaaagcuuauggucauucuccuacucucuguaggaagcuugcugucuucgauacguggagcuccuuggcgguccacauugcaauggacaacacuguugugauggaggaaaucaguaaguggcucagaguuuccauggacaagaaaguugaaaucacgggcaacauacacacuuccucgccugaguccccacgggagccucggcgaguguugucagucgccccaugccgugcaggugcuccguggggccugugcgccaagccagaugcacgguggccucgcucuccuaucccggcggucauaccaagagaggagagcccaggcugucuggaggccgcgacuugguaucucacgucguguuuugugucuugguuacaaaucguuuaugaaggcccugcugugcuuaggcgcccucgugugggaauucuggugaaguuauuuugcgugccuugaugugcgacagagagauguagcaaccaucucuagcugcaccaucucgagcaaaggcacgucgugaaggcagagcucuuuucagcuuucuggaagaaaggucugcugcaacccugaaggaaccugggcguggcaacauuuacaucuaggaggaaaacuguggcucaguuuuaacaaaugggcucauugagugaguuccaaauucauguuucaccuuccaugauguagccaagcugagaacucuuaaaaaugccucauugccuuuuucacucagggccaccuuuuucccaaggaacuucucaaaacucccucaauuccaauuuuauugaaguucuacauguaggcuauugccuugaauccaauuuuccauaagaaagagcucauuuaggccgggcgcgguggcucaugccuguaaucccagcaccuugggaggccgagguggguggaucaugaggucaggaguucaagaccagccuggccaacauggugaaaccccgucucuacuaaaaauacagaaacuagcugggcaugguggcacgcgccuauagucccagcuacucgggaggcugaggcagaagaaucgcuugaaccugggaggcggagguugcagugagccuugaucacgccacugcacuccagccuggccacagagcgagaauccgucccccgccccccaaaaaaaagaccucauucagagccacagccguaacugcgcacagauucacagugggaguggguccugcccugugacugugggugugccaggucaccacacaggugugugcugggucacagacacgccccuucccugccucuccauucuguuucuucaucgucuggccauccucgggggcauugugacacagcggagggagugaggcaggacuuuauaagggagagugaggcuggcuucugcagcauugagagcuuugccacagcaggcucuccuuccaggauucuguuccucagagacuugaacuugggaucauaaccaaaggguguuuguuucuuccaucugccuuuuuccuccauucuguuucuugaaauuuuuauaaaacauuggaaacacaggaagaguacaaagaaagagaaaaauuauugauuuuaccacucagaaauaacucauaugagcauuuugacauucuuacucucaguauuucuccugugcuuuucaaaaacuuacauaguuuccuaaguauuuucuccuggccaugagugacagcauuguaauuauuaacuggcuacacaauauacuauuauaccuuaguucccuguucacugccccauccucccucccguguuuggggaaaucacuuacccccucguuccgcacgcgugcucaggaucucaccaagucacaccucagucccuggccucggauuagggaggcuguugcugggugcaguggccaggaaggcgcaagggucagggcuuccuagaaccuccgucccucugggugcagguagcacuggugggaguguugggggcagcuugucuguguggacuccagcuccgucccuucgggagucucagggcugcccaaagcagugcugcugaaacguggcuugucagagugagaguggagucagguccuggaagagcuugaaucugcauuucccagccccuggggaugguggcucccgggaggauguggaggcugccuggucugacuggcuucgucucacugcgucagcugccugaaaggacacuguuccucacaggagcauguggaaggugccugaugcccccauuuaggaagaaaggcauccacauccagccagcaaaggcacuggcauugaugcacaaggcuuggguuucuggguuccugaguguggcgugguguugugaggaggacaucggggucguucugaaugaccccuaccaaaagccccaggagggaguaguggggggagggcaggaagcaggcugcuuuuuucagucgugcugcuaagagugcgcaagggaggacgucugaggaagaaguccgcaaagccgaagcuagagaaacagacguguccuuggcuaagcaaggacuuuucuucuaguuucucggaacugcuuguggaaggagcaguuagauaggagaagacugaugccauucagaaauuccacuaaagcuucuuccugcagcgaaagagcugccugacgguguucccacucagauuuuaggugaagccugugggguaaggggagaccuuacugccuacaguguccccauccaccaacccaucccccccgcaacucauccuucuguccacccccagucaaaggccagccaggacauccuuagcaugcucuucuuguccuuaacguugaugggcuuagaccuuucuaacgacaguagacagaaugucacugaauguagggaggaaauacagauuggaaaacgugucagucuggcagugaggacaaaugacuccaaugaaagaaaaguaaauaccagagcaagcacagucagaaacagaguggggaggagaaucacaauagcuggaacucaacucucugagaggcagugcagccaaauagaggcagcugagagcagaguauguggauuagaacuuuucgggagaguuggccacugaaggaguaggagaaaauuccccugaguuggugagaguugagucuuuagagcuaaagacccccaaauuuuuuuaucagaaguacuuaaacauacauguuccugauaauauuuccaaauugcagaaguaaagggaaacuucucuaaacauccaaauaauaguaucacuacuaagcugcuuugaagaaaggcagucucaacuggccugggcaucucaucuuugugccauaccaaaugcuacuggaaaauguuuagaauucugagaaaagaccuggcuucaugaggugagaguagguauguguacuguguaguugucauugauagagaaauauaaauuuuaaauguguucaaaauauaaagagaacacgagaaaauuucaggugguggcaggaauaggcaaaagcccguugcacccuguugacagcaggguguuugugacgugguaggucacacacucagugcugggcucuggaggcacagaagcaaccggcccagcuacgcaucagcccuugagccgauucauguguucgaucauauuccugagacaguagggucugugcagguaacaaagcaccagucagcaggaaacucaccaccgggaagccuuucuaucaaaacauaacuucaaaaucaguaaagugggccgggcaugguggcucacgccuauaaucccaacuucaaaaucaauaaagcgggccgggcgcgguggcucacgccuauaaucccaacuucaaaaccaauaaagugggccgggcgcgguggcucacgccuauaaucccaacuucaaaaucaauaaagcgggccgggcaugguggcucacgccuauaaucccaacuucaaaaccaauaaagcgggccgggcgcgguggcucacgccuauaaucccagcacuucgggaggccaagguggguagaucacaugaggucaggaguuaaagaccagccuggucaacaucguaaaaccccaugucuacuaaaaaaaaaguuagcugggcaugguggcacgcccucguaaucccagcugcucgggaagcugaggcacgagaauugcuugaaccugggaggcagaggcuacagugagcugagaucaugccacugcacuccagccugugugacacaguaagacugugucucaaaaaaccaaaacaacaaaaaauaauaaaaauauauagaaaacagaauaauuaacagauuagcuauggaaagaucaaagcuacaggggacccagauaacacaacaggcagaguuuaguagauacgugucaaacccuagauugugacagcagagugugccugggaauuucuaugaaacuaaugcggaauaaaaugaaaaaaggacaaaacccugcugccuggaaaugugaaaccucaaaaaagucaaguguagagaccguaacuauguaucugaaccugauguguacagaacucagaagaaaaccuguguaucuucaguacuaguauauggguucuuuacaaagugaaaauuaaugaaauaagcauacaacucaagaauucggaaaaagcaaaauuaacugaagaaaccaaagaauaauauuaaagacaaauacagaaauuaaugauuuaaaggaagaaauguauuaggccagguguaguggcucauguuuguaaucccagcacuuugugaggcugaggcaggaggauugcuuaaagccaggaauucaagaccagccugggcaacauagccagacgucuauuuuuuuuuuuuuuuuggaacaguucugcucugucgccaggcuggagugcagugguggcacgaucuuggcucacugcaauuuccgcugcccagguucaagugauuccccugccucagccuccugaguagcugagacuacaggugcaugccaccacgccuggcuaauuuuuuguauuuuaguggagaugggguuucaccauauuucaccauguuggccaggauggucuugaucuccugaccucaugaucugcccaccuuggccucccagagugcugggauuacaggcgugagccaccgugccuggaccucauucuauaaaauauuuuaaaaauaaauuuuaaaauuaaauuuauuagaacuaacacauacuagaacuggcucuuugaagcaauaacauauauguuuuaaaaaaaucaaaguuaaaaucccucccuuggcuaagcacuguggcucccgccuguaauccuagcacuuugggagguggaggcaggcagauugcuugaguccaggaguuugagaccagccgccuagguaacaugguaaaaccucaucucuacaaaaaaacaaaacaaaaaaacuagccggacaugggggcauguaccuguagucccaccuacucgggagucugaggugggaggaucccaugagccugggagguugaggcugcagugagacaugauugcaccacuucacuccagccugggugacacaguaagacccugucucaaaaaccaaacagaaacccaaacaacucccuuaaggcugggcgugguagcuccuacccauaaucgcaccucucagggaggcugaguuggaggauugcuugagaccaaccuggacaacucccucucuauaagaaauagaaaaaugaggccaggcacauggcucaugucuguaaucucagcacuucgggaggcugaggugagcagaucacuugaggucaggaguucgagaccagcccggccaauguggcaaaaccccgucucuacuaaaaauacaaaaauuagcugggcguggugacacacaccuguaaucccagcuacuggggaggcugaggcaggagaauugcuugagcccagaaggcggagguugcagugaaccgagauuaugccacugcacuccagccuggacaacagagaaucggcuucaaaaaagaaaagucagggggcacaguggcccacaccuguuguuccagcuacucgggaggcugaggcgggaggauugcuuaagugcagguguuugaggcugcagugagcugugguugcaccacugcacugcagccugggugacagagugagaccccgucucuaaaagaaauuuaaaaaguucugucucagaauccuuguuuuccagcugucuguuuugagaaauuugaguccuacaaaaaaguucagugagucauggccacaaacccuccaccuagauccaccaauuguguuuugacacgcuugguuuuuaugagcaagccuccuacgaaugagaguguuccugagagccacacagccucaucaccacaaaagaggugacgccacgacucaccaggguccgucuuggccccuugcuguccagggaacaacccgugccgcugauuuguguuccugguugaggguccggugcuguguguauauaguugugaugucuuucuagucuuuaauugagaagguucugccucuuuguugugguuguugcugcuuuguggcauuuuugacgaguucaggucagcugaccaucccacacgcuggauuugucugcuuccucacaguugggcuuggguugagccuguggcugagaguagccucuggguggcaguguccucugcucucccauccggggccugcagugggacacuaugucagauccccggagauggugucuuuuuuccuuuguaauuaaugaauaauccaguggugacacugagcauguccuggugagcugugugacuccugccugauaauggugguuuuucuagccuguccuuuccuuucacguuuauugguuggcguucugagaagagccgccuuuucucccaucacuuagugugcagugugcuaccugucaccugucugucaccugucagucacugucaccugucacugucacugucaccugucacuguccaucuuuuugaugcuugacgguuccaccuuuggccgguggccaccucagucugguggugucuuuugccguguucuggcguuuuucguuuauguuuugagcccucccuuauguucuggguuaagcagaugcugcaggcaccucugaacauucccugccuggcccuggaaucagccuggcuccucugaguggggagugguguugagaaaccucgaucuagacgccgggcaugcuccaugcucccggagugucuucucccaucaccgcacccuccgguugauguguccuccggaccauugacucacggguguguguaggcagaagggguggaagcgaggaaaggcguugcugaggaggcccggagggagcggguucuggcugugcuggcacuagccaggcuggcaggcugcguggguacuucugugauuuuccucucaagugcacguggcuuuuucuugcacuguuucgugugugugcuuuauuucacaauaaaacucuugaauuaaguaugcauagaaacuauuucuuuuuucucuggguggcaagauuaugaaaaaauuuucuuacgcuuuucuauauuuuccaaguuugaauuucacuguaagcaccuggcuuuguaccgcccuuuuucuguuacacagucaucauuugcuugcuuguugugggagcacuuuugcacaggucugcuugguuagugaaagcaugucucccuuucuaggaagguugugcaggaccagcguucccugugcaggcgccacugcguuuccugcagauuccgaccggcacugcaacggauucccugccggagcugaggucaccaacaggccgucgccauggagaccccugguacuucucauuccccugcgccuggggcucacggacaucaacgaggccuacguggagacgcugaagguggguccugccgugcggcgcuugcccugaguccccguccccuucucccaguucuuagucacuuucagcgcaucgucgucacguggccauuugugcagccggcucucgggggagggguaaacaacccugguuuacaccguugcccaaggggugagugggcgugaggcacguccaucaguaggcacgugcugcuuucguucugcaagugucaaggcgagugucgaggaugaaagcaugaggcgcuugcaggggguccuuggaaccaggugccacuccucggccugacggggagccccgcccccucccgggucuccacugugccccaggcaugcccaccccacucccccacagcccucuuggccugaggucccuucggaggguggguuggccugugaggaagggacgugugggcagggccuggggaugggcagggcugugugaggagcuccagccacaggcucccccaugucaugaaagcaaaagggggcggggagcgguggcucaugacuguaaucccagcacuuugggagggcaaagcgggcagaucacgaggucaggagucugagaccagccuggccaacauggugaaacccugucucuacuaaaaauauaaaaauuagccgggcaugguggugcgcgccuguagucccagcuacacaggaggcugaggcaggagaaucucuugaacccaggaggcggagcuugcagugacccgagaucaugccauugcacuccauccugggugacagagugagacuccaucucaaauaaaaaaaaaaaaaaagcaagcagaagggaaaaccauccuuucuucagguaacucaaauuuuagaccaaggagucacauuuguauggaacugaaauguggcuuccuguuaaaauuauucaguugucugaacuuggccccuccguccagccuucugcccauccuguggggucucagcugcccccacacauaggccccgucuccaucgcuucugcccugucaggucaaagcacucagcagggccaccucccgcaccccugcucacaucuccugccaggcccccucacucccggccuccccaaagcccaccucugacaugaagcuucccugagcugagccugcagauuggguuucuugugccugugggauguccuguggucuuuccuggacaguaagcucuuugguaccauguccccuccuguccccucuugugucacccaguugggccucagcaggcccuugggcccccuauggcaguggguggggggaccgucugcucccaccugggaccugugcucagucccccgccccuccacagcacugcuucaugaugccccagucccugggcgucaucggagggaagcccaacagcgcccacuacuucaucggcuacguuggugaguccaggguucccaccgugucccugugggccugggccuuuuaagggcauuccaugagcagguaccacaccccaggugaccacuugaggccacugguggaaaagcagcaugcccugggguucauuuucagccuggucgcgggcggccuccugugugccccuuucccugauggucuggugcccucggcucccuccccaccuccugcccacugcuucucagugugaugugggugcagugggucugaaaugcggccuccucugucccuuuccucugccggcucggccacccaccugcccaccugccucauccucccaggugaggagcucaucuaccuggacccccacaccacgcagccagccguggagcccacugauggcugcuucaucccggacgagagcuuccacugccagcacccgccgugccgcaugagcaucgcggagcuugacccguccaucgcugugguacguggcggccaccugagcacacaggcauuuggugcugaaugcuguuugggaaugacgaggaaaacuuucggauuuuugcguuuuuuuuuucagcauguugggauaaguacuguguucacgugguugggaaucugaaggguauaagagccggaacuguguccuugcacccucacgucccucccccaggcaccaccuccugugcagccuucauggccuucgaguggcccagagagcgugugucuggaugugagcgugugugggcgcgugcugagugugcauggaugagugugagccauggugagugugucccccucacaccuacauuuaaacacacgggcggccccuccacccaccccugcaccaccuucgucacacccacauuuaaacacgggcggccccuccacccacccacuccugcaccaccuuuuguuuuccggaggcucugacuugaccucucugggggauuuccuaagaaggagcuucccuguuuuuccauuuugauuaccuaguugugauuuuuggugugugauuuaugcagaccugccugcccucaaauauauuugauggggaaagaggccaaaaaaccccccuagaaaucaugaaugacggugacaugcucagggaagcaguuaaccgaaucgggggcucuguuguggaugcuccgccccauuuaggaggaagaaggcagaucugggccugaaaugggacggucucugagcuguggcgcagccccagagugcacaccacgcuccaugcaccuccugggcaggguggcaguaguggggaacaugggcuggagcucuguggcucacacuuuuuguuuguuuguuuguuuuugagacggagucucacucugucgcccaggcuggagugcaguggcacgaucucggcucacugcaagcuccgccucccagguucacgccauucuccugccucagccucuggauuagcugggacuacaggcacccgccaccacgccuggcuaauuuucuguauuuuuaauagagacggguuuucacuguguuagccaggauggucuugaucuccugaccucaugauccacccaccucggccucccaaagugcugggauuacaggcgugagccacugcgcgcagccuggcgcacacuucuuaccagaaccuagucacgaauuccucgucgaacuagaauuagguauguuuguuacuguaaacgcagcuugguggcuuacagugauuggcacucuaacagucaggucaggcuagagagccagccaccgcagacagaggaguggacgcgugaacguugaguugagaccaaaggggccaccuggugggauaacuguccucacccgugaggaggaggaauguccccuguccccgggggagagugcuccuacaccagcgccgaggcggcagaauggugucuucaggggaagagagugcccaguuugagcuucuccccccauuucguuucuuuuuguguuaacaucugcgcaucuggcagcguugagaauuccuagugacugucauuacaggcggcagcuuuaaggaugugauugccggugacccuuggccgguccccugucuccuggcuccucagcaggaggcucccugugucacgguguccuugggcaguucucgguggccuuugccgccaagcuuccagggagcugcugggcgaaggcugagacccagcggcccugccucacagucacagagagaagagcuccccacuuggcccuaacucauaaccugccccaaucccggaacacucggugagguuugagagaugcacaccacguaacaucucgugggcgaaucaaggcacagcaacgcaguggagccugaggggagccgggcacuggugcaggggaccaugcacagggcacccucggagcuccguuccuggccacaggagccaaggcaggcuggaauguccagcaccugcaugcugggggccucugcugcgccacuggcagugggaauggaagcccccaccucuuagccgacugcagaugggggugucguguucugcucaucgucauuucguuuuagggguuuuucuguaagacugaagaugacuucaaugauuggugccagcaagucaaaaagguuuguagccgccccacacccacagccgagcugagccacccagggagacaggcaguggggcgugcaggggucgaaggccugcguccaggucucaggcagccucacugggccguggggagcuuugucccgccuggcacagcuauguagcugagcaggguggggcguccuggauugcccaucuggcaacacaguuaacaacccuggggacggauguugcguguugacuuuagaaugggauuuccaguguccucauccgucuccuguugagauggggguggugauggggugcugagcuacgccggccgagugcguguggcccaccccccucugccgugguggucagacugugcuguguguugaucaccacacuggguucucguguagccuuuaguguggagcugccucuguuuucucaucagugagaugggaugacagguuuguccgcuggcuguggccggcuggccccuuucucuuggccgcagcaagcacuggggugaggcugcaccuaacggccaugucucacuaacagcugucucugcuuggaggugcccugcccauguuugagcugguggagcugcagccuucacaucuggccugccccgacguccugaaccugucccuaggugagagcugccaaguccagguggggucccucggagguacgaucugugcccuugcuuccccaguccuggcccccuugguuuugaccauuaaggugugugugagccugagccgugagcacuuggcagugguucgccugugagaccagguauggaguggagcguccccuccuccaagcuugcgcccagcagcccaggacccaccucgucuuccccaccagcgcugccugcccgggcgcuguggagcugggcgugcuaccauggaguccucaggggucuggagcagacagaacaugcaggcucuguggugacgcaguccugggugggggacugguucacuugggcaccacuggccauggguggcguagaccccucggaccauggccagcgugccgcaggagccggccugggcucgugcagugaagugaguggccgugagcgcguccuccucaucucugucucccugugggaaacucuacaaacaaggcaauggcaauggaaccacuccugaugaccacgagggucagacgcgggacagaggccccucaggccugagauugugccggccgcccccugcccuccucacccugcccugcuccucuucucugcucccuccccccauauucgcaggucugcacaacccccggaccuguucacacccgcauggggacagcugucugugggcugcagagcaggcacugcucagucugccccacgccaagggcccuugacucacacccagguggcccacccaagaugccugaugcgcuauguccuguuccuucuagauucuucugauguagagcgacuggaaagauucuucgacucagaagaugaagacuuugaaauccugucccuuugaaaauccuggggucggggguggcaccugugagagccuggggcuccuggugccgcugcguuucauccaucccgcccgcucgccugccgagggcugcgccccgugcugccuccccccagagggccacccgcugugcucguggacugaggcugcgcugcccgggaggccuuacugcuuggugucagacugcccagcucagagugcccgucagggccugugcauccgcacgcggagccgucuguuaggagcuuccagaguguucucucgacacugccagccccguguuagcaccugggccucagucccacuugcucccaggcgccgguucugugguugguuuggaauuaaaguccuguuugaaguugucagacacagacaugaauuucugggcgcucccugagucagagucucagaagaccugugcaggcuggcgugagaggagcggcagccacacugcggccccacgcccaaggacugggcugcucucgaggggggcgcgcccaccgcuguguccucucugcccagccuggcuuaccaagggcuaccucagugggagaugagguuggaggaacgaaggcgagguuccuccuugcuuuggggagaaaaguauucaggaagugggugugugggaaaccugaagauggcgugcacaggacacagcgugggcggccugggcagaagggcggcuggcuguccuggagcugcugcuggagccugcccucagagugucccuuuccagugcuguggcauucuguggcagcuuccccagguguggugacggggggggggcggggccuccaccugugacagccaggcuugaggguggacggcgugccucucccaggagccuuccccauguccuugccuugcugagaauugcccucccaugccgcugagguguuaggugguuuagggccaaaaggggaaaaccacuugagucuugugguguguggugggcagacaccacaggguggcaucaccugguggcauuuccagaaccucagccccgauuccagcacccaccaccgccugacccuguguaaccugcugucccgggucccagagugcacucugccccgcugcucugcugccuguccugggaaaguaucuuugccccacuaggaaauguaaacaggagggcuuggggagcgugggcacuuuucucaugagcagcuacugcggcguuggcaggacucgcugcugcugcugcugcuuguguaggucggggagccagagauccccgaggacgcgcgccggacagucggcacugaccggcccaccugguagcagaggacacccccagccccccaagcauugaagacauaguguauuuccucguauccuuucucccuuggguguaguugggguggggaagcagggaaggcuggugcgaucuccauuccuugggcuccacguccgaguucauggugcgccgcugugcugggagcugcagugguaaugugugggacaccuugaccaaaggggagcuuugucucguguguuuugaaaaaggcuuaaugaagagaauguuguucauucuuaguaguauaguuugcaauucuuaauggcaaauaauaaguuucaguagaaaacaa

SEQ ID NO: 191131 - RNA, 36245 nt, Homo sapiens
uuguuuucuacugaaacuuauuauuugccauuaagaauugcaaacuauacuacuaagaaugaacaacauucucuucauuaagccuuuuucaaaacacacgagacaaagcuccccuuuggucaaggugucccacacauuaccacugcagcucccagcacagcggcgcaccaugaacucggacguggagcccaaggaauggagaucgcaccagccuucccugcuuccccaccccaacuacacccaagggagaaaggauacgaggaaauacacuaugucuucaaugcuuggggggcuggggguguccucugcuaccaggugggccggucagugccgacuguccggcgcgcguccucggggaucucuggcuccccgaccuacacaagcagcagcagcagcagcgaguccugccaacgccgcaguagcugcucaugagaaaagugcccacgcuccccaagcccuccuguuuacauuuccuaguggggcaaagauacuuucccaggacaggcagcagagcagcggggcagagugcacucugggacccgggacagcagguuacacagggucaggcgguggugggugcuggaaucggggcugagguucuggaaaugccaccaggugaugccacccuguggugucugcccaccacacaccacaagacucaagugguuuuccccuuuuggcccuaaaccaccuaacaccucagcggcaugggagggcaauucucagcaaggcaaggacauggggaaggcuccugggagaggcacgccguccacccucaagccuggcugucacagguggaggccccgccccccccccgucaccacaccuggggaagcugccacagaaugccacagcacuggaaagggacacucugagggcaggcuccagcagcagcuccaggacagccagccgcccuucugcccaggccgcccacgcuguguccugugcacgccaucuucagguuucccacacacccacuuccugaauacuuuucuccccaaagcaaggaggaaccucgccuucguuccuccaaccucaucucccacugagguagcccuugguaagccaggcugggcagagaggacacagcggugggcgcgccccccucgagagcagcccaguccuugggcguggggccgcaguguggcugccgcuccucucacgccagccugcacaggucuucugagacucugacucagggagcgcccagaaauucaugucugugucugacaacuucaaacaggacuuuaauuccaaaccaaccacagaaccggcgccugggagcaagugggacugaggcccaggugcuaacacggggcuggcagugucgagagaacacucuggaagcuccuaacagacggcuccgcgugcggaugcacaggcccugacgggcacucugagcugggcagucugacaccaagcaguaaggccucccgggcagcgcagccucaguccacgagcacagcggguggcccucuggggggaggcagcacggggcgcagcccucggcaggcgagcgggcgggauggaugaaacgcagcggcaccaggagccccaggcucucacaggugccacccccgaccccaggauuuucaaagggacaggauuucaaagucuucaucuucugagucgaagaaucuuuccagucgcucuacaucagaagaaucuagaaggaacaggacauagcgcaucaggcaucuugggugggccaccugggugugagucaagggcccuuggcguggggcagacugagcagugccugcucugcagcccacagacagcuguccccaugcgggugugaacagguccggggguugugcagaccugcgaauauggggggagggagcagagaagaggagcagggcagggugaggagggcagggggcggccggcacaaucucaggccugaggggccucugucccgcgucugacccucguggucaucaggagugguuccauugccauugccuuguuuguagaguuucccacagggagacagagaugaggaggacgcgcucacggccacucacuucacugcacgagcccaggccggcuccugcggcacgcuggccaugguccgaggggucuacgccacccauggccaguggugcccaagugaaccagucccccacccaggacugcgucaccacagagccugcauguucugucugcuccagaccccugaggacuccaugguagcacgcccagcuccacagcgcccgggcaggcagcgcugguggggaagacgagguggguccugggcugcugggcgcaagcuuggaggaggggacgcuccacuccauaccuggucucacaggcgaaccacugccaagugcucacggcucaggcucacacacaccuuaauggucaaaaccaagggggccaggacuggggaagcaagggcacagaucguaccuccgagggaccccaccuggacuuggcagcucucaccuagggacagguucaggacgucggggcaggccagaugugaaggcugcagcuccaccagcucaaacaugggcagggcaccuccaagcagagacagcuguuagugagacauggccguuaggugcagccucaccccagugcuugcugcggccaagagaaaggggccagccggccacagccagcggacaaaccugucaucccaucucacugaugagaaaacagaggcagcuccacacuaaaggcuacacgagaacccaguguggugaucaacacacagcacagucugaccaccacggcagaggggggugggccacacgcacucggccggcguagcucagcaccccaucaccacccccaucucaacaggagacggaugaggacacuggaaaucccauucuaaagucaacacgcaacauccguccccaggguuguuaacuguguugccagaugggcaauccaggacgccccacccugcucagcuacauagcugugccaggcgggacaaagcuccccacggcccagugaggcugccugagaccuggacgcaggccuucgaccccugcacgccccacugccugucucccuggguggcucagcucggcuguggguguggggcggcuacaaaccuuuuugacuugcuggcaccaaucauugaagucaucuucagucuuacagaaaaaccccuaaaacgaaaugacgaugagcagaacacgacacccccaucugcagucggcuaagaggugggggcuuccauucccacugccaguggcgcagcagaggcccccagcaugcaggugcuggacauuccagccugccuuggcuccuguggccaggaacggagcuccgagggugcccugugcaugguccccugcaccagugcccggcuccccucaggcuccacugcguugcugugccuugauucgcccacgagauguuacguggugugcaucucucaaaccucaccgaguguuccgggauuggggcagguuaugaguuagggccaaguggggagcucuucucucugugacugugaggcagggccgcugggucucagccuucgcccagcagcucccuggaagcuuggcggcaaaggccaccgagaacugcccaaggacaccgugacacagggagccuccugcugaggagccaggagacaggggaccggccaagggucaccggcaaucacauccuuaaagcugccgccuguaaugacagucacuaggaauucucaacgcugccagaugcgcagauguuaacacaaaaagaaacgaaauggggggagaagcucaaacugggcacucucuuccccugaagacaccauucugccgccucggcgcugguguaggagcacucucccccggggacaggggacauuccuccuccucacgggugaggacaguuaucccaccagguggccccuuuggucucaacucaacguucacgcguccacuccucugucugcgguggcuggcucucuagccugaccugacuguuagagugccaaucacuguaagccaccaagcugcguuuacaguaacaaacauaccuaauucuaguucgacgaggaauucgugacuagguucugguaagaagugugcgccaggcugcgcgcaguggcucacgccuguaaucccagcacuuugggaggccgagguggguggaucaugaggucaggagaucaagaccauccuggcuaacacagugaaaacccgucucuauuaaaaauacagaaaauuagccaggcgugguggcgggugccuguagucccagcuaauccagaggcugaggcaggagaauggcgugaaccugggaggcggagcuugcagugagccgagaucgugccacugcacuccagccugggcgacagagugagacuccgucucaaaaacaaacaaacaaacaaaaagugugagccacagagcuccagcccauguuccccacuacugccacccugcccaggaggugcauggagcguggugugcacucuggggcugcgccacagcucagagaccgucccauuucaggcccagaucugccuucuuccuccuaaauggggcggagcauccacaacagagcccccgauucgguuaacugcuucccugagcaugucaccgucauucaugauuucuagggggguuuuuuggccucuuuccccaucaaauauauuugagggcaggcaggucugcauaaaucacacaccaaaaaucacaacuagguaaucaaaauggaaaaacagggaagcuccuucuuaggaaaucccccagagaggucaagucagagccuccggaaaacaaaagguggugcaggaguggguggguggaggggccgcccguguuuaaaugugggugugacgaagguggugcagggguggguggaggggccgcccguguguuuaaauguaggugugagggggacacacucaccauggcucacacucauccaugcacacucagcacgcgcccacacacgcucacauccagacacacgcucucugggccacucgaaggccaugaaggcugcacaggagguggugccugggggagggacgugagggugcaaggacacaguuccggcucuuauacccuucagauucccaaccacgugaacacaguacuuaucccaacaugcugaaaaaaaaaacgcaaaaauccgaaaguuuuccucgucauucccaaacagcauucagcaccaaaugccugugugcucagguggccgccacguaccacagcgauggacgggucaagcuccgcgaugcucaugcggcacggcgggugcuggcaguggaagcucucguccgggaugaagcagccaucagugggcuccacggcuggcugcgugguguggggguccagguagaugagcuccucaccugggaggaugaggcaggugggcagguggguggccgagccggcagaggaaagggacagaggaggccgcauuucagacccacugcacccacaucacacugagaagcagugggcaggagguggggagggagccgagggcaccagaccaucagggaaaggggcacacaggaggccgcccgcgaccaggcugaaaaugaaccccagggcaugcugcuuuuccaccaguggccucaaguggucaccuggggugugguaccugcucauggaaugcccuuaaaaggcccaggcccacagggacacggugggaacccuggacucaccaacguagccgaugaaguagugggcgcuguugggcuucccuccgaugacgcccagggacuggggcaucaugaagcagugcuguggaggggcgggggacugagcacaggucccaggugggagcagacgguccccccacccacugccauagggggcccaagggccugcugaggcccaacugggugacacaagaggggacaggaggggacaugguaccaaagagcuuacuguccaggaaagaccacaggacaucccacaggcacaagaaacccaaucugcaggcucagcucagggaagcuucaugucagaggugggcuuuggggaggccgggagugagggggccuggcaggagaugugagcaggggugcgggagguggcccugcugagugcuuugaccugacagggcagaagcgauggagacggggccuaugugugggggcagcugagaccccacaggaugggcagaaggcuggacggaggggccaaguucagacaacugaauaauuuuaacaggaagccacauuucaguuccauacaaaugugacuccuuggucuaaaauuugaguuaccugaagaaaggaugguuuucccuucugcuugcuuuuuuuuuuuuuuuauuugagauggagucucacucugucacccaggauggagugcaauggcaugaucucgggucacugcaagcuccgccuccuggguucaagagauucuccugccucagccuccuguguagcugggacuacaggcgcgcaccaccaugcccggcuaauuuuuauauuuuuaguagagacaggguuucaccauguuggccaggcuggucucagacuccugaccucgugaucugcccgcuuugcccucccaaagugcugggauuacagucaugagccaccgcuccccgcccccuuuugcuuucaugacaugggggagccuguggcuggagcuccucacacagcccugcccauccccaggcccugcccacacgucccuuccucacaggccaacccacccuccgaagggaccucaggccaagagggcugugggggaguggggugggcaugccuggggcacaguggagacccgggagggggcggggcuccccgucaggccgaggaguggcaccugguuccaaggacccccugcaagcgccucaugcuuucauccucgacacucgccuugacacuugcagaacgaaagcagcacgugccuacugauggacgugccucacgcccacucaccccuugggcaacgguguaaaccaggguuguuuaccccucccccgagagccggcugcacaaauggccacgugacgacgaugcgcugaaagugacuaagaacugggagaaggggacggggacucagggcaagcgccgcacggcaggacccaccuucagcgucuccacguaggccucguugauguccgugagccccaggcgcaggggaaugagaaguaccaggggucuccauggcgacggccuguuggugaccucagcuccggcagggaauccguugcagugccggucggaaucugcaggaaacgcaguggcgccugcacagggaacgcugguccugcacaaccuuccuagaaagggagacaugcuuucacuaaccaagcagaccugugcaaaagugcucccacaacaagcaagcaaaugaugacuguguaacagaaaaagggcgguacaaagccaggugcuuacagugaaauucaaacuuggaaaauauagaaaagcguaagaaaauuuuuucauaaucuugccacccagagaaaaaagaaauaguuucuaugcauacuuaauucaagaguuuuauugugaaauaaagcacacacacgaaacagugcaagaaaaagccacgugcacuugagaggaaaaucacagaaguacccacgcagccugccagccuggcuagugccagcacagccagaacccgcucccuccgggccuccucagcaacgccuuuccucgcuuccaccccuucugccuacacacacccgugagucaaugguccggaggacacaucaaccggagggugcggugaugggagaagacacuccgggagcauggagcaugcccggcgucuagaucgagguuucucaacaccacuccccacucagaggagccaggcugauuccagggccaggcagggaauguucagaggugccugcagcaucugcuuaacccagaacauaagggagggcucaaaacauaaacgaaaaacgccagaacacggcaaaagacaccaccagacugagguggccaccggccaaagguggaaccgucaagcaucaaaaagauggacagugacaggugacagugacagugacaggugacagugacugacaggugacagacaggugacagguagcacacugcacacuaagugaugggagaaaaggcggcucuucucagaacgccaaccaauaaacgugaaaggaaaggacaggcuagaaaaaccaccauuaucaggcaggagucacacagcucaccaggacaugcucagugucaccacuggauuauucauuaauuacaaaggaaaaaagacaccaucuccggggaucugacauagugucccacugcaggccccggaugggagagcagaggacacugccacccagaggcuacucucagccacaggcucaacccaagcccaacugugaggaagcagacaaauccagcgugugggauggucagcugaccugaacucgucaaaaaugccacaaagcagcaacaaccacaacaaagaggcagaaccuucucaauuaaagacuagaaagacaucacaacuauauacacacagcaccggacccucaaccaggaacacaaaucagcggcacggguuguucccuggacagcaaggggccaagacggacccuggugagucguggcgucaccucuuuuguggugaugaggcuguguggcucucaggaacacucucauucguaggaggcuugcucauaaaaaccaagcgugucaaaacacaauugguggaucuagguggaggguuuguggccaugacucacugaacuuuuuuguaggacucaaauuucucaaaacagacagcuggaaaacaaggauucugagacagaacuuuuuaaauuucuuuuagagacggggucucacucugucacccaggcugcagugcaguggugcaaccacagcucacugcagccucaaacaccugcacuuaagcaauccucccgccucagccucccgaguagcuggaacaacaggugugggccacugugcccccugacuuuucuuuuuugaagccgauucucuguuguccaggcuggagugcaguggcauaaucucgguucacugcaaccuccgccuucugggcucaagcaauucuccugccucagccuccccaguagcugggauuacaggugugugucaccacgcccagcuaauuuuuguauuuuuaguagagacgggguuuugccacauuggccgggcuggucucgaacuccugaccucaagugaucugcucaccucagccucccgaagugcugagauuacagacaugagccaugugccuggccucauuuuucuauuucuuauagagagggaguuguccagguuggucucaagcaauccuccaacucagccucccugagaggugcgauuauggguaggagcuaccacgcccagccuuaagggaguuguuuggguuucuguuugguuuuugagacagggucuuacugugucacccaggcuggagugaaguggugcaaucaugucucacugcagccucaaccucccaggcucaugggauccucccaccucagacucccgaguaggugggacuacagguacaugcccccauguccggcuaguuuuuuuguuuuguuuuuuuguagagaugagguuuuaccauguuaccuaggcggcuggucucaaacuccuggacucaagcaaucugccugccuccaccucccaaagugcuaggauuacaggcgggagccacagugcuuagccaagggagggauuuuaacuuugauuuuuuuaaaacauauauguuauugcuucaaagagccaguucuaguauguguuaguucuaauaaauuuaauuuuaaaauuuauuuuuaaaauauuuuauagaaugagguccaggcacgguggcucacgccuguaaucccagcacucugggaggccaaggugggcagaucaugaggucaggagaucaagaccauccuggccaacauggugaaauauggugaaaccccaucuccacuaaaauacaaaaaauuagccaggcgugguggcaugcaccuguagucucagcuacucaggaggcugaggcaggggaaucacuugaaccugggcagcggaaauugcagugagccaagaucgugccaccacugcacuccagccuggcgacagagcagaacuguuccaaaaaaaaaaaaaaaauagacgucuggcuauguugcccaggcuggucuugaauuccuggcuuuaagcaauccuccugccucagccucacaaagugcugggauuacaaacaugagccacuacaccuggccuaauacauuucuuccuuuaaaucauuaauuucuguauuugucuuuaauauuauucuuugguuucuucaguuaauuuugcuuuuuccgaauucuugaguuguaugcuuauuucauuaauuuucacuuuguaaagaacccauauacuaguacugaagauacacagguuuucuucugaguucuguacacaucagguucagauacauaguuacggucucuacacuugacuuuuuugagguuucacauuuccaggcagcaggguuuuguccuuuuuucauuuuauuccgcauuaguuucauagaaauucccaggcacacucugcugucacaaucuaggguuugacacguaucuacuaaacucugccuguuguguuaucuggguccccuguagcuuugaucuuuccauagcuaaucuguuaauuauucuguuuucuauauauuuuuauuauuuuuuguuguuuugguuuuuugagacacagucuuacugugucacacaggcuggagugcaguggcaugaucucagcucacuguagccucugccucccagguucaagcaauucucgugccucagcuucccgagcagcugggauuacgagggcgugccaccaugcccagcuaacuuuuuuuuuaguagacaugggguuuuacgauguugaccaggcuggucuuuaacuccugaccucaugugaucuacccaccuuggccucccgaagugcugggauuauaggcgugagccaccgcgcccggcccgcuuuauugguuuugaaguugggauuauaggcgugagccaccaugcccggcccgcuuuauugauuuugaaguugggauuauaggcgugagccaccgcgcccggcccacuuuauugguuuugaaguugggauuauaggcgugagccaccgcgcccggcccgcuuuauugauuuugaaguugggauuauaggcgugagccaccaugcccggcccacuuuacugauuuugaaguuauguuuugauagaaaggcuucccgguggugaguuuccugcugacuggugcuuuguuaccugcacagacccuacugucucaggaauaugaucgaacacaugaaucggcucaagggcugaugcguagcugggccgguugcuucugugccuccagagcccagcacugagugugugaccuaccacgucacaaacacccugcugucaacagggugcaacgggcuuuugccuauuccugccaccaccugaaauuuucucguguucucuuuauauuuugaacacauuuaaaauuuauauuucucuaucaaugacaacuacacaguacacauaccuacucucaccucaugaagccaggucuuuucucagaauucuaaacauuuuccaguagcauuugguauggcacaaagaugagaugcccaggccaguugagacugccuuucuucaaagcagcuuaguagugauacuauuauuuggauguuuagagaaguuucccuuuacuucugcaauuuggaaauauuaucaggaacauguauguuuaaguacuucugauaaaaaaauuugggggucuuuagcucuaaagacucaacucucaccaacucaggggaauuuucuccuacuccuucaguggccaacucucccgaaaaguucuaauccacauacucugcucucagcugccucuauuuggcugcacugccucucagagaguugaguuccagcuauugugauucuccuccccacucuguuucugacugugcuugcucugguauuuacuuuucuuucauuggagucauuuguccucacugccagacugacacguuuuccaaucuguauuuccucccuacauucagugacauucugucuacugucguuagaaaggucuaagcccaucaacguuaaggacaagaagagcaugcuaaggauguccuggcuggccuuugacuggggguggacagaaggaugaguugcgggggggauggguugguggauggggacacuguaggcaguaaggucuccccuuaccccacaggcuucaccuaaaaucugagugggaacaccgucaggcagcucuuucgcugcaggaagaagcuuuaguggaauuucugaauggcaucagucuucuccuaucuaacugcuccuuccacaagcaguuccgagaaacuagaagaaaaguccuugcuuagccaaggacacgucuguuucucuagcuucggcuuugcggacuucuuccucagacguccucccuugcgcacucuuagcagcacgacugaaaaaagcagccugcuuccugcccuccccccacuacucccuccuggggcuuuugguaggggucauucagaacgaccccgauguccuccucacaacaccacgccacacucaggaacccagaaacccaagccuugugcaucaaugccagugccuuugcuggcuggauguggaugccuuucuuccuaaaugggggcaucaggcaccuuccacaugcuccugugaggaacaguguccuuucaggcagcugacgcagugagacgaagccagucagaccaggcagccuccacauccucccgggagccaccauccccaggggcugggaaaugcagauucaagcucuuccaggaccugacuccacucucacucugacaagccacguuucagcagcacugcuuugggcagcccugagacucccgaagggacggagcuggaguccacacagacaagcugcccccaacacucccaccagugcuaccugcacccagagggacggagguucuaggaagcccugacccuugcgccuuccuggccacugcacccagcaacagccucccuaauccgaggccagggacugaggugugacuuggugagauccugagcacgcgugcggaacgaggggguaagugauuuccccaaacacgggagggaggauggggcagugaacagggaacuaagguauaauaguauauuguguagccaguuaauaauuacaaugcugucacucauggccaggagaaaauacuuaggaaacuauguaaguuuuugaaaagcacaggagaaauacugagaguaagaaugucaaaaugcucauaugaguuauuucugagugguaaaaucaauaauuuuucucuuucuuuguacucuuccuguguuuccaauguuuuauaaaaauuucaagaaacagaauggaggaaaaaggcagauggaagaaacaaacacccuuugguuaugaucccaaguucaagucucugaggaacagaauccuggaaggagagccugcuguggcaaagcucucaaugcugcagaagccagccucacucucccuuauaaaguccugccucacucccuccgcugugucacaaugcccccgaggauggccagacgaugaagaaacagaauggagaggcagggaaggggcgugucugugacccagcacacaccuguguggugaccuggcacacccacagucacagggcaggacccacucccacugugaaucugugcgcaguuacggcuguggcucugaaugaggucuuuuuuuuggggggcgggggacggauucucgcucuguggccaggcuggagugcaguggcgugaucaaggcucacugcaaccuccgccucccagguucaagcgauucuucugccucagccucccgaguagcugggacuauaggcgcgugccaccaugcccagcuaguuucuguauuuuuaguagagacgggguuucaccauguuggccaggcuggucuugaacuccugaccucaugauccacccaccucggccucccaaggugcugggauuacaggcaugagccaccgcgcccggccuaaaugagcucuuucuuauggaaaauuggauucaaggcaauagccuacauguagaacuucaauaaaauuggaauugagggaguuuugagaaguuccuugggaaaaagguggcccugagugaaaaaggcaaugaggcauuuuuaagaguucucagcuuggcuacaucauggaaggugaaacaugaauuuggaacucacucaaugagcccauuuguuaaaacugagccacaguuuuccuccuagauguaaauguugccacgcccagguuccuucaggguugcagcagaccuuucuuccagaaagcugaaaagagcucugccuucacgacgugccuuugcucgagauggugcagcuagagaugguugcuacaucucucugucgcacaucaaggcacgcaaaauaacuucaccagaauucccacacgagggcgccuaagcacagcagggccuucauaaacgauuuguaaccaagacacaaaacacgacgugagauaccaagucgcggccuccagacagccugggcucuccucucuugguaugaccgccgggauaggagagcgaggccaccgugcaucuggcuuggcgcacaggccccacggagcaccugcacggcauggggcgacugacaacacucgccgaggcucccguggggacucaggcgaggaaguguguauguugcccgugauuucaacuuucuuguccauggaaacucugagccacuuacugauuuccuccaucacaacaguguuguccauugcaauguggaccgccaaggagcuccacguaucgaagacagcaagcuuccuacagagaguaggagaaugaccauaagcuuuuguacaauucaaagacgguucaucuuugcagcuauagcugcgcgaaggaggguucgcguuagaggugcuucucggaugagaagggccaaggcuccuaaaauccggggcacagccaaugccacagacaggaagaaagcugaggguaaaucugcuucuucucgccugaggcccagggguccugcccuugccccagccuccauucauagagagcacacgcaagaggcuuuugaguggccugguuuucuggucucacuggcacagaggcaggaacuagaacaugaacgcagcucugagacgcuguggguuuugccaacuuugaggcaggccucccagcaccuucacgcucugcucugcucuccccuccaccaaacacgcugagcugacaaccaaggaaucugaguccuuauagagaaaucugcagcuuagugggaagcacgacugugcacgccagugaggaggaaccauggccuuggauuuccccuucugagggaagggcagauucugcagccaaaagucuaacacgacucugaucucaucucaggucuggcggagguggggucagaggaccucaacaaaagguaaaacaauagaaaaggcccugaggcagcaaagaccuggugcucccggggacagaaugcaagaccuguggaggggagcuggguggggguggagcaggggacuggggugaccacacagagccccucccaaugcacaagcccaggggggacacugggaggacagccugccccccacugccccccugccccaccaccuuccuccucccaucuccagcccagcugcagugcugaagaugggaggacagccugcuuccccgccccacucccacaccaccuuccuccucccaccucuagcccagaugcagugccgaagacgcacccacacacaagggacacagcagcacuggcaaagcugaccuggcggagggcaaacaaggaagcagcagccacgugggccgguggucaacacugcagagaacaguaacgcaggaacggggaguggcacuacuaacguagccacagggaagaccuuggugccaaaggguaccugggcagacauggggcgcaacccaggcaggugucgggggaacaggguccaagugccaggcaccacacaugcaaaggcccugaggcuggugugucccaggagcacaacgugucaugccagggaggucggguagagccccgccugagucagcagugaagagccagggcgguucaaggcagagcaguggccaauauguuuuaugcagauggcucugcuguuauuugcuaaagagacucuaggaugacaaagagagaaggaagaucaacaagaaagaagaagauggggcugggaccagcacagggagugaaaggaugaacacuggucagagucuggacauauuuugaaugggcccacugaaagaaagaggaauugauauuuugaaugggcccacugaaauaaagaggaauuggccaggagcgguggcucaugccuguaaucccagcacuuugggaggaugaggcagguggaucacgaggucaggaguucaagaccagccuggcuaacauggugaaaccuugucuccacuaaaaauacaaaaauuaguugggcaugguggcaugugccuauaaucccagcuacugaagaggcuaaggcaggagaauugcuugaacugggacccgggaggcggagguagcagugagcccaagauugcaccacugcacuccagccuggacuacagagcuagacucugucucggaaaaaaaauaaaaaaaaaaaaaagaaagagaggaguccuggccaggcgcgguggcucacgccuguaaucccagcacucugggaggcgaaggcagguggaucacgaggucaggaguucaagaccagccuggccaacauggugaaaccccaucucuacuaaaaauugaaaaaauuagcugggcaugguggcgggugccuguaauuccagguacuggggaggcugaggcaggagaacugcuugaaccgggacccaggagguggaggaagcagugagcccaagauugcaccacugcacuccagcccaggcuacugagcuagacugucucaaaaaaaaagaaaaaagagaggaguccuggccaggcacgguggcucacgccuguaaucccagcacuucgggaggcugaggcaggagaaucacuugggauucugagcagagaucaugccacuacacuccagccuggcgacagagcgagacuccgucucaaaaagaggggucuagaacaaucccagauuuugguuugagcaccugaaggaccacuguaggagaagcaggcuggggccagcacgggcucuggcugucaggucaccaugcacacagauacccagguggaaaugcagaauaagcagcuggaccugagcuuggaguccagggacaaaucagcccuggaagccguccaugugccugagugccacagcacuugcagguuggggaggaucauccagcaacaggggcgggggcugguggggagcaggcaggggaccaggagaaacagcgagcauggcgaguggccuggugcuuccagagaaacagcgcugacuugguggggccacuccaggcagcagcaagagaagugugaguggaaggguguggugggggcuggggagcugcuggacagaggacucugaagggcaugcaguagggacugagcaggugccacgccaaacacagggcgggcccuggagacagagggagcagcaggcuggggaugugggacgggggugacgugggacgcgggugacgugggauguggcagagacggacuugugcaggaccccagggaaccugacagaaaagcuggguggagacagugacugccaugcugaggagcaggcugugggugaggggagacagggccauuucaggaauguggaacgugggaugccugagggccuugagugggauacagaacaggcagaugcagaaggagaggcuucaagggggccguggcugaagacaggcuggggagacgcuggcccucagaccaguggggaggagacccugaggggacaaguccugggggaucuggccagagccuccccaaaaaugcugggaugccaggacacauggaaucagaccaaaugacccuggaugggucaagaggagugaagaguggacacgaagcugaaaccacaggcaaguuucuggaacugcagggaaggucaucucagaggaaucuggggggcgggcacgcaauggggcugagugaggugcgaaaggaagcggugcggagcaggugcagagcacacuuucagacgcugagguguaugggaaggugagcgaggcuacagggagucuccggguagagugagaaaggcagguggcaaggcccgcggagggcagccuccaacaagccugcagagguggaagggcccggcacccgcacagauggcugcagacuagcuucagcugcccaccccaucagaagccaccauuacagguggauccaugcagcaaagaacaaggguccaaugugccagccaggauguggacuacgguguucauuuuguuagaaaacauaaauuccuauucacaagaccucaacacagucaucgcugagaaaccuucugagggccaugaaguaaauaauuagagaccccuuauuuccuguagccaugaagacucaaggagaauuuaacccccagggaacaucccugcugccccaugcucagcaguggaagcgcaguacauacuucaggaccugggcgacaguguugggcccguaccacuggccuauggacuugccuucgccaacucccauuugcgcugcagggaacagauacacauuagcaacacacacccgcccccagcccugaccucugguggcacguggugccaggagacacgucacaggaaggccuggacagcacccgacccagccuccagacggaaggaugccccaacaagaucgggggaggcaugagggggcaaacaaggucucagggacuguccuucacuaugaacuuagaaaaggaggggaaaugaagggaccacuuccuucuauaagugaaaacacagugcucaaaagccggccuugcuugcaagaaaggccaacucuucuuuacucacuccacuucaaucugagcauucagauucacugauggggcgaggccaauuuccccagacugugccgagcaccaggcacugcaagccgcauggacagcaggaagggcaaggcccagggucugggccugggugggacgggggugaugugggaugacacgggggugaugugacagcagcgcacagauggucagaggucaguguuuacagguuuacagccuccugcuccacaucccacgacaccagaaaagcucugaggggaaaccgaccacuccacccucuccagacagcccggguggggccuggcacauucugcagccucccaccuaucuggugaauggaguaguaacuguccuuccugucgaugaaugcguugaggacgcugaaguagcugucuggcugccucuuccuuuguguccaccuccaaucuauuggaaaaaaaauuacaggucagcucuaccauaaauaugagaaacaaguuuucacuuucacacuaaagauacagauggcauccaaaccuuuuucagaaucuuuuuuuuuuuuuuuuuuuuuuuaaacagagucucgcucucucacccaggauggagugcaauggcgugaucucggcucacugcaaccuccaccucccggguucaagcgauucuccugcuucagccucccgaguagcugggacuacaggcacaugucaccaagccuagcuaauuuuuguguuuuuaguagagaugggguuucaccaugcuggccaggauggucuugaucuccugaccucgugacccacccgccucggcaucccaaagugcugggauuacaggcgugagccaccacacccagcccagaaucuuuuaaaaguaaaaacccauguucuccaggauuucaaauacauauacgccaaguuaucaaaacaaaucuguacagaaaacaguuucaguaauuuaaaacauuuauuagcauucuucuucuucuuuuuuuuuuuuuuuuuuuuucagauagggucuaacucuguugcagaggcuggagcgcaguggugcgaucucagcucacugcagccuccaucuccuggguucuagcaauucuccacaucagucuccgaaguagcugggacuacaggcaggagccaccacgccuggcuaauuuuuguauuuuuugugagacggggucucgccauguugcccaugcggauuuauuagcauucuuuaaagucaguuuuuuaaaucaagaaaaacaaguggcucauuacucaagaaacccccaaguucuacuuacuguuuuaccuguggucugcucuaaagagcccugaccccacaguccccuuugcuuccugagaacaccguggccaugcgcccuccccagggcugugacucaccucggccuaggugccggcacaccagggcuugggcaaagaucaucuguccacaccgcagcaugcagccccagccuguguccgagguggggccuguccccccugucguggcagacagagagagaagugcucauggccagauggccccacaggccacaagcccacuggcaggaggcagccggucagucccacaccacaggcaccgacucccuccuccaucagcuccaccuggggcaacacacaccucuuaggacucaguaacgccaagggccacauuuacuggagagugaaaugucccgacaaccuccucaaaaugggcaaaacacaugaacaagucagucacggagcaaaaggaaugucugacaaacauaugaagacacugacccccguaagucauccagaaaaugcaaaguuaaacaaaacaacgcauuuuccaauuaucagaaaggcagaaauucaaacgcuugaugacauccagugcugcugagagcacaggaagggccgcaagggcagcaacucagcccuuccagcacaggugccugggcccugcccucacggccacucccuggggcccagaaagauggacaacaugcaccauggaacugcgcggcaugugacaggcacgugggaaacacugccagcccauagcagggguccaguggaaggccacugcacagcugugacaacagagagggccaccugugcagcagacaagaggcugcuagguggcugcacaccagggugagaagcagagauucaggggucagaccacaagguucgcccugugcccaccucugggcuuccggcagcuucuccaugcacuggcacggacaauaaacccugugucuugggguagugguggccgucacccaccaacaacccaaucagcagugcccauggucacccucgcuccacugcugaucgcucuacugcugauaaaaacguaucucagagccaggcgugguggugugcaccuguagucccagacacucaggaggcugaggagggagaacugcuugagcccaggaguucaaguccagccugggcaacauagcgaaaccccaucuauuaaaaaaaugaaaguaauaauuuuaaaaaauuaucuccguggggcuaagaaggaaacacagcacacugcccuucagaacugcgacagggcugcuucaugugcaggcucauccccagccucuaccuccuccacaaggccucugccaaaccagaaaggcuucgcuccaguccuguucuccuucccagcacgcggcaggguagcugugaaggagauggaggcuggggacaaaccugcauccaaggcggccaagagagcagguucagcgcagcugcgaaacaagcggaaacuguggaaugagcaacuauucccagggcacaucugacaagguaugucauuaaaauauaucauuacauaucaauauucccaggguacaucucacaagguguaucauuaaauaucaaccuaaggagacacugucguaugucccuacgcgucaguguucuccaauguccagccguuguggcuauuugacuuccaccucacuucaggauaaagaaugaaaccaccccuagaagagggaccaaacccugaccuggcacugaggaagcaugacgccagcccggcccucaccuccggccucaguucuccgccggugagaggcaaggcugagaaccaguccccaucuccuuccagcuccaggguauacaacaaugaugaauggcuuuuaacagaaugcaccuuaguguuacauaaaaacaugucacauucaccuggcccuucaaaucuccccacagguuaaguguggaaaauacuaaaaaagaugagggcuacagagaauggcuuccaaacauucuggaccuaaguaagaaacacauuguacagcugugacccagaacacacacucaaacaugcaaacgaaaacgaagaucccugaagcgccaugcugcgugcccguggcggacacacaccgcuuucuaugacauucuguccuacauuuaaaacaacguuggucauaacucaugauacugauuuccagcuccaguaauaagcugggauuugcaguugaaaacacacuagccuagagucaggcgccguggauucuagcuuugccacuacuacacgugaggccucggccaauucaguuaagcaggauugcugugaagauucaaaugaagucaguggcauauugaagucaaaucuacaagcguaaguuuuccuccuuccuaaaaacauauuuugucccgcguuguaauaaaacagaguacuuaccaauggcuggaaaguuuuuccuguauguaaaccaaagucuagaugccacaucagacaagaucucguccuuuucuagagguuguuuaaaagaaaaaaaacacacacacacaacgccuuaaguuugcaagucacaaguuauggcagaguuagcagagaacagugaucacaaaaugcuucugcaggccaagcggucagaccagggugggcuccagcauggccgauaccugugaaaaugcuguauuuucuacccaguauccaaacgggcucugaggucucaggaaaaucuucaaacucagcaaaccggagagugucguaggucagaguagcuguugaaaccaaagaugcacaaucaucagacacuuauaauuucauaaacuaguaucgaaagaggccauuuacagcauuucugugcugaagagaacaacuguaaauucuuguaacagcagcacucccucucguaucucgggccuaccaagacacccaccauggauggaguaaacucuuaggaaagagaaggaggcccugcugggcagcugcucugcuaagguauggggacagggagguggggccagcaugcuacuuccugagccuuucauauucugagccacugagucagugucuaacagcugacacgagggugagaggccaaguuaggggccaaccugaggggugagaaagcaaaaaaaugaaaacccacccgauucaagcacuuacuuuagacuuaaaaaguaaaggacaaaaauaaaguuaaaccaccuccuucauccuuguacgcaagggaagccaagaagaaacagggcaaagagucguuuuccauggccauccuaagguuuaccagaugucaccauggcagcguguucagagucacugugaugaaggcagaugcuccggggcaagaaacacugagcugcugggaagacugggguucuggucuaccccaauuuccugguuaggagcaggugcuggagaagcauggggugcuacucucagguagaaaguuaaccccuggacacugagagaucaaacucucugccaaguccccagagguacccggguacaaaaagccuagugaucaaggacugaaccuguuuucauuucaacaaugcuaccagaagagcaugccaccacuuccauggggcaacaccccacuuucuaaggaggcagcuggcugcagagccauggugcuuaccugcugggcuaaugauuagcccugcaugccaucuuacucuguuuuacuucaauuaagaaacuaggccaggcacaguggcucaugccugugaucccagcacucugggaggccgaggugggcagaucaccugaggccaggaguuugagaccagccuggucaacauggugaaacuccgucucuacuaaaaguacaacaauuagccaggcgugguggcgggcgccuguaaucccagcuacuagggagacugagccaagagaaucacuugaacccagaagguggagguugcagugagcugagauugugccacugcacuccagccugggugacaagagugaaacuccaucucaaaaaaaaaaaaaaaagaaaaagaaaagaaaaagaaaaaaaagaaagaaagaaacuagagaggcccagggucuuccuguccacagaacuguggcugaggauacccaugucccacaauguuccugaaaagaaggcgccagccagcagcaaugcaccagcccaaacacccauguggcgagaugcccauugcguauucuggggcggcaccagaggcaucucucuccagcugcucuucagggaacugggaacacacaauucccaucugcugccucuccagcucugauggugucugaucacucauccuucaccagcaacuuuacagcaaucuuuugaaaaucaaucacauaugaauuucucccacaucuaaauuuacuuuuugauaacaaccccacacuucaauaagaaugacauaugcuaaucauaaaaaauucugaagacuacaaaaauacacaaaucacgugaagccucguugcccagcaaugacucuuuccagaagucuuuaugcacagguucguacgugaaaucauacuaugccugugguuuccucagcauucuacauaaacacagaucuccaccuaagcugauacuaaaaagcaucgugugugaacuucugugcugugcacaauccccuuggggaggcagggggcagucagaauuuaaagcccagcuuggguacugguaaacuguaguuuccugggccacucacuuaacuucuaagugugaauguucccucauccauaaaaugggauaacaacaggacagccucagcauaugggugugacguuucaaugaaacacuuccaaugaggugcuggcuggcagacagaagggcugcaauguccgcucugucauuaacaucgaggacucagaaccacagggucaaaggcacacaaauuuuacuauacccaaaagccuuaauuguaugcgcagcuaauucccaaacacaggguucagaagcaccugcaagcaucucccucggugcaggcagaacuaccaaauccacaauagagggcccuacaggcacuguuuaaaggauucucagcugugggagacccaggccccucucugccccuuuccuagaguagugcuguggcuuccugagcaagaugacgggcguuguggagcggcugcagccagaugaagcaagcuuuccacagcagggcuuuguccaagagcucugcuccuguuuuuuuuucuuuuuuuuuuuugagaccgggacucauuuugucacccaggcuggaguacagugguguaaucacagcuuacugcagccucaaacucccaggcucaaucaauucuccggucucagccuccugagcagcugagacuacaggcaugugccaccacacccagcuaauucuuguauuuuuuguagagaugaggucuaaucauguugucaagcuggucucaaacuccuaggcucaagcaauccaccugccuuagccucccgaaggcugggauuacaggcaugagccacugcaccuggcccccaagagcucugcucuuacauauuucacuuguccaugcuuucagagacauuaucaaccaaacugcuuggugacugugaauaaauaaaguccaaguuuacauucucuccugccuuuuuauauauauguuacuuguuucugcacaugauuacaaaaacugaauuaggaugaauuaagguccaugccuuuuuuuuauucuuuugugauggagucucacucuguugcccaggcugaagugcaguggcaugaucuuggcucccugcaaccuccaccuuccggguucaagaaauucuccugccucauccucccgaguagcugggauuacagacaucugccaccaugcccggcuaauuuuuguauuuuuaguagagacaggguuucacuguguuagccaggcuggucucgaucuccugaccucaagugauccacccaccucggccucccaaagugcugggauuacaggcgugagccacagcauccggcccacuccuaucuuuuuaaagagcugaaaaacaucaugaugucccugcuaccucucuaaagccacuccugaaucuucagaagucccuacuauucuuugaccuguaggcuuuauucaauauauagacuaaaauccagaaaacuuauucucaaggaaaaaggaugaaaacaccaccggucuaauuucuuuucuuuuuuuuuuuuuuuuuuuuugagacggagucucacucugucgcccaccaggcuggagugcaguagcgcgaucucggcucacugcaagcucugccucccggcucaugccauucuccugccucagccuccugaguagcugggacuacaagcgcccgccaccacgccuggcuaauuuuuuguauuuuuuuuaguagagacgggguuucacuguguuagccaggauggucucaaucuccugaccucaugauccucccgccucggccucccaaagugcugggauuacaggcgugagccacugcgccuggccaccaccggucuaauuucaacacugcaagacaaugauuccaucuugcuguuggaacauucuucucauguuugacaccguuccaaggcaccagcuuugaacuaaagauacacauaucuuuuauuuaaaguacagcagagcuaaaugaacacuggcaaguaucucuuuguagacuacagauguuccuuaauuaggaugggauuauguccaauaaacccauuguaaauugaaaauacuuaggucaaaaaugcacugaggccaggcacaggggcucaugccuguaaucccagcacuuggggaggccaaggcggguggaucaccugaggucaggaguuggagaccagccuggucaacauggugaaaucccaucucuauuaaaaacacaaaaaguuacucgggcaugguggcaggugccuguaaucccagcuacucgggaggcugaggcaggagaauugcuuaaacccaggaggcggaggcugcagugaccugagaucgcgccacugcauuccagcccaggugggagagugaaacucugucucaaaaaaaaaaaaaaaaaaagcauugaauacacguaaucuaccuaacaucauagcuuagccuagccugccuuaaaugugcucagaacacuuacauuagccuacaguugggcaaacucagcuggcaacacagugcccuguagagcaggggucauucccccuucucaugauguggcugacgaggagcuaucuggcaucucgagaguaucuggaggcauacugcuagcccagaaaaagaucaaaauucaaaacgucaaguaugguuuccauagaaugcauacugcuuucacacuaucguaaagucaaaaaauuguaagucaaaccaugguaguuuggagaccaucuguacuucagaagaauguggcguaugucaucaggaaaaggaccauauuguugaaucaguaacagucugcaguaacagaaucuggaagcugagaaacuucuaggaugucuaguuucccauauuaaaaauauaaaugguaaaggaaugagagaaguauagauaaggaagaaaaggaaaaaggcucccucugaaagcagggucacgaggccugagcggcugugaaguugagggauuuucaucacggacgcaguaaaaugcacagcagguguauuucuuagguuuaucaccaaacuuuauaggcaaggaagccaacuucagagugaagggaauaagagguguuccauuaaguucaaauacaccaccacaccuccagcuauaacugugaaaauuacagguguguggccucagauugcucacuguauaaaccaucaaggagaccaggaaaccccaggggagcaaauccaaggagcaaucacggugcuuggcagugaacaggaguggcgcagccacggcgaacgugacccaugaggucccuaaggagggcucccacaccgugccccaagcugcucugcuccuccguccagagaaacgcacuccggcccuccccgagaauccugcccucuguugggagcgagucauacauuccccuagggcuaguggcggacacucugaaaacaugaucccuugcuucucccaccacacugcacccuccucucgguacuguggaggacgcugcaaguggggaguguccacacgucacaccuggagcacguuccugacagcuggagcgccagcuguggagucagaagucugagcccaccacugagcagucacgcaaccuuacaggcuagugaccuucuugugacuugguguccucacugugaaacggacaagucaaggugcaggaaaagcucuaaacugcacgggagcaguaaccacucuuucagggccagccuucucagaucacugaaacgggugagcagucacgaaccggcauggaugggagguauucuguaagcagaggugcagcacagaguacaaggucaacagagacccaaccaaacaugagucucuuuacuaacacugaauccaacauaacguccuuuccuccaagagugacugcauuuagagagcaagagccugcccccggccucacgggcuggcuccaaggaccaaagagaccugcagcgauuccuacaaaagagccaauaaagacucucagacucgcaucucuucaguuaugaggaggucuucccuguacucuaggggccccacacugucccucucaugcuggaggacaggaaggaaugcccucggcaggcccuccgagcagaacucaccccuccuggacacccucgcagcuccagcugaagaggaagacacaaugaggagccauggacugaggcaucagaacgguacaaagaccucccugaccuuccagaucuuacuuuauaauggaggaagauaacuuuuuuggaauuaacacuucuaauuucuuucuuuuuuuuuuuuugagauggaguuuugcucgucacccaggcuggagugcaauggcacgaucucggcucacugcaaccuccgccucccgguuucaagcgauucuccugccucagccucccgaguagcugggauuacaggugugugccaccacgccuggcuaauuuuguauuuuuaguagagauggguuucucccauguuggucaggcuggucucgaacuccucaucucagaugauccgcccacaucagcuuccgaaagugcugggauuacaggcaugagccaccgcaaccggccgacacuucugauuucuacugagguuugguucuggagucugacagccugcucgauagcuacaggcagaccgcgcccggccaacacuucugauuccuacugagguuuguuucuggagucugagagccuggucgauagcuacaggacagacacaggccuggacuucuuccagccucagucuccucacccaugaaauggggcacagccaccaguuuuccaaguggggugagaacccacaaugggugcaaaacuaacgcucacaaucacuaacaucugcagaucgaccaacacgaugauuccauucccaaacguuccuucuggcucugucacccaagggucuggcucugucacccaagcuggagugcaguggugugaucucagcucacugcaaccucccccuuccggccucaagggauccucccaccucagccuccugaguagcugggacuacaggcaugcaccgucaugccuaauuuuuguauuuuuuguagaggugggguuucccuauguuaagcaggcuggucucaaacuccugggcuccagugauccacccaccucagccucccaaagugcugggacuacaagugugagccaccacacuuguuccuucacugacucucagauguaugagauccacuuaggccugacaccagcugccucagcaauucgccauggagagguucccuugucuuauuucauagccccugucauaauuucaucaucuucccgugccacaucaugugauuuauaagguaauucauguagcuccugauagaaaaggagucaaacuucggaaaaaauauccacucgccgggugcaguggcucacaccuguaaucccagcacuuuaggaggccaagguggguggaucaccugaggucaaggguucaagaccagccuggccaacauggcaaaaccccguugcagugagccgagaucacgccacugcacuccagccuggacgacgggggggggggaaaauauauacauacacacacacacacacacguauauauauauuuauacauauauguguauauauuuauguguauauauacguauauauauguuuauauauauauguacauauauacauaaauaaauauauagacccaucucuagacuuccagguaaugauauuaauuugaaauaagaugacauguaaggccaggugccguggcucaugccuguaaucccagcacuuuaagaagccaagaugggaggaucacuugagcccaggaguuugagaccagccugggcaauacagggagacccugucucucuuaaaaaaaaaaaaaaaaaaaaaauagcuaggcguggacaucuguagucuuagcuacugaggaaugugaggcaagaagaucacuugagcccaggaggucaaggcugcaaugagcugaggccgcaacaccauacuccagucugagcgaugaagugagacccugccucaaaaaaagaugacacgcaggaggaacaagaugaagaaguagguuggguguggugguucaccuguaaucccagcacuuugggaggccgaggcgggcagaucacuugaggucagaaguucgagaacagccuggccaacauggugaaaccccaucucuacuaaaaauauaaaaaaguuagccaggcaugguggugcacaccuguaaucccagcuacucgggaggcugaggcaggagaaucucuugaacccaggaggcgaaggcugcagugagcugagauagagccacugcacuccagccagucugggcgacagugagacuccgucuuaaaaaaaaaaaaaaaaaaaaaaaaaaggacggagaggugcuguacaccuuaagaaagagucccccuuagaagcaguucucccauuuggucggcuggaucccagacacuugauuuuccacgcccucuucccugggacuucugcgaucacaagcagaagagggcagauggcauuuuaauaauauaguaauuccaucagaaaaaacaugugacuuaguacuacuaaucugacaggcagaaauguagggaauuguacucaaugaauuuaaccaacuucucuccauuuaguaccaauuacacuucauucaaccagagaggacuacaaaaaaaaacgaguaaauuuaagagcuuacuguaaaccacuucauuucgaagaaaccuuccuaaaacacuuagaaguuauuuuccaaaagauuuauauuuuauaaauucaacaaagguucuucuuuuccuuuagaaagcucuuagguuuaagauaacaguuugcauaugauuacuacuuuuuuuuaaaucuccaagaguuuacaugagaaugcuaguaguucaguccugaaugaaaacagagaaagagagaaaggaacuccaaauuuagcuacaucagaaagcuagaaaacacuguuucagugcacacacugggcagauugcgcacauuaaaacccacuccccuagaucgcgcccaccgcacuccagccugggaaacagagcaagacuccaucucaagaaaaaaaaaaaaaccacuccccagcagccucugcauucauuacauguuaugcuaacauacuggauuuauguuaaacucuacaaacugaaagcuuugauaguaggggaauguguagguuauuauuaauucaaguucuguuuuuuuuuuauuaccaaccacaugccagacacaagugaugcacuagaaaugcaagcacaagacaccagcucuguccucaaggaaugggcaguguggcuauuuaagugcuggcaccugccagucgucugaauggggagcaugcuuuuagggacagugcuagggacugguggagaacacagccacacuguggucugccugccaccuccuggaccucuccacacccgcagaggccuuuggccucuuuucuuucccacccacauucacacccugggugaccucaucugaugugaccuccagucuaucuccagcccaggcuuauucuuuuagcuccaaaccuguagacccaaaagcccacuggacacugcucuacaaggaugucuaacauccaccucacauucaacacacauaaauccaaacucgcaacagaaagcuucccaccagacaggaccuccccaagucuuccccaucugaguuucuuuuuuuuuuuuuuuuugagacagagucucgcucugucgcccaggcuggagugcaguggcgcagucuuggcucacugcaagcuccgccucccggguucacgccauucuccugccucagccuccugcguagcugggaucacaggcgcccgccacuaugcccggcuaauuuuuuguauuuuuaguagcgacgggguuucaccguguuagccaggauggucucgaucuccugaccuugugauccgcccaccucggccucucaaagugcugggauuacaggcgugagccaccacgcccgccccccuccaucugaguugcuuagcucaggccauacacuauggggccaucuuuaacuccucccucucuacccaucccucucccaacuuccaaucuacaaacaaauucuauugucucaaccuccaaaacacaugcagaagucaaccucuuacccacccugagcuaauccacuggcaucuccuugcuggcuuguucaacagucucuuagcuggucucgcugccucugcccuugccccucugcaguacauucucaaaagagaugccagagcaagccuguugaacacagucuaucaugugacuccuccucuagaaugaaaccuuccaaacggcugccauccuguucagaauaaacacugaguccucacuaugagcugccauccuguucagaauaaacaccgaguccucacuaugagcuggcaaggccccacuacacugagccuaagucaccuuucuauccucagcuccugcuucucccaccgccacccgcugcaccugagccacaccaggcucuugcuaccugcccuuccuccuacacugcuuuaagucuucgucaaaacuuaaaccuucagagugagacccuuccuggccauccuggcuacaauuccaauccuccucauccuuggcccaaaucaccaucccccaggagccacgcacuucgcugcuaaugcuggucucaugucuagaacguuagcuaccccagggcaaugguuuucaucuauguuguuacuucucuaguccuagugucuagaacaaugccuaacacauaucugacagucaguaacaaacaguguauugaauuaaugacuaucagaacagaaacuguauuacacauggucaaggaaggcagaaucuucaagaacucuagagaucaaaggagggcagaucauuaaucaucucugaaaggaaauacagcaucaagucagaaggaaaauuccccaugauauccuacaaacaucauauacguuuuuaucagcauaaacagagaccuuuaaaugcaaacaccuuuucuacucugaucccacaugcagcaacauccaguguccuauuaaaguaucaccaugucaacacaguugucaagggaaaauaaaagauaaaauaaaguaucgccauguaacaacauaacuguucucccaacuugaacaugaugauuuucacauuuuaggucauaugaucgacacugaaccguguuuuugaccuuagccaagucucucauaugauacuccagccucaagguaucgaaaugauagaggcaggaggcagacaaauccuaggcagagaggggugggucaccagugaaacccaaccuucaagccacaguuuaaagccugaaagccaagcgacgagucucggauaaauccacagacuggauugcgaaccucucuuccuguuuggugcgcuuuccucuaauuaauccccacccuucaccuauuuuacauauaccuacuuuucucuaauugguuuauuacacuguugugcccaccuuugaguagugacuuuguuuuaaccuuuuuugcauacucacagacaaaucagcacacacuccccauucugagccuauaaaagcccuggacccagccacaccaagggagaccacccgacuuuggguggaagaccacccuugaguccccucucugcugagggguguuucaucacucaauaaaacuauucuccacccuccucacccuucgauugucaguguuaaguguagucucauucuucuuggacgugggacaagaacuagggacccaaugaaugcaaguacaaagaaggcuguaacacuguggcccugggcccucugccggcaaagggcagccacccacugugacaccccacgugacaggaggcagcaaagggaagcagcggggacggagccagccccagagcuauagccuggagcagggcaaugggaguaacagggcugcugacacucugcaacacccccucuugggcuucaggguuguaagcaccccugcuugggcgccacuaccuuccccuugucuggacaccagaauccacugucccuuugucuggacgcuggaguccgccgugggaguugcuugccacaugucuagcuguaagcucugcagagcccacucuggugccugcgcuugaaacagcuggcgggacccggcacucacucacccacacacccacucccgccaggggcugagcauacagucaugguggccaugguauccgugccauagugcaaaccaggugcccaccgguggaccaaguagaugggguaucuccugcggcgagccuggacccaagcaaggccugggcaggggccucgccagccggaggucucuggcugccagaguggcugagaaaaauccugcaucacaaacaauaacaccuaaaaagauauaauacaacaguuguaaaauaguaaacaacaaauaguacacagcugcaaauaguucaaccgugaaugacgguuauucuaaaagacaaacuucacaagauauacaccuggucaacaugcuccuuagggagucagggcuccuguuuccuccagccaccuaccacauuuaaguggugagcugcuacaaaucauuuuaauagauauuggcaauacacauuacaguuuuccaacucagaucuuaauaaauuuauguuguagcuaccagaaaaauaaaaaguaaaaacaaucccauucagaaugacagaauuaaaccagaugaaaaucuuucuuuacagaugggggauacuugguaaaaggcaaaucaguucccacaaagaaugaaugagcuaaaacuucuguguaaaaauauuucuagggcuacugggcuagcgauggguuuggcgcugacuuaaaauaaucuugcuagcaaaaauggagcggaagcaugaaaggauaggaaaaaaaccaacacucccuauacacacacacacacacuccuucucuuucucucucucuuaggaccccaagaaacuaagacccgaugauacaaauucacuguuucucuuucucgucacggaaaagcagcuuggagaaucuacugguuacuaaauugaagacaaaaacaaaaaagauacguauacugugaugaacacgucacguuucucuccuccaaccuaccaauaacuucauaaaaguuaaagagcuuccaucccuucacgcucagcugcggaaaggcuacgcuuucgcccgccgcucgcguccccggcccggaccgcggccgccccguucgccgccgcgccucuccccgcccggcaggcuccgccgcccuccacggccgaccuggcgcaagggccugugcagccacaaccuccggagcgcuccggacgggaccggaaaagcagaagcuccagcgcaaccgacggcggguuccgcggcgcagugcgccgccgucccccucccgcucccaccgcccaccacccaccaacaccgccccgcgcucccgcagcgcccgccgccccggcccagccuggcccgcaccggcgugccccgaggcgagucgcggcagcccgacccgagcaggggaggccaaugauaaggcgagcaccuccugcggaaagaccgacccccggcaacuccucaccugcguccaucuucccaguccggccgccgacugacccgagcggcgucgcuccgacgggccagcaacgcgacgcggcgacgggacgccgcgggggccaauaggugugccggcgc

SEQ ID NO: 191132 - RNA, 27441 nt, Homo sapiens
uuguuuguuccaaaaaauacuuuauuuauuaaacaauauauccauaaucuauaacaugauccaaaaauacugauauacaucuuuacauuaucuaauaaaaagauuuacaacauuaucuuuccuuuacaaagggaacauagauaauaauuccuugaaaauaaaaauguaacauucauguuaaagcugcaucaucguuuuggaugaaacgugguuaaagguggacaccacaaaauacauacagaggaagaaagaaacuccaacacaaucucuccugaaugggaacauuuucuuacacuuccccuggcuuaaaauuccucucagcacaaguauugaaggccaaucacugcucacuaaaaauuuaagaaaaccuuaagucuucaaugcccauaauuaacaucccucacgguuuuacucuaaaccaugaagaccuaaccuaggacagggcagacccucggcucuggggucaugugggaagcugcucugggccagcgucauugcucaaagcagccccagccagggcucccaacgacaggacaggaggccaaguccggcagggcugcuggacaccagacaagcuggccgguguccccaucagucccagcaaacccucccaccgccaccagucugcacagcugcuucucgcugcuccaggcagacuggaaaacacccacgccacaaagcccuggccaacagugagacgggcggucagcugcugcucaggcagccacguaggccuccgcacggcgucccuggccaacaguggucucauguccacccgcccaggggucccguccagcaugagacgggcggucagcugcugcucaggaggccacgcaggccuccgcuuggcauccauguccccagcagcagcaccuagggcacauucgcagaugcagagggcucgguuucaccagcuccuguuuucacugcagccugccuuccccuacaggauuuccucagaucacugacugauaccgcagcacugaaaacaaggaaaauggguagaacgcuccuucccaucgaggucaaucgcacagccacagaggacccacaccuucggcucagaugaagcugccacagugacccacugguuccagcccacacacccucaauccaagagaugggucuggggccgggcagcuguggaggggggucugguccgagaccaaauccuugaaucacccccagggagaaggcggccaggccuucuggagcaaggcguggauggugcaaaugguguggcuucugugucccugcagggcgggggccaggccaggggccaugaccuucuuuucuggccaaacggccacuccugagugugucucucccacggguagacagcgucagccacagagcacucaggauucaguuggguccaaacuacagcccaaggaauugucucauucugcucauguuuucuauguuucuuccaaaacucuaugcauauuauuuuggugauauuauuguaaguggcaaaaguaaacauuaaaaacacuaagcacagaaacuugaaaagaaaaggucaaaauucaauaccugggauggugcacaguggcaggcaggaccacaucaucacgugucagacaaaagcgucccacagggaagccagucaucuuuccccaaaaagcagcgagaccucaggaagccgggcagccaaaagcaucaacaaccccagcgcuuuccagggguagccacaggugugaacagcucaaagguggagcgcaauaucaaauucauuucugaaaaauugccaggcgcuguuucagcacaaacucccugcacuuaccuaucccucuucccaaaaaugguaaaagagagaaaaacauuuuccacaauguauccuccacgaucaauaaacaucuguguuggccgggugcgguggcucaugccugucaucccagcacuuugggaggucgaggcggguggaucacuucaggucaggaguucgagaccagccuggccacacauggugaaaccccauuucuacuaaaaauacaaaaauuagcugggcguggugguggacgccuauaaucccagcugcucgggaggcuaaggcaagagaaucacuugaacccaggaagcagagguugcagugagccaagauggugccauugcauuccagccugggugacagagcaaaacuccguuucaaaaacacaaaacaaaaaacaaaacacacacacacacacacacacaaaaccugugcuaacaaaaaguuaagucauuaaaugaaaauucaucucccagcugagcgcaguggcugacaccuguaaucccagcacucugggaagccgacgcaggcggaucauuugaccccaggaguuugagaccagucuggccaauauggugaaaccccgucuccaacaaaaauacaaacuuagcuggguggccaggcgcgguggcucacgccuguaaucccagcacucugggaagccgaggcgggcaaaucgugaggucaggagaucgagaccauccugguuaacauggugaaacccugucucuacuaaaaauauaaaaaauuagccaggcgugguggcgggcgccuguagucccagcuacucgggggggcugaggcaggagaauggcgugaacccgggaggcggagcuugcagugagccgagaucacgccacugcucuccagccugggugacagagcaagacuccgucucaaaaaaaaaaauuaacauacaaaacccacccaucuccaguuucacagccguggcgaagggugugaagcacuguagccugcccucucuggcgcuuucccuucuaagccgcaggaaggcaccgcuuggagggagccccuucaggcccagacacuggcagggacgagcagcagcaguggccgaccgcccgccugcaccugccuggcaccugcgcccggaggauccacucccacccacacccucggaaaaggacagguggcccagaggcauccguguguucaagaaccgcagaacaugaauguggacaccaucccaaccaggacuguucaggguguucuuguucucuuguucucacucacugacuaccagcuucucgacgggagggccccgucugagacacagagcuucacacguuccuucugcuuuauuuccucucccuagugaaacauuaaacacaggaggaaaagauacagauguagccaucagaaggaagugaggcugucauuccaaauggccccccaccaugaagaaacccaggcuucuuaaaucaggaaccucacgucucaguuuucccucagguuucuuucuguggugugaggacagaaacaggcgucccugcauuccucagcaauccucuccuuccucuaaaggcacgggagaggauuuccgagcgccugcgaugcuguggggaaccgcaggcugggcaccgucaccaacgcgucacaacagagcaaaucugcauagccuuccccaacuaccaccgaaaggauggcuccggcucagcuuggugaacgcucauuaaacaaaaagcacacucgaguuuccuagcuucauuccagaacugcuauuguggcacaacaaauucacaacaaauucacaucggaguccccucgaccgggagcugcgggccugggaaugcacagcacaggcagaagcauucgugguucgucagcuccuggcagacgggacucacuucacggacacacagacccacgaucuucaugcuauuaggguaauuucaucuucacaguaaaaaaucaccaauucccagagaaacggagcaucagcccagcugucgcacagggucucgcgggugcuggucacgggaccugcggccacuccaagcuaaugaagagccguuuacuccggaggugaguccccgagggaggacugaaguccaagcuaaaaaggcggcgccagcgaagcggaggccgcuuccuccagggaagagcccccagcccucccgggcccauccgaggcgccccacgcgggagcgcacgguggccggaggcggcgcggagccgagugugaggagggcagccgccgccacggcaguggccccacgcgcgccucgguggcaggugcuccagcgggcggggcacgcggagcccgggcuguaccggacaguccuggaaaaccacaggaaagcuacgcgaggguggcggccgcccuccguggaccagguuaccauguccccgcccgcacgcccggccgggcagcccgagcucacgcgcgcccgcccacguccgccggggucccugcugaugcucggggggaguccuguaaaagccacacugaggucgcggcggcgagucccugcaaggucgcccuucugugcgaacaggcuuuggugguucuuguucuaggaaacauccagcgcuucaacuggccacggaguuacuaaguaucaaccgaacaagguaguuuuaaaaggaagggaaauauugcgacacgaaugaagggacagauuaacuugcuccucggauccgggcacacagcuccuccuacuucuucuuccucuuuuccuggacacaccguggacagaaccugugacaagaaaggcgcagugaggcccugggcgccauuuccgccagcgcgcagggugcccagggcccgccuccccaugucucccagggcugcuggacgccggcaggagggcaccaggagaggcacacgcaguggggccgcggcccucccgcagggaaaaugcgccgaugcacgugcggcucuaugcaggacgccgguucugaagcugacagauacaccaucaaugagcaaaaccgauuugacacccaggcguuccuccuuaacagguggguccuucuuccccggccgauggcagggucgcuggugcccucugucugcagucugugggggcugcagguaccaagcacgcguugagagcauggcagccccucaggcccacggaaacccagccaggcacccugcacuggcccuggaagcugccgucucacaagugcucccuggugacucugagcaaguucuggagcugcacgcacaaggggcuccugaacagaggcagcugcugaccacagaggacauuccauagguuccccacgcaggaggcagccgacucgcaugacggcaaccgucaaccaccgccuggcccaggcccaagccugcccagggcccuccgcccuaacagccuccguaccccuucucaaaacccucggugcaccaucccccagccgcacggcguggggcaccacagugccaugugucccugugacaggacagccuguguugacgccacaugacaccgugagcucggccagccuccgagacacggcauccuuucccuguguccucacaccgaacaccaaggauaacuggcucuuaccaacucgggcgagucugccggaguuucaaacacgcugccacgaugaccucugagugccacacagaagagcacauuccgauuucauuuucagaacauagauauccauuuuuagauuuucagcacaggcaaacaaagccagguuuuuaucuuuuuauuuauuuauuugagacagggucuugcucucucgcccaggcuggagugcaguggcgcgaucucagcucacugaagccucggacuuccaggcucaagccauccucccgccuccgccucccagguaguugggaccacaggcacgcaccaccacgcccagcuaauuuuuguauuuuuuguagaguuggggucucccgauguugcccagacuacagguuuuuauuuaaaugaaaucugaggaacaacaaugcagaaaguugccauugccaaggggaugcaagggucagguagagaaaacacacccuucuccacuagacagagccaggggcagagccccagauccaugccccggcuucagggcucacaucucaugcuauauuucccaaauuucccuaggggacaagaaccucucauuucugauuuaagacgaucccuaccucccagaguccggaagguuguccuucaggaggggccauuaacgugaauaucacguaaccugguaaccaccauuccugggugacggcaucccucugccagcucggacaggcacagcagcaaaggggggauaaagccacacccagagcagccaccagccagccacacuccuugaggccacaguggggcaugccuacguggcuaccgugucccgcuaagcccggcaagauucugccauggagcaccuucuccuggggaggccagcagcgcaacacccagcagacugggagaaaacagagcgagcguccccacacucaccauuuuccuuuggguuucgugguaagguccacgcaggcaaagugaaaccacucaauuggacacugcaaaguaaagggagaaaccgcagucaacacgccucauguucuguaugcaaaacacaagaaaugccaacauccgccagcccugccccacacaagaccccgccccauggcgcgaauccugcaggcgacacucacgucuggauugucacagccaaucaucuccccauaggagaccugguggcacaggcaguacguggguucguuuggguccacgggcauguccagcacaucagaggggugcacggacaggauggugucagugaacucagaccugcaggggacagggcacaggcaccacugaaggccauggugggaagugaggcggcacggacaccacgggcccuucugucucugacuuaaggcccccucaccccaaaacugugaagacaaucauuccaagggggaaauugguaccgugcucugagcgacacauaaugaauaagcuugcuuccauuuuucccauuguccuuuagaaaugaaugcgacuccagggccagccacugcagucaugcacuaacugaauacacaccuuguggacguuuucuuccuggagcacacauuuucaaaaccucaauaaccccucugaacacgcaauguucuaagaaggcgcagcaagaaaaucauuaaguauacgaacagauugucagcugaugcuagaaagaacaguuacccacaaaaauccaggaacagcagcagcuggcagcagagggguggagaccucgcgcccaccuucgggcccaggcaggggcaugggggcacagagggcccccaggaggccgugaagcgcagcacucacccacagcaccgggguucuggucccacucuggggacgaguccacucucaucucggucccuccucccagacaggacucccccggggaccucuggacucaacccacuucugggccaucccuccaaagaccccggccccuuuggaaacaagcacacgucaccucugccagcagacggcugacaccugagagaagccugccagccucccacuccagacugacaggugucagagcagcccgcacagucaacagcucucccguaacugugaccuccucccaagagaacagccaugcguccugcgcccgggcccuccacgcaccuacucaggcaccucugccccaauacugacucaaccagcagcuccccacacacucccuggaccgcccaccacccacccagcuguccaccuggcacagggccccuuccgaccacacaccauccuugucacuccuucauccccaucagcucccacguggguuucuacacagcagccuggcagguguuccaccccgucuaugccucccuccaagccugccaccuguagcaccauggccgucccaccaggaccacagaccucagguggagacuuuccuguuugaaagggaugcacuuagggggaaauuuacgcuuuuauauuucaguauuuuucaaauaaacuuacaagcugcagguacuauagacaguguauucccauuaguacagaaagaaaaaguaucuucccuaucccacccuccaacccacgaauaucuaguugguauguaaacacagcagguuagcaggaggaacguggccgugagaaaaacagucacgaucagggaaagccaaggagcagaagucugggucccagagggaaucaacacucagcuuuuccuuggauaccugucuaaagcuuuucuacgccuuugcaauugccuguacacauacacacacacucgggcucagcaugcacccggccuccccgcugcccucuggcacaggggcgcccaccuaagucuguccuuugcagguaaucugcucuucugcucuuucucucugucugggaauagacagggguuucucuuuagagcugaaauccaucagcgucacaaguccagguccaggugcugccgacacugcuuucaagcaacagucucaaguagucuucgggucucuccucugacagcagcacgcaagggucuacgucucagccuccugccgauuccgggaugccaccuguggcuucaccuccaaggggcuccugcggucuccucgagucaccucucacccgcggagagcagggcagcacccucugcugccaaccguccccgaaacgcugacgcccuccucuucugcgccgaguccaauucuguccacaaagcccgaccugacaucuugagcugccacuugaccugugucucagcaucaccagguucgagggcgcuggccagauuugauggcugugggagagggccgggggccugaggggaccgcccagcaagggcaccccagaagcugaggccaccgugcaggccucacuggccucucagucucgccugagggagcgccauggcguguggccagggagugcugcuaucagcccugagggaggcaaccaggaggccauggggagcccugucccuugcacaggccagggugaccccaacugucagcggcugcugacucccuucagcaccacugccacaagaggcacccucugugcuaacuccccaggguguggcaggcaccccucgccagacggugccagcgagcccuuccgcgcccggccccgauggcuucccagcacuccacguggcuccuagcagggggcuggcugccuguccaagccccgggauuccaggugcuacaggugacacugcccuucauccacacacacagguucugccucgccagagcaaggccacagggcagcaacagugcagggggcagccucaggucacgggaucucagacgagacacggagcaucugugcagucuaggaacacugcauuccaggaagagccccgggcacguggggaacaggccugaagagggcaguccacagggacaggauggugcgugcgccuggguccccagcagggaacaggaccugccuugaggcagagcggccuggcaccacagcgugaccacgaggggcgugaauacccacugugcugaugggucagggacgcgcaccacagaacuccagagcccaggggcaggcgggcuccugcacacacccaggaugaugcccuuggaggcacccgagugcacacucccgccccggcaggccaggcuuuggguccaaccgacugguccucaggaugacccgucugcccaccugcaccauccuccugucccucuggaaggggccuccuuggcgccuuggacgucagagcccagcuucagagcuggccuuaccagccugucucgacgucuugcaaugggacaggagcagcacugccacuugggggcacagagaagaaagagauucacacacaagcuagauccagagccgcagggccccgcaacugucgccaucggugaucacccuucucaucugucacuacugggaccugcacggcaggcagcgcugagcucccaggcuccgcauugcuacuaaacagugcuggucagcgcacugucaggacaggaaaagccaugaggccacaguggaucuuccuguguuugcagaggugcuggcuguuccugaggucucugaagcugggcagagcccucagggaggaagccccgaccccaacagggagcuggagucuccuucacccccacgaggacccccagugccugcauuccuuaugccuagcauacccuugagaaacagcacugggugaggaagagaccaggaggagucccacuuucacgcagaaaaggcacggucgggacagggccuucagguuccgagcaggaaggagcaggaagacucagaacgcuguugccacugaguuagaaaacacaaaacccagcaagucacaaaaaccacauucucaaagaugucggggagcuguggagcaacaagagcuagaugaccugcagccagagugggggguguugggggguugggggcggcguccgccugccucaugcacugagugagggcugggcuggccacugggccacgcugagcccacacagccacacauggcggccgcguccccaccgacauuuauaguccagaggcugcacagagcaacuaaaagcagagggaaaaucccugcaaccucggaguucucgagcaaggggucugcucgggcaccgcuggucuccucccccgcacuucuaccaacuguggaagccgcuggggcaggaggcgagagaggaaaccucaagguccucaaggggccucgguggagcugaagcugagacccugccccgccccaggcccccagcccuauuggccuggacuaaaacagaacgaacaccuccuggggagaacagaaauuucccucuccacgcuuccuuuauaucuaaagucagacagcuaauaaaucaugagacauguacccucagcagggaaauaggacugauuauguuuuuuuaaaagcugguuaccaaggaaugguggcacaugccugugaucccggcuacucaagugacccucccaccucagccuuccaaagugcugagauuacaggcaugagccaaagcacccagcccuacaaucucuuaaaugaaaaauguauuaaaggagauuaaaacuaacuuagggccgggcacagcagcucacgccuguaaucccagcacaucgggaggccaaaaacaggcagauccaccugaggccaggaguucgagaccagccugcauaacacggugaaacccugucuauacuaaaaauacaaaauuagccagucaugguggcacgugccuguaauuccagcuacuugggaggcugaggcagagaaucgcuugaacuugggaggcggagcuugcagugagccaagauuguaccagugcacuccagccugggugaccaagcaagaccgucucaaaaaaaaaaaaaaaaagacagaaagagaaaagaaggaaggaaggaaggaagggagggagggaggaagggagggagggagggaaggaggaaggaagugagggagggagggaggaagggaggaaagaagaaaggaaggaaggaaagaaagaaggaaagggaaggugagaggcugagcugggcggaucacuugaggccaggaguuugaaaccagccuggccaacaggcugaaaccccgacucuacuaaaaauacaaaacuuagccggguguggugacgcucaccuguaaucccagcuacuuggaaggcugaggcgggagaauggcuugaacccgggaggcagaggcugcggugagcggagauugcgccaccgcacuccagccugggccacagagccugaaccugucucauaaauaaauaaaguaauagaaacaaaucaaacugaaguacagaaagaaaaaagcuugcagaaaguaagcagagccucggugagcugugagaaaaucuaagcuaaggaacgcacagggagcuggacagcaggaagaggagaaaggagagcacaaaaauacuggaagaacugucugaaaauuuuccaaauucgaugcaaaguauaaaccaacaguucaaagaugcucaacaaguuccacgcaaaauauacacaaaaaaaucacaccaauacacaucauaaccaaacuguuaagagccagugacaaugagaaaucuuaaaagcaaaaaaaaaaaaagaaaccaccaaaaauaauuauuaucaguaauuuaucaucagaaucaaugaaagacagaagaaaaugagagaacaucuuuagcgauaaaagaaaaaaggucaaccuaaaauucuauacgcagugaaauaaaagcauuuucagagaaacaaaaacagagaauucaucaccaucagcauacauguacugcaaaaaauguuaaaguucuucaguagaggagaaaugacaagacagaaauuugcauccacauaaagaaauauacguaagcagaauauguauggaaaaaaaauuuuuaaagaaagaaaauaaauauuaagaaauaauaguugggccaggcgcgguggcucaugccugucauccugccacuuugggaggcugaggcgagagggucacuggaggccaggaguucgagaccagccuggccaacauggcaaaaccccaucucuacuaaaaauacaaaaauuaaccaggugaguagguggguguaaucucagcuacucaggaggcugaggcacaagaaucacuugaaccugggaggcagagguugccgugagcugagaucgcaccacugcacuccagccugggacacagagcaagacucugucucaaaaaaaaaaaaaaaugaagguuaccagaaauggcaacuauaugagguaacuauauauggggugacuuuuguggugagaacacuuaaaaucuacacauuuuuuugagacuauauuguuauuaacuguagucaccauguuguaaaacggaucuuuugaacuuauuccuccuaucuaaaugaaauucuguauccaacgucuccccugaccaccccagcgccugaccaccauucuacucucuacuucugugaguucaacaucuuuacauuccacauauauuuuaaggcguguuucacgucaucagugguuugcaucuaagguaauaacgugcugggaagcucagaucacaggcaaagugaaggacaacagcacaaaggcaggaaauggaagaacacuuguguggagccacacguuaaacaucaaauaguguaauaucugaagcucacugugauaacuuaaggaaacugagugcacacacuagaacaauccuuaaaauacaggggccggggcaguggcucacgccuguaauccuagcacuuugggaggccgagguggguggaucacuuggggucagggguucgagaccagccuggccaaaauggugaaaaccugucucuacuaaaaauacaaaaacauuagccgggugugguggcgcacaccuauaaucccagcuacugcggaggcugaggcaugagaaucgcuugaaccugggaagcagagguuguagugagccaagaucaugccauugcaaauuguacuccagccugggcaacagugcaagacuccgucucaaaaaaaaaaaaaaaaaaaaaagcauggcuaauaagacaagaguggggaaaaaaacggaauacuaaaaaauaccugauuaguccaaaagaagacagcaaaggagcagaaggaacaaacagaaaacuaauagcaagauggugaaccuaaaucccaccauaucauuaauuauguuaaauaugaacagaccaaauauugcaaugaaggccgggugcgguggcucaugccuguaaucccagcacuuuacagggaggggaggccaaggugggcagaucauuugaggucaggaguucgagaccagccugcccagcauggugaaauccugucucuguuaaaaauacaaaaauuagcuggcuuucaaaggauuucaauuauguaauguucuuugaccacaacagaagucaacuaaaaaauuaaaauuagaaagguaucugaaaaaucccaaauuauuuggaaauugagacacauacuucuacauaaguuauagggcaaagaaguagcaugaaaaaaaaaauucuaggucaggugcgguggcucacgccuguaaucccaguauguugggaggccaaggcaggcagaucaccugaggucaggaguucaagaccagccuggccaacauggugaaacccugucucuacuaaaaauacaaaaaaaaauuagccaggcauggugauacgugccuguaaucccagcuacccaggaggcugaggcaagagaauugcuugaaccugggagguggagguugcagugagccaagaucacaccacugcacucaagccugggcaacagagugaggcuccgucucaccaaaaaaaaaaaaaaaaaaaaaaaaauucuauuccagcacuuugggaggccaacguggguggaucacuugagcucaggaguuuaagaccacccugggcaacauggugaaacuccaucucuaccaaaaauauaaaaaauuagccaggcaugguggcaugcacuuguggucccagcuacuugggaggccgaagugggaggaucucuugagcccaggagguggaggcugcagugagccaggaucaugccacuacacuccagccugggugacagagugagaccucaucucaaaaaacaagaaaaacauucuaaaauauuuuaaauagguaaacgaaauaaaaauuuaaaacaauaucaaaauuauaucaaaaucauaauauaucaaaauuuguggagugcaacaaagauaauaauuagaacaaggaagauauaaaaaucaauuaugcaagcuacuuccaccuuaaaaagcuagaauaguauaggcaaaguaaaccugaguagaaaacaggaaauagagaguagaaacaaaugcaauagcaaacaaaaaaauagagaaaacaauaaaaauaaugaaacuaaaagcuaguucucuaaaaagaucaagacggccagacgcaguggcucacgccuguaaucucaacacacggagagguugaggcaggcggacugcuugagcccagauguuugagaccagccugggcaacaugaugaaacccugucucuacaaaaaauuagccaggcauaguggcgcaugucuguggucccagcuacucgggagcugaggugggagaaucacuugagccuggggacagggagguggaggcugcagugagccaugugcaugccacugcacuccagccuaggugacacagcuagacccugcccucagggaaaaaaaaaaaaggaucaagacaaaaugagagaaacauaaauuaccaguaucaggacugaaagaggggucaucauaacagacacaucagaaccauaauaaugcaaaauuauuaacaaccugaugucaaaaaaaucugacaacuuacaugaaacaaauuucuugaaagacacagauuuuuuccaaaacugacucgagaagaaauagaaagccugaauacuuccauaacuuuaaaggaacugaaugcaacaucaaacuguacacuuagaauaacauuuuauuguauguaaauuauuccuuaauaaaguuaauuuaaaagguuagaaaaacaacaggacuaaacuauaauguauagugucuaggaaugcacuauaaaacuauuaaagaaacaaggaaauaaacacuauagaaaucuggaucauguuuauuugggggcaggaggaguuuaugauuuuaacagggcauauggaaggccuuccagcagcaguuaaucacugacuaggugcuacuuacaaagaucuucacuuuacggaaauuaauuaaaccauguuuguucugugcgguuuucuguaucugugcacuacuuuacaauacgagaauguugggauuuuuuuuuuuuuuuugagacggaguuuugcucugucacccaggcuggggugcaguggugugaucuugacucacugcaaccuccacuucccggguucaaacaaucucccugcgucagccucccgaguagcugggauuacaggcagcugccaacuacucagcuaaguauuuugcauuuuugguagagacgggguuucaccauauuggucaggcuggucuugaacuccugaccucaggugauuaaccugccuuggccucccaaagugcugcgauuacaggcaugagccaccucgcccggccaaaaggcuaagcacuagcuaaaaaacugaaaauuggggcugggcacaguggcucacgccuguaaucccagcacuuugggaggccaaggcagguggaucacgaggucaggagaucaagacuauccugacuaacaaggugaaaccucaucucuacaaaaaauaaaaaaaaauuggcugggugugguggcaugcaccuguagucccagcuacuugggaggcucaggcaggagaacugcuugaaccugggaggcagagguugcagugagcugagaucgcgccaccacacuccagccugagggacagagcaagacuccaucucaaaaaaaaaaaaaaaaaaaaacugaaaauugggucgggugugauggcucaugccuguaaucccagcacuuugggaggccgaggcagguggaucaccugaggucaggaguucgagaccagccuggcuaacauggugaaaucccaucucuacuaaaaauacaaaaacuuagccgggcaugguggugcgcacuuguaguugcagcuauccaggagggugaggcaggagaaucgcuugaaccugggaggcagagguugcagugagccgagauggcgccauugcacuccagcuugggcaacaagagcgaaaccccaucucaaaaaaaaaaaaaaagaaaauugucccuuuuuugucaagaagaacucuuuuuuucucuuuauuuuuuuuuuuugagacagagucucaugcuguggcccaggcuggaauguaguggugcgaucguggcucaugauccucccagcucagcuuucccuaguagcugggacuacagcccacaccaccacccucagcuaauuuuuucuauuuuuuguagagaugggggacucacuugguugcccagacuggucucagauuccugggcucaagugauccucccgccuuggccucccaaagugcgggaauuauaggcaugagcuaccgugcccaaaacuuacacucuuugacccucccucugugagaucaucuccacagaggcuucguggcauuucagcauuuucucuuuagucuaaaugucacuccucugagguaaugcuacgaucucuuuggaggguauacaacaccuuuggcagggagggugucagugggagaaugcuuuaaauaaaguaucucaaaaaacuucaaguuaaaugacaugucuauuuaauaaauguggccacauaauuaacaaugaauauaugcacacuauauguugacacauaaaauaacugacagauauacagaaaucuagcuacuuaaagaguggucuacauuggccucugucaacaacacguugcucaccauccuccugucccuaguggggcagcacacacuguggcuaagaggacaggcacuggagucagacuccaggugcagcccagccgcaccacagcagcccuaaagccugggcaggucccugcgacacugaaaaugccccugacaacggcacccccucaaaggcugcggugaggacaggcugacgacaggcgcgcagcguaagaaucagaauaccacccggcacacggggugcacuucacucgggucagcuuccaucaguguuccuacauccgggauacaggcuauggguauucguucuuuugggaaaaagaggggaaagccucuuacccuccuuugugcuucuuuuucuuuggugugucuuccucugauguccuccugccucggccccgggacccucuuuuuucuuucugaccccggccuucugaaaaauaaucaagaugcaaauuauuuuuauagaauucucuaaagcaaggcaaguuuuguguuuuguuuuuaaaaaggggucucgcucugucucccaggcuggcuggagugcagcggagcaaucauagcucaccgcagccuugaccucccgggcucaagcaauccacccaccucagccucccgaguagcugggaccacaggugugcaccaccacaccuggcuaauuuuuaaauuuuuuguugagaugaggucucgcuauguugcccagguuggucucaaacuccuagccucaagugauccuccugccucagccucccaaagugcugggguuacaggcguaagccaccacacccagccugcaagacaagguuuacccaaauaugauacuuacccuagugaucauacuuuaaugauuuaccgugacaaaacucuucaaaacuccauaguuaacaguaauaaaauaaagaaaaaaaauuaacagacuugcuuuuuaacccucgcccuccggagcuuucaaaaucacugcccuccaucuuguccuucagaucugcuucaaagcgcgccaggucugcaucaagccuucgaauguguuuauccaccuacaaaaggauacccaaagucuuauuuuaaaguaaaaccaaaacaccucagaaucacgaauguacaaaaguauccaccaggaaacaccuucuugcccuuuaauugagucuccaaugaacaaaccucugcuaaaacaaggcccacuauuucaaaguccaugcaagggucuugugcuuuuucugcauauuuugacauugcaauggaauaaaucccauuuagggaaaagacaugagugugggcaauaaugagaagcagaguugugaaaugcagugaacaaggccugggauaucugacgcugaacccuacuuuaaaauauggcuaccuggaggccaggugcagcggcucacaccuguaaucccagcacuuugggaggucgaggcagucugaucaccugaggucaggaguucaaaaccagccugaccaacaugguaaaaucccaucucuaaaauaaauacaaaaauuagggcaggcgcgguggcucacgccuguagucccagcacucugggagaccgaggcagguggaucauuugaggucaggaauucaagaccagccuggccaacauggcaaaaccccaucucuauuaaaaauacaggccaggcacgguggcucauaccuguaaucccagcacuuugggaggcugaggcaggucaaucaccugaggucgggaguucaggaccagccugaccaacauggagcaaccccaucucuaccaaaaauacaaaauuagccgggcuugguggcgcaugccuguaaucccagcuacucaggaggcugaagccggagaaucgcuugaacccaggaggcagagguugcagugagccaagaucguggcauugcacuccagccugagcaacaagagcgaagcucugucucaaaaaaaaaaaccaaaaaccaaaaacaaaaauuagccuguugguaguggugcacaccuguaaucccagcuacuuaggaggcugaggcaggagaaucgcuugagccugggaaguggagguugcacugaacugcagccaugccacugcacccuagucugggcgacacagugaggcccugucucaaaaacuaaauaaauaauacaaaaauaaaaaaauaaaacuacaaaaauuagccaggcuucguggugggugacuguaauccuagcuacucaggaggcugaggcaggagaauugcuugaaccugcgaggcacagguugcagugagccgagauagcaccauugcacuccagccugggcaacaagagcaaaaguccaucucaaaaauaauaauaauaauaaaguauggcuacugcaugccuguaaucucagcuacucgggagacugaggcaggagaaucgcuuaaacccaggagguggagguugcagugagccgugaucacaccacugcacuccagccugggcgacagagcaagacucugucucaaaaauaaauaaauaaauaaaauaaauaaauaaaauaaaauauggccaccuggaggucgggcacgguggcucaugccuguaaucucaguauuuugggaggcugaggcgaguggaucacuugaagucaggaguucgagaccagcauggccaacagggugaaaccccgucucuucuaaaaauauaaaaauuagcuggguguggugcugcaugccuguaaucacagcuacuagggaggcuaaggcacaagaaucacuugagccuaggaggcggagguugcacugagcugaaaucacaccacuguacuccaccguggacgacaaagugagacugucucaaaaaaaacccaaaugguuccuccgagcagauacacaaacaaaaagggcccagaaaaaaaaaaaaaaaaaacagggaugguccuacaugaaguguauuccgucugcacuuccuccagcagcgucagcuaccaaagccagccuuccacuuggcuaugcccauuuccgggcaguuuuuacauuuuguugcaugagaggcaggaguagaggucagaggaagagccauggcccccgccccgcccucaccaucucguaggucugcauggccagcugcacuuugucgucacuguauuccuugcacuugcuguaggcguucuggaucuucugcaggcgcuccacgcgcuggucuggagacagcgucuucaccguggagauguacucugcagccaggaugucaaucucugcuuucuuaucugauggagaaaugggggaaaagcuagcccugcacaagacaccaugaugugcucaccagacuggcaacaacuaaagucagccaacgccaaguuguggcaaagauguaggcugacaugaacucacgcugugcuggugggagcgcaagugggcagaaccguucugcacaaacagucugggaucgugugaaugugcagacuuuacggcaacgugcccaggacagucccagcucugaauguuacacagcaaguggucacagugccuucuucgacucucaaacauccuguaugaauaacuuguagccaccuuuccuaugaccuggcauacuacucuuuuuucccuuuucuuuuuuuccgguagagcagucaagaaagaacacacuacucuuaaauacccuaaacaaaccuuaugucaccuaaagaaauccacacgggaaacauucauaagagcagaaaacagaaaacaaccccaauguccaauccucaguaaaauggagaaauaagcuguggucccuucagacaacagagugcuacucagcaacaaaaagagcaaacuacagccacacacagcaacacggaugauucccagagaaggugacacggagcaaaaagagcaagaaacaaaagaaaacauacuggaugauuccauuaauaugaagagcagaaacagacacaacucuuaacccuucaguuuagagggguaagaaaacuaggccaggcgugguggcucacgccuguaaucccagcacuuuuggaggccgaggcgggcagaucacgaggucaggagaucgagaccauccuggcuaacuugaugaaaccccgucucuacuaaaaauacaaaaaauuagccgggcgugguggcgggugccuauagucccagcuacucgggaggcugaggcaggagaauggcgugaacccaggaggcggggcuugaagaaagccaagauagcgccacugcaguccggccugggcgaaagagugagacuccaucucaaaaaaaaaaaacaaaagaaaacuguugaaggccaugcacggcggcucacgccugugaucccagcacuuugggaggccaaggcaggaggaucacgagguuaagagauggaaaccauccuggccaauguggugaaaccccgucucuucuaaaaauacaacaauuagcugggcaugguguuacgugccuauggucccagcuacucaggaggcugaggcaggagaaucacuugcacccaggaggcagagguugcagugagccgagaccgugccacugcacuccagccugaugguaaagcgagacuccgucucagaaaaaaaaaagaaaacuacuguuaaagguggaaggugacugucaccaaacucaggauggucaccccuugguuggggaggggugucaugacuaggagggucacaaaggccuucaggugccaaagggcuugauuucuccaucucgguagcagacaacagagagguucaccugguaauauuuguuaagcaaucuauaauuguugcacauucauuuccugaauauauguuacauuucacaauaaaauaacucucuguauucccuagucaagaugcuguaccuaaggaaaaaaacacagcuaucucagucuugcaaaacaugugcccaggccgggugugguacucacgucuguaaucccagcacuuugggaggccaaggcggguggaugaaccugaggucaggaguucaagaccagccugaccaacauggagaaaccccgucucuacuuaaaauacaaaaaauuagcagggugugguggcgcaugccuguaaucccagcuacucgggaggcugaggcaggagaauugcuugaacccgggaggcggagguugcggugagcugagaucgugccauugcacuccagccuggacaacaagagcgaaacuccaucucaaaacaaaaaaaacaaaccugugcccagcauaaugaauaaaaaaucucaggccaggcacaguggcucacaccuguaauaccagcacuuugggaggccaaggcgggcagaucaccugagguugagaguuugagaccaaccugaucaacauggagaaaccccaucucuauuaaaaauacaaaauuagcugggcaugauggugcaugccuguaaucccagcuacucgggaggcugaggcaggagaaucacuugaaccugggaggcagagguuguguugagccaagaucgcgccaucgcacgccagccugggcaacaagagugaaacuccaucucaaaaaaaaaaaaaaaaaaaauugccacaccaaaacacauuaucaugaaauuuaaaacuucagagauaaaggaaacaucucaaaagcuucugaauaggaauaacaaaaaaaaaauagaucacacauauaaaggaccaagaauccaaacggcaccagauuuucugcagcaacguggaagcuaggagacaaggcagcaaugucgccaacuuccugagugaaaacaauugucaaccuaggauucuauacccaaccaaacuaucagcugaguaugaggcuagaacaaacacauuuucagacaugcaauguuacaagaaaaucuaccuuccuuuuuuucuuuuuuuuuuuuuuuuuugagauggaguuucgcucuuguugcccaggguggagugcaauggugcgaucuccaggugcaaccuccgccuccagguucaagugauucuccugccucagccucccaauuagcugggauuauaggcgugcgccaccacacccggcuaauuuuguauuuuuaguagagacgggguuucuccaugucgaucaggcuggucucgaacuccugaccucaggugaucugcccaccucagccucccaaagugcugggauuacaggcaugagccaccgugccuggccaagaaaaucuaccuuccuaugugccuuuuuuucaggaaccuaccaaaggaaaggcucuaucaaaacaggagagcaagggcaaaaagaagacauuuaagauucagggaagagggucccacacugaagaggggugaaaggagaucccaggaaaaccucagggcaacaagugugcaguuggcauggaaacaaucaggacuguggccuccaggacagagggcucugcggaaagaaagcacacacagaacugucaggguagacagccugacagaccacaaggaaaagcccagcuggggagacaagggucgaaugcagaaaacaaagccaacaaacagggccaugaguaacucuaagaaauacacaaaguuauuccaaagaggucauauaagcacagcagguggcauggcucaguguuaaaguaccuacacagcugcccaauggaagucccaucacuggucucaccacaaauucuaacaaccuacagccaggagaugggggagccaggugagggcaugugagggugugggggccacuggagaaguacagcugccugugccauauacgucugaacaacgucuaaaacugacgagagauaaaauaagaaacagcaacaaaaacauguuguuuagaaacagggaguuuaagggccgggcgcgguggcucaugccuguaaucccagcacuuugggaggccuaggcaggcggaucaugaggucaguagaucaagaccauccuggcuaacauggugaacauggugaaacccugucucuacuaaaaauacaaaaaauuagcugggugugguggcaugugacuguagucccagcuacucgggaggcugaggcaggagaaucacuugaacccgggagguggagguugcagugagccaagaucgugccacugcacucuagccugggcaacagagugagacucugucucaaaaaaaaaaaaaaaaaaaaagaaaaaaacagaguuagggccaggcgagguggcucacgcuuguaaucccagcacuuugggaggcugaggcgggcagaucaugaggugaggagaucaagaccauccuggcuaacacggugaaaccccgucucuacuaaaaauacaaaaaaaaaauuagccaggcgugguggcgggcaccuguagucccagcuacucaggaggcugaggcaagagaauggugugaacccaggaggcagagcuugcagugagcugagaucacgucacugcacuccggacugggcgacaaagcaagacuccgucucaaaaaaaaagaaacggaguuaaauaucaaacggccaaaaaguacuaccaaacuuuuaaaacaaugcacgcacuacacacuuugaaaauugaaaauauuuaaaagaaaaaauuggcaauaaauauuuugauuggaaagggugaugguuauaaaaacaugauauaaagauguguaagaacccaagaaacaauguggcuucaaaaguaucaacaccuacugcaagacacugagugauacccacggcccagggcuaggccaaugccccacuaaccuggguccccucaaaacccucugcccccagccuucaggagcugcuggcucccaccugucagaacucaguucugguuguauggagaggucugaacccaccuuccguccucugguccagcucucgcaucagcuggaaguuccucugaaguucgcagggaagguucucgauaccugaaacgcaaaaacacagaagccauguaccucucagcagcaagacaaaaauucaccuccaaagguuuucugucuuuuuuuuuugagauggaguuucacucuuguugcccaggcuggagugcaguggugcgaucuuggcucacugcaaccuacaccucccagguucaagugauucucacgccuccgccuccugaguagcugggauuacaggcacaugccaccaugcccggcuaguuuuuguauuuuuaguugagacgggguuucacaagguuggccaggcuugucucgaacuccugaccucaggugauccgcccaccucggccucucaaagugcugggauuacaggugugagccaccaggacuggccaaaaguuuuauacuucaagucuacaagcccacucuguauucugucucugucaggguuugcggagcggaaggacugugaucucauuuuuagaugcagguaccaaacagugcugacaagaggcugugugcacacuucggaagcugucagaagucaaagaagggagagggaaacuuggaaaccaacagcacaggcaggggaggccaacugaccccacccucuaggcugcccccccucagugagcagcaucuuccaaggcucaagccaaaauccccuggguccuccuugaucuuccccuacuuuacccagaaauccagugcauugagcaguguagccacgcugcccacgcgacuuuaugcaaggauagaaauguuuccucucucggaugggcgugguggcucauaccuguaaucccagcacuuugggagaucaagacaggcaaaucaguugaggucaggaguucaagaccagccuggccaacauggugaaacccugucucuacuaaaaauacaaaaauuauccaggcgugguggugcacagcuacagucccagcuacucgagaggcuagggcaugagaauugcuugaaccugggagguggagguugcagugugcugagaucauacccuccaaccugggcaacagggugagacuccauuucaaaaaaaaucaaaaaaagaaaaagaaaagaaauguucucucugagcugcccaagacagugguggccauagggagcuacugagcacuggaaaugggacuaacgccauucaauuuuuaauuuuacuuaaauagucccuguggcuagcgcaaccauuccccacagucugccaggaggacccccgugcugcuuucgcgucugcuuuguuacccccuagaccaggccaaccuccgcccccugcacagcugacacaggcuccuaaggggggcugccuccuccagucuuggccacccucccaucugcuguucacaguuaccaggcaaucauuuuaaaccuaacucuaucuuaugcaucugaugcuuccagccccaguguuuucccagcuccccuagaggacagaggcacagccucccggcuggcacagccucccagacacacacaaagucaacccuccuugggaggccagcccacuggcugggcaccaggauagagaaggccuccccuccagcgugcuccccagcuugacucuucuacccagggaaccccccacuacucagacccccaagagacagcggagcacaugggcagaaucgggcgucccucuagggcagcggucuccagcuccaggccacggcucacucgccacugucucagccccugggcgggugccaggccgaagaccaugaggauccccagugcagcgcccccacaagggcccuccagagccacccggcacaaccccaaacaccgcgaccccaaagcugugcccaucccgggccgacgucaggggucccgcguggggucugccccucuacgagcgggagacccugagcaggcugcucggcagcgcuggaccuucccugguguguaaagugagggaaagcaccguccgcucagccgcugggggcgccgaccugcugccaccuggaaacagcacagcccgcccaccagggccgacucggcaccgcccuccccgccuccgcgccgcaguccccagugccggggagagacgccccgcggcccgcacgcccuccccagccgcggucacacaagaggccggcgcacacgggcgcacagccaggcggaggcccagaccccggagcccccaaggcccggagccccgcagcgggcgccagcuccuccugcagacgggacagggacgggcgggaccuggcggggccggggccggagcugggggcggagaugaggcggggccuggguaggggcgggaccuaauaugugggcggggucgaggccgcaagccccgcccagcaucgccaggccccgccccgccgugacgcaccuggaauuggcgcgacccagccggcgggaccccccgcgcccgccccccgcgcccuccccucccuugcggcccugccccgccccguccgcgcgccccccgucgcgcccggccgcgcccgccgcccucccgagcccacggggucugcaugcggugcccggcgcgcggggggcugcggcacggaggacuccgcgugggcggcgggcgcggggcccguggggcgcgcuuacuguccagauagugcuccaaguacauggcggucgccaucuucguccgcggccgcgcucggggu

SEQ ID NO: 191133 - RNA, 6710 nt, Homo sapiens
gcgauggggugcuggccugccaggagcacagauacagagcuagagcccagcgaggccugugcugcgaggggcugugcugugccaggggaggccccgcacccgggaagcccagaggagagugugcacucacggagcccuccuggcagggccgcgucucuggagcagcagacccgugucccucugggaggucaacugcggccucacagcugggccugucccagcacagcccuuguuggagggcgcacccccguguccucagcaccccaguguugagugcauugaccugcagaggggagccugugcuggucccgggcgucuguguggcuccugggugcccaucugcaccccuggcccugcucugggcuucaguggagccgugccaccgugggaguguccaggguccugacguagcccugagacguggccagcucccuggccugcugcccgcacagugggcccuugucucugcucugggucaggcgaggcagccacccaugaugagcucugcagccuucccaagguggcuggugagucccugcccuuugcacccccagcacccucaccccucuacccgggcgcccggggucaggacccgcuccugagguaucuguccagcuggccgcccccucugucugggggugcuggacgagucccacuccuugccaaccccaggguggcuccucagcucucaaacaaggggcgggcugcagggauuccgagggccccuccagcaagaggucccacaugcaucucccaaugggacacuuaccuggcccacagggugggugugacacugaggguuccugggggcagauucagggcaugggauggagacagacugguugugaggggcccaaugcagggggccggccccagcccacagggucguucugcagaugggcuggucggggacgcucuaccaggugaagggucuguggucggagucuucgcccuggccagggcccaggacgcucacggugcaggcugagggucagagccgccgagggcccccugccgggauucugugcaaagggccucugcacuuuaugugggugcaugugaaugccccucgccaagauguuccuacccugcaccugacacuucccacgacaagaagugcugaccccagagggugugcgcggaccccagagggugugcguggaccccagagggugugugcggaccccagagggugugcguggagggccuggucugaccucaaggcucuuggggcgcccacacaggaugggcugugagggguuggcgggggugggggggguggucugugauggcccccugcugagccagagugaccccuacaaccgguccagggguccacggaccagaaggccagguucuccuggaggucccaucuccccugggccucgguuuccccuucugugacuccacacccccaaggagggcccugucagggagggcggggggcacugguuaauguccaggacauggcugucccagucaagccaaaccccuggaaugugcugaacuggcuacacugagcggggcuggccuccgagacagaggggccugccgaggacacggaggcucuguggaacccagggaacuggucacacugaggacacggaggcucuguggaacccagggaacuggucacacugaggacacggaggcucuguggaacccagggccuggccacacugagcacggcuggucccccaagacagagggaccuccugaggacacagagucucuguggaacccagggccuggccacauggaggacacggaggcucuguggaacccagggccuggccguggcaaggaagccccaagccaagugugugucagccuuguccucucugugggccucaguuuccccucugugcaacaaggggagugaccagcugguuucuggagucuccuccucucccucucuguccccaggggugggccugggccucaugucugcagggggugcugacaccugcuccugugguccgggccuuggggagggagccaagugcagagagaaugucuugcuugugccugcucagcccagagggacacauggcgucugcaccugcuucccgcuugggcacaauugcccuuugagagcagagccaggggcuucuuggggacggaagcugcucucagaagccgcgcacugguggugggggagcagcaggaaggggccggccagcuguccuagccaagagccuuucaggaaccgguggcccagggcagagguggcuggagguggagcugucuguuugggccucaggugucggggcaaggccugcuuggguuuuacacgaguguugcgccuuuacccgggucucugucagugggucccgccugacccgugggugugcauggguccccgucguaggcaggcguucugcccuggccaggcgugguguccggcauccggccaucucccuccucccuccuucccuuagccccgcauccaggugccccgugugcccggccugggcggcuggccguggaucugaccgcuccugcaugguggaggaccagcguucccacugucugcagcugugccaccucccugugccgggcugugcgugcucacgcucggcuccgucugccuuugugcgaucagacugagagaccccccaggcaggucccgccugcaacaagcagaccccaugcgugccccaaaugcccccucacccgggcccugcccugguggguguugccugggagcaaacucccagaauggccgccgggccccacucggcuuuggagcuucugauuccugugggcgcuucucaggucagggcccugcaggugggaagcaccaggcacuggaaugagggcacuguggggccagcugccugcaggcaggggucugaucaccaagcaccuguccccugcaggaucccuggcuguggcucccccgaugacguucaggaagugggagccgauccccuguccccagagagccccgugacucccccgaugacguucaggaagugggagcggauccccuguccccagagagccccgugacucccccgaugacguucaggaagugggagcggauccccuguccccagagagccccgugacucccccgaugacguucaggaagugggagccgauccccuguccccagagagccccguggcucccacaggucccugugggcucaccucuuugugucucugcuguggcuuccacggugcuguggccucuauucuggggacacugagcuccuccuugcucgagguuuuggguccucauuguccacaugaccuccugcugggcgaauucugggaugacccuguguccugggcacauggcuggcagggucccgggggcucucuggccagccuccccugcacccuggcaccaaccagccuggccgagggucagcucccagagccguguugagaggggaaggggcugauuccacagacauuuggggugcagugggugcgagggagggugggggaggggcugcuccagaucuggggugagggagucagaaacagggcugaccccaagguggguacaggaagaggcccaggugugggcaggagcugucugcaccuccugagcgcguuccccaguccagaccgggagcgaguguggggcucccugggccugucuugcugaccuguggcccuguacugaccagcagagcaugggggucccucguaccccuucacggacagugcucuucgagcgggagaggacgggccugaccuaccgcgugcccucgcugcuccccgugccccccgggcccacccugcuggccuuuguggagcagcggcucagcccugacgacucccacgcccaccgccuggugcugaggaggggcacgcuggccgggggcuccgugcgggugagugaguggccgggggcucuguguggguguaguggccggaucugcuggggcugcacaccccgggauggggcggggguggcggcggcaggcagaugcccgagguagagaugagcaaaccaggcucagcgauccugggugcccugcggggggcugugcccaggucccuggacguccuggucagcggaacuuccuccucugggcaguggggugcccugcacgugcuggggacagcagcccuggcggagcaccgguccaugaaccccugcccugugcacgaugcuggcacgggcaccgucuuccucuucuucaucgcggugcugggccacacgccugaggccgugcagaucgccacgggaaggaacgccgcgcgccucugcuguguggccagccgugacgccggccucucguggggcagcgcccgggaccucaccgaggaggccaucgguggugccgugcaggguaggcgggcagggugccggucugggucccuuugauuggccacgguccacauggaagggagauuccagcgggaaauugccauucugccccaccccugucuccagccacaagggaaccaaccaucccuuuccccaggacuguucugcgccucccgucccaggcaaaucccucuccccaggaccguccugagccucccgucccagacaaaucccucuccccaggacuguucugcgccucccgucccaggcaaaucccucuccccaggaccguccugcaccucccgucccagacaaaucccucuccccaggaccguccugagccucccgucccagacaaaucccucuccccaggaccguccugagccucccgucccagacaaaucccucuccccaggaccguccugcaccucccgucccaggcaaauggguauugaucacccccagucacccagugggcaggagcaggcccucuauggcugacccgacucucucucaucccccccgcuaaucucuuuaucugcagaggagaaggcuggacgcugaggugucucucagcucccaaaccaacagccaccccgccccaccccuuccucuuauucuuuacucccuucucacccugcccagggccuggccaggccucacccacaacuuucccuccaccccauccucuguggccaccugaccccggcccgugggagcuacagcagggagugcagcagacacauggccaacccagggaccccacugcagggccucaugccccccgccugcccucugcucucucugugugggcagcgcucaccagccucccugggugccguccaccugggcucggcugcuaagagcugugagaggcuuguucagccugggaggacucagggcggcugggaugagucguguggaagggcggucagagugcgaugguccuaacccgaggcaccagccccuccuuccccgucccccugugccuuccuccagccccccgaccucggggacccagcagccccucccaccucugcccuccucccugcagacugggccacauucgcugugggucccggccacggcgugcagcugcccucaggccgccugcugguacccgccuacaccuaccgcguggaccgccgagaguguuuuggcaagaucugccggaccagcccucacuccuucgccuucuacagcgaugaccacggccgcaccuggcgcuguggaggccucgugcccaaccugcgcucaggcgagugccagcuggcggcgguggacggugggcaggccggcagcuuccucuacugcaaugcccggagcccacugggcagccgugugcaggcgcucagcacugacgagggcaccuccuuccugcccgcagagcgcguggcuucccugcccgagacugccuggggcugccagggcagcaucgugggcuucccagcccccgcccccaacaggccacgggaugacaguuggucagugggccccgggaguccccuccagccuccacuccucgguccuggaguccacgaacccccagaggaggcugcuguagacccccguggaggccaggugccuggugggcccuucagccgucugcagccucggggggauggccccaggcagccuggccccaggccuggggucaguggggaugugggguccuggacccuggcacuccccaugcccuuugcugccccgccccagagccccacguggcugcuguacucccacccaguggggcgcagggcucggcuacacauggguauccgccugagccaguccccgcuggacccgcgcagcuggacagagcccugggugaucuacgagggccccagcggcuacuccgaccuggcguccaucgggccggcuccugaggggggccugguuuuugccugccuguacgagagcggggccaggaccuccuaugaugagauuuccuuuuguacauucucccugcgugagguccuggagaacgugcccgccagccccaagccgcccaaccuuggggacaagccucgggggugcugcuggcccuccugacaggccuucuggccgugcccaugccccuugggugccuggggcagagggguggaauacguuggggugccccacgauagcuguggggggggcucuuagugcaagauccuguggauuagaaacaaguugcuccucagagcucucaagcagggacugcucuuuaggaaggggagcagcggcugggagugagcagggcagggugggggcagggugggggcacgaagugggcccugggugacccccacagcucccuuccgaggcugcagggccaggcgcgggaccgcagguagcccaggguguuguggguggcagcacuuguuuacuggcugcuuucuggcucgaaauaaaggaaucgugcuugugucggg

SEQ ID NO: 191134 - RNA, 62562 nt, Homo sapiens
cccacgccgcgccuuccgguugguccuugaggcgacgggugaggcacagcugagcgccaaagccacaggcuggggcgcuaacgcccccgcucagcgcucugcgcuccagacagcugcgagcuggaguaggaagguucaggcgguggcggagagugcgcuggaggcuggagggccaggaggcgggaagcuucccgcacgggggcgcugucaccugccugugggaggagccagagagggaccuggcucugcugcucugaagcaccggagucgggagaacccauccagacaugaagagcgccaaagguauugagaacuuggcuuuuguccccuccagcccagacauccugcgccgcuugucugcgucgcccucccaaaucgaagucucugccuuguccucugacccccaaagagagaauucucagccacaggagcuucagaagccccaggagccccagaagucaccagagccaucucugccuucagccccucccaaugucuccgaagagaagcuccggucacugucgcuguccgaguuugaggaggggucuuacggcuggaggaacuuccauccucaaugucuccagcgcugcaacacaccuggaggcuuucugcuucacuacugccucuuggccgucacgcaagguaaaguccagcgcccgcuugaggcucgggccaguggagagcgaggugggcacggcgagccagccgggggagagggcaggugcgcgggguccgugggacgguggacgcgcccugcaagguggccccggguuuggaacuugcuugcgcucucaccaaggucaaccuaccggcccccagccagccuuccaaaguucagcuucuccuuuaucacuacaguucaaacuugcaauacaagccuuuuucucuuuuguguuuuaccucaguuuagcggauucaagacuuacagggaagauuacaagaaccuuccuuugggaaagguauacccuggggaguuuauuuuacauuauaaagacaaaaauuuaccuaggcacucuuuaaagguauuuuacuuuuacauuuguuucauugccucaggggaaggaguaauacguuugcaggugggagugggaugccuuacaaggaagaaagcuaugaaaaaucuaucguauaaauuagauacagacauucauguuuugugaguguauuuaguuugagaguauguggucaccagaggagcccagugaguaaauuagcaaaggcucccgacguuguugagccuuaaucuucauuguguuacauuaguuauccagcaucuguuuuguucuaggaucucuuuuagguucucuugggaguuacagauucaguucagauuuauacccucaggggcuugcaaucuaagcucaguuuggaggagugauauccuggagggagaacagcucccuugaaagaaggcacagggaagguuaaagcugcuucugguguguucaauacagagguugaaggaaaauaggaaguuaaccugaguugacuuugaggaaggguggagaagagguggagaggagucaagaaggacaugccgaagcuuagcugaauuggaauguagauauuuuuuggucacuugagucauaguccgagaauauuuucuguauaaucagucaaggauuaauuggaagaaauacaaccuuagaaauauagauuuuagaggguuggaaacagcucauuuuuuaaguuaauagaaaacuaagucaaagccuaaguauacuuuuuguucuuauucuuccucuucaaggaacccagggccccuugcuuugcgcauuagaugcuaaguaaccauuuauugauugcaaguccgcugcagcucuucuacugaagguagauuuguguugaagaauuauuucccuguccacuuuucuugucccuaccaaaguuccccuccauuaaugucuugaucauaguuuuacaaaauugguaauugugaagcaucucagugucaaaggaaugcgaagauaaaaaaguuggacacaaguaaaaaaugucuuaucuuguguauuaucuuaaaauuccucugaaauuucuauauuauuccaaaauauaacauuuuauauuuaauauaaaauauugccuaaaauuguuaucaaauguaauugucacuccuagaaaauuugucagguuuagucuggagcagcaucuacccagagguccccaauuuaagaagcuuaaucugagauaauagugacccaauaggcugggcaugguggcucacgccuguaaucccagcacuuugggaggccgaggcgggcggaucaguugaggucagaacuuggauaccagccuggccaacauggugaaacccgucucuacuaaaaauacaaaaaauuauggccgggcgccguggcucacgccuguaauugcagcacuuugggaggcugaggcaggcagaucaacugaggucaggaguucgagaccagccuggccaacacggugaaaccccgucucuaccaaaaauacaaaaacuaguugggcauuguggcgcaugccugcaaucccagcuacuuggagggcugaggugggaaaaacacuugaacccaggaggcggaguuugaaguggaccgagaucgugucauugcacuccggccuaggcaacagagggaaacucugucucaaaacaaaacaaaacaccacaaaaauuagccgggugcgguggcacacgccuguagucccagcuauucaggaggcugaggcacgagaauggcuggaacccgggagguggagguugcagugagccgagauggcgccacugcacuccagccuggugacagagcgaggcaaggucucaaaaaaaaguauaauaauaaaaagugugacccaauaaauuacuaguuuacguuucaguuuaaguuugaaugccugaaaacuuuauugccauguuucucaaacaugauccuuaagaucauuuccaugguauauuuaaauauacauuuaauuggaaagaaaaacaaaauuucucgaaugaguuuauuuaacccagcauuucucaaagacaaacagggauucucuaaguacuuaauuuucuaaugugcuuccuauugucauucauuuacaacagagagauguaguauggagcguuuccugauuuuuuuguuuuuguuuuuuuaaguaguguucuuggaacuuguauagcauagaauucacuuuaagagucauuggauuaaugugcuauccuuccugaggaguuuacaaauuuuuuuuucaaagagaaguuuuaccauaaagacaauucuuucuauuaacuaauuuuuaaucaguauggcaagugauagggaaguugauuuuauuggaugcggaaaauuuuguauuauuagauaacguauaaaaaugucauccuaagauacuuuagguacuuuauuuugaaauccuaagaauuguaaauuggcuuauagucuuaugaaauggguauaaaaguaaaaaauaugucaugaguuuugaaacuuauuaaauuuguugaauuuauuuuuuuugaaauauauuuucagcuacggucuuaaucaaaauuuaaagagauuuguggagaucaugacuuguauguauauacucauucugguauugaaugaaaacaauuuaucauaccuaaguaaaaaggauaccuaguuaauucaaucagauguuuuuuauuuucaacuuauaguaauguuuaaacuccuguaaguuuaaucuauaucuggacuguuaaugaaugaaaacaauuuaucauaccuaaguaaaaggaaucucuaguuaauucaaucagauuuuuaaaauuuucaauuuauaguuauguuuaaaacuccuguaaguuuaaucuauaucuggacaggacauuuuuaaguaagucaaaauuuucagauuuucagucuuaccuuguuuaccuucuauuccuucacuauaguuauaauaaauauauguuuuuuucuuuuacuuugcauacaauuuagaaugcaagugguugaaagacuuauguuuacuuuugcucuagaauccuuuacaugguaacuuuaauaucuguaagaauguuagaaaaauauagggguuugagagcucaauuucuucuuccuaagacuaaaucaagguuaucucuuuuuuuggaguuggggagaggagggaagagauaaaguaauagucaaaguuaucucuugucauagauaaauauguuuaaggauugaauaauuugggaagcaauugagccuaacuguaguggccuauggggucucuugugccuuuuguagucuucugagugagguccaugggaguaugauauauuaauacuuggaaacucuaucaaacuggcuucacgggacuuuaccaguuugacuucaucauuuaaagaaaaaugaauuaaggcuaguuaacuauaauuuaguacguagcaagcaucagucuuguuggacaccugaaaauucacaaguguacaauuuaaaaagcaaacugggccaggcgcguuggcucacaccuguaaucccagcacuuugggaguccgaggcggguggaucaccugaggucaggauuucaagaccagccuggccaacauggugaaaccccaucucuacuaacaagauacaaaaaauuagccaggugugguggugcaugcguguaaucccaucuacuccagagccugaggcaggagaaucacuugaacccuggagguggagguggcggugagccgagaucgcgccauugcaguccagccugggcaaugaaagugaaacucugucucaaaaaaauaaauaaauaaaauaaaaauaaaaaauaaauaaacaaaaauaaaaagcaaacugauuuucaaggaaauauguuuagguugccuaacuuugaaacuuugaggcuuugaaaacugguacauuuuaagaaaaaaaagaaaugaauaaucaaacucuacuucauuguguuaauaaucuuaaucguaugguaaaauauuaaugaugcacaucaacuuuucuguuuuuuagguauuguaguuaauggccuaguaaauauuagcauuuccacuguugagaagcguuaugaaaugaagaguucccugacuggccugauuucaucaagcuacgauauuucauucuguuuguugucuuuauuuguaucauucuuuggugaaagaggacauaagccgagauggcuugcauuugcagccuuuaugauuggacugggagcacuuguauucucauugccacaauuuuucaguggagaauauaaauuggggucucuuuuugaagguaaguuucuauuguguuuauguuuguuuuaaucugaagaaguggauaaaacuaggucauuaacuuuauauugcaauucacuuacacaguaugguaaggguuuacaucucuuccacaccucacugguuuguucauugugugaacuguaugagauaggagauuagagagacuguacauuauucaucguuucagugguucuccaaguuuuuaagccucuaauucuuauuccccauauuauacacaguccuccucaagaagagaugacuuguuuuccuuugcagguugugaccucauuggaguucugagaucuuuaguuuuucccuuuuguacuuuuauuugcuguguuuacagcucugcacccuggacauguugauuccugauuugagacaaagagaggugacauuuagaaaaguggaaauuuuccuaagaaaugaaacuagcucuacuuuuggaccuagauaagaaacauagaacuucagagcaaccuacaguugcucucguuagauggagaaauauauuauucaaaggcucagaaaggaaauuuaauuauauacauauuuuuucccaaugacauuuuuaauaaaaaaacaaauauaguagagccagaacgguggacaaaugaaaguagaccuuaacauuuuaauguccuuccugggacuucuaauagcaaauauugaaauaauuagaaauaaaaucagaugguuauaaauucagaggcuuuauucacuuacuuaaccccugcaaauaaaagacaaaggauaauuggagucuguuaugcuauaggaauuauuuuuaagaaguuaagauuguuagauuuguuuguuaauauugaaaauuaguauuugcuauaguguggauguuugucccccuaaaccucauauuggagggagguguuugggucauggagauggaucauucaugaauacauuaaugcccugggaauggggucagugaguucuguuuguucccaacaaaacuguuuguuaaagagaguuugagcuaggcgugggggcucacgccuaaaaucauuucggaagacugaggcagaagaaucccuugagcucaggaguuagagaccagccugggcaauauagugagacucuacaaacaaaaaaagauucuggccccuccccuguagcucucuugcuuccucucuccccaugugaucucugugaucucuggcuagcugcccuuugccuucugcccugaguggaagcagcuagaggcccucacuagaagcaggugcuggcaguauguucuuguacaguagaacugugagccaaaucaauuucuuuucuauauaaauaccucagguguuccuuuuuagcaaugcaaauggacuaagacaauauuaaaguauuaaucuuucccaagaucaauuuuccaauucuagaaugauaacaaacaggaaaauauucucaauaacaaauuauauauuacacagcaugguuuuagaagugcacuuauuagguaaguaggcuucauuuuagaaguaaaaauagaauauguaagcggaugaauggagaguauuuuuaaaaugugguagaguuuggaaugaauaagauaaggagaauaaguuaucagcagagagagcacuuacauagauucuagcacauuaucugagauuggacaagacugcacaaggcaacuugacauaauuucacugggaauaguuuuaggaacaagccacauauugcagcguaggcuuuaguauaacacuauugaaaucuaaaucguaagggaauaucuaaauuuucaucugccacacaagaaaacauaauacugauucuaugauaguuauuuguucauagcauuuaggugguaaucuuugugcuguuucugggcccucaaccuuucaguugcucagaugccuugcuuguucuuaaguaaacaaaccuugcucgaaaaucuaugacucucuaaacugaaacguaaauacuucuuccaguacaaagccugaucugucuuccacgaucuucucagcuuccucucuugccauuuauaccuggaguuauagccauugugaagaacuuauuuuccuaaaggaaaauugccacaaauuaagguguuugugugugaccagaggugaagcuaagauugcugaagccagaucauaaacuuuuaguaguguacugugcagguuuucaccaaguucuuauugaucuaauuaacauuuuucauuauuuuaguagauuauugaaauagguuagaggaauuggcugaucuaagauuuuuacuguaaauugacucauaauuuaaauaauagcuuaaauguggcaaaugaaagcaaaaacucagcuugcccuccuguuauucugccauucauacaauauauauuuauugauauggacuacacaugguguugagauaacaccaguaaaacaguuccaugccaucuggauuuuauguacuagugggaagaaauaugcaauuaauaaacaaaugaacaagauaauugaaaauugaggugaguggguaaagagacaaauagaaugaaguaauacuguguuaaagguuaaguaugauugccaggaaaggcuacagugauaauaucuggauagugaagagcuaaccuugaaagauaauuuccaggcuggagaaaaauaugguuaagggcuuuggagcagaggagggcuugguagguuuuaggaauaguccguuuuggucagcauugucaaagcaagggaggcuguuuuggagaggcagguagacacuagggaggcauuuagauugugcuugaaaugcaaugcaaaguuguggaagaguuuuauacagggaagugcaugaucuuacuggaguuuaagagacaagaguaaaugggagccaaucacucuggaaauuuuuauuguaguccaggugggagauaaauguggcugagacuggggugguagcagcagagauccagaagaugaaugauucucaguguguuuuauaggaaaaagaaauaggacucuguuggauauauugugaaggaggaaugaaggaguccuugguauuuggcuugaucagcuggggccguuuuuacuagaagguggaagacuagguagaacagaauuagaaugaaauuaagaauucggguuuggaguuuuuuaguaugaacugcauauuauauauccaguguugcaguguauauccccaaaauacguguuuacauaaaugugcaagucauucacuugguuugauuccuagaagugcaaauacugaauuugaaggccuuccucauucuaguuuuugauagauaaugucacacugacuuucaggaagggauauauuaguuacucucccauuguuggugaaugaaaaugcaucacuguuguguugaauuuuugcauuuuuuuccccugugauuuuucuuaacagaagugucauugugguauguguagguguuuauaauaugacagacacaaaauucaggauugaaauugcauuacacauuuaaaggaauucagacauuuagaaacggaagggauguuagaaaugauaaaaccuggccgggcgcaaugacucaugccuguaaucccagcacuuuuggaggccaaggugggcggaucacaaggucaggaguucgaaaccagccuggccaacacagugaaaccccgucucuacuaaaaauacaaaaagaaaaaaaaaauuagccaugugugguggcauaugccuguagucccagcuacuugggagccugaggcaggagaaaugcuugaagcagggaggccgagguugcagugagcugaaaccguaccauugcacuccauccagccugggugacagagcagagacuccaucucaaaaaaaaaaaaaaaaaaaaaaagaagugaaaaaaccucuucuuuuuauaguguaagccuuagggcaagaggugaauugauuucacagaugguuaacaacaacuaaaacuaauccuaauuuuuaugguuuguuuauuguuuuucaaaaguguaugcuuauuacucauacuaaguuauuaacuauauugaaugauuuuaauauuuuuuaugaauuucaagcauuucuuccccaacuucuaguagucagguacaguggucuauauuaaucuacuuuugcaaguaugggaaucuauaacgaaaaaucugaauuauuugucaaacuuuagggagaguagagaagaaaacuuaggaaaaggaaacugcaaaaagaaaacagauuaguugaaagcuuccuguaaauuaauuagaggcaaggggauguguaaucuucuuaaguaacuuaacauaacauagagcauaauauuaauaaaugauuuuauuaauugaaauuauacauguaauuuaauuuaagauggacagugaggaaauuaacauacccuucugugcuuuuucuguuguucuuaagggaaaucaaaaucagggcucacuuuggaugggauaaucucuguaagaggaaacuaaaguaauauagcuaguaaguagaaaaaaacauaaaauaugauaaacauguaugauuucuacaggugugagaauaacacaaaagaacguuaagaacaaaaguuaagaagauauauuuugaaacagcguggacuuucuauuguguuguaaacaauaaauuuaaguagguuggagagaaaguguuuuuuuaagggaagcuuuuagaaagacauaagcauuagaggugauuaacuuugaauggagaugaucaaagggaaguugugguuguuacuggacuaaaaaaagagguaguauuaaaauuaagaggaacaaauacaugcuauuaagggcuaauuuuuuguacaaguuaacccaaacauagugucaaaacacuuuuaaauaagucauauuugacauucauuuugacuuacuucaacauaauauuaauaugacacaacauauuguaguaugacuuuaaaauauuuaaaaugcgauaaguaaaucuuuaccacguaacauuuuuuucaucuaagcaaucuuaauuucuuuuagaugaguguuauuuuaauguuaccaugcaaaauaaucuuuaugucucuuugagacuuugggagagaggcauuauuaaauacugaggaauuguagaaaaguaguuacuuagccuaguaaagcucuuuuuauuuauugaccaauaauuagauaauuuuuccuacguugcacuauaucuuuguuucucuuuuccaucuccuuucccucaaagaaaccuuaaaugauaaaaauucacauuagcuguagcacuaaauuucuaauuuuuuuuuuauuggcauuugagagagaaugcuucaucaaaggacuuugguuaugcuugguaacuacuuacaaaagcugugcuaggaaaaugauuacaguaggacucaaaguggacuuuacuucugguuacuauuuuaucuuuuuuucuuagaauacuuuuuucuuuaauggaaugcuugccuagauuugagaagaccuagggcaaagaauuuuagagguuuucaagcacaaauucaauacaggaagcuuuaauuuugcuuggccucugaguguuuuuccuuuuuugauauuauuuuuuacuuuacggaagucacuuauuuuucuuaaauuuuacuucuuuguaacugaaaugaauaaaggaguaauaagaagaggugauuuuuuuagauuagaagcuauaaugguguaauaaaacaaaugauucaauuuuaaauuuaauacauacaguaaaaggccuagagcuaccuuuuagcaauaguuaaugcucuagauaaaacuaucacaauuuuuuauaucagaggcuuuucagucuuucucauacuuccuagauaauaugaauuacccugagccaggcucaauggcucacaccuguaaucccagcacuuugggaggcugagguggguggauuacuugaggccaggaguuugagaccagccuggccaacauggugaaacccugucccuacuaaaaacacaaaaauuagccgggcaugguggcaggcaccuguaaucccagauacuugggaggcugaggcaggagaaucacuugaacccaggaggcggagguugcagggagcugagaucgggacacugcacuccagccugggcaacagugugagacuucgucucaaaaacaaacaaacaaaaaaaaauauauauguguguguguguguauauauguguguauauauuuguguguguguguguguguguguguguauguauauauaugaauuauccuggaugguugcuauuccuguuuaauacugccucuuggaaauccugauucaguaaguuuggaguaggacucaaucaauauuuuuaaaaaauuacccagguuaucuuagucuaauuuaggacauacauguccauuuuagugucugauuacuuuguaaagcuucuaacuguggauauagagagaaagguuucuuuuccuuuccagauuauugcuuuaugucuuccuuuaaaauaggaguuucacaaucaucaugaaaugcuaggugcucuaaugcagccaguuuuguugaaaugcaaaugaccaaacuucugaaauagaggaaacuuacagagaaaaauaaguaggaaaaaaaugugucaaugaaauuuuagcacaaacucauucucauuacaagcuauaguuugcugguagguagagguuuaaaaaauccauguccuuuagcaagagaaaaacauguccaaacauuucugaaaguacuaucugcagagaacaguuucuagaggcauuaggaauauguuaaaaauguguucaaugguugaaugaguuuggaaaaaaaaaaaagaagaacgcuaagcaguugucuuuauugcagcacuauaaagcaaaugcauucugugaaucuuuaguuagggguaugauauguagaguugaugaagaggcuccguuguuauacuuguccccuucauccugcuuucgccccuuacuuugucuuccucuagguaaaugaggcagugaacacacuuugguaaaaucugcucuaucugcuuuagguuuaacuaugugaauuugaaagcccuuguugaguuuagaaacuuuauuaugaucagcaccuagaacagcaugugauauagacuagguccuuaagaacuauuuguugaguugucacauauauuaaugaauggaguccuuugaugagguauauuaagagccuaaugccuuguccuuccacagaagacaguaagaguagguaauggcagauaaaggcaauuugggauucucuguccacauuuuccauaaacuugggcuaaaaaaauaggguaacauuuaaagagaauuuucucuuucucucucuucuucaucauauuuuuuucuggcgaccgaauuaggacaaauuauguuguuagaggcaaaaauuauuuuccguaaucuuuuugaguaagauuugagaucugaaaaauuugcagugugaaaaggaagcuaaaaugagaagcauauucagaaauaguagcagaaugcuuugauauucuacuuuugguuuuugucuuaaugacuugcuaagauguugauuucacuucagugcuucuaagaaaauucucuuuuaauguuccauuuuuuuagcccaaguuuauggaaaauguggacagagaaucccaaauugccuuuaucugccauuaccuacucuuacugucuucuguggaaggacaaggcauuaggcucuuaauguuaaaauguuagcaauucucuuuucauggacuuuuaaaaaucuuaauauauaaaaugaagugcucugauagggcauucaaguggccauaggcguaguugugucuaaccagauauauuguguggaagguaaugauuaagcaaugucuuuuuuuuuuuuuuuuuguagcuuccuuagaaagguuggugguuuguggcaggaaauaaaugaggaaauucuauuuucuuagucacuauucuuaaaaacgcacaaauuugccaguguguguuuuaauauauuuuuucuguuucauuuuaaugcuauuaguucauccuauuuaaugaaaguauucagcacuuuagcagagauaugagagucagaaauaagugaguuuaaguuuuugcucacacacugugauagaacuacagugauccuggagauaaguuucuuugacuauaaauuauguugauaauaaucaauaccacauagaagaguauacauauguggugauaaggcagugccugguguguggugagugcucauuaaauaguagcaaugaauaauaaagucuuuuuuuuuuuguggaugucacuugguguugacauauccccaaagucugaccaaacacuuuugaacuaguacauuagaaaggguuuuaauuagauauauuucuaagaucauauuguuacgagauaagaaaauaauucauuugguguagcucagcuuaauuggguccacuuagaauaacacauuaaaauauugccuuuuaaauagccaaguugccauuugaaaauaucuugaauuuuuugacuuugaacaugauauguacuuuguaaaauguucagaaaauaggaacacacaaacaaaaauggaauaaagaaagaaagaaagaguuuucaugguaacacaccuugguuauucaccguuaacacuguucagucuuuuaaaaauguauauacacauucauacguauauugucauacauaaacuacacuacacagucauuaacacacauucaugcacacauucacacucacauaauuuuauuaacauucacacaucuuuacaucacauucucacaaacacauucaaaauccuuguuugaaggaaacaagauuuuuaaucuaggaacguugacuucuuuuuacuuggaagauguguuggacacauuuuauauuaguaaagauggaguugcagaaucuuuuugcuuuucuauuauuucauuuuauaaaugacuuauuuaaccaacccuccuuuguuauauuuuuuauuaauacauuuaauuuuucugguuagagagguucuaugggucaugcagacaauuuggguaauacuaagaaguggaaagagaaaaaaacucaauucacuguuuuucuuuucucaaggaaaacagcuucggaauugucguacuguuuuucugugccuauuuuuaauacaguuaauaaaauauguugcaaccugugagcauuuucuugcauagcauucuguuuuacauuuuaaacauucucauagaacugaauuuuuacauauaaaaaguuuuuuauuauaaauuaacucaugaugaacauuucuauguuuaaagguuuuacuauauuucaauaauuauacgguauauaauauuuuggaauugacuuuuuuuagucugaguaauuuucugaauacucaucauguuguuguacauaucaauuguucuguucuuucuacugcugauuaguaauccaugguauggauguaccauaguuuguuuaaccauuugccuauuaaagaacaucugguuuguucccagauuuugguuauuacaaauaaagcuacaaacauuagugugcagauuuuugugugaacauaguuuucauuuuucuggaauagaugcccaggaguaaaacugcugggucauaugaaaauucuauguuuaguuuuuugagaaacugccaaacuguuuuccagauucacuguaucacuuuauauucccaucagcaauguaugagugacucgguuuauuugaauccuugccagcauuugguguagccauucuaauagguguacagugaaaucucguuguguuuuaauuuguauuucuuuaauggcugauaacauugagcaucuuugcuugugugaauuugcuaucugcauaucaucuuuggugaaaugucuuuucaugucuuuggauauuuguuucuuuacuguugaguuuagagagacauuuauguuuuccgaguacuaggucuugucacaugcuaguuugcaaauauuuucauccagucuguagcaugucuuuucauccucuuaacagggucuuucagagagugaaaauuuucaauuuaaauaaagucgaauuuaucaguuuuuuccuuuuauagauuaugcuuuuauugugaagacuaaaaacccuuugccuagcucugaucccuaagauuuucuucuauuuuuaaaaaaaguuuuauaguuuucuauuuuacauuuaagucugugauauauuuugaguuaauuuguauaaaagaugugagguuuaaaguuugauuuuuguuuauaaguguccauuugcucuagcuccauuugaaaagucuguccuucaaccauugaauuacuuuuguagcuuuucaaaaaucaguugggcauauuuguauagcuauauuucugggaucucuacucugcuccauugauauauguaucacuucaccaauaucacauucuugacuauuauacuuauauaagucuugaaauccuauagacauugcucucacuucauuguuauuuuuccauauugguuugccucauuccuuuuuauuucuauauaaauuuuagaauaaucuugucuauaucuacaaaauaucguaauaggauuuugagaggaauuguauuaaaccuugauaugguuugguuuuguguccccacucaaaucucaucucaaauucuaauccccaugauccccacaugucaagggagggaccuggugggagguuauuugaucaugggggugguuucccccaugcuguucuccugauagugagugaguucucaugagagcugaugguuuuauaaguguuugacaguucuuccuucacaugcucucucgccugcgaccauguaagauguaccugcuuccccuucagccgugauuguaaguuuccugaggccuaaauuuuuuucuuuauaaauuacccaguuucagguaguaucuuuauagcagugugaaaaugaacuaauacaaccuguauauuaauugggauauuaauugggauuaaacugauauaguuacuauguugggucuuccaauccaugaauauauauggauuuauacuccauuuauuuagauuuucuuuaauuuuuuucaucaguauuuuauauuuuuagcaugcaaguuauguauauauauuuuguuagauuaacaucuaaguauuucuuuuugcuuuuuuuugaaugauuguaaauaguacuguauuuuaaauuucaguuuccauauguucauugccaguauauggaaauacgguagauuuuuguauguuuuauuguguauucugcaauguuacugaauuaauugguucuugauauuauuuuguggauuccuugguguauucuauguagacagucauguuuucugcacauaggaacaguuuuauuacuuccuguaccuucuguauggcacuaauuuucuuucucuuuuuuuuuuuuuuuuuuuuuuuuuugccuuauugcacugguuagaacuuccaguacuauuuugaguaagaauggugagagugauuguucuuaccuucuucccuauauuaggcaagaaagcuuucagucuuucacuacugcugcauguuuuuauaaauacucuuuaucaaguugggaaaguucuacucuauuccucuuuuucugagaauuuuuaucaggaaucauuguugaauguugccaaacacuuguucugcaucaauuguucaugugauuucugaucaugugaucaugaucaugcgauuuuuuucuucuucaaucuguuaauacaguaguuaacauuuuuugauuuuuuugaugccagccuugcaucccagaauaaaccucaccuggcaaugguguacaauucuuuggauauauuugugaauucuguuugguacuauuuuguuaagcauuuuugugucuauauucauaagggauauuaguuuuuauuuucuuuuauguacugucucuauuuggcuuuguaguuuuuguggauuuuaggggauuauaaacuucauacaauaaauugagaaauguuccuccucuacuauuuucugaaauugauuuuaauuuuucuuuauauguuuguuagaauucugcaagugaaacuauuugagccuauagauuucuguuuggggaguuucuuaauuaaaaaaguuaauacucuuaauaguuaucuuuaauaguaauucaaaucuauuagguuggugcaagaguaauugugauuuuugucauuacuuuuaauggcaaaaacugcaguuacuucugcaccaaccuuauacuucguuuugggugaguagauauaauuuaugcuuuuuauguaauugacccauuucaucuaaguugucaaauuuauguauauaaagcuaacuguuccuaguauuuauuuauuauauuuucuuugucugcuggaucuguugugaaauccuuugcuugauuccugauauugauaguauuugucuacuuuuucuuauucuuugucagucuugcuagauguagccaauuaaauucaucuuuucagaaaaugaacuuuuaguuucauugauuuuucucuauaguuuucuauuuuccaauuuauugauuucugcucuuuauuuucuuccuucuacuuauuuuaaauuuauucuauuauuauuuuucucuaggugggugacauggaagcuuagauuauugauuuuauuuuuauuuuuucuaauguaugcauuuuagugcuauaaaauuuucuuucaguacugcuugaguuguauuucacuauuguuauauauuguguuuucauuuuuacuuaauucagugaauuuuuuuauuuccuuagagacuuccuuuuugacccauagauuauuugaaagugugagagcauguuguuuaguuuccaauauuuggagauauuuuuguuaucauuuuguuaaugauguuucauuagauuccauuguagucagaaaacauacuauguaggauuugaauuuuuaaaaauuuauuaagguuuacucuauggcgcaggaugugaucugccuuggcauauguucugugggcguuugaaaagaaaauguauuuugcuauuguuuggcagagugcuuaaaaaauguugguuagauccuguugguagaugugguugauaaguuaguuuauauccuugcuaauuuucuguucuaucaguugcucagagagggguuuugaaaucuuuuauuguaauuguggguuugucuguuccuccuuucauucuauaaauuucugcuucauguuuuacagcucuaugauggugaaaacauguuacucuucuugguaaauugacuauuuuuucauuauguaaugucucucugugucaaguaaauuuuuuugcucuaaagucaguuucagcugauauuaauauggcuacuccuacauuauuuugauuaaugcuuggaugauauguuuuuucccccaaucuuuaaauuucagccugcccacauuacugcauuugaagugaauuucuuguagauggcauaguuggguuguuuuuuuuauucacuaugucaauauccuuuaauuguaauauucagaccauuuacauguaauguaaauacuaguauguuaaaguuuaaaccuguacuuuuaauauuuuguuuuguguuuguucuuuguuuuuuguuucucuauuaucugcuucuugcuuuccugaaugugaguugcuugaacaguuuuagaauuccauuuugauuuaucuguaguguuuugaguauauuucuuuguauaacuuuuugaguguuuuuuucuagguacugcauuacauguauguaaguauagucuuuguauuauauuauuagacucugguucuuauuuaaaucuucugucuuaacuacuugacgcuguucugauggcuuugaggugggggugggugaggccuuauuugccgaguggcaucgaaguccaaguucaccucuuggccucaauugacaccuaguaggaagacaggcuccuuguuacuguuggguggugguggcaguccuggaucuccacuagaacuccacugauaucauucucucugggaaugguagaagugacuugcuacucuucuacugacaccacagagaagaaguauggccuaauuccaacuagacuacaguguaaguucugacucuucacuaggcuuccucuuguacuagcagagagggagugggggugcuucuguugcuacauagagcuggaaacccaggcuaccaguguagauuucacuggcacgaggggugaggaucauuaccucuugauggagguagaagucccggaucccuucucauccuucucugacaccacccuggaagggggauggggcaccuuguuacaccauauauugcaggggugagugugggugagauugcaguuuuucucugugguauuugacuagaguagcauguuuacuguauaauuuuucugccuugccaagcugcuucuuucuugaucuuuuggcuagaaugaugauaauuuucuugugccucuuuuuuuuguuuuguaugcagccuuuggcauuuguggguugcuaacuuauucagcugaaaaucugggauagauuaagcaaaaauaaaacccaggaaacucaccacuauguucguuggguacugucuagggaacuaaggagcggcaauggauuggugccucucacuacuauagcuaauaauccacuuaauggaauucuuacacccugccuuguugaauucuaguacccaagggauuuaaguuuccaucaaggcacacagucauuauucccuuaaauccaaagcuuaacaauaacuguucgcuaauccuuuuugaucucuucauaguaaauauucaacagggagaguucacuaaauugacagagcuaauggauccuaguuaccaagggaaaauugaguuguuccuuuccaguugcaaggaacaguauauuuuuggacugcaagauucacuuaggugccgcuuaacacuccuauacccaauaguacuuguuaaaagaaaacuucaguaacucaauagggaaagaagagcuggagacuuguaaaagacgguaaaauaccugacuaguuaagguauaggcagugguaaagggaacaagaacugcaugauagaaggaagcuaugcuugucaguugggcccucugaccaacuauagaaagagaacuauggagcugguuaauugucgcccugcucuuguuuucgucugccaccuucgaugcagaccaccgcuggggcuaacacuucaguguugcuuucaggugggagaauaacugaaugcauguuaucucaugaugauauuuugcagauagcuuuuuguggguuucuuaugugggagacauacagauuuuuaaauucagaugaagauaaaaguggaugcuaaagaaggagggggagcuguguuggauauucuguguccuuccagggccaauauuuacuauucaugacuuuugcuuugugcuuuaguagaaaaauccaacagacugugucaaucuggcacuuuucucugcccuggauuguaguuggguuagcuaauaggaguuugcauauugggaagaaagaggucccaagugugcauuuuccugguguccuccccacuggugugguuuggaguggcugugugccacuguaaccuucuaggauuuaagucuguuuguauaagggcuaaauuuaaauauuuuuaaugaccuaggacuguuuuguuucuuuugacacuuuuguuaugauucuaaccagucuuuuucaaaagugauuuauagagcacuaguucugggagauguuagacauuaaugaagaaaaaacuaacuugaauauaugauagaugauuuuuaaagauaauauucuuuaucauguuacauauaaauaagugauuauuccacuuguuauucgagaaccaagaagauuuacgaagcacacaaagccuuuguuugccugugcauucugaaauuauuuagaagugcuugugacacgugauauacaguauacugcugguguucucuacaaagaagauucucaguaguccaaguguauuugugacuuggagucucucuucaaagucuacucuaaacuauguccuggugaugaccauucaugucauaguuuccuggccuccaauuaugcagggugaccuauagagauuuacauacauacuuuuacaguauagugauauuucuuuaaauuauauauuuaaguauuuuguucuaugauuuuaguuuucuuucuuagguacaucaacuauuucaacuaugcguauauaugaucuuauuuggccuccuuauguuaacauuucuucuuuuuuaucaugaauuuugcucacuuuccucauuuguacucuauaugcccauaacuauguuuucucagucaguuuacccaugugccccuuuccguuguaucuucuuuucuaugggguuuuaguuuuuuccuuuuacuuuuuucugucaggauuugaucuccucuuucuuuccuucaucauuucuuuucuuuuacuucauuuauuuauauaaaucauugccucaucucgugaugaacuauguguucacauuucucauuugcuccaugaaaauauuuuuguggucagugcccuaaucuuaauuuuaauaaaauuaugcugccuuuuuuuucuuaugacaucuuucuguaaaugccgugguaaccagagaugugguaccagagaugacaggagaggaauguaggauugagcuaaauuccccaggccagaagaugcuguuuagacucgggguggucaacuauaaacaaaagcagcagcucuuucuccuuccucagggcagugguuaggagguuaggagaugaggagugaggcugaggaaagaaaaguacagcuacccccugggaaaggagaaagagagaugguguuuguuuaaaguuagccacgucaaagcaccugaugcagguaacuggggagacuggguucccucaaaacuaggcuucuuuacuccccucuccaggaugcauagauacacaucuccugggaaucuuaucaaauguguggcuggggaaguggaaucacaucacagcagaguccauucugcccuaccccuggcagcaggauaggcccaggggaaaagagguaccuuuagccucuaggucuuuagggcaaaugcuuggagagcagcaggcugugggucuuugauugggguuaagcauuuggcugagcuugguauuuaucuucugaauguuuugacauaugguauguggauuuccuuuugucuuuuugucacagaccugccaauauuaguggguaagacuggccacuucuuuguucauuagguacaguucuaauccuuaauuuuauuggcaguguuccucuaaauuuauaaacaacguaggagcuuccacuugugguguaucgucaaaucacaugccuuuuaauuaauguugaaauuacaguauccaugggggauugguuccaggacccccauggauaacaaaaucugcaugcucaagucccuucuauaaaaugguguguuauuuguauacaaucuaccuacauccuccuauaaacuuuaaaucaucucuagauuacaaauaauagcuaaugucguguaaaugcuauguaaauaauuauaguauauuuuuauuuauauuucuuuuauugguguauuguuauuuuucuucccugaauauuuuugaucugugguugguugaauccacagauauggaaccuguggauauggagggcuaacuguauuuggucagaaauuguuugauuuuucauuagaaguugaaauucuagguucaaaugguuuccucaacuaauaaucucacaaaauucauugaauagguaaaucuagcuauuuuauaaacuguauuauaaaaguacaauuugcuucugauuaucuuaagguacacauggcaucucugaaugaaguauuucucuauaggcuaaaauguacccuuuaguaguguuuuucagggcaaguucauuuuaugagauuuaauagguuuaaauaauauagguuuaaauauuuuucuuugucuuuauauuugaaugacaauuuggcuaagcauaaaauauaagggucacauuaucuugcacugguuacuuuuuuggcaucccuuuacugccucuaugggauuaauguugcuuuagggaagucugaauguaagcuuauguuuuuuauuuccuucugcauaagugacuuuaucuucuugucuagcuguucaaaaaagucuuuucaucuuuaaaauucacagacuuuacaagggaauauuuugguguugaaaguccugcaucagauuuuccugggauucuccauaucuuuuuaaaucauagaucaauuuuaauuauagaaaauuuuccuuaauuuuaccuuuaaacauauuuauuuuucuauuuugguugauuauaccuauguuugauugccuuugucugaauucuauaucuguaauuuucucuguaaccuuuuaaaucuuggugucuuauuuuuccuuuauuuaauuuuguucauauuucucaagucuauucucucugucauaauucucacagucucuauucuuuuuugaccauuccagggugaccuccauuucugauaguuuuguucuuuuauguuuuauagaacaaaacaugauacugaguuauuuagcccauguuuguguuuuuuucuuuucuuucucuauuucacugcauuucuuucuuucuuucuuucuuuuuuugagaugaagucuugcuuuucugcccaggcuggagugcaguggcucacugcaaccuccuccucccggguuccagcaauucuucugcccucagccucccgaguagcugggacuacaggggugugccaccacacuuggcuaauuuuuguauuuucaguagagacggguuuuaccauguuggcaaugcuagucucaaacuccugaccucaagugauccacccaccuuguccuuccaaaguacuggaauuauagguguaagccaucacgcccugccucaacacauuucuaugagcuuauuaaauccccguuuugagcucuggauuuuaagaggcaauuguuuccauuccuuuuuuaaguauggcaauauaguaauuuuaaaaucuacauuaaugacaguauuuuucuggagacuguucucccuuacuagccauuuguuuuucuuuuuugauuauuauucaacuuugaaugaggugaauuauuccuugucagcuuuuugugggauguuuguauuagauuucauaauacaggaccaccuguauuaugaaaauggaucaauuaaauagagcuuuucaugaagcacuguaaaauggguuauagcuggguugacauauugaugccuuuaaaccuuagaaagcugaaguaauaacaagagauuugugcuggagugggauugcacagauuagugacacaagaucaagccgccauaaauaaaccccagauagucaaguuaguaaaagaugugcuuuuugguuaaugcaauagaaugcuggaucucugucuucucccacuaaaagauauuacauaugaauuaacuuagcacuucacagcccugcuuccuuucucaauguaugccuguauuauucacauuuucuacuuggggccugccuggaugccucugcuuucucaaguuagcuaauugucugauuauauucaccagagcugaucuaauuggcuuauugcgaucaccugggcugagcuaauuggcuuaauguauuuacccgaguugcaaaagaugaccucugaccuacuuuucuucugaggccuuuuucgcaacauauacacacauauuacauagacauagccaugugauccauucuguguguauauguuuauccaccuaucuuauaucuaaauaaaguaguaaaaaugcuaagauaaaaccauuguuuguguaauuauggaauaaggaacagucauguaccaaacucagaaccuaggaaaauugaacuaauugaaaaauuaguucacagaaaaaaaugcaagugacaauaaauguauggaaaaaugcuuaaugucacugauuuuaaaaaugaaauuuaaaaaauuauauauauauauuuuuaaccaaugagauugguagucauuuaaguuuuauuauguaaaguguuaaugaauuguuggugggauugcauauuuguaugacuuuuugauaaagugguuuggcaguaucaaaauauaaauauuuauucacuuugaccuagcaguuucacucuuuguaaccuguccuauagauaggcuugcccaaaaugugccaggguaaacuuaaaaaaauauguacaucauaacauucugauggaaauaagaaaaugaucuaaaccuauguauaauacaauauaauauuaauaauauuuauuauuaaauacaugugcuggacuaggcaauaaaauuacaggacauuuaugcuauagaauauuaugacagugacaauaaauaaauuuaaauauagcuuuaagugcuaauaucagagacguccgggacauaauaagugaaaacuggacauuguugaauauaaagauaguauguuuuauuaugacuauaauuguguaaaaaaauuaaaugggguauacaacacguaaaugugugaguaaaugucugaaaaacugaaaagaacuguugacagugguuacccccaucuaagugacagaggugaauaggagugaauaggccuucauaaagugagggcaggcugggguaagaaaguguauuuuucuuuugauguauuuuuaaauaguuuaaaucaaaguaaaaugauuggaagaaauaaauaagguuauauuauauuaggcaaguguaauuuauaugauagaaauuuaaauuauuagcugaauuucuauaaauucacaauuuuuuuuuccacaaagacacuuguguaacaacaaggaauagcaccaguuguacaucuucaacuucuucacuuucuaacuacuuguaugucuucaucuugggacaacuauugcugggggcaggaggaacuccucuuuauacucugggaacagccuuucuugaugauucugugcccacacacaagucuucucucuauauagguaaguuuacucucuaaacugucucaguaucacuuuaucuuauuauuuguucacuuuagaaguaaaguauaacauaggcuuacuaaaaaguuaguuguaaugccauagguuuucccaauaaauaaaugcaguauuacuuuuguuuuauuuccugccaaauaaugucaguaaauauaaauuauaaugauuuuuguugauccucugcuguauuucuugcucuaggcaugccagcuuugcaggacaggaauagccauuuaagcagcauucucuuuagauugcuugaaucuuaggguaacuuucacaagugacauagaggcaaaucucuacaagguguagagauugagcucugccauucugugugauuuaugacauccuauauugacuuacaguccacaaaagaaaccauuguuucuccuuugugaucuaauuccugguagcauaaguuucucuuaaauuccuucucuuauguuccugcaagguaaagcuaacuagacaaugcacagcccuacaucuaauuauugaauacuuuauuugcauaugaguuuucucuuuaucagucuguuaaucuaacauaggagauucauuaccacagcauuuggaagacaguauguucaguguagccuaagccacugaggaucucacagauaccauuggcuuugauuacagccagaguauucaaauggagaauacacugcugcgcccacccagaaucaaacccaaaggguaccuacccaaccaacaccauagauauaucuauaggaauaugucuuauccugugaaaacuacucaguaaaauuggaagagugacuguuacuccaacugugcagguaucaauauaguaacaagcaaaagcaaaaacaugaaaaagcaaggaaacauggcacuuugaaagacauacaauaauuauacaguaacagaaucaaaauaaaauaaaaaucugugaaaugccuaaaaaggaauuugagcuaauggucuuaaagaaacucaguacgauaucaagggaacucagauaaacaacacaaggaaaucaaggaaacaauucaugaucugaaugagaaauucaagagagauagaugucauuaaaaauaaccaaauagaaaucaugcaacugaugaauuaaaugaaugaaauuacaaguguaguugaaugaaaaauuacaguugagagcuuuaacaauagacuagaucaaacagaaagaauuucugaccacgaagagcggucuuuugaaauaacccagucaaacaacacagcaaacaaaaugaaaaaaaaaauaaagaaagcuuaugugacauaugggcacuauuaaguauacaaauauuugaauuuuaggaauuucagaaggagaagaaaugggaaaagguauagaaaauccauauaaugaaauaaugcugaaaacaucucaaauugugggugagaaauuagacauccagguacaggaagcucagggauucccaaauagauucaacccagaaggguccucuucaagguguauuauauucaaacuggcaaaaaucaaagacaaagauaauucuaaaaauaacaaaagaagagcgucaagucacauauggaggaauucccauuagaaagauuucucagcagaaaccuuacaggucaggagacaauuggaugauauauuuaagaaugcucaaaggcaggggucugggggugggagggacacagcugucugucaagaauacuauauccagcaaagcuauucuucagaaauaaaggugaaauaaaguauuucccaggcaagcaaaaauugagggagugcaucaucacuagaccggcccuacaaaaaaugcuuaaaggaguucuacaucuggaagcaaaaggacaauaauuaccacccugaacacaagugaaagcauaaaacucaauggcagagaagauacuuaagaaaaagaaaggaaucaaauguuaucacuacaggaaacugccaaacuacuaagaugaacgagagaggaagaaaugaacaaaggauauauaaaacaaucagaaaacaauuaucaaugauaacaaccuugaauguaaauaguuuaaauucccuaauuaaaaauauagauaggcugaauggauuaagaaaguauaucuaaccauaugcugccuagaagaaacucauuucaacuguaaagacacacuuagacugaaagugaagggauaaaaaagauauuuaguuguaauuguaaaccaaaaggguguggcaguagcuauauuuaaauuagacaaaauagucuaagucaaaaaauacaagaaagagacaaagaauaucauuuuacaauuacaaauucaccaagaauacaaaaauaaauucacuaagaagauauagcaauuauaaucgaauaugcacccaacaccagagcaugcacauauauaaaucaaauauuauuagaguuaaagaaauggaccccaacauaauaacaguugggaacuuuaaugccccacuuccagcacugggaagaucaucuaggcagaaaaucagugaauaauauugcacuuaaacuucaguauagaccaaauugaccuaacagguauauacggaacauuuuauccagcagcuacaggauacauguucuucuuuucagcacauggaacauucuccaggguagaccauaugaagccacaaaguaagucucaaaaaacuuuuaaauauuaauaauauaucagguauauucucugacuacagugaaaaaaaacuagaaaucaauaaugaggaacuucuggaacuauacaaauagaugaaaauuaaucaucaugcugcugagcaaccaauaugccaaugaagaaauuaagaaggaauuacaugaaauuagaaauacaauaaaccaaaucuuaugagguacagcaaaagcaaugcuaacagggaauuuuauaccaauaaacaccuacaucauaaaaauagauuucaaauaaaccaccuaaugauguaccucaaggaaauggaaaagcaagaacaaacaaacccaaaauuagaaggaaagaaauaauaaagacuauaacagaacuaaacaagaguuacaagaguuaaaaaaaaaaaaaacuacagaagaucaaugaaaugaaaauugguuuuuuggaaaagauaaaauaaagccauuugcuagacuuaaaaaaagagagaagaccuaaauaagugaaaucagaaacaaaauagaaggcaucacagcugauaccacagaaaaacaaaggauuguuagucuuacuaacaaauacauccaacaaauugaaaaaccuggagaaaauggauaaauuccuaggcacauacaaccuaccaagauugauccaggaagaaauagaaaacuuggucagacaaauaacauguaaugagauugaaucaauaauaaaaagucuccuaugaaacaaaagcccagggcuggauggcuucacugcugaagucuauaaaacuuguaaagaagaacuuagcaccaguucuuuucaaacuauuccagauaguugaagaggagagaauucuuccuaacuuauucugagaccaguauuacccugaugccaaaaccagagaaaaacagaauguaaagaggagcuacaagccaauaucccuaaugaacauagauacaaauuccucaacaaaauuauagcuagccaaauucaauggcacaucaaaaaauaauacaccauguucaaguggaauugaucucagugaugcaagaauuaguuugccauauggaaaucaauaaauaugauacaucacauaaacagaaugaaggacaaauaucacaugaucaucucuguagauguagaaauguauuugaugaaacucaauaucccuucaugauaaaaacuuuuaagaaauuagguauaaaaggaacguacaucaacacaguaaaggccguauauggaaaacccacagcuaacguuauacugaaugagaaaaagcugaaagccuuuccucuaagaacugaagcacaagaaagcccacuuucuguuuuuuuucuuuucuuuucuuuucuuuuuugagauggaaucucgcucuugucacccaggcuggagugcaguggugcgaucucugcucauugcaaccucugcuuccuggguuuaagugauucuccugccucagccucccaaguagcugggauuacaggcaccugccaccacaccuggcuaauuuuuguauuuuuaguagagacaggguuucaccacguuggccauacuggucucgaacuccugaccucagauaauccacccaccucggccucccaaagugcuaggauuacaggugugagacaccaggccuggcugaaggcccacuuucaucacucuuauucaacaugguacuggaaguccuauucagagcacuuaggcaagagaaagaaauaagggacaucaaaauuggagaagaggaagccaaauugucucucuccacagaugacauagucuuacauaaaaacaucuaaagacuccaccaaaaaacucuuagaacuauuaaauaaauucagugaaguuucaggguacaaagucacauuaaaaaaaucaguaguauuucuuuacaccaaugaugaacuaguugaaaaauauaucaagaaaguaauaucauuuauaaugguuacaaagaaauacauaggaacaaauuuaacccaggaggcgagaaucuuuaaaggaaaacuacaaaacacugaugacagaaacugaaaacagaaaaaaaauggaaaggcaucccaugcucauggauucaaagagugaauauuguugaaaugacugucuauacuacccaaagcaauguacagauucaaugcaaucccuaucaaaauuccaaugucacuuuucacagacauggaaaaacaguccuaaaauucauacggaacuagaaaagaugccaaauagccaaaacaauccugagcacaaagaacaaaaccgaaagcaucacacuaucugauuucaaauuauacaacaaagcuuuaguaaucaaaaaaggaugguguugguaucaaaacagacacauugaccaauggaacagaauagagaacucagaaauaaaucuauguauuuauggccaacugauuuuugcuaaagauaccaaggauauacacuggggacucuuuaauaaauggugcuguaauaacuggauauugauaugcagaagaauacaacuagaccccuaucucacaccauauacaaaaaucaacucaaaauggauuagagacuuaaauguaagacucagaacuauaaaauuaccagaggaaaacauaggggaaacacuuuaguacauuguuccaggcaaagauuauauggcuaagacugcaaaagcauaggcaacgaaaacaaaauuagacaaauggggcuauaucaagcuaaaaaguugcugcacagcacacgaaacaaucaucagauuguagagacaaccuauaaaacaggaggaauuauuugcagacuguucauccaacaaaggucuaauuuccagaauauauaaagaacuuuaacaacucaacagcaaaauguccaaauaaucuaauuauaaaauaagcaaagaaucuauauagccauuuuucaaaauaagauauacagaugaccaccauguguccccauguuauuguagcgcuucccacaauagcuaagagauggaaucaagcuaaauauucgucaacagaugaauaaagaaaaugcgaaauguauauacaacaggauacuauucagccauaaaaaaaaaagaauccugucauucauaguaacaugggugagccuagaggacauccuguuaaaugaaacaagucaggcacagaagauaaauauugcauguucuuacugguaugugggagcuaaaaagaaaaaauaucagcucauagaauuugagaauagaauuacgguuauuaaaggcuggggaagauaugggaaggggaggauauggagagauuuguuaauggauagaaaacuacaguuaggagaaauaaauucugguguucuauauagcacuguagauugaauauaguuaaccauuacucauuguauauguucaaaaagcuagaagaggggauguugaauguucccaacauaaacaagucauaaauguaugaggugaugggugugcuaauuacuacgauuugaucauuacacauuguauagauguauugacacauaaccauguacacucuaaaucuguacaaugguuaugugucaacuaaaaaaggggaaaaaaagugaaacuauauucaacugacuccccaaaauacuugggagcuuaaauaaacagcaacaacaacaacaauaaaaagacaugaguggucaaauaacuuuuguuuuaugaaaauucagaguuauauauggcaacauuuuaaauaucucacagauagaaauaagcucaauuuaauucuacugcaaguaaaaauagggagagucccuacccuaagagcaagaaaucuaauggcuuacuuuuaagaaauagacugaucagcacauccagauuugaagucagcugcuguagugcaaaauacaaaauucugucugaguugugcagaguagaaaagacuucuuguuucacauugcuugcauuguuuucuucaugauauuguaaaguguaacuaugaucacuaucaguaaaggauaaaugguagauauacuaccucuacugccaguuaacaacacuuuccauggauuuauaauuuuugguuuuguucuaaguauuacuacaaauagcuuuuauauugaguuauguguuuuaggauuuuugacuugacuaucaauucaaaugguauuguuuuagugaaaauaugugugauuuugauauguuuaauuguuuagauuuuucuguaguaaaauauuuguuuucacuguuagauaugcaaagugaaguuguacauaugacuguauucaaugucucuguucuucuucuaggaaccgguuaugcuaugucaaucuuaggcccugcuauuggcuauguauugggaggacaacugcuaaccauauacauugauguugcuaugggagaaaggcaaggcaguaucuauuuuucuuuuauuuaaagucauuuuauuuuaauuaugccagcaucauagacagaacauuuucacaguacuucccucaguauagcaugaggaauuauucaggaaacaaaauugaauacaaagaauucuuauauaauaucuuauuuggcugcauuaccuuuugggucagugcuauaccaucuuuuauuauaauaacauauuuucauaaauaauauuuaauaaagucaucuggugaaauuuuuaaaaauaaguauguaggaccccaugcauuguucaaaaauaagaauucaauaaaaauuagcaguauuuuccauagauuuaguugggacuagauagucugaagagucucaagagucugugauucucagaaaauguuccauaguaacucugauaaugucagagaucacaauuaugccauuuuaacaaugaugacaaugaaagauaguaauagauaauauuuauuuguccuaugcuauauaccagacaccauauguuuugaguguuaacuuauuuuaugugcuaucuuauuuaauccucucaaguauucugcaaaguaguugauacgcacagguugguaaguggcuaagacaugaauuaaaguagaucucuuugacuccaaaauucaacacugaguuacuuaccuucuccauuuccugauuagagaaauuugugccuuuacugaggucauauuuuuuuucauuuugccacugggaauaauaacugcacaauccucuacaugaccaugagcagugaauauaaaaauguggucauagguaugugauuuguucucuaaacuguuaguccuagguuaaucuuucacagccuauaaaaaggcaugcagaagaacucuugaauuagugacccagagauuuaagaaaggacauuuuaauuucaguggaaaauuacaggaguuguaggauuaguguauuuucggaaagggccaaaguguauuaaaauaugagacuccuggcucggcacaguggcucauaccuguaauccuagcacuuugggauaucaaaguguaaggaucacuugaggccaggaguggcuugugccugaagucccagcuacuugggaggcuaaaaugggagaaucacuugaacccagggguucaaggcugcagugaacuaugaucaugcaauugcaccccagccugggugacagacugagacccuguuucaaagaaauaaauagacaaauaaauaguugcuuuaagacuaauuuuacauuaaagaaaugcucuaauugaagcacacucuggacuuuuaacacagaucagugauuugcugugauauauauuuaauuuaauacaguagagaagaaaauucagccaaaguuaaaagaauguugagaaauucuacauaucuuuucaaauauuugucauauuuacuauuagauauuuuaaacuuuugugucauauuugccauuuuuaaacauuuuguaaaccauuauucuuauaacucucaauuaugucugcuaccuguuuucugauucuuugcaauggcaccauuaaacuguuggauauuauaaucauauucuacuauaugcacuugaaguauaaaguauaugauuauccuaacugaguuuuaauuaauaagguagaguugacuuuuaccucuuguuuuucuaucauauagcacugaugucacugaggaugauccgcgaugguugggagcuugguggauuggguuucuucuaucauggaucuuugcuuggucuuuaauaauaccuuuuucuugcuuuccaaaacauuuaccagguaaacaugcuuucuuuaaaaccagagagguuuauuuuaauuguaggccaguugcuauuuucuauaugauuaauaagaacuauagauucacccuguuucuuuuauagaaucucaacugucugccuauguaaacuuuugaauauucuucauucuagaaaauauuggguaacaaucuuaauauucauguuuuuuuaauuuccaauuaauaauaaaacuaugaauauuuaccucuuuaguacuuaauaaauuuguuucuuauguuuuaucugcaauucugcuuuauguguaugcaagguacaacgucuuuuaaacuguuaguuuguauucaguuagucauuaauuucaaucugucuuaaaucauucauguuaauuauuuguaguuaaaagugcaaguacuuuuuuuuuuaaguuaucacugaagucauuccguagcguacuuuuuuuuuuuuuacuguaugugaauauuaaacauuauuuucuuucuuucuuuuauguuuuuugagacagagucucccucuguugcccagacuggagugcaguggcacgaucuccgcucacugcaaccucugccucccgaguucaagcaauucuccugacuuagccuccugaguagcugggacuacaggcaugugccaccacucucggcuaauuuuguauuuuuauuagagaugggguuuugccauguuggccaggcuggucucgaacuccugaccucaggugaucugucugccucagccucucaaagugcugugauuacaggcaugagccaccacauccggcuugaauacuaaacauucuauauaaaaagaaaagguuaauaagaaagacuauucauuuuucucuaugagcucuugcuucuguaaaaucauguaguuaaaauucauaucuguagaaguauuuuucuuuagguugaagguauuuaguuguuuacauuguuauuugcagcaggauagauuauuaacuuuuggaaaugggcaagagacaaucugacagacugaguagguagacgcguuaauuucuuucuacccugagccauucauuuauaguuccauauguuaacuguuuucucaaauuuguuggcaguaccauuauuaaaaaucaaagggacaugguaauaagauggcaaauauuucauuugucaagcauguuaggauuaagagagcagaggaaaaaagccacaaaaguacuuuaauguaaaagaucaaaaagagaaccauuugaaaggaagaaaaaaauguuaagagauuuuaaaugaaaagcauagaugugugauuggagcaaaauugucucauuuuaauguuuagacugguuggaacuuccuuagcuaguaauaaugaauacuaguucuuggggcauccugauuacagacauggauauuuacauauuugaacaauuuuauuaacagaagaacuagccucuuauagaauuuauauacuaguggaaguaugugucgguuaaaaaguaagcacuuuuuuuacaugaagaauaaaaugauagagcacguuuacuuauuauauauuauauauauuauacauauaauauauuauauguauaauauauauauuauauauauauauauauuuuuuuuuuagguacagcagaaauucaagcuggaaaaacuucccaggcucaucagaguaauaguaaugcagaugugaaauuuggaaaaaguauuaaagauuuuccagcugcucuaaagguaaaauaaaauucuucucugucucucucucagucucauacacacacacauauacacacacacaccucacauguacauauguguagauguguuuauauauuauauauacacacauauauauauacaaauacaaccacacauguauacauacauauaaacacccacauaaacccacacacaccaacacauacccacacaugcaaacacacaugccaucuuuucauaguagcauuuuguuugcuuguuuacuacaauuugagcucuuauaaacaacucuuuggauucaguuuuauugucuuuugaguaaaugaaaacuauugcaggguagaaugguugaaagagcaugaguugucuuauuggcaauaucauauucagugguuccuuguuaacacuaauagcccauuauuccaugacauuuuccuuaugaaauugauuagucaauuaucacugaauuguaaauauauuugagaauucugaaacaauauuuuucuuuugugaaagaggugguuagugguaacuucuuuugaauucgaggcuaaagaacaaaaguguuaugguccauuaaguuguacucagcagaaaaguauucuuucuauuuaguguuauaaaaguuuuauucauaaaggacuuuauaauuuuaccuuuucaagaugugaaauuguuugcuuuucauuguuuuugguuucuugucaaauaaaagccuuaaaauguuuuuacuucuccacucagcccaucuuucaacucuccacaccauacaugcacauucuuguguuuugcugauauuguucaugcuuuaauugcaacuacuguuauuuucucuuacaguaguucuguucuauuucauuauuccuguuuaguuuaucuuauaaauuuuaauuuacauuaccauauagagucauuacugaccauuacuuuuuuuuguccuuguguccuccugcuuagagaucucucuauucugauuucaaucucuaugaauucaacauuuucuuguugguuuuccuuagauaggauaccaccuagauauccuugaaugucugaauaauauauuuuacuaggugaauacuuuuggaucauuccucuuuaaucccaguagucuguggauauuguuugcucuuuucuacuuaauuguguuguauuugagaaguuuuauguuagugcgauucugacuuauucuuuucaucuuuauguugguaaguuuuuucauuuaucuuugauuacaggaaauuuacucaguuaugcugaaguauaugucuuuuuucauuaauucuucucaagauuugauuauuuucaaucugaagacaauuuuuuaaaauauugcuauuuuuauuauuauuaauuauuuuaaauuauugcauguuuuuagguacuuuuuccuccuuuugucagucuauguggcucugacuucuaaagcucccaucuugcuccuuugugacuccgugugugugugguguguguguguguuuguguuuugcuugguuuuaugaaaaauuuuuuggcauuuaauauuugagaacuauaauuugguuuucauuuugugguuaaauguauuaacacaauuaaccuccauacuacccucugucaauaaauaagauuaugagaggucuagccauauagacaccuauuuaaaguugcuuaacuguguuucuaaagugcuuaauugcugaguguaaucauggaaccauacuauuaauuugauacuuagagaccauucucaucucugcucauagucuuaaacucuuucuuuacuguacauaggaauucagaacacaauaaaauaucaaauaggugguagauuuauaguguggagauuuacaguaacacuggggaagggaacuuuuccaagaaggcuuuuaccuucuuuccauagcccuuggaaugcaauaaaugcauaaccaccauguugaggaauuaucuaucaauuuucuagguuuuccacauauaaauuuucucaucauguauguguaauucuauuaauuauccauaguuauauuuuuguuuuggaggaaaugcugaaauuuuacagaugauuguaaaauuuuguuauuucaucaugcuaaccuucuaauucuguacuuugcaauacaaucauagcuauucauuugaggaacuguauuuuuuucuuuagaauuugaugaagaaugcugucuuuauguguuuaguucuaucaacuucuucagaagccuuaauuacuacuggauuugcuacauuuuuaccuaaauuuauagaaaaucaauucggauugacauccagcuucgcagcuacucuuggagguaaaacauuuucuuuaucuuaaccuaaaaauuuuacuuuacuauauuaaauuuuuaugaggauaguguauaauuugagguagcccuccuugaaauuuaaacuaaaaccagcccggccaacauggugaaacccugucuguaccaaaaaacauaaaaauuagccgagcauaguggcacgcaccuguagucccagguccuucagaggcugaggugggagaaucacuugaaccugggagguggagacugcagcgagccgagauugcgccauuguacuccagccugggugacagaaugagaucuugucuuuaaaaaaaaaaaaaaaaagacacuuaaacuuaauuuugguaaaaauuucugauuuucugacauuaggcaaucuuuuguaugaacuagagaaagacaaaggcuaaaauuccuaaagagaacauauauuaaucuuaauguucaauacauuaauuugacuaauucccuacuugauggaccuuuaagucauuuguacauguauuucuauaucaggugaauaaauauaaguuaaaaccauauugacacuuguuuuugauguuuuccaguugucaguaugagugaguauauguguaugguuucucacaaucuacauucuuuuuucuuauuaggggcuguuuuaauuccuggagcugcucucggucaaauuuuagguggcuuccuuguuucaaaauucagaaugacauguaaaaacacaaugaaguuugcacuguucacaucuggaguugcacuuacgcugaguuuuguauuuauguaugccaaaugugaaaaugagccauuugcugguguaucugaaucauauaauggguaaauacaauucagugcuuuuugauauuaauaccagaauaauagacuaagcauuuccaagcauauguuuucuuaaauggugagaaauuggcuuuuuaaaaauuuggaagaccuuuuuuccuauguaagaacaugugguuuuguuuuuaguuuagauaauugaugucuucuuaaaaguuggggauauuuauacaaagaacauuuaaggagcaacuuucauauacugggcacuauacuuccucagugauacaaagauuaauacuguaggauuuuugccucuaagcgauucacauccuagggagaauuucacauuauaugcuuuuauugauuuaaguuuuuagaaauggaaauaacuccauaauuaugauaaaaauuaucuuauuagguugguugcaaacagacaagaagagaaauuagaauaaagcuaguccuugcuaauacuuaccauuauuguaucuacuuagaaguuuauguuuauuguaaauaaauaaauaacuuguucucaccuguagacauguuucuagcuauaacugauucaaccauuuauauuucuuuguuuuccuuuuuuguuuugcuuugaaauuuuaagccauaaguagguggucaggcaggaggguguugcacagcagugcauuuuauaccucacagugcugcuuuaauuguuucauuacauguguuugaggcugucaaggaaagugguacguuaggucaaggacuccauaauuuuguauaauaugacauauagaugauauaaauauaaucuacuuugcucagaaaaguuugccaaugacaaucaucaugauuuguaguugcugcuaauauaucugugauucuuuuacauuaaugcugaguguucuaaagcaguguuuaguuaagcuccaucacauuuuuuucuuuuuuuguuuuuuuuagacagagagucuugcucugucacccaggcuggagugcaguggcacagucuuggcucacggcaacaucugccuccugaauucaaaugauucuugucucagccucuggaguagcugggacuacaggcgcaugccaccaugaccagcuaauuuuuguauuuuuaguagacgugggguuucgcccuguuggccagguuggucucaaacuucugaccucaagugaucugccuggcucggccacccaaagugcugggauuacaggugugagccaccgcgcccggccaagcuccauuacauuuguucaacauuuguugaaugcuuccucuggcagaucuucuuggcaaaauaccuguucuaaaggagagauugcaaaagaaaacagugaacaaauagucaauuagguaaugggagauuaaaaaaaauugcuauggaauugaaaagaaggugagcuuuucaauuuuauuugauuagaauccagaagggcuucacagcauaauagugaaaugggguuuaaaaauccuucaaggauacaaagaguuuugagaaauaaagauuugagaagagagaaagggagagggaauaugcuaaaccaagguuauaaaugcuauaaaaugugaaggcuaguuucagagaccagguugaauggaacuuagauuaugugucuagaaauaguagaaauauauuuuggaauguugaaagguagguagagguuaaguuguguagaccugacuuucaccccuauaaacuucacccaaacuuaucccaguaaacauuuuuuguauguuccuuuuagaaaaaaaaggaaguucuggauaguuuaacacauaguuuaucaccuugaguaacaaaguacaugugaauccauuuaauauugucuaccuuaaauaauaguuacuaccaggugugcuguccagguguguaaucagaaaggaaggcaugugugaugggguaauucugagguucacguagggguuggccauuaagauauauuaagaucugggauauaguguuuaauacacauacauguuucuuagugaugagaaaaacugaaagugaauacacauaaauaucacuaaacguauauguuuuuacucauauuuauguauguguguguauauagauauaaauagaaauaggaacagaauuuaaugucacaaaguaggugugacauuuucagaucauuuuuuucucauggccccaaauucuuaguuuuagcuucuauacacugaguauuaaaauguguauauuacaaacaggucagucaaacuagucucaucuaagaaacacguauaaaagaaaagguacaggcauauguugaggauauuguggguuugcuuccagaccaccaaaauaaagcauauauugcaauaagcaacucaaguggauauuuugguuuuccagugcauauaaagguuauauuuacccuauacuguagucuauuacauauacaauaaccuuauuucuagaaaagcaauguacaauguauauaccuuaauuuaaaaauuauuuauugcugaaacaugcugacaaucaucugagccuucagcaaguuguaauuuuuuugcugguagagagucuugccucaguguugauggcugcugacugaccaggguggugguugccaaagguugggguaguuguggcagcuucuuaaaauaagacaauaaugagcagucagaacacacacaucauucauugauuaaauuuuacuucuuaaaggggcaugguucaugguguccugaaacaauuauuauaguacaucaaaaaucacugaucaccauaacagaaaugauaaugaaaaaguuugaaauuuugcaagguuaccaaaauaugaaauagacauaaacugaucguguacucugggaaaaauggcacuugauagacuuacugaauacuaucacuaucacuagguugccacuaaccuucaguuuguaaaaaacacaagauuugcaaaguacaauaaaacaaaguaaaguaaagcuagguaagccugucuauggaaagaacagacuaagaagcucaagaaauaccuuuucagggagugagagacagaagagguucugaggauguaggguuucuaguagaggggugcaaagaaucuuugacuuuugccaugguaagcacagauggguaaaaagagauuuugcauccaugaauuaaugaauuagguucauugauauguucuuugaaagucccuguuuaauauaacagcauuuccaaaaaauguaagaucaggggauauauauauauauaaauaauuucaacuuuuagauucaggggguacaugugcagauuuguuaccuggguauauuauaugaugcugagguuugggguaugauugauucuguuacccagguaccaagcauaguacugaauaguuuuucuuuucuuuuuuuuuuuuugagauagagucuccuuuggucgcccaggcuggaguguaguggcacgaucucagcucacugcaaccucugccuccuggguucaagcaauucuccugccucagccucccgaguagcugggauuauaggcgugccaucacacgcagcuaaauuuuguauuuuuaguagagacaggguuucaccauguugaccaggcugaucuugaacuccugaccucaggugauccacccgccucggccucccaaagugcugggauuacaggugcgagccacugugccuggcuaauaguuuuucaacacuugccccacuucuucucuucucccucuuguaucugcagugucuauuguugccaucuuuauuccauaaguacucagugauuagcucccacuuuuaagugagagcaugugguauuugguuuucugugccuguguuaauuugcuugagauaauggucaggauauuuuucaauaauauuuuaaaguaauuuauuauuaaaucuuuaauugggcacaauacuaaauucgauugcaugaauacuguuuauuuucccacuguuccccacugcucuuuuguugccuugacaaucuauaggaacuuugagucuuauuuuggugaucaguggugguaaugaugauucauguuuuacuuaaaaccucauagaauauagaaauaccauaguguauacacacaguauuuuuuucuguaucugaucuuuagcuagaauuuuauugauuauaugaaauagcaucuuaaagaggcauaucaauauuuugcaauaguuuuagggaaauuuuagccuguuauagaggcauaauuauagaauacuuuguauuuaagaaauuaauguuugaauucuacuuguggcaaacauaaagauguuuauauaugcacauuuauuuuauuauauuuuaaaucuauuaaacauuucaaaauaggauauuuuaauauuuuuaaauauguauacacuaagaaaauuuaauaaacuucacaagcaucugccguuuuucuacuaauagcuuucuaguuaccucaagaaguaaaccuuuguaaaauauguagacuaaugugaccaccccuugauauuaaggaauauaagcuauauuucuuuguuaauacuauaauuugcaucaugcugucuuauacuuuguaugaucucaguaauuauuuaucaauaacaugagaauuauauauugggaacuuuaaaaauugcuguguaaaggcuauuucuagaguugcagggaugguuuuucucugguugucuuauuucugcaucuauguuaugagcucugugagcggacacucuggugauggcuuuugugaaugugaucaacccuugauauuaucaucauacuugauaaagauaaaucuggcagcaucuguggaauagauuugaauaagaugagacugcaggcagaguggcagauuacuaucuugaucacucuuuccuucagacucccuacugauuuagucauuuuuuucucuuuaauuuguuuucuucaugacuuucuuguucuccgccuacuuuguaugucaucauuuuccaacacagugucgguuaucuucuaauacuuacagaaaucacucauuuacuguguuugaccccugaugcaaggaaguuagcuucaugguggcagagguuugcuucuccuccucccucccuucuucccuuccuuuuccuucuuucccuuuccuuaucucuuucccuucccuuccucccuucuucccuuccuucuuuccccguuucccuuccuucucgcuuuucucccuuccuucuucccucucccucccucuuucuccuuuucuccuucacucccucauuccguuccuucuauccauuucucucucucccucaaucugucauuucuaguucuaacucuagcuccuucuuucuuuuaaauauaauucuaccaccuugaguagucuagcacauaauugguguccauugugucuuuauuaaauaaguggacucccaagacuucaguacccuucucauuccauacacuauaugacugaucuuauaaauguucgugguuucagcuacaucuauguccaaaugguuauuaagaaaucuagcuccauucaagauuucuucuccaccaaauuggagauacucuuaaucuuauuacuuacaauaccauacucaucauuguucuccuguaccuaaacaccagguuagauauuaggagucaccuuugacucuuccauucuuuuuuuuuuuggaaaugggaucucacucuguugcccaggcuagagugcaguggcacaaucauaacucacugcagccucaaacuccugggcucaagugauuuuucugccuaagccucuugaguagccucuuccauuuuuaacaggaagagucaucuucaaccaauccaucaccaaaucuuacugauucuacauccaaaaguuuucuuuaaucugcuuccuaucaucauauguucuaucuuagcucuccuuuauauugucaucaccuacugucuaggguauuguaacugguccccuuucuucaaauucauacucuguacaacuccuagaauuacuucuuuaaaacgaacuuuugacagugucacuuuccauucuaaaaauaccuuaacgauuaccuuuugucaggcccauguggcucucaauuaaacugguccuuuacuccuguccagcuacauuucccaucacucugugccucagacaucauucauauuucuccacagaggaugcuguuucucuacccuaugccuuuguaccagcuuuuucugaaguacguuuccccuuccccauuugacuggcuuacuuguacucauucuuuauauauuuuuuacgauuuuuuuuguauggagucucacucuguugcccaggcuggagugcaguggcgcaaucuuggcucauugaaacgucugccucguggguucaagagauucuccugccucagccucccgagaacugggacuacaggugccugccaccaugcccagcuaauuuuuguauuuuuaguagagaugaguuucaucauguuggccaggcuggucucaaauuccugaccucaagugauccacccgcuuuggcaucccaaagugcugggauuacagguguaagccaccgcaccagccucuuacucauuuuuuaaaucgcaucucaggcaguagcuccuccagccccuuuucucuaaacuuuggcuuguguuagguguccuuccuuggugcuucuaaaaggcacuuugcugauaucuguaaccacacuuagcauauuacugaauaauuaucuaagucccucucuacuucuaaacugugaaauccuugagggcagagacugucuuauucggcuuuguauucccguuacccagcauagggucuagcaguugcucaauauauguuguuugaaugaauaaauaaaugagguauaagggaugcauuuuugauuaguguaacccuuuauauuagggaagauguuuucucuaagaggcagcuugcaaugacacugagccuggggacugggaaaauuauauuugguaaggaaagaaaaguaacuuaaucucccuggaccucaguuuucccauugaugagaugauuauguucaacagcaugauuuuguucauccuuccaaguuuaaaauauugucugcauccuggacauauuuggcacuguauggagauauuuugguugcuguaaugaaggagagugcuacugguaucugguggaagucagagaagcugcuaaacauucuauaguccauagaaccaaccccacaagagaauuaccuggugccagaugggaaacucuugucuucuucacuuauucugccuuuuauuuuaaauuacugacagauacuauacuauaugacuauuguuuuuauugccucucuccgacaagaaguuaaacuuuaugugcaaaggaagacguuuuauuuguuuaguaauuauguguugagugagugaauaaaugaccuaaugguaagauauaacagugcuucgaaauuguuaguuaaaaguuaugacagaucauuuacccuucuuucauuucuuauuuacaggacuggagaauugggaaacuugauagccccuuguaaugccaauuguaacuguucgcgaucauauuauuauccugucuguggagauggaguccaauauuuuucucccugcuuugcaggcuguucaaacccaguugcacacaggaagccaaagguagcuuaugucuccuacuuuucccuuaaugaggcaauauguuuguggauuaucuugacuucucuaaugggguuaugcaaugccuauucuugccuuccugcuccauugccuccguuaagcagcccaugaugucuccagcugaaauagauucuuuuuccuucaugccucuugcaguuauuguugaaaaaucaauuuggaaguuacaaacauuuuaguaacaucacuuuguugcaguuaugaaauaucuuuuaccuuuucaaauuguuuuauagucaucccucacaauacaugggggauggguucccggaccccugcauauacccaaauaugccauacuuaaguccugccgauggccuugaagaacucgcuuuaagucagcaccucaguauauauggguuuugcauccugcgaauacuguauuuuugauccauguuuagcugaaaaaaaaaauccgcauguaaguggagcagugcaguucaaaccuguguuguucaagggucaauuuuauuuuucccuaacuauuuaagaucuuugaaggcaagagaguuuuccuauuuucacuagguacaguuuauauaauagaaacuuaguauuuguuuuauuugauauaccaugaauacacuuaaaauauucaaaucaauuuauuuuuaaauacaaauucauauuuaauucuggaucugaauacuaaucagugugccuagauguuauuucuuuucuguacaguuaaauaguuuaaaagaacucaguacaauuuuacuguacuauaucuuagaaacuaaauauuucaucuuagcuaaacuuaagaaccuuggaaauaaauaauauucagauuaugaguaguacgcaguauaguaugcauugguagauaaugugauaacuuuaaaaggaucuaagggaaauauauacugugguauaaaagaaaacaaugaauaagauguguaagaguuauaugacaauuuugaauauuugaauuuuuuucuguauauaugaccaauaaaugcuauugacuaacuuugauuagaagcagauuaugacaaggaguuauuaggaaggguuuuagucacauaacuaaauauauauagacacaaauaccauccugcacaagggaacaacacagaaaaucuaauacccagagcauacuuaaaauaguuuuuguuauuucgauaugguuaauuuaauauuuauauuuuucaccaaaugcuaagauaauuacuaucuuacacagcaaguugucuucuagaauuuuuuaggaagagcaaaugauuuugacuugcaaauuuucuauuuguccugacuuuuuuauguccaaucaguccaugaaauaaucaauugauccacaauauuuuucuuaugaaauauuucagauaggcaauauacauuuauaauacuuuuaauaagcacccauauacauuuguucacagcaauacaguuuuaaucuuauauuucacaccagugacccaaacuacaaaaucugaccuugacuaacugcuauauugcaggcaaaugagagugguaaaguuucauuaggauagaaaauacuguucucaguuucucuccuuaaaauuuuuaaaggcugaauuaccucauuauuugauauaucugauugcugaauauguaauagucaauuuuggaggugucaucugcauauuugguuuuccugaauugguaccaguggucuuagaauggcuuuagcaccaaaaaaaaaaaaaaaaaaaaaaaaguuucuggccuuuggaacaaugaaagcacugcuucucuuugauuucucuggcucugcucugauucguugaggccuuaaugucuaaaaaagauuuauaguaaggauaaaggauauggaaggauggaguugagauguaaaaugacuuuaagaaauaauuacuguugaaagaaguguagaaugugcaaggucauguaacuuauauucccauuaaauuguuuuguaagucaauaaucacuguagcagguuacaaacugaaguaauggccacaaaagucaaauacagauaauuccacaucauaaauaugguuuguuuccacuugcuuaauuucuuaaggguuaaauauucucucagcauaauuuguugaauauggauuaagacaguaugagaguguuugccaugucuagagaauaccuaauuuacaauaauuuauuuucuaaaugaucacuuucauuguuuuuaugucuaauauuuuuagguauauuacaacuguuccuguauugaaaggaaaacagaaauaacauccacugcagaaacuuuugguuuugaagcuaaagcuggaaaaugugaaacucauugugcgaaacugcccauauuccuuugcauuuucuuuauuguaauuauuuuuaccuuuauggccgguacuccuauaacugugucuauccuaagguauguagcacguugagaaauuuucauucccuaaggcaacauguugauggaaaacaaauggacucgggguucauuugggguucauauugaccauugguucaauaccaaucagcccuuacaagaucauuaguucuguggcauuggacaagcuccucuguagaaccccagauguaggagauuuaaaugauaugcaggugaaagugucuucacauugccugccuggcuugugcuugguguuuucucugcuucuuucaugaagcuucaggugugagcuggagaaacguucaguuuugaguaucauagaaauaaaaugcauuccaauaugccagaaucagaauggcaugcauucuaccuuaugcauuaggcacugugacguuaaaucuuccuuaagcagugcuaaucaauaagaaacuggcuauuaccuguguuguucaccuguguuuuauguuuccaguugcucuuccuccuuguaucccacugcacaaacacauuccauacuuguacauuucauaccuguccuuccauagagucaucagucuuuguauaucuuuccuaaugaauuauagcuuuuuucuuuuuuuguuccuuaguauuuacucacuacauuuucuuuuuuuacuguuuauuuaauuuuuauuuuaagcucagggguacaugugcaguuuuguucuuuuugcuuagaguagcuuuggcuuuucugcacugaagccauuagguccugggcuuuucuuuacugggagacauuuccuuacagcuucaaucuugcuacuuguuauuggucuguucaggcuuuggauuuuucuugauuccaucuugguagguuguauguaucuaggaauuuguccauuucuucuugauuuuccaauuauuggcauauuguugcucauaguagccacucaugauccuuugaauuucuacaguaucacuuguaaugugucuuuuuauuucugauuuuauuacuuugcaucuucuccuuuuuuucuuagucaggcuaaagguuugucaauuuuguuuaauuuuucauugaucauugguauuguuuucuucauuucaguuucauucauuucuccucagaucauuauuuccuuucuucuacuaauuuuagguuugguuucuucuuguuuuucuaauucuuuaagauguaucauuagauuauuuauuugaaauuuuuccuuuuuuuugauguauagcuauaaacuucccuauuaguacuucuuuugcuauaucccauagauuuuggcauguuguuuucauuaucauuuguuucaauaaauuuuucaauuuucuucuuaauuucuuuauugacccacuagucauucaggaguauauuguuuaauuucuauauauuuguauaguuuccaaaauuccucuuauuaauuucuuguuuuaguccauuguggucagggaagaugacugauauuauuucaguuacuuugaauguuuuaagacuuguuuuguaaccuaacguauggucagucauugagaaugauccaugugcugacgaaaagaguguguauucugcagcuauuggaugcaauguucuguaaauaucuauuagauccauuuggucuauaguacagauuaagucugauguuucuuucuugauauucuaucuggaaaaucuguccaaugcaaagcaugggguguugaagucuccagcuauuauuguaucaaggccugucucucucuuuagcucuacuaauauuugcuuuguauaucugggugauucaguguuggcuacauauauauuuaaaauuguuauauccucuugcugaauucaccccuugaucauuauauagugacuuucuuugucucuucuuauagcuuuugucuugaaaucuauuuuuucuagguauagugacuccuauucucuuucaguuuccauuggcauggaauguguuuuuccauuucuuuauuuucagucuaugugugucuuuauaggugaagugucuugcuuguuggcaacaggucaauggaucuuguuuuaucauccauucaaccaggcuguguuuucugauuagagaguuuaguucuuuuagauucaguguuauugauaaaacaaacaaguaaaaagaaaacuaauaaaaacucuacaccuuaacuuuguccccuggcuuuuuauucuuuuguuguuucuauguauaucuuauuguacuaugucuugaaaaguuguuguaguuacuauuuuuuauugguucaucauuuaaccuuucuacuuaggauaaggguaguuuacacaccacaguuccaguguuagaauagucuguguuuuucuuuguacuuaucauuaccagugaguuuuguaccuucaggugauuacuuacugcucauuaauguucuuuuucugauugaaguacacccuuuagcauuucuuauaggacaggccuggcauugaugaaaucccucagcuuuuguuugggaaagucuuuacuucuccuucauguuugaaggauauuuuaaccagauauacuauucuaagguaagaguuuuguuccuucagcauuuuaaauaugacuugccacucucuccuggccuaugagguuuccacugaaaagucugcugccagauguauugaggcuccacuguauguuauuuguuucuuuucucuugcuaguuuuaugaucuuuucuuuauccuugauguuugagaguuugauuauuaaaugccuugagguagucuucuuuggguuaaaucugcuuagucuucuauaaccuucucguacuuggauauugauaucuuucucuagguuugggaaguucucuguuauuaucuuuuugaauagacuuucuuacccaucuuuuucucuaccucuucuuuaugaccaauaacucuuagauuuuccguuuugaggcuauuuucuagaugcuguaggcaugcuucauuguuuuuuauucuuuuuucuuuugucuccuaugacuguauauuuucaaaaagcuuguuuucagucucacuaauucuuuauucuguuuuaucaguucugcuacuaaaggacucugaugcauuauucaauacgccaauugcauuuuucagcuccagaauuuccacuugauucuuuuuuuguuuugagauggagucucgcucuguugcccaggcuggagagcaguggccaugaucuuggcucacugcaaccucugccucccaaguucaagugauucuccugccucagccucccgaguagcugggaugacagacgugcaccaccaugcccagcuaauuuuuguauuuuugguagagacaggguuucacuauguuggccaggcugagucucaaacuccugaccucaagugauacaucugccucagccucucaaagugcugggaauugcaggugugaaccaccaugccuggccaauauuauuucagucuuuuuguaaaauauaucugauagaauucugaauuccuucucuguguuuuuugaauuuauuugaguuuccucagcacagcuauuuuaaauucucugucugaaacgucacauauuucuguuucucagauuggucucuggugccaugagcucauuuggugaguucauguuuuccuagaugguguugauacuaguagauguucuucagcaucuagguauuuaagaguuaaguauuuauuauagucuucauugucuggguuuauuuguagccauccuucuugggauggcuuuccacauauuugaaaggacuuggguguucuaauuuuaguuguaucugcuuuaaggggcacccgaaggccaguaaugcugugguuuuugcagucucucucccucuguucugagccaccuaaagcugaagguggagugaugcaaacaccucuguggccaccaccacugugauugcacugggucguaccugaagccagcacaguuuugggucuuuuccaaggucuuuuguaacuacuccaugguuacuaguucuguuugcuuaaggaccuggggcccuacaaucagcaagugggaaagccagccacgcuuguguccuucgcuuggguggggagguccuacaggcacuggugggucuagaagugccacccagaagucagggacuagagucaaaaaccuuagaagucuaccuggucuauuguauugcggcuaagcuggcauggaaaccacacaguguaguccuuuccacucuucuuuccccuuugcaaaggcagagaagcuucaccccauaggccccuccaacccaggccacgaggaguacugccagacuaccaccaauguuccuuuauggcccacugccucuuuaagucagcuugucaugaaugcuggcugggcugggacucacccuucagggcagagagcucccugcuggcccaggacagguccagaaaugucaaagagucaaguucuggaauuggggacuccaauaaccugcuuggugcucuaccccccggggcagugaugguaccuaaagcguaagacaaaguccccuuuacuuuucccucugcuuuucugaagcagaacgaguuuugccccguagccaccaagcugguaaugugcugagucuuaucagaagccagcaagucucagaguucucacccaacgcccucaauguaguaucuggguauuggugcugguuauucaggcccaagggcucuucaugacuuaaaaguauaugaacgcugucaggacugguguauuuccuucaaggcagcaagcacccuucuggcccaaaaugugucuagaaauauuuucugggaccuaaggccugaaaugggagggccucacaacucugacuggugcucuguccuccuguagcugaguugguauccuagaugcaagacaaaauccuccccacucuucccucucuucuccucaaguggcaggaagggguucuuuuggaaccuggagcugugcagccuggggauuaguggaggaguaauaccaggacuccauugucugucccagcuguugucucaguaugucacgugugccuccaguccacugucuuugagccuaauucagcacuaagacuugcccaagaguugcagucccuauggccuagacugccuuucaaguuaacuuggagacacagugcuguagcccuugguggugaguuguuuuguaagcacucaaguuuggacugcugcauaggagauuaaccucuggccagggcugguuuaaauacucccucugugggcaggugucagguaaguuggucugguuuuccuuucugcucuaacaggacagcagugauuuuauugccucacaauugcucuauucucccuccccaccccaagagauucucucuguauuacacugccacugccuggguugggagguguggugucugagauucaggacuguuuuuuuuuaaucucuucagugccucuuucaggaauauaaaguucaaaccagguauuauaagugcucaccugacuuuugauucuuguuaaaguguuguguuuuuuuuucuguguagauaauuauuaacuuggagcuuuucagucuaucaucuuguuccacccucuggcuguuuuagcuauucuggauuuuuugucauuccauaugaauuuuaggauuguuuuuucaauuucugugaaagaugcucuuggaauuuugauggaaauuacacugaauucuguagaucacuugauguaggauaaauauuuuaaaauauuuauuccuccaauucauaaacaagggauagcuuuccauuuauuuguggcuucuucaauuucuuucaucaguguuuuauagcuuucaguguacaaguauuuuaccucuuugguuaacuuuauuccuaaguauuuuuuuuucaaugcuauuguaaauuuuguuguuuacuugauuucuuuuguucauuguugguguauagaagugcagcugauuuuuguauuaugauuuuguaugcuaaaacuuuacuaaauucaucugcuaguuguagugcuuuuuuggcaggaucuuuaguguuuucuacauauaugaccaugucaucuucacagagauaaucuuaccuuuuacuucccaauuuggauaccuuuuauuuuucuugccuacuuacucuggauaggacuuuuaguacuaugccgaauagaauucaugagagugggcauccuuguccuguucuucaucuuagaggaaaggcuuucagguauucaccauugaguaugauguuagcuguggauuuguuauauuugggcucuauuauauugagguacacuccuucuauacauaauuuauugaugacuuuuauggaaaauaugucuuguuaaugaauacccuuucucuuuacauuuauuaaaauuaauaaagacuagugacucuuugguguuauuugcaauauuuuaggucagauaacauuuuucuucuuuuauaaucccaggaagauuaaaccauuuauaagcucuuacaaaugcauuauuuugcguuuacaacauuuacuuuaauauaggaaugcuaaacucuuauaaaugugaacuugcucaaagagugaauauacuauaccaccuuuuuuggucucauauauauuuaauauuuccagguguguuaaucacagacaacggucccuagccuugggaauacaauuuaugguccuucgauuauuagguaugccauuuuucuuuauucauugcuaacuguuggcuauuuugguucauuaguguuauuuauuuuuuaauuuauggccuguggcaaaaaaaauuauaguggaaggcuacaucauucuuguugaaggaagccauuuuccaauguuucagauauaggauuauuuacuuauugcauacuuuuaaccuaccugacugguuaccuguuccaacuauguugcuaauaaaaucuuaaaaggugugucaugucuauuucaaauauaaaauaugaucaucaacacauaauuucuuuucucucugcuuuugucucuauucgugacacuauuguguuacacuagcaauuaaaaaugauguuaaaauguuucaacagcaacugugguauggauauugugacuaguuaagaauuauuggaagaaagaauuuguaccagagaauuuuauaaaguuccagguacaggacaaauuacaagaaagacagacauaguaaacauaauauuaagauuauuuauuaaagcaaaaacaaaaaguuggggcauuagagaucaccucguccaacuugccaauuuuuucagaugaguaaauuaagucccugagaagugcaggguuuugcccauaguuacacaacuagugauagaaaugaaaguaggaaaaugauuccuaacucugagucuaguacucugacuuguaucaugcuacaggucaugaaagaacagacuggauguagcugaaaucuuugucuaaaaauuacaaccucaaauaauuggaaguuucuuaacuauauggaaguugaguaccucauggccucuuggaaaugguggcggguauauaagauagugauauuccuagauaugguauuauaagacuauauauuuguauauacauacacuaauacauacagaggcccauguuaguuuauauacacaugcacacccacauagauacaacauauacuauaguucagcagauuuauuugugcaucaugaauaauuuauuuugauuuuuaacaaguauaauagcuaauuucaaaggcauauuuauucauuauauuagaaaaguggugaauuaaaauauuaacuuuuagcccaauauauauuggauauuucuauugaaauacuuuuuugaauugauuagaaauacauaguaauuacauauaauuauuuuagaauauuguaucugcuuuauauuucuuugacuuguacaugaauuaauuugcauguggacagaugaauacuuauuuuuauuucuauaaaauauauguaugaucauguauaaaaagaucuguaauucuaaacuguaaucuuuacuguuguauauuucacccauaauucuuuuagggacaauuccuggaccaauuauauuugguuucacaauagacagcacauguauucuuugggauauaaaugauuguggaauuaaaggagcuugcuggauuuaugauaacaucaagauggcccauaugcuaguagccauaaguaaguggugacuucuugauaauuuuagaguaaacuaaggauguaaaaaaaaaaaaaucucauuguugguuacuuagggucacagguauuuugaaauguucaguccacauuguugaaccauccaguagucuuccugaagcagagaacauuuaucacagcauguuaugaaaggcuuugaacagauggaguuugcaaggcucaguacuaaauacaagaaaauaaaauucuagcuuucauuacaucauacaguauauacuuuucuuuuaauaacuuaucucaaacauuuuuggaaaguauacucgaaagcuaaaagagaauucugagaaacucccuggaaugauugucaucuagguaucuagguguugcaaacacauauggcucaggcagggaaguauccuuugucuccaaggcacguuguaaggaacauuuuuauaguuuagaagguuagcugugauguuuaauucuuuuugccuuuugcaguuuguaaugucuugguuaagcaaugaaugaaauuuaaggcaagauuaagauuaaguaaaacaauguaucuaguuuacacuaguaaaauaaaaguugaaauuuaaaaauuuaaaauuugaauaauaaccuaggaaacuaaaauagcuuagagaaauccugaauguauguauacauauguaucuaauauaaugugugauuuucauugugauuauuuugacacagguugaucaagauaggcuauuauuacucuuacaugcauguaaauccagaguaugcuuucugaguugauagagauagaguaauagaauauuugcugaagaaauaaucuauaaauucuuauagcacuuggggaguaaguauugacaaguauaggcaaaauuaaucaucccauuacuuuaccuguuguuaaaaaccauuuuuuauucaauuuuuaaaauuauauauuuuuaccacaaucauggcuacauacaauguuuuuauguuuaaaauuuauuuaauucauuuuguuuguacuuuuuggucaaagauauagauagaacaaaucauucauuuuccuagucaaugaugaaugggaauccccccacaaaauauauaaaaccuuaaaauuuucagaaugaaacaaauaaaaaaaguuguaaguuguaccuauguaacuaaucauucuauagucuaguaaugccuagaugaaugagcauuccuguuuuucaaauacauguuuuuaaacaaaauauuaauaaucaacaaaaagaaaccagcuacugcaagaacuauacugugagaccacguugaauuuauuaggcuggcaauuauuaaaugcuuauacugugguuggaacuaguuucucuucauauaacugaacuuaaaaucagauuuacuuggaaauaaaucaaaguuugugaagugaaucuuaauguuuauuuuuagcugauaagaagaguagauuugguuaaguauugagugugauauccucccacagaggcuuuaagaacuccaaaaccuuuuuaauuuuuagaauuauuuucuguccuggaagggaauguucuucaauuuauucagguucaagaauguuacaaacuacuuucccucauuauugacuuuugguugcuugcaauuuuuuauagauaucauauuguguuaacgaauuuauuuauuuauuuuugagacgggguuucugucugucacccaggcuggagugcaguggugugaucucagcucacugcaaccuccaccucuaggggugaagcgauccucucacgucagcaucccaaguagcugggacugcaggcuguaccauccaucauaccugaauauauuuugcacuuuuuuuuuuugguagagacaggguuuccuauggugcccagccuggucucgaacucuuggacucaagacauccaccucucucagcuucccaaaguacugggauuaugggcuuguguuaacaaaucuagaugguggcccaauuccuauuuaguucuauacaacacuuauuuuacaagaaugcacaagcauaaccaagaauaaguuaauuauugugcucuauuacagcuuagaaagaaaauaaguacuagugacuugaauuguauacaaauguuuuuucuuuccccuuaauguuucaaaaauuuuaaacauagaacuauaaugguuauguaauuauucucuuuaaaaauguucuauucaugaagauuuuucucagugauaauuuuuaucauaauuaaaaacaaaagcacaugauuaauuuuuuuuuucacuuagguguuacuuguaaaguuaucaccauguucuucaauggauuugcaaucuuuuuguauaaaccaccuccaucagccacagaugugucauuucauaaagagaaugcaguugugacuaauguuuuagcagaacaggaucucaacaaaauaguaaaagaagggugaaaugggaaaagagaagacuguuuuacaccuggaaaauuuaccucgauuuuuaagaacacacauugccauggcaggauuaucuauccaauauggacaaucauauuuacaaaauugauguuuuuauaaucaaauguauuuuuuuacuuauguaguuuuuguuuuaugcaagaaacagaccugugccuucaaagcccacguaaagccucaaaacacagcacacacacacacgagcacacacacacacacacacacgaacacacacacacacacacacacgcacacauacacacuuauuuccuauucccauugucuagguaugaaauccucaagcaauaacaagaaaaaaggcccacaauuagaaaaauuuacauuuaaaaaaaauguuguuucuauccccauuacaacuuguuuaauuuuaauuuucauugucaauauuuugagcuuagaacauuuaugguauaaaaauuuaaacuaaucaaaguugugugaugauuuccgggaauuauuauugaaagccuaugaauuuaaaaccagguuuaccauguaauuuguuuuuaaauuuauguauacuagccuggccuuucuccaagcaaauuauugaacuauuagaauauguuaguuaucauccuugugucuuaguauauagugaauacagaaacaucagcauuguauacacauauuuucacuuuaacucaagaauuccaggagguaauuuguugauauuacaauuuuuaacacauuuaugauucugugauaauauuauucaauugcauauauuucagaggaaaguaccagucaguaaagaaaaaugccaacuaaacaugaaacuauugaucaauacuuauauaccuuuaauuuuuccuauuugaaaagccaaccacuuaacacauuacucauagcaccuaagacagugccuugcauaguguagucaucuauuauuauuguuuaauuagaauauuaaacccuacccuuuaacucagcaguccccaaccuuuuuugcaucagggaccauuuuuguggaagacaauuuuuccaugggggaagaagguaugguuuugagaugaaacugcuccaccucagaccaucaggcauuaguuagauucucauaaggagagugcaaccuagaucccuugcaugugcaguucccaauggagugugcacuccuaugagaaucuaaugccacuacugaucuaacaagagguggagcucaggcaguaaugcucacucaccugccucucagcucaccaacuguguggcccgauuccuaacaggccacacacagcccagggcuggggaccccugcuuuaacugaugcauugauuugauaaaguauuuuacaagccugauaauguuauaacccuguuuauucaggucagauuuaugccaacuuugcugagaauauggaggguauagaugagugaacaucaacaaacauaacuucuaccaugguuaagaauuuuacuuaggaaaaguauugaaguucaaauccagauaguauuacauuugaaauuguuauaaggguuauuaauuuaauaaaauucaucaucagguuuccccuauaagcuuucuccuagguuaauuuuccacaagcauuguuuuauauacacuguaaucaggauaacacaagcuuaguguuagaucuuguaggaaaccaagauuagaaacauuagaaauuugcagaauuuaagaaauuauguuuugugguaaucuauggccaacgauguuagaaccuagcgcaauuguaaagugaaauucaaggagaaggaaugaggaguuagggaagcagcauacuugaauauuagagaaggagaggagcugugggucaggaaucagagagaccugcuaaaaccagacagauauaaacaccaaagacggaagccaaauagguagccaaaaauccagauauuugagaagcaggaaauuuauagcaaccaaagaaauagggcaagagaggcaggugaacacacaugauaccucaauugacaaucuuccucccaccaagccagacacguuguaaaugcugcuuccuauuggagcccagaaaaaaggaaaaggaaaguuuaggcuuucuuuguccuuuguguggaagcagggaauuggauugaagacuuucauaguuguaacauaaaggcaaauccugaggaacucacugauggagaugugaaauggcaguaaggaagaaaacagaauaacugaacaaauauauuagucuagggccacuuaauuuagaggaagaaaaaaaaucaacccauccauagaaauaguuugauaaacaggucacuaaaucauuggcguuuauaaagauucuuagcuaucaagggcugcauuguauuuuauauacucaguuuuauaaggugauacuuuuuaaauaagcgcuuuaaugaaaaugguuagacugaaaauaauuuugguccuuaaaaggagucaggagcuuuuauauauaagguacauauuuuaaaagaauaccuccuuuauaacaggguuuuacagacacuaccauaauuuauaaucauuauuuuuuacuuuuggguucaccuagaucauaugaguugaugugauacuucuagaacaaaauuauucauagugcguuuuuuguaauuuaugauuguuaaguaagcuugacuuauaaauugacauuguaauuguguacauaauuggauauauguguuaaaauuuaacauuuagauuuacuuaauuguagaaaauacaaauguaaaacuuacacauggaaagaacuguaugcaguugacuuuacuauguaaauuggagggaaacaaaguuuuagauccauuuucuuucaaaauuuucuuuauuguaaaguaugcaaaauauauauucauaccauuuauuaaaucagaauguuuauacaa

SEQ ID NO: 191135 - RNA, 9983 nt, Homo sapiens
ucugauggcaauguuuuuaaugagucugaauucguuaaugaaggggaaaauuuauuauuuuuuuuucccaaugacucccaaguccuacucgcaaacaaauacauuguagaaaaaaguuuaauugcugguuauuguuugaaucuugaaauacaauucuucacugaugauacugguauaaaauggugguuauuaauucaugcuagcacaaccaaaacuaauuuaacauuauugguaaaaaugagucauuuuugaaucucuauuaaaaucugaacacauaaacaaaucugugcuaaaacuggaacugccuucucacucuacauauaauuaaacuuccagcuucaaccaucugauguugaaaucuaaagcaccuccaugaguuaaauguccccgacaaaccauguagauggacaaacaagauugguggucuuuaauugcuggcgacagaaaaggcugcaguuuaguacuuaaaccugcaguuaguggucaacuuucuauccaggcagaguaaacuaaggagagcuaugaaauaucaaaagaaaacuagaggccaggacaaagaggcaaugucagccaagccacugcaagaugguaugcaccccuguauuucagccaagggcaggcaauccaaaauuacacacugcuuuccuuaacuugaccaaacaguguauuuuuccucugaaaaucuugucaaagguuguauuccauuguaccuagugaaauacaaaguccacucucauaaaaauauuauauuuuucaaaagaaauauaauacauugaaaaucacugauugcugcuucuucgucuuuuuuuccgugaauguguagguguuugagucucuuguauuucuucuuuuacacaggauaugggcuguuugaaaacuauuucaucaucuuuaucaucaucauucaguucagccacuugagauuuucgccucuccaaaaauguugguguacaaacugguguggggcccuggauucaacaaguaaagauuauaauacauaaauguaaaacaugauuaugacuuuacccaaaaauaucaucucuccucuauuuuuacaaguugugccccauuauuuuagcucuguuaccaucuuuuggugauacuauugcaaagaauaaagaacuuagaugcuuaucaaacuugguacagaaauucacaauuaacaaauauagcauguuccauuauaagguuuuaggcagaaaauugcuaaaucaacaauaaagaucuaccaaaugucacaauauuuaauuugaaaucuuaaaaugagaguagcagaaacugcuucuccuccuucaaauuauuucuauaauaucuggugucuggaguauugaaaaccauuuuaccuggcuauccacagucuucucaggagugucaagaguaccugaaacuuuuuucuucuucuuacguaaaaccuuaaaauaaauuuuaaaacacaucaauuugaauauugaucagcuacaguagucuugaauauguuuuccuacuuauccuucucuaauaucuugcauguaaaaugauaaaaaaaauuuuaccuggccuuuuguagacgucugacgauuaguuuuugaaauacuuuccguuuucuguaaaaucuuuaauaaagaaguuagaaauugacacucauaucuuuucuuucuaaacuuagcauuagauccucauauauauuaucaguaaauccucccuaaaugacaagagcauuucauuuuaaaaaaucaaaacucauaaauacagugaauuaucucaaguaaagggcaaaacuaggaaaaacccaguagaggaauugacagagcugcagagguugaagggaaggccaaaaccuggagcucacugauucacagaauccugaauucaggaggguggaagcaggaagaaugugcaaaggcaggccacccccaucuccuaagucacaaacaggguacaggaaaagcagugcucacaugccucuuuucaaguuucacugucucaguucccaaaugguucacaagaguaccagggccuaaggccuuggcgaaauauucuaauacuauuaaagacaguauuugggauuugggcaaaaaauuaaccaccgagaauugaggcaaaggaggguaacacggucaucuaguuucuggauaagguuaaaaaccuaguaaauuggcugggcgcaguggcucacgccuacaaucccagcacuuggggaggccaagguggguggaucaugaggucaggaguucgagaccagccuggcuaacauggugaugaaacccuaucucuacuaaaaaaaauacaaaaaauuagcugggugugguggugugugccuguagucccagcuacucgugggggcugaggcaggagaaucgcuugaaccugggaggcggagguugcagugagcugagauagugccacugcacuccagccugggcaacagagggagacuccaucucaaaaaaaaaaaaaaaaaagaaaagaaugagaccuuuaccuauacuagccauaccauaauaagcuucauucuugaucuauaauaaaagacauagcucuccucacugugacagauggaggaaagggucaguguuuugguaucuacuuauagcauacaguaaaccaaagacuuaauucuggcagugucaccucugaaugacaaucuuuuucuuuuuuagcgauacggucuugcucuguugcugaggcuggagugcaaugguacaaucacaguucacugcaaacuugaaauccuaggcucaggagauccuguugccucagccuccugaguagcaaggacuacaggcacacacuaccucaacuggcuaauaaauggcaaucuaagaguauuacagucuuuaguuaaauaguggguuuacuucaguaacuuaaaacagaacauguaaguuaaacaaaucagauuaucuccuuaaaagaagcuuccucuucuguauaauagaaauaacagaaucuggucucauaauguuuuaggaagaaccuacaauggaauguuucaaaaguuuagucaggccagucaugguggcucacaccuguaaucccagcacuuuuggaggcugagguggauggaucaccugaggucaagaguucgagaccagacugaccaacauggugaaaccccauuucuacuaaaaauacaaaaaauuagccggguaugguggcacgcaccuguaaucucagcuacucaugagggugaggcaggagaauugcuugaaccugggagguggagguugcaaugaacugagauugugccacugcacuccagccugccugggcaacacagcaagacucugucucaaaaaacaaaacaaaacaaaacaaaacaaaaaaggaugggugcaguggcucacgccuguaauccuagcacuuugggaggccgaggcgggcggaucaccugaggucaggaguucaagaccagccugaccaacaaggagaaaccccgucucuacuaaaaauacaaaauuagccggggugguggcgcaugccuguaaugccagcuacucgggaggcugaggcagaagaaucgcuugaaccccggaggcggagguugcggugagccaagaucacaccaucgcacuccagccugggcaacaagggugaaacuccaucucaaaaaagaaaaaaaaguuuagucaaaaaacuggcugggcacguggcucaugccuauuauuccaacacuuugggacgcugaggugggugaaucaccugaggucaggaguucgagaccagccuggccaacguggagaaaccccgucucuacuaaaaauacaaaaauuagccagacgugguggugugcaccuguaaucccaacuacuugggaggcuagaggcaggagaauugcuugaacccaggauguggaaguugcagugagucaagauugugguaagugcuaggcuagguacuuuacaagguacaaagcugcccccuccccuccccacaacaaaccacaaaaaagauuucacgaauauuuaccaaagaaggaaaaucauagucaauuccuuuuuuagcuaauuucuuccugaguaaucuuucuuucuuuuuaaaucgcuccuccauccguagcuuuuguguuaguguccgauuccgauuauaccguuucacugauggauaugauggcugcuuaaauggaauauuccagucuuuaaagaguucuuuauguacuuuuucagguggcauaaaaugaccuauuuucaaaaagaaaaaaacauaaagguauuuuaauguuaacuuuagaaucuccgcagugccauuccucacacaacaaaaugauauggcuggguacaguggcucacaccuguaaucccagcuucucucacagcaaugcgaagugaauagagagacaagaccugggcagccuugucagcugugaacuuggguaccuaagacggccacaugccaccaugggcacagggaagccagaaacuucgcuuugccucccaagggcagcaggaucuggacagggaugcucucugcacccuauggacugcaggguagggggcuucacuggcuucuuucugcaggauaaauuacucaucuggugcgucacuccuccacucccucuggcuucucucguguggaagagcuacagccauugccauuuagacagauuuugcaacgcgauuccugaccuuugaugcuauccccacugcccucaggauaaauucggaacucgcugacuuagaaggccuucaguaaccugaccugaagccucuucuugcuccuucaucucuugcuacuuuuccucacauucucucacagcugaaugguuaggcaucauugguuuggcauucacugucccucagccaggaauggucugucuucacuccuguccccuucaccuggcucacuccuguuuagucuucagguuucaaugucaacuauacuuccuuagagaagccuuucacagcccauaaggauggguuagcugcuccucccauguguccccaagguaacuuguccaguuccauuuaggguaaaaacagcucucaggcuagauuuuaaaauuccaauuagaaucugccugcaacauacacugaaauccuugcaccauucuguaagacucaucccagagaugaaguggcauguccaagcagcuaggcaagccgcccuucccaccacagucacccaccaacagcaggcacccaggcaacccugcgguaagacaggagcacuuacacuccaagagucuuucaccaaacagguaguuguucauuguuucagcaacuauuuuggcaacauccucagacucaaacuccacaaaugcauagccuuugcuauuuccagucugcaacagagaaaccgccacaaaaaguagaacaauuaaauuugaaugcgucaucaaauuccuaaaaugccauuauuuuaaauaauguauauuagccccuuaucaaauauuacguacgacacgcuuaauucuaacuucaauucacauauuccggggacuguuaugggaaaaagaaaagaugcacgagucugaacacacagcugauuuucugguauucuugggauuuugguuacauaugauaaauacacaauuccuauggcuggaauuuauucaguaacaacacuccgugauauuaaaaaagucuucaacuuaaaagucacauggcuuaacagugggaaucaggaggcucauuuccagcaccaguugugucaguaacaagcaacuuggacacuuccacaacugagucucagcuuaauuaucuucaacagguggauucugggaaaaauuuaaaucccucaaaauccauuuauaaucccaacacucaaaagagaggggaaggccaggcgcgguggcucaccccugcaaucucagcacuuugggaggccgaggguggaucaucugaggugaggaguucaagaccagccuggucaacacggugaaaccccaucucuacuaaaaauauaaaauauucacuuugggaggccaaggaggguggaucucaaggucagggguuugagaccagccuggccaacauggugaaaccccaucucuacuaaaaauacaaaaaauuagcugggcauggugacauguaccuguaaucccagcuacucaggaggcugagccagaagaaucacuugaaccugagaggcagagguuguagugagcugagaucgcgccacugcacuccagccugggcaacagaauaagacuccaucucaaaaaagaaaaacuaggccaagagggguggcucaugccuguaaucccagcacuccaggaggccgagguggguggaucaccugaggucaggaguucgagaccagccuggccaaaauggugaaaccgugucucuacuaaaaauacaaaaauuaggccgggcacaguggcucacaccuguaauccccacacuuugggaggccgaggcagguggaucaccugagauugggagcucaaaaucauccugaccaauauggugaaaccccaucucuacuaaaaauacaaaaauuagcugggugugguggugcacgccuauaaucccagcuauucaggaggcugaggcaggagaaucacuugaauccgagaggcugagggugcagugagccaagacugugccacugcacuccagccugggcaacagagugagacuccauuuaaaaaaaaaaaaaaaauuagccaggcaugguggcaggcaccuauaaucccagcuacucgggaggcuggggcaggagaaucacuugaauccgggaggcggacaucgcagucagcugaggaacugugccacugcacuccagcccgggcgacagagugagacuccgucgcaaacaaaacaaaaccaaaacaaaacaaaaaaaaaaugaauagaaugaaauagaaaaucagcgcaucacacaaaacaaguuuaaauauugucucauuuggcuuuuauuucaguuaugcuuacaugcauauguaugugugcugguuugugcuguaaaacuuuuuuuaaaacccucaucuucuuugugaugguaaaaacuuaccucuuauugugagccaaagucugcaaaauacucuucuagaaaauucugccuauaccuguacaaagauuguuccuagcagcuuaaucuaaagaguuaaaaauauuaaaaaaccuaauguucgggcugggcacaguggcucgcucaugcuuguaaucccaguaccuugggaggccgaggugggcggaucaucugaggucaggaguuugagaccagccuggccaaaacaguguuuaguagaaacacuguuucuacuaaaaauacaaaaauuagccaggugcaguggccgguaccuguaaucccagccacucaggagggugaggaaagagaaucacuugaaucugggaggcagagguugcagugagccgagaucgccccccaaaacaaaaccuaauguucaauaggaggguggauaaacuuuaguaaccuaaguaaugagcaaugaugauaacaaaggcaauagaguuacauggauaaagcucagauuauugaauacaaaaauucagcugaagaaugauagaguaauauaauuuuaaaauaauaccauauguacauuuauauauguacacauauguauucuaguacauauauauauaguaaaaacuuauauauagcaaugaaaacugaauuuguggccgggcgcacuggcucacgccuguaaucucagcacuuugggaggccgaggcgggaggaucacaaggucaggaguucgagaccagccuggccaacauagugaaaccccgucucuaguaaaacacacaaaaaauuagccaggcaugguggcaggcgccuguaaucccagcuacuugggaaggugacgcaaggagaauugcuugaacccgggaagcggagguugcagugagcugagauuguaccacugcacuccagcccgggcgacagugcaagccucagucucaaaaaaaagaaaacugaauuugugaauuuaauucccuaauuaaagaaguugaagagcacugggaaggguacaaaagggaccucaauucuaccuacaaucuaucuuuacgacaacuaacagaugauggaugugcacccuaucccccacaugcuaaaucaaauaggugucuauggcuacaaccaauuaaaguuuaugugcggggaaagaaaagaaagugggucacuccuccacuauugaaacaagcuauguaaagcguuuucucauuagaaggcagguaugacacaaauaguaauuauacuuauauaguguuuauuguguaccaagcaauccucuaaagacuuuauauuuaaccuuugacuaaauacucccaggaaguuuuacuuauauuuaacagaucacaacacugaaacaugguaaggucauaucacucuaacuaguaagguguagagccugaccccaaaccucagcaguccaacuccagaguccucaccuuuaacuauucacuauauaaaccuuugcuauuauaaggaugcuuguaccaaaggcuaacacaagaaaauguauaaaccugggccucauacuaaagcucauuuaccaggacugucaauuuaauguaaggauuuggagaaauguaaaaaacaaacuuuuacaauaauacugauuuugcuccuguagcuguuucagauucuaaaccuccuccacucuccuuuuuggaaugaaaucugauaagcaauaauguaugcgugaacgugcucuuuaaugucaaggauaauacacauuugaaaaacaaaacauuaaauccaacugcaaaaaucuuacccuuuuacuucuggacagccugaaccgugucacagugccaaacugggagaaauaugaaaagaucuggguuucgucaaguagguuagguagguggcgcacauagacuacuccaggaguaaguuguucuuguuuuuuucgcuaaagacguaaagaccagguaaauuaaauauauaaauaagaaaaucacauuguaacaaaaccccuagcccucggcccaagaaccuauucugcauuuccacuuaccacaguaguaauuaaagaacuggcuguuuaguguuucucuccccacaaaggccauggucaagcaguagucaacuaucuuuccagccuggcaucccagcacccaguauaauauuagagcucaauaacuaugucaaucaacggauaagcaaggacaucuuugaacaagccauuuuagaucuucugcccagagaacucuacauaaacguaggcuucaauuugguaugcauauuacuguuuacucgcacuucaucgaaaaauuuucgauacgcuuguuaacucucacgguacagauuagccuuucaacgucucagucaucauagccuuaccucuguaacaggaacuucuaaguuuuccuguguauuuuaugcuaaaaaccacagaaaguauaagcgaugucaggggcccuagucagcaaguggaaccuggcaaauacucuauuuuaauaacucccagaucaccaacccggcauacaaacuucccgaauguguuaagucuggggcucccauuuuugggggaaacgcggaagcgugacagcucuaacccggagauaaccugugguauaggagccuauucccuccagcugguucuuucuacugcuucugucaccccaauacuuccccguuacccuccacaugaaggcuccagggccucagcggccaaaccccuccaucauuuaccgaacagcguaaacccuuucgucucggaaaccguggccugcaagcuuaagaggucggucccugauucggucgaauccacuugggagacccuggagguaaugaaggcgagcacgaaggcaaggggcgcccgggccggaaaccgugcaaccccagauacccucuagacccgguccaucgcccccgcucgcagccugggccagggugccugcucaccuggguuaugcgcuugcgaaccugcgccaccuccuuuugaaacucgacaucuuccugcggauuaagcgacaggauuggcccagccgggccagaaaaagucgccaugccaaaagccgccgacgcuaaccacgcggcgcucccggaaacgucgggcucccagcucccccgaggcggaaguagag
